US009271455B2

(12) United States Patent
Wu et al.

(10) Patent No.: US 9,271,455 B2
(45) Date of Patent: Mar. 1, 2016

(54) SOYBEAN POLYMORPHISMS AND METHODS OF GENOTYPING

(75) Inventors: Kunsheng Wu, Ballwin, MO (US); John LeDeaux, Creve Coeur, MO (US); David Butruille, Des Moines, IA (US); Anju Gupta, Ankeny, IA (US); Richard Johnson, Urban, IL (US); Sam Eathington, Ames, IA (US); Jason Bull, Wildwood, MO (US); Marlin Edwards, Davis, CA (US); Paul McLaird, Lenexa, KS (US)

(73) Assignee: Monsanto Technology LLC, St. Louis, MO (US)

( * ) Notice: Subject to any disclaimer, the term of this patent is extended or adjusted under 35 U.S.C. 154(b) by 1276 days.

(21) Appl. No.: 12/601,461

(22) PCT Filed: May 29, 2008

(86) PCT No.: PCT/US2008/006765
§ 371 (c)(1),
(2), (4) Date: May 25, 2010

(87) PCT Pub. No.: WO2008/153804
PCT Pub. Date: Dec. 18, 2008

(65) Prior Publication Data
US 2010/0275286 A1   Oct. 28, 2010

Related U.S. Application Data

(60) Provisional application No. 60/932,533, filed on May 31, 2007.

(51) Int. Cl.
*A01H 1/04* (2006.01)
*A01H 1/02* (2006.01)
(52) U.S. Cl.
CPC ... *A01H 1/04* (2013.01); *A01H 1/02* (2013.01)
(58) Field of Classification Search
USPC .................................................. 800/267, 312
See application file for complete search history.

(56) References Cited

U.S. PATENT DOCUMENTS

| | | | |
|---|---|---|---|
| 5,210,015 A | 5/1993 | Gelfand et al. |
| 5,217,863 A | 6/1993 | Cotton et al. |
| 5,385,835 A | 1/1995 | Helentjaris et al. |
| 5,437,697 A | 8/1995 | Sebastian et al. |
| 5,468,613 A | 11/1995 | Erlich et al. |
| 5,492,547 A | 2/1996 | Johnson |
| 5,538,848 A | 7/1996 | Livak et al. |
| 5,595,890 A | 1/1997 | Newton et al. |
| 5,616,464 A | 4/1997 | Albagli et al. |
| 5,736,330 A | 4/1998 | Fulton |
| 5,746,023 A | 5/1998 | Hanafey et al. |
| 5,762,876 A | 6/1998 | Lincoln et al. |
| 5,858,659 A | 1/1999 | Sapolsky et al. |
| 5,876,930 A | 3/1999 | Livak et al. |
| 5,945,283 A | 8/1999 | Kwok et al. |
| 5,962,764 A | 10/1999 | Briggs et al. |
| 5,981,832 A | 11/1999 | Johnson |
| 6,004,744 A | 12/1999 | Goelet et al. |
| 6,013,431 A | 1/2000 | Soderlund et al. |
| 6,017,704 A | 1/2000 | Herman et al. |
| 6,030,787 A | 2/2000 | Livak et al. |
| 6,090,558 A | 7/2000 | Butler et al. |
| 6,100,030 A | 8/2000 | McCasky Feazel et al. |
| 6,294,336 B1 | 9/2001 | Boyce-Jacino et al. |
| 6,592,822 B1 | 7/2003 | Chandler |
| 6,599,331 B2 | 7/2003 | Chandler et al. |
| 6,649,414 B1 | 11/2003 | Chandler et al. |
| 6,691,109 B2 | 2/2004 | Bjornson et al. |
| 6,799,122 B2 | 9/2004 | Benson |
| 6,913,879 B1 | 7/2005 | Schena |
| 6,996,476 B2 | 2/2006 | Najarian |
| 2006/0141495 A1 | 6/2006 | Wu |
| 2006/0282911 A1 | 12/2006 | Bull et al. |
| 2006/0288444 A1 | 12/2006 | McCarroll et al. |

FOREIGN PATENT DOCUMENTS

| | | |
|---|---|---|
| EP | 1343911 | 5/2007 |
| WO | 2006122215 | 11/2006 |
| WO | 2008021413 | 2/2008 |

OTHER PUBLICATIONS

Smalley et al (Crop Science 44: 436-442, 2004).*
Meksem et al (Molecular Breeding 7: 63-71, 2001).*
Hall et al., "Using Association Mapping to Dissect the Genetic Basis of Complex Traits in Plants", Briefings in Function Genomics, 2010, pp. 157-165, vol. 9 No. 2.
Fernandez et al., "The Use of ISSR and RAPD Markers for Detecting DNA Polymorphism, Genotype Identification and Genetic Diversity Among Barley Cultivars with Known Origin", Theoretical and Applied Genetics, Apr. 2002, pp. 841-851, vol. 104 Issue 5.
Bi et al., "Single Nucleotide Polymorphisms and Insertion-Deletions for Genetic Markers and Anchoring the Maize Fingerprint Contig Physical Map", Crop Science, 2006, pp. 12-21, vol. 46.
Borevitz et al., "Large-Scale Identification of Single-Feature Polymorphisms in Complex Genomes", Genome Research, 2003, pp. 513-523, vol. 13.

(Continued)

*Primary Examiner* — Keith Robinson
(74) *Attorney, Agent, or Firm* — Thompson Coburn LLP; William A. Holtz

(57) ABSTRACT

Polymorphic soybean DNA loci useful for genotyping between at least two varieties of soybean. Sequences of the loci are useful for providing the basis for designing primers and probe oligonucleotides for detecting polymorphisms in soybean DNA. Polymorphisms are useful for genotyping applications in soybean. The polymorphic markers are useful to establish marker/trait associations, e.g. in linkage disequilibrium mapping and association studies, positional cloning and transgenic applications, marker-aided breeding and marker-assisted selection, hybrid prediction and identity by descent studies. The polymorphic markers are also useful in mapping libraries of DNA clones, e.g. for soybean QTLs and genes linked to polymorphisms.

6 Claims, 3 Drawing Sheets

(56) References Cited

OTHER PUBLICATIONS

Fan et al., "High-Resolution Association Mapping of Quantitative Trait Loci: A Population-Based Approach", Genetics, pp. 663-686, vol. 172, 2006.

Jansen et al., "Genotype-by-environment interaction in genetic mapping of multiple quantitative trait loci": Theoretical and Applied Genetics, 1995, pp. 33-37, vol. 91.

Jansen, Ritsert C., "Mapping of quantitative trait loci by using genetic markers: an overview of biometrical models used", Proceedings of the Ninth Meeting of the EUCARPIA Section Biometrics in Plant Breeding, Biometrics in Plant Breeding: Applications of Molecular Markers, 1994, pp. 116-124, The Netherlands.

Kruglyak et al., "A Nonparametric Approach for Mapping Quantitative Trait Loci", Genetics, 1995, pp. 1421-1428, vol. 139.

Wilson et al., "The Sequence of *Zea mays* bac clone CH201-108E11", Genbank Accession No. AC201832, Apr. 4, 2007.

Winlker et al., "On the Determination of Recombinant Rates in Intermated Recombinant Inbred Populations", Genetics, 2003, pp. 741-745, vol. 164.

Lyamichev et al., "Polymorphisms identification and quantitative detection of genomic DNA by invasive cleavage of oligonucleotide probes", Nature Biotechnology, 1999, pp. 292-296, vol. 17.

Mein et al., "Evaluation of Single Nucleotide Polymorphism Typing with Invader on PCR Amplicons and Its Automation", Genome Research, 2000, pp. 330-343, vol. 10.

Zeng, Zhao-Bang, "Precision Mapping of Quantitative Trait Loci", Genetics, 1994, pp. 1457-1468, vol. 136.

Olivier et al., "High-throughput genotyping of single nucleotide polymorphisms using new biplex invader technology", Nucleic Acids Research, 2002, vol. 30 No. 12 e53.

Utz et al., "Comparison of different approaches to interval mapping of quantitative trait loci", Proceedings of the Ninth Meeting of the EUCARPIA Section Biometrics in Plant Breeding, Biometrics in Plant Breeding: Applications of Molecular Markers, 1994, pp. 195-204, The Netherlands.

Arus et al., "Marker-Assisted Selection", Plant Breeding: Principles and Prospects, 1993, pp. 314-331, Chapman & Hall, London.

Lyamichev et al., "Invader Assay for SNP Genotyping", Methods in Molecular Biology: Single Nucleotide Polymorphisms Methods and Protocols, 2002, pp. 229-240, vol. 212, Humana Press.

Boerma et al., "Pollen Movement Within and Between Rows to Male-sterile Soybeans", Crop Science, 1975, pp. 858-861, vol. 15.

Cui et al., "Detecting single-feature polymorphisms using oligonucleotide arrays and robustified projection pursuit", Bioinformatics, 2005, pp. 3852-3858, vol. 21 No. 20.

Jansen et al., "Constructing dense genetic linkage maps", Theoretical and Applied Genetics, 2001, pp. 1113-1122, vol. 102.

Jansen et al., "High Resolution of Quantitative Traits Into Multiple Loci via Interval Mapping" Genetics, 1994, pp. 1447-1455, vol. 136.

Lander et al., "Mapping Mendelian Factors Underlying Quantitative Traits Using RFLP Linkage Maps", Genetics, 1989, pp. 185-199. Vol 121.

Stam, Piet, "Construction of integrated genetic linkage maps by means of a new computer package: JointMap", The Plant Journal, 1993, pp. 739-744, vol. 3 No. 5.

\* cited by examiner

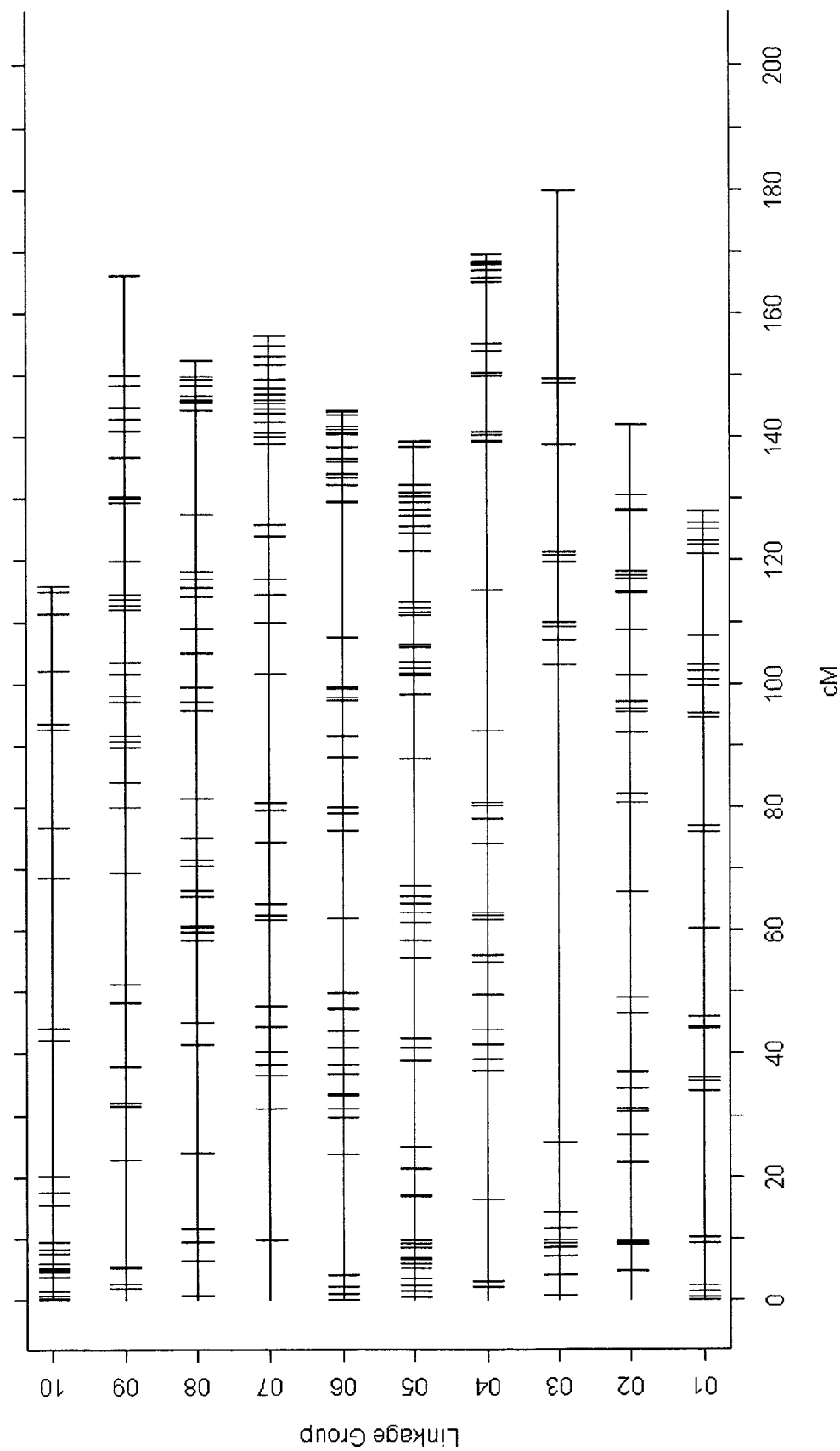

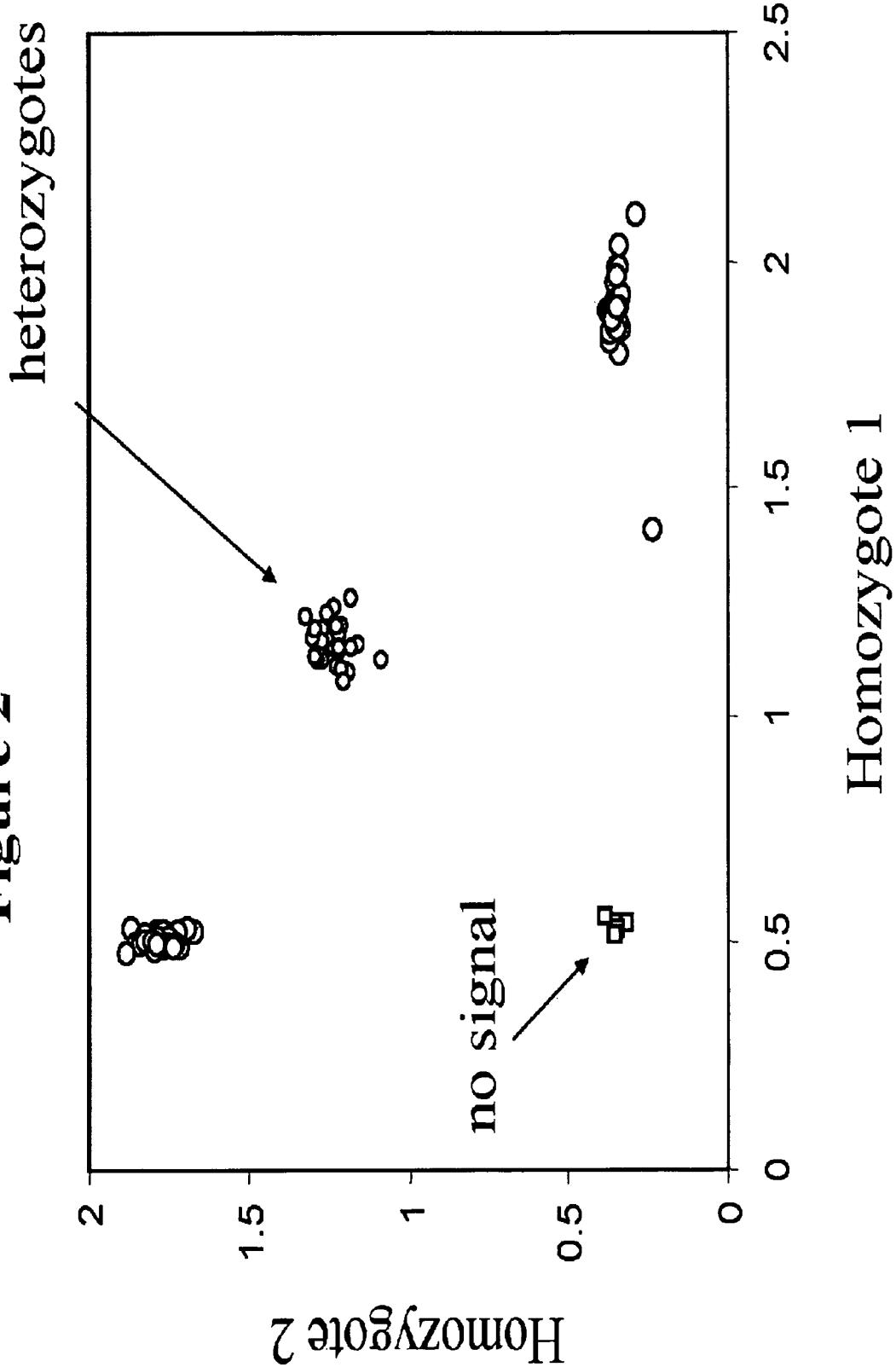

SOYBEAN POLYMORPHISMS AND METHODS OF GENOTYPING

CROSS-REFERENCE TO RELATED APPLICATIONS

This application is a National Stage application of International Patent Application No. PCT/US2008/006765, filed May 29, 2008 and incorporated by reference herein in its entirety, which claims the benefit of U.S. Patent Application No. 60/932,533, filed May 31, 2007 and incorporated by reference herein in its entirety.

STATEMENT REGARDING FEDERALLY SPONSORED RESEARCH OR DEVELOPMENT

Not Applicable.

INCORPORATION OF SEQUENCE LISTING AND TABLES

The sequence listing and a computer readable form (CRF) of the sequence listing are provided herein on CD-ROMs, each containing the file named "46-21(54825).SEQLIST-.txt", which is 7639719 bytes (measured in MS-Windows), all of which were created on May 29, 2007, are herein incorporated by reference. Two copies of Table 1 and Table 3 are also provided herein on CD-ROMs, containing the files named "Table 1" (Copy 1 and Copy 2), which is 14403168 bytes (measured in MS-Windows) and "Table 3" (Copy 1 and Copy 2), which is 82686 bytes (measured in MS-Windows), all of which were created on May 29, 2007, are herein incorporated by reference.

plants that contain a desired genotype at multiple loci, and that are expected to transfer the desired genotype, along with a desired phenotype to their progeny. Molecular marker alleles can be used to identify plants that contain the desired genotype at one marker locus, several loci, or a haplotype, and that would be expected to transfer the desired genotype, along with a desired phenotype to their progeny.

The highly conserved nature of DNA, combined with the rare occurrences of stable polymorphisms, provide molecular markers which can be both predictable and discerning of different genotypes. Among the classes of existing molecular markers are a variety of polymorphisms indicating genetic variation including restriction-fragment-length polymorphisms (RFLPs), amplified fragment-length polymorphisms (AFLPs), simple sequence repeats (SSRs), single feature polymorphisms (SFPs), single nucleotide polymorphisms (SNPs) and insertion/deletion polymorphisms (Indels).

Molecular markers vary in their stability and genomic abundance. SNPs are particularly useful as molecular markers because they are more stable than other polymorphisms and are abundant in plant genomes (Bi et al. Crop Sci. 46:12-21 (2006), Kornberg, DNA Replication, W.H. Freeman & Co., San Francisco (1980)). Because the number of molecular markers for a plant species is limited, the discovery of additional molecular markers is critical for genotyping applications including marker-trait association studies, gene mapping, gene discovery, marker-assisted selection and marker-assisted breeding. The discovery and identification of polymorphisms for use as molecular markers requires a substantial sequencing and bioinformatics effort, requiring large scale sequencing from two or more evolutionarily diverged lines or populations.

LENGTHY TABLES

The patent contains a lengthy table section. A copy of the table is available in electronic form from the USPTO web site (http://seqdata.uspto.gov/?pageRequest=docDetail&DocID=US09271455B2). An electronic copy of the table will also be available from the USPTO upon request and payment of the fee set forth in 37 CFR 1.19(b)(3).

BACKGROUND OF THE INVENTION

1. Field of the Invention

Disclosed herein are soybean polymorphisms, nucleic acid molecules related to such polymorphisms and methods of using such polymorphisms and molecules as molecular markers, e.g. in genotyping.

2. Related Art

Polymorphisms are useful as molecular markers, also termed genetic markers, for genotyping-related applications in the agriculture field, e.g. in plant genetic studies and commercial breeding. Such uses of polymorphisms are described in U.S. Pat. Nos. 5,385,835; 5,437,697; 5,385,835; 5,492,547; 5,746,023; 5,962,764; 5,981,832 and 6,100,030.

In particular, the use of molecular markers in breeding programs has accelerated the genetic accumulation of valuable traits into a germplasm compared to that achieved based on phenotypic data only. Herein, "germplasm" includes breeding germplasm, breeding populations, collection of elite inbred lines, populations of random mating individuals, and biparental crosses. Molecular marker alleles (an "allele" is an alternative sequence at a locus) are used to identify Evolving technologies make certain molecular markers more amenable for rapid, large scale use. In particular, technologies such as high-throughput screening for SNP detection indicate that SNPs may be preferred molecular markers.

SUMMARY OF THE INVENTION

It is in view of the above problems that the present invention was developed. This invention provides a series of molecular markers for soybean. These molecular markers comprise soybean DNA loci which have been discovered by direct sequence analysis of soybean genomic DNA. These molecular markers are useful for a variety of genotyping applications. A polymorphic soybean locus of this invention comprises at least 12 consecutive nucleotides which include or are adjacent to a polymorphism which is identified herein, e.g. in Table 1 or Table 3. As indicated in Table 1 the nucleic acid sequences of SEQ ID NO: 1 through SEQ ID NO: 7800 comprise one or more polymorphisms, e.g. single nucleotide polymorphisms (SNPs) and insertion/deletion polymorphisms (Indels). As indicated in Table 3, certain polymorphisms identified herein have also been mapped to certain soybean chromosomes.

The invention first provides for libraries of nucleic acid molecules that comprise at least two distinct sets of nucleic acid molecules wherein each of said distinct sets of nucleic acid molecules permits typing of a corresponding soybean genomic DNA polymorphism identified in Table 1 or Table 3. In certain embodiments of this aspect of the invention, the library comprises two or more distinct sets of nucleic acid molecules are arrayed on at least one solid support or on at least one microtiter plate. The distinct sets of nucleic acid molecules can be located in a separate and distinct well of a microtiter plate. The distinct sets of nucleic acids can also be located at a distinct interrogation position on the solid support.

Libraries where the nucleic acid molecules are combined in a single mixture are also contemplated. In still other embodiments of the invention, the libraries can comprise at least 8, at least 24, at least 96, or at least 384 distinct sets of nucleic acid molecules wherein each of the sets of nucleic acid molecules permit typing of a corresponding distinct soybean genomic DNA polymorphism identified in Table 1 or Table 3. Libraries comprised of sets of nucleic acid molecules that permit typing of soybean genomic DNA polymorphisms identified in Table 3 that are selected from the group consisting of SEQ ID NO: 3122, 2914, 3984, 3608, 1448, 69, 1261, 3436, 1142, 80, 88, 980, 538, 1925, 3669, 2270, 1397, 3747, 888, 365, 2132, 1972, 459, 762, and 1094 are also contemplated.

The distinct sets of nucleic acid molecules in the libraries can comprise a nucleic acid molecule of at least 12 consecutive nucleotides that include or are immediately adjacent to a corresponding polymorphism identified in Table 1 and wherein the sequence of at least 12 consecutive nucleotides is at least 90% identical to the sequence of the same number of nucleotides in either strand of a segment of soybean DNA which includes or is immediately adjacent to said polymorphism. In other embodiments, the nucleic acid molecule is of at least 15 consecutive nucleotides or of at least 18 consecutive nucleotides. The nucleic acid molecules can further comprise a detectable label or provide for incorporation of a detectable label. This detectable label can be selected from the group consisting of an isotope, a fluorophore, an oxidant, a reductant, a nucleotide and a hapten. Detectable labels can be added to the nucleic acid by a chemical reaction or incorporated by an enzymatic reaction.

The distinct sets of nucleic acid molecules can also comprise: (a) a pair of oligonucleotide primers wherein each of said oligonucleotide primers comprises at least 15 nucleotide bases and permit PCR amplification of a segment of DNA containing one of said corresponding polymorphisms identified in Table 1 or Table 3, and (b). at least one detector nucleic acid molecule that permits detection of a polymorphism in said amplified segment in (a). In such distinct sets of nucleic acids, the detector nucleic acid comprises at least 12 nucleotide bases or comprises at least 12 nucleotide bases and a detectable label, and wherein the sequence of said detector nucleic acid molecule is at least 95 percent identical to a sequence of the same number of consecutive nucleotides in either strand of a segment of soybean DNA in a locus of claim 1 comprising said polymorphism.

The invention also provides computer readable media having recorded thereon at least two soybean genomic DNA polymorphisms identified in Table 1 or Table 3. In other embodiments, at least 8 of the soybean genomic DNA polymorphisms identified in Table 1 or Table 3 are recorded on the computer readable media. Computer readable medium having recorded thereon at least two soybean genomic DNA polymorphisms identified in Table 3 and a corresponding genetic map position for each of said soybean genomic DNA polymorphisms are also provided. In other embodiments, at least 8 of the soybean genomic DNA polymorphisms and corresponding genetic map positions are recorded on the computer readable media.

The invention also provides a computer based system for reading, sorting or analyzing soybean genotypic data that comprises the following elements: (a) a data storage device comprising a computer readable medium wherein at least two soybean genomic DNA polymorphisms identified in Table 1 or Table 3 are recorded thereon; b) a search device for comparing a soybean genomic DNA sequence from at least one test soybean plant to said polymorphism sequences of the data storage device of step (a) to identify homologous or non-homologous sequences; and, (c) a retrieval device for identifying said homologous or non-homologous sequences(s) of said test soybean genomic sequences of step (b). In other embodiments, at least 96 soybean genomic DNA polymorphisms identified in Table 1 or Table 3 are recorded on the computer readable medium in the computer based system. In still other embodiments, the data storage device can further comprise computer readable medium wherein phenotypic trait data from at least one of said test soybean plants is recorded thereon. The data storage device can also further comprise computer readable medium wherein data associating an allelic state with a parent, progeny, or tester soybean plant is recorded thereon. Computer based systems wherein a plurality of mapped soybean genomic DNA polymorphisms identified in Table 3 are recorded on the computer readable medium and wherein the computer readable medium further comprises genetic map location data for each of said mapped polymorphisms are also contemplated.

Isolated nucleic acid molecules for detecting polymorphisms in soybean genomic DNA identified in Table 1 and Table 3 are also provided. Isolated nucleic acid molecules for detecting a molecular marker representing a polymorphism in soybean DNA identified in Table 1 or Table 3 that comprise at least 15 nucleotides that include or are immediately adjacent to the polymorphism and are at least 90 percent identical to a sequence of the same number of consecutive nucleotides in either strand of DNA that include or are immediately adjacent to said polymorphism are contemplated. Isolated nucleic acids of the invention can further comprise a detectable label or provides for incorporation of a detectable label. The detectable label can be selected from the group consisting of an isotope, a fluorophore, an oxidant, a reductant, a nucleotide and a hapten. The detectable label can be added to the nucleic acid by a chemical reaction or incorporated by an enzymatic reaction. The isolated nucleic acid can detect a polymorphism in Table 3 selected from the group consisting of SEQ ID NO: 3122, 2914, 3984, 3608, 1448, 69, 1261, 3436, 1142, 80, 88, 980, 538, 1925, 3669, 2270, 1397, 3747, 888, 365, 2132, 1972, 459, 762, and 1094.

Other isolated oligonucleotide compositions comprising more than one isolated nucleic acid that are useful for typing the soybean polymorphisms of Table 1 or Table 3. Such isolated oligonucleotide compositions can be used to type the SNP polymorphisms by either TAQMAN® assay or Flap Endonuclease-mediated (INVADER®) assays. In one embodiment the isolated nucleic acid composition is a set of oligonucleotides comprising: (a) a pair of oligonucleotide primers wherein each of said primers comprises at least 12 contiguous nucleotides and wherein said pair of primers permit PCR amplification of a DNA segment comprising a soybean genomic DNA polymorphism locus identified in Table 1 or Table 3; and (b) at least one detector oligonucleotide that permits detection of a polymorphism in said amplified segment, wherein the sequence of said detector oligonucleotide is at least 95 percent identical to a sequence of the same number of consecutive nucleotides in either strand of a segment of soybean DNA that include or are immediately adjacent to said polymorphism of step (a). In the set of oligonucleotides, the detector oligonucleotide comprises at least 12 nucleotides and either provides for incorporation of a detectable label or further comprises a detectable label. The detectable label can be selected from the group consisting of an isotope, a fluorophore, an oxidant, a reductant, a nucleotide and a hapten. Isolated polynucleotide compositions for typing the disclosed polymorphisms with Flap Endonuclease-mediated (INVADER®) assays are also provided. Such compositions for use in Flap Endonuclease-mediated assays comprise at least two isolated nucleic acid molecules for detecting a molecular marker representing a polymorphism in soybean DNA, wherein a first nucleic acid molecule of the composition comprises an oligonucleotide that includes the polymorphic nucleotide residue and at least 8 nucleotides that are immediately adjacent to a 3' end of said polymorphic nucleotide residue, wherein a second nucleic acid molecule of the composition comprises an oligonucleotide that includes the polymorphic nucleotide residue and at least 8 nucleotides that are immediately adjacent to a 5' end of said polymorphic nucleotide residue, and wherein the polymorphism is identified in Table 1 or Table 3.

Various methods for genotyping soybean plants to select a parent plant, a progeny plant or a tester plant for breeding are also provided. In one embodiment, the method of genotyping a soybean plant to select a parent plant, a progeny plant or a tester plant for breeding comprises the steps of: a. obtaining a DNA or RNA sample from a tissue of at least one soybean plant; b. determining an allelic state of at least one soybean genomic DNA polymorphism identified in Table 1 or Table 3 for said sample from step (a), and c. using said allelic state determination of step (b) to select a parent plant, a progeny plant or a tester plant for breeding. This method of genotyping can be performed to type a mapped polymorphism identified in Table 3. The allelic state of polymorphisms can be determined by an assay permitting identification of a single nucleotide polymorphism in this genotyping method. Single nucleotide polymorphism assays used in this method can be selected from the group consisting of single base extension (SBE), allele-specific primer extension sequencing (ASPE), DNA sequencing, RNA sequencing, microarray-based analyses, universal PCR, allele specific extension, hybridization, mass spectrometry, ligation, extension-ligation, and Flap Endonuclease-mediated assays. In certain embodiments of this method, an allelic state of at least 8, at least 48, at least 96, or at least 384 distinct polymorphisms identified in Table 1 or Table 3 are determined.

The methods of genotyping can also further comprising the step of storing resultant genotype data for said one or more allelic state determinations on a computer readable medium and/or further comprise the step of comparing genotype data from one soybean plant to another soybean plant. Genotype data can also be compared to phenotypic trait data or phenotypic trait index data for at least one of said soybean plants in certain embodiments of the methods that comprise those additional steps. Genotype data can also be compared to phenotypic trait data or phenotypic trait index data for at least two of said soybean plants and determining one or more associations between said genotype data and said phenotypic trait data in certain embodiments of the methods that comprise those additional steps. In still other embodiments of methods wherein associations are determined for said phenotype trait data or phenotypic trait index data to said genotypic trait data, the genotypic trait data comprises allelic state determinations for at least 10 mapped polymorphisms identified in Table 3.

Methods of breeding soybean plants are also contemplated. The methods of breeding soybean plants comprise the steps of: (a) identifying trait values for at least one trait associated with at least two haplotypes in at least two genomic windows of up to 10 centimorgans for a breeding population of at least two soybean plants; (b) breeding two soybean plants in said breeding population to produce a population of progeny seed; (c) identifying an allelic state of at least one polymorphism identified in Table 1 or Table 3 in each of said windows in said progeny seed to determine the presence of said haplotypes; and (d) selecting progeny seed having a higher trait value for at least one trait associated with the determined haplotypes in said progeny seed, thereby breeding a soybean plant. In certain embodiments of these breeding methods, trait values are identified for at least one trait associated with at least two haplotypes in each adjacent genomic window over essentially the entirety of each chromosome. The trait value can identify a trait selected from the group consisting of herbicide tolerance, disease resistance, insect or pest resistance, altered fatty acid, protein or carbohydrate metabolism, increased grain yield, increased oil, increased nutritional content, increased growth rates, enhanced stress tolerance, preferred maturity, enhanced organoleptic properties, altered morphological characteristics, other agronomic traits, traits for industrial uses, or traits for improved consumer appeal, or a combination of traits as a multiple trait index. In other embodiments of these breeding methods, progeny seed is selected for a higher trait value for yield for a haplotype in a genomic window of up to 10 centimorgans in each chromosome. In methods where the trait value is for the yield trait and trait values are ranked for haplotypes in each window; a progeny seed can be selected which has a trait value for yield in a window that is higher than the mean trait value for yield in said window. In still other embodiments of the method, the polymorphisms in the haplotypes are in a set of DNA sequences that comprises all of the DNA sequences of SEQ ID NO: 1 through SEQ ID NO: 7800.

Methods for selecting a parent, progeny, or tester plant for breeding are also provided. These methods for selecting a parent, progeny, or tester plant for plant breeding comprise the steps of: a) determining associations between a plurality of polymorphisms identified in Table 1 or Table 3 and a plurality of traits in at least a first and a second inbred line of soybean; b) determining an allelic state of one or a plurality of polymorphism in a parent, progeny or tester plant; c) selecting the parent, progeny or tester that has a more favorable combination of associated traits. In certain embodiments, the parent, progeny or tester plant is an inbred soybean line. A favorable combination of associated traits selected in the parent, progeny or tester can be a parent, progeny or tester that provides for improved heterosis.

Methods for improving heterosis are also provided. The methods for improving heterosis comprise the steps of: (a) determining associations between a plurality of polymorphisms identified in Table 1 or Table 3 and a plurality of traits in more than two inbred lines of soybean; (b) assigning two inbred lines selected from the inbred lines of step (a) to heterotic groups, (c) making at least one cross between at least two inbred lines from step (b), wherein each inbred line comes from a distinct and complementary heterotic group and wherein the complementary heterotic groups are optimized for genetic features that improve heterosis; and (d) obtaining a hybrid progeny plant from said cross in step (c), wherein said hybrid progeny plant displays increased heterosis relative to progeny derived from a cross with an unselected inbred line.

Methods of genotyping soybean to select a parent plant, a progeny plant or a tester plant for breeding wherein a plurality of distinct sets of nucleic acids are used to type a plurality of distinct polymorphisms that map to a plurality of genomic loci are also provided. These methods of genotyping a soybean plant to select a parent plant, a progeny plant or a tester plant for breeding comprise the steps of: (a) obtaining a DNA or RNA sample from a tissue of at least one soybean plant; (b) determining an allelic state of a set of soybean genomic DNA polymorphisms comprising at least two polymorphisms identified in Table 1 or Table 3 for said sample from step (a), wherein said allelic state is determined with a set of nucleic acid molecules that provide for typing of said soybean genomic DNA polymorphisms; and c. using said allelic state determination of step (b) to select a parent plant, a progeny plant or a tester plant for breeding. However, other embodiments of the method provide for determining the allelic state of at least 5, at least 10, or at least 20 polymorphisms identified in Table 1 or Table 3. The set of soybean genomic DNA polymorphisms can comprise at least 2 polymorphisms selected from the group consisting of SEQ ID NO: 3122, 2914, 3984, 3608, 1448, 69, 1261, 3436, 1142, 80, 88, 980, 538, 1925, 3669, 2270, 1397, 3747, 888, 365, 2132, 1972, 459, 762, and SEQ ID NO: 1094. The set of soybean genomic DNA polymorphisms can also comprise at least 2 polymorphisms selected from the group consisting of SEQ ID NO: 3122, 2914, 3984, 3608, 1448, 69, 1261, 3436, 1142, and 80. Alternatively, the soybean genomic DNA polymorphisms can also comprise at least 2 polymorphisms selected from the group consisting of SEQ ID NO: 3122, 2914, 3984, 3608, and 1448. In one embodiment, the set of soybean genomic polymorphisms comprise the polymorphisms SEQ ID NO: 3122 and SEQ ID NO: 2914. In this method, the set of soybean genomic DNA polymorphisms can be associated with a trait values identified for at least one of yield, lodging, maturity, plant height, drought tolerance and cold germination. Genotyping methods where the set of soybean genomic DNA polymorphisms are associated with a trait value for yield are particularly contemplated. In one embodiment, the polymorphisms associated with a trait value are selected from the group consisting of SEQ ID NO: 3122, 2914, 3984, 3608, 1448, 69, 1261, 3436, 1142, 80, 88, 980, 538, 1925, 3669, 2270, 1397, 3747, 888, 365, 2132, 1972, 459, 762, and SEQ ID NO: 1094. Polymorphisms selected from the group consisting of SEQ ID NO: 3122, 2914, 3984, 3608, 1448, 69, 1261, 3436, 1142, 80, 88, 980, 538, 1925, 3669, 2270, 1397, 3747, 888, 365, 2132, 1972, 459, 762, and SEQ ID NO: 1094 are associated with a trait value for yield.

Methods of genotyping soybean to select a parent plant, a progeny plant or a tester plant for breeding wherein a plurality of distinct sets of nucleic acids are used to type a plurality of distinct polymorphisms that map to a plurality of genomic loci distributed across the genome of soybean are also provided. In these methods, a set of at least 20 soybean genomic DNA polymorphisms identify polymorphisms that are distributed across the genome of soybean are typed. In certain embodiments of this method, the set of at least 20 soybean genomic DNA polymorphisms that are typed identify polymorphisms that are distributed across a single chromosome of soybean or are distributed across at least two chromosomes of soybean. In still other embodiments of this method, the set of at least 20 soybean genomic DNA polymorphisms identify polymorphisms that are distributed across all chromosomes of soybean. When the 20 soybean genomic DNA polymorphisms are distributed across all chromosomes of soybean, they can be distributed such that at least 1 of the polymorphisms in the set maps to each chromosome such that at least 1 of said polymorphisms in said set maps to each chromosome. However, this method can also employ more polymorphisms, such that at least 10 of the soybean genomic DNA polymorphisms in the set map to each chromosome. In other embodiments, at least 20 or at least 50 of the soybean genomic DNA polymorphisms in the set map to each chromosome. In certain embodiments of the methods, at least one polymorphism maps to chromosome 1 and can be selected from the group consisting of SEQ ID NO: 4093, 3168, 1993, 4808, 5176, 3705, 2968, 6401, 7154, 7741, 177, 4251, 584, 4672, 4078, 3248, 2471, 1728, 4140, 4169, 4258, 1466, 5899, 4203, 3624, 6068, 6303, 6309, 3363, 6057, 2579, 6431, 2744, 3018, 6670, 3133, 4591, 4656, 3127, 4306, 2161, 6021, 3623, 6504, 1612, 516, 4296, 2702, 4124, 1076, 967, 3885, 800, 2153, 5915, 7766, 6672, 5391, 2645, 382, 1550, 5564, 1763, 7566, 1722, 3327, 3724, 6359, 1499, 6680, 1147, 345, 1832, 608, 7548, 4553, 5482, 7055, 2157, 3270, 6896, 7347, 1502, 1765, 4173, 6150, 5085, 2607, 6686, 448, 2355, 2639, 4850, and 1897.

In other embodiments of the method, at least one polymorphism maps to chromosome 2 is selected from the group consisting of SEQ ID NO: 2484, 3849, 6346, 6230, 336, 2253, 4062, 5763, 6118, 1450, 4299, 4268, 7480, 7774, 3664, 261, 4018, 2265, 5833, 933, 7547, 1519, 3271, 4754, 7691, 1349, 5587, 6852, 6500, 7429, 4261, 3359, 6845, 1560, 4977, 1626, 4440, 2019, 2164, 690, 2491, 3242, 5314, 7053, 3747, 6728, 389, 3986, 1485, 1988, 5472, 6494, 4023, 221, 5566, 4602, 6519, 2042, 1181, 2514, 3199, 1462, 904, 7515, 329, 1377, 6130, and 2194.

In other embodiments of the method, at least one polymorphism maps to chromosome 3 is selected from the group consisting of SEQ ID NO: 2222, 1105, 4825, 1773, 5419, 3275, 3562, 4148, 6154, 3488, 3349, 7710, 3721, 4423, 1313, 3801, 3103, 4222, 2910, 2504, 3730, 3834, 6625, 355, 5025, 4164, 2260, 6368, 2022, 3567, 2957, 3362, 359, 6180, 2070, 5380, 917, 6320, 5213, 1186, 1616, 6539, 7191, 5055, 7378, 1269, 7380, 1986, 2274, 5838, 6098, 3758, 1280, 6022, 6977, 6783, 3060, 6560, 5330, 1630, 2966, 2166, 5858, 7297, 2650, 6467, 1075, and 6910.

In other embodiments of the method, at least one polymorphism maps to chromosome 4 is selected from the group consisting of SEQ ID NO: 5919, 631, 6047, 6592, 283, 6474, 4015, 1740, 3995, 3756, 5255, 2341, 2933, 292, 3984, 5538, 3157, 6439, 368, 1082, 7360, 2108, 2629, 362, 4489, 4980, 5522, 463, 163, 5923, 6020, 1995, 6388, 1151, 3463, 5658, 443, 5236, 2637, 3238, 1950, 2824, 3674, 5762, 3210, 7511, 2842, 2319, 4531, 2883, 2225, 4816, 892, 7386, 4509, 5846, 823, 3797, 3024, 3746, 7637, 4171, 4257, 2622, 6249, 950, 4156, 3339, 3717, 976, 1161, 5885, 1099, 1533, 1827, 4787, 360, and 4221.

In other embodiments of the method, at least one polymorphism maps to chromosome 5 is selected from the group consisting of SEQ ID NO: 5225, 5448, 6261, 1464, 753, 5766, 6067, 4519, 4809, 6745, 6451, 3594, 7734, 2884, 4032, 88, 5977, 1880, 4394, 517, 1611, 2963, 1582, 7292, 7181, 4255, 2659, 3217, 2736, 2638, 2437, 2912, 1197, 6684, 2810, 5175, 7009, 1623, 6510, 4346, 6239, 2320, 3905, 5458, 4072, 4318, 6367, 4001, 2079, 1319, 3691, 6632, 3315, 3391, 4117, 6191, 5002, 1223, 1261, 4146, 2417, 3963, 1090, 6295, 6793, 2878, 5198, 3512, 2407, 3533, 1448, 7152, 69, 3539, 5172, 5468, 5602, 3273, 3692, 6691, 6121, 2743, 4289, 4044, 1837, 486, 1465, 2050, 4125, 5105, 3481, 4281, 1257, 2307, 739, 5372, 1513, 4652, 7200, 1589, 2188, 1951, 2292, 6241, 6516, 4185, 202, 1748, 4580, 1183, 5642, 6955, 4986, 6848, 98, 2099, 7112, 3402, 3530, 5384, 3827, 1420, 311, 817, and 5169.

In other embodiments of the method, at least one polymorphism maps to chromosome 6 is selected from the group consisting of SEQ ID NO: 1920, 2270, 2334, 811, 3328, 5137, 1590, 1286, 1918, 5009, 5108, 4798, 2032, 2186, 2803, 5141, 2954, 805, 750, 1037, 7529, 1310, 5854, 771, 244, 2733, 5634, 6488, 4812, 5101, 7767, 7206, 7539, 6432, 4861, 3470, 3454, 3653, 6314, 1427, 4232, 4100, 4757, 278, 1969, 4604, 1813, 4436, 5239, 7454, 4998, 2325, 6203, 4077, 1829, 4069, 6655, 2657, 3593, 7455, 6, 10, 199, 6264, 4050, 6189, 7383, 2123, 5288, 5305, 89, 149, 6194, 4849, 1963, 3839, 5573, 1493, 824, 3645, 704, 1404, 980, 7371, 3709, 5459, 6413, 3784, 1309, 5882, 1379, 3547, 3903, 1646, 973, 2176, 2515, 2762, 900, 1027, 3872, 5916, 6311, 3180, 7535, 4696, 7492, 514, 4360, 860, 1917, 3392, and 3433.

In other embodiments of the method, at least one polymorphism maps to chromosome 7 is selected from the group consisting of SEQ ID NO: 7333, 7600, 481, 4994, 2982, 1106, 7136, 4949, 1998, 5755, 2429, 3471, 2155, 4852, 5661, 7516, 5406, 5539, 5266, 5320, 4418, 3619, 172, 4614, 780, 5951, 1410, 4348, 5572, 5708, 6304, 4215, 912, 6548, 1883, 469, 4202, 1996, 602, 5656, 144, 2221, 79, 7271, 6351, 3879, 504, 2731, 1191, 2377, 2333, 3040, 3023, 255, 1258, 2858, 5021, 4500, 2761, 5737, 7012, 2445, 873, 6300, 332, 2241, 1509, 592, 1571, 4076, 6360, 6398, 2569, 154, 5723, 3389, 161, 153, 398, 1558, 3056, 3714, 3775, 6023, 1542, 2741, 6746, 7785, 5509, 1312, 3941, 7247, 6148, 1625, 4210, 7192, 3929, 2886, and 4944.

In other embodiments of the method, at least one polymorphism maps to chromosome 8 is selected from the group consisting of SEQ ID NO: 3125, 4896, 5102, 2536, 1028, 1642, 5457, 2386, 5357, 4147, 6035, 2644, 3013, 6491, 4142, 5787, 1819, 7259, 4128, 612, 215, 6681, 2786, 6766, 6483, 5795, 2734, 4727, 115, 654, 1551, 1038, 1414, 2353, 2330, 47, 1816, 1231, 2915, 2143, 972, 2698, 4029, 4597, 1575, 5161, 2466, 3358, 2173, 5192, 832, 2354, 2008, 6639, 6110, 3410, 5729, 6995, 2214, 585, 7509, 1878, 4822, 1237, 3813, 3829, 5555, 3962, 840, 6215, 4705, 1884, 218, 809, 7033, 2282, 5929, 168, 6006, 429, 2509, 424, 7408, 3817, 3002, 3259, 7134, 1069, 6428, 2990, 7180, 3497, 5792, 1706, 6032, 3432, 3431, and 4823.

In other embodiments of the method, at least one polymorphism maps to chromosome 9 is selected from the group consisting of SEQ ID NO: 6190, 174, 2779, 5185, 5698, 6454, 2531, 50, 5080, 4964, 2739, 4668, 2588, 849, 7087, 3975, 3977, 6717, 7375, 2804, 4448, 2525, 1546, 1834, 6863, 4971, 1129, 6095, 6287, 5961, 6931, 6935, 3461, 2424, 2409, 1972, 2974, 1906, 553, 661, 792, 4842, 5817, 150, 4492, 2231, 2956, 4231, 2851, 4160, 1598, 3767, 6721, 6370, 7316, 3787, 3156, 1033, 2821, 6980, 3656, 3269, 4797, 6269, 4275, 7185, 6034, 4538, 7096, 3377, 3409, 1620, 487, 6615, 4941, 7419, 6685, 7504, 6281, 6734, 4847, 7127, 4663, 1520, 1905, 3129, 1296, 4014, 2312, 4935, 1239, 3151, 5149, 6908, 5431, 3161, and 6589.

In other embodiments of the method, at least one polymorphism maps to chromosome 10 is selected from the group consisting of SEQ ID NO: 2434, 2678, 920, 6861, 6464, 6950, 1786, 1567, 2899, 5920, 3251, 3049, 1112, 6008, 7346, 611, 3203, 1992, 6335, 587, 3093, 459, 909, 4437, 2506, 4920, 4786, 6518, 6927, 4751, 1138, 3263, 3311, 4226, 3719, 3865, 4948, 2894, 6174, 6659, 3371, 3089, 5513, 4646, 4381, 2055, 2217, 2939, 2717, 5744, 3262, 7681, 7411, 5215, 7761, 2713, 2061, 4298, 6244, 1149, 4046, 4701, 5243, 4784, 3140, 7173, 407, 4081, 6478, 509, 1389, 3590, 2508, 835, 7224, 1785, 1757, 3464, 6202, 6700, 4857, 3167, 5146, 7615, 7790, and 5439.

In other embodiments of the method, at least one polymorphism maps to chromosome 11 is selected from the group consisting of SEQ ID NO: 1531, 4150, 4186, 5997, 6107, 5692, 1032, 6449, 1432, 12, 600, 1067, 353, 5549, 3757, 2136, 7341, 5727, 3491, 55, 449, 6936, 5191, 538, 3372, 3694, 5665, 5754, 3755, 7295, 3572, 2237, 7794, 1624, 2800, 3876, 337, 7203, 4953, 300, 1326, 5480, 4024, 3898, 507, 3939, 6045, 5364, 4039, 3820, 53, 7315, 7340, 1172, 2530, 6395, 4821, 6009, 2843, 3037, 5297, 4562, 4096, 3828, 2533, 6658, and 7084.

In other embodiments of the method, at least one polymorphism maps to chromosome 12 is selected from the group consisting of SEQ ID NO: 4218, 4178, 4434, 5076, 1436, 216, 7176, 4295, 7085, 5299, 3663, 2121, 1329, 5659, 3420, 2057, 4011, 1085, 3255, 3062, 6668, 2559, 852, 3809, 135, 5694, 182, 4127, 2944, 6902, 206, 4287, 4569, 2610, 2699, 2685, 3738, 7293, 5709, 2697, 7155, 1351, 5531, 3733, 5663, 6001, 7470, 7486, 1196, 4405, 755, 5608, 7092, 2281, 2608, 6358, 6787, 6005, 70, 2680, 14, 5154, 5639, 4600, 7195, 6688, 3780, 3892, 4428, 6120, 5415, 322, 1820, and 326.

In other embodiments of the method, at least one polymorphism maps to chromosome 13 is selected from the group consisting of SEQ ID NO: 2647, 7207, 1605, 2888, 6147, 1956, 3979, 4715, 7262, 5461, 3524, 948, 6557, 5346, 6342, 5847, 73, 1268, 4278, 4385, 4259, 4968, 1898, 7731, 3710, 5434, 5508, 1944, 7448, 5031, 7614, 6568, 583, 7246, 762, 3390, 6069, 5142, 269, 1203, 1591, 1946, 1442, 126, 1925, 3696, 4198, 370, 1169, 1780, 5336, 1142, 2489, 5443, 5626, 7153, 1363, 1476, 3183, 893, 7526, 5826, 3920, 3114, 7321, 7339, 493, 1059, 4745, 5515, 6339, 3011, 4796, 6622, 4175, 4240, 2801, 267, 2565, 3522, 6169, 1079, 4802, 885, 910, 2970, 5745, 2980, 7472, 5491, 598, 2494, 5561, 6750, 6198, 7184, 86, 2695, 721, 773, 508, 7487, 879, 3030, 3408, 348, 7559, 1463, 991, 7253, 184, 2877, 72, 4315, 5033, 2327, 7304, 107, 3659, 2413, 6073, 3110, 7072, 4552, 5976, 4441, 6475, 2519, 3174, 4576, 6716, 3333, 5619, 6458, 123, 1396, and 4130.

In other embodiments of the method, at least one polymorphism maps to chromosome 14 is selected from the group consisting of SEQ ID NO: 2240, 2749, 1847, 2950, 5924, 6509, 1246, 4790, 5893, 5855, 4608, 2485, 5127, 1599, 4990, 2790, 4615, 6767, 7714, 7659, 543, 1267, 2560, 6858, 350, 3187, 3330, 6588, 1684, 395, 6081, 6809, 726, 297, 1071, 1749, 6730, 1811, 2724, 3435, 4993, 5074, 3436, 6792, 2297, 489, 4535, 3897, 3608, 908, 1835, 4249, 4685, 5895, 1855, 4, 8, 5059, 7105, 4269, 7556, 3101, 1525, 3367, 6143, 6084, and 5147.

In other embodiments of the method, at least one polymorphism maps to chromosome 15 is selected from the group consisting of SEQ ID NO: 868, 7416, 3126, 3298, 5695, 3227, 1182, 4568, 1697, 2703, 6786, 80, 7387, 4742, 3597, 6593, 6197, 6666, 1093, 2708, 3844, 7066, 3574, 944, 4560, 1730, 5743, 2020, 601, 3646, 5610, 795, 1566, 3919, 5666, 7049, 7690, 6421, 7349, 3355, 1431, 51, 2021, 3303, 3144, 1094, 5277, 3800, 120, 139, 2864, 6899, 4659, 6983, 7056, 2920, 201, 1087, 5056, 446, 6077, 4507, 4276, 712, 441, 2718, 4153, 2385, 3117, 7723, 5908, 3123, 3016, 4262, 1999, 2601, 2555, 1324, 5257, 6830, 3459, 4293, 4458, 6673, 4277, and 3184.

In other embodiments of the method, at least one polymorphism maps to chromosome 16 is selected from the group consisting of SEQ ID NO: 6550, 826, 1298, 2636, 7555, 7284, 7278, 2051, 2860, 723, 7324, 1205, 3200, 1581, 2403, 5094, 3039, 5261, 4426, 4703, 3906, 25, 4598, 1282, 5802, 6687, 1885, 4570, 3917, 3185, 4115, 5957, 6268, 250, 1225, 3393, 1644, 3846, 4380, 1708, 650, 1260, 3348, 3606, 5011, 7641, 5436, 4392, 5836, 7661, 452, 7015, 4522, 1498, 1473, 929, 4040, 6294, 2777, 2387, 1675, 1361, 3034, 1482, 3193, 7330, 3283, 7450, 1515, 5254, 4074, 3218, 622, 6055, 808, 916, 2367, 6489, 6591, 4245, 253, 7572, 2029, 5462, and 5421.

In other embodiments of the method, at least one polymorphism maps to chromosome 17 is selected from the group consisting of SEQ ID NO: 1394, 2246, 2662, 3716, 2458, 4814, 1863, 2289, 5952, 2905, 4952, 396, 7078, 4188, 5442, 4163, 4871, 317, 5321, 6094, 7656, 4831, 3, 5985, 3261, 273, 4005, 1511, 6172, 7394, 4463, 1158, 1354, 1769, 2118, 2191, 3076, 4880, 5015, 5881, 6391, 7400, 720, 1100, 915, 7051, 118, 4135, 7109, 2914, 2975, 3249, 3352, 1288, 1405, 5637, 7290, 5914, 7631, 3669, 2001, 3899, 1761, 5677, 5680, 992, 3806, 4158, 3540, 2675, 3122, 7301, 7303, 7797, 6959, 7343, 1359, 6165, 1018, 6562, 2881, 4303, 6537, 416, 5424, 249, 3864, 955, 2859, 1900, 6653, 841, 7129, 542, 2400, 5664, 4965, 638, 7327, and 3368.

In other embodiments of the method, at least one polymorphism maps to chromosome 18 is selected from the group consisting of SEQ ID NO: 2595, 2802, 3882, 1872, 7029, 1141, 7208, 6619, 6803, 7175, 7183, 3928, 5774, 5890, 7228, 6046, 2523, 3350, 2535, 7244, 3519, 7099, 259, 6981, 1561, 2052, 3163, 1226, 3228, 6541, 4667, 425, 6052, 5742, 2623, 7167, 1425, 3059, 888, 6301, 365, 502, 4355, 3991, 2958, 5167, 2299, 7131, 7613, 7257, 6748, 2856, 4384, 550, 1658, 4216, 7665, 3356, 6389, 4386, 414, 3149, 1572, 7361, 7279, 7296, 205, 3947, 162, 3508, and 734.

In other embodiments of the method, at least one polymorphism maps to chromosome 19 is selected from the group consisting of SEQ ID NO: 3545, 1664, 6958, 3499, 7622, 2562, 3361, 191, 2084, 1472, 1140, 5208, 3690, 7735, 6455, 3830, 7323, 848, 2890, 5913, 1413, 2953, 2017, 1335, 7226, 3722, 1887, 3398, 313, 1136, 7064, 7490, 4182, 4133, 1933, 3788, 1340, 2025, 4378, 3625, 2456, 3650, 1484, 7232, 4179, 4236, 5401, 7094, 7635, 6850, 7471, 6507, 6514, 4710, 4497, 1369, 4327, 2846, 5685, 197, 1146, 2189, 7017, 1378, 4792, 1047, 1397, 5939, 2291, 4151, 613, 488, 7080, 5481, 1017, 1529, 2012, 5832, 2132, 2976, 3910, 2538, 5416, 2380, 6138, 4872, 2065, 1628, 7157, 6481, 3299, 6242, and 4960.

In other embodiments of the method, at least one polymorphism maps to chromosome 20 is selected from the group consisting of SEQ ID NO: 3967, 845, 3229, 5398, 2348, 3671, 3592, 5747, 5987, 3742, 1164, 6754, 1364, 6380, 3785, 6667, 4242, 175, 1979, 116, 3950, 166, 3026, 3859, 3682, 1784, 3869, 1062, 3837, 499, 7023, 539, 6232, 192, 4057, 1922, 2371, 5361, 1219, 5786, 7190, 3208, 1544, 3321, 3306, 2104, 4490, 6026, 2149, 4730, 4746, 4105, 1991, 3058, 2895, 5331, 6581, 2651, 4954, 4273, 4045, 1297, 231, 1044, 1249, 1908, 1128, 2516, 6135, 3414, 6709, 6708, 1725, 7196, 3266, 1202, 1576, 6290, 7201, and 3665.

Further features and advantages of the present invention, as well as the structure and operation of various embodiments of the present invention, are described in detail below with reference to the accompanying drawings.

BRIEF DESCRIPTION OF THE DRAWINGS

The accompanying drawings, which are incorporated in and form a part of the specification, illustrate the embodiments of the present invention and together with the description, serve to explain the principles of the invention. In the drawings:

FIGS. 1A-1B are genetic maps of soybean showing the density of mapped polymorphisms of this invention.

FIG. 2 is an allelogram illustrating results of a genotyping assay.

DEFINITIONS

Figure 1B:
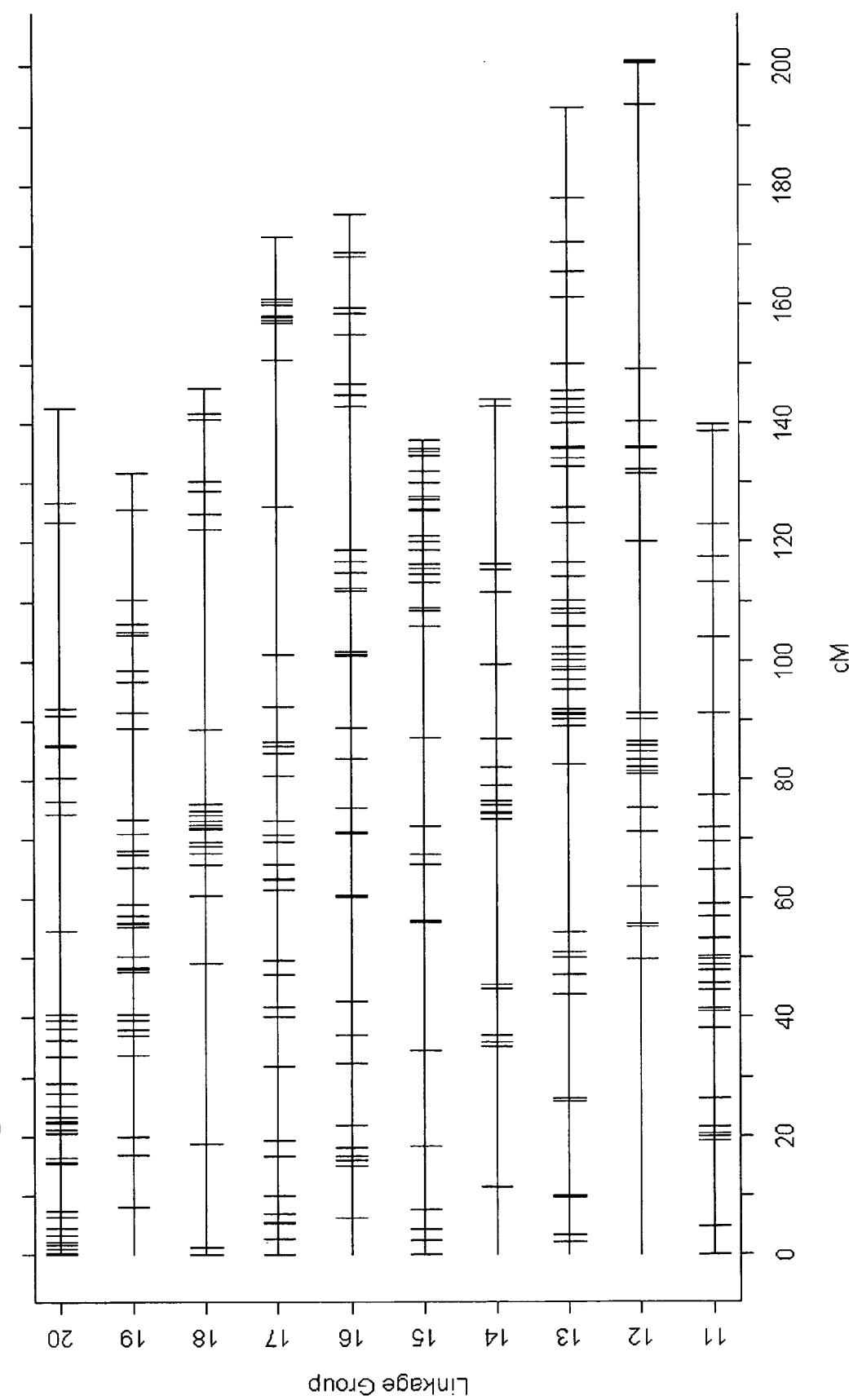

As used herein certain terms and phrases are defined as follows.

An "allele" refers to an alternative sequence at a particular locus; the length of an allele can be as small as 1 nucleotide base, but is typically larger. Allelic sequence can be amino acid sequence or nucleic acid sequence. A "locus" is a short sequence that is usually unique and usually found at one particular location in the genome by a point of reference; e.g., a short DNA sequence that is a gene, or part of a gene or intergenic region. A locus of this invention can be a unique PCR product at a particular location in the genome. The loci of this invention comprise one or more polymorphisms; i.e., alternative alleles present in some individuals.

An "allelic state" refers to the nucleic acid sequence that is present in a nucleic acid molecule that contains a genomic polymorphism. For example, the nucleic acid sequence of a DNA molecule that contains a single nucleotide polymorphism may comprise an A, C, G, or T residue at the polymorphic position such that the allelic state is defined by which residue is present at the polymorphic position. For example, the nucleic acid sequence of an RNA molecule that contains a single nucleotide polymorphism may comprise an A, C, G, or U residue at the polymorphic position such that the allelic state is defined by which residue is present at the polymorphic position. Similarly, the nucleic acid sequence of a nucleic acid molecule that contains an Indel may comprise an insertion or deletion of nucleic acid sequences at the polymorphic position such that the allelic state is defined by the presence or absence of the insertion or deletion at the polymorphic position.

An "association", when used in reference to a polymorphism and a phenotypic trait or trait index, refers to any statistically significant correlation between the presence of a given allele of a polymorphic locus and the phenotypic trait or trait index value, wherein the value may be qualitative or quantitative.

A "distinct set of nucleic acid molecules" refers to one or more nucleic acid molecules that hybridize to DNA sequences that are include, are immediately adjacent to, or are within about 1000 base pairs of either the 5' or 3' end of a given soybean genomic polymorphism. In certain embodiments, the distinct set of nucleic acid molecules will comprise a single nucleic acid sequence that includes or is immediately adjacent to a given polymorphism. In other embodiments, the distinct set of nucleic acid molecules will comprise one or more nucleic acid sequences that include or are immediately adjacent to the polymorphism as well as other nucleic acid sequences that are within about 1000 base pairs of either the 5' or 3' end of the polymorphism.

"Genotype" refers to the specification of an allelic composition at one or more loci within an individual organism. In the case of diploid organisms, there are two alleles at each locus; a diploid genotype is said to be homozygous when the alleles are the same, and heterozygous when the alleles are different.

"Haplotype" refers to an allelic segment of genomic DNA that tends to be inherited as a unit; such haplotypes can be characterized by one or more polymorphic molecular markers and can be defined by a size of not greater than 10 centimorgans. With higher precision provided by a higher density of polymorphisms, haplotypes can be characterized by genomic windows, for example, in the range of 1-5 centimorgans.

The phrase "immediately adjacent", when used to describe a nucleic acid molecule that hybridizes to DNA containing a polymorphism, refers to a nucleic acid that hybridizes to DNA sequences that directly abut the polymorphic nucleotide base position. For example, a nucleic acid molecule that can be used in a single base extension assay is "immediately adjacent" to the polymorphism.

"Interrogation position" refers to a physical position on a solid support that can be queried to obtain genotyping data for one or more predetermined genomic polymorphisms.

"Consensus sequence" refers to a constructed DNA sequence which identifies SNP and Indel polymorphisms in alleles at a locus. Consensus sequence can be based on either strand of DNA at the locus and states the nucleotide base of either one of each SNP in the locus and the nucleotide bases of all Indels in the locus. Thus, although a consensus sequence may not be a copy of an actual DNA sequence, a consensus sequence is useful for precisely designing primers and probes for actual polymorphisms in the locus.

"Phenotype" refers to the detectable characteristics of a cell or organism which are a manifestation of gene expression.

"Phenotypic trait index" refers to a composite value for at least two phenotypic traits, wherein each phenotypic trait may be assigned a weight to reflect relative importance for selection.

A "marker" or "molecular marker" as used herein is a DNA sequence (e.g. a gene or part of a gene) exhibiting polymorphism between two or more plants of the same species, which can be identified or typed by a simple assay. Useful polymorphisms include a single nucleotide polymorphisms (SNPs), insertions or deletions in DNA sequence (Indels), single feature polymorphisms (SFPs), and simple sequence repeats of DNA sequence (SSRs).

"Marker Assay" refers to a method for detecting a polymorphism at a particular locus using a particular method. Methods for detecting polymorphisms include, but are not limited to, restriction fragment length polymorphism (RFLP), single base extension, electrophoresis, sequence alignment, allelic specific oligonucleotide hybridization (ASO), RAPD, allele-specific primer extension sequencing (ASPE), DNA sequencing, RNA sequencing, microarray-based analyses, universal PCR, allele specific extension, hybridization, mass spectrometry, ligation, extension-ligation, endonuclease-mediated dye release assays and Flap Endonuclease-mediated assays. Exemplary single base extension assays are disclosed in U.S. Pat. No. 6,013,431. Exemplary endonuclease-mediated dye release assays for allelic state determination of SNPs where an endonuclease activity releases a reporter dye from a hybridization probe are disclosed in U.S. Pat. No. 5,538,848.

"Linkage" refers to relative frequency at which types of gametes are produced in a cross. For example, if locus A has genes "A" or "a" and locus B has genes "B" or "b" and a cross between parent I with AABB and parent B with aabb will produce four possible gametes where the genes are segregated into AB, Ab, aB and ab. The null expectation is that there will be independent equal segregation into each of the four possible genotypes, i.e. with no linkage ¼ of the gametes will of each genotype. Segregation of gametes into a genotypes differing from ¼ are attributed to linkage.

"Linkage disequilibrium" is defined in the context of the relative frequency of gamete types in a population of many individuals in a single generation. If the frequency of allele A is p, a is p', B is q and b is q', then the expected frequency (with no linkage disequilibrium) of genotype AB is pq, Ab is pq', aB is p' q and ab is p' q'. Any deviation from the expected frequency is called linkage disequilibrium. Two loci are said to be "genetically linked" when they are in linkage disequilibrium.

"Quantitative Trait Locus (QTL)" refers to a locus that controls to some degree traits that are usually continuously distributed and which can be represented quantitatively.

As used herein "sequence identity" refers to the extent to which two optimally aligned polynucleotide or peptide sequences are invariant throughout a window of alignment of components, e.g. nucleotides or amino acids. An "identity fraction" for aligned segments of a test sequence and a reference sequence is the number of identical components which are shared by the two aligned sequences divided by the total number of components in reference sequence segment, i.e. the entire reference sequence or a smaller defined part of the reference sequence. "Percent identity" is the identity fraction times 100.

As used herein, "typing" refers to any method whereby the specific allelic form of a given soybean genomic polymorphism is determined. For example, a single nucleotide polymorphism (SNP) is typed by determining which nucleotide is present (i.e. an A, G, T, or C). Insertion/deletions (Indels) are determined by determining if the Indel is present. Indels can be typed by a variety of assays including, but not limited to, marker assays.

DETAILED DESCRIPTION OF THE PREFERRED EMBODIMENTS

The following detailed description relates to the isolated nucleic acid compositions and related methods for genotyping soybean plants. In general, these compositions and methods can be used to genotype soybean plants from the genus *Glycine*. More specifically, soybean plants from the species *Glycine max* and the subspecies *Glycine max* L. ssp. *max* or *Glycine max* ssp. *formosana* can be genotyped using these compositions and methods. In an additional aspect, the soybean plant is from the species *Glycine soja*, otherwise known as wild soybean, can be genotyped using these compositions and methods. Alternatively, soybean germplasm derived from any of *Glycine max, Glycine max* L. ssp. *max, Glycine max* ssp. *Formosana*, and/or *Glycine soja* can be genotyped using compositions and methods provided herein.

Isolated Nucleic Acid Molecules—Loci, Primers and Probes

The soybean loci of this invention comprise a series of molecular markers which comprises at least 20 consecutive nucleotides and includes or is adjacent to one or more polymorphisms identified in Table 1 or Table 3. Such soybean loci have a nucleic acid sequence having at least 90% sequence identity, more preferably at least 95% or even more preferably for some alleles at least 98% and in many cases at least 99% sequence identity, to the sequence of the same number of nucleotides in either strand of a segment of soybean DNA which includes or is adjacent to the polymorphism. The nucleotide sequence of one strand of such a segment of soybean DNA may be found in a sequence in the group consisting of SEQ ID NO: 1 through SEQ ID NO: 7800. It is understood by the very nature of polymorphisms that for at least some alleles there will be no identity to the disclosed polymorphism, per se. Thus, sequence identity can be determined for sequence that is exclusive of the disclosed polymorphism sequence. In other words, it is anticipated that additional alleles for the polymorphisms disclosed herein may exist, can be easily characterized by sequencing methods, and can be used for genotyping. For example, one skilled in the art will appreciate that for a single nucleotide polymorphism where just two polymorphic residues are disclosed (e.g. an "A" or a "G") can also comprise other polymorphic residues (e.g. a "T" and/or a "G").

The polymorphisms in each locus are identified more particularly in Table 1 or Table 3. SNPs are particularly useful as genetic markers because they are more stable than other classes of polymorphisms and are abundant in the soybean genome. SNPs can result from insertions, deletions, and point mutations. In the present invention a SNP can represent a single indel event, which may consist of one or more base pairs, or a single nucleotide polymorphism. Polymorphisms shared by two or more individuals can result from the individuals descending from a common ancestor. This "Identity by descent" (IBD) characterizes two loci/segments of DNA that are carried by two or more individuals and were all derived from the same ancestor. "Identity by state" (IBS) characterizes two loci/segments of DNA that are carried by two or more individuals and have the same observable alleles at those loci. When a large set of crop lines is considered, and multiple lines have the same allele at a marker locus, it is necessary to ascertain whether IBS at the marker locus is a reliable predictor of IBD at the chromosomal region surrounding the marker locus. A good indication that a number of marker loci in a segment are enough to characterize IBD for the segment is that they can predict the allele present at other marker loci within the segment. The stability and abundance of SNPs in addition to the fact that they rarely arise independently makes them useful in determining IBD.

For many genotyping applications it is useful to employ as markers polymorphisms from more than one locus. Thus, one aspect of the invention provides a collection of nucleic acid molecules that permit typing of polymorphisms of different loci. The number of loci in such a collection can vary but will be a finite number, e.g. as few as 2 or 5 or 10 or 25 loci or more, for instance up to 40 or 75 or 100 or more loci.

Another aspect of the invention provides isolated nucleic acid molecules which are capable of hybridizing to the polymorphic soybean loci of this invention. In certain embodiments of the invention, e.g. which provide PCR primers, such molecules comprise at least 15 nucleotide bases. Molecules useful as primers can hybridize under high stringency conditions to a one of the strands of a segment of DNA in a polymorphic locus of this invention. Primers for amplifying DNA are provided in pairs, i.e. a forward primer and a reverse primer. One primer will be complementary to one strand of DNA in the locus and the other primer will be complementary to the other strand of DNA in the locus, i.e. the sequence of a primer is preferably at least 90%, more preferably at least 95%, identical to a sequence of the same number of nucleotides in one of the strands. It is understood that such primers can hybridize to sequence in the locus which is distant from the polymorphism, e.g. at least 5, 10, 20, 50, 100, 200, 500 or up to about 1000 nucleotide bases away from the polymorphism. Design of a primer of this invention will depend on factors well known in the art, e.g. avoidance or repetitive sequence.

Another aspect of the isolated nucleic acid molecules of this invention are hybridization probes for polymorphism assays. In one aspect of the invention such probes are oligonucleotides comprising at least 12 nucleotide bases and a detectable label. The purpose of such a molecule is to hybridize, e.g. under high stringency conditions, to one strand of DNA in a segment of nucleotide bases which includes or is adjacent to the polymorphism of interest in an amplified part of a polymorphic locus. Such oligonucleotides are preferably at least 90%, more preferably at least 95%, identical to the sequence of a segment of the same number of nucleotides in one strand of soybean DNA in a polymorphic locus. The detectable label can be a radioactive element or a dye. In preferred aspects of the invention, the hybridization probe further comprises a fluorescent label and a quencher, e.g. for use hybridization probe assays of the type known as TAQ-MAN® assays, available from AB Biosystems.

Isolated nucleic acid molecules of the present invention are capable of hybridizing to other nucleic acid molecules including, but not limited, to soybean genomic DNA, cloned soybean genomic DNA, and amplified soybean genomic DNA under certain conditions. As used herein, two nucleic acid molecules are said to be capable of hybridizing to one another if the two molecules are capable of forming an anti-parallel, double-stranded nucleic acid structure. A nucleic acid molecule is said to be the "complement" of another nucleic acid molecule if they exhibit "complete complementarity" i.e. each nucleotide in one sequence is complementary to its base pairing partner nucleotide in another sequence. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Nucleic acid molecules which hybridize to other nucleic acid molecules, e.g. at least under low stringency conditions are said to be "hybridizable cognates" of the other nucleic acid molecules. Conventional stringency conditions are described by Sambrook et al., Molecular Cloning, A Laboratory Manual, 2nd Ed., Cold Spring Harbor Press, Cold Spring Harbor, N.Y. (1989) and by Haymes et al., Nucleic Acid Hybridization, A Practical Approach, IRL Press, Washington, D.C. (1985), each of which is incorporated herein by reference. Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization, for example, 6.0× sodium chloride/sodium citrate (SSC) at about 45° C., followed by a wash of 2.0×SSC at 50° C., are known to those skilled in the art or can be found in Current Protocols in Molecular Biology, John Wiley & Sons, N.Y. (1989), 6.3.1-6.3.6, incorporated herein by reference. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid molecule of the present invention will specifically hybridize to one strand of a segment of soybean DNA having a nucleic acid sequence as set forth in SEQ ID NO: 1 through SEQ ID NO: 7800 under moderately stringent conditions, for example at about 2.0× SSC and about 65° C., more preferably under high stringency conditions such as 0.2×SSC and about 65° C.

For assays where the molecule is designed to hybridize adjacent to a polymorphism which is detected by single base extension, e.g. of a labeled dideoxynucleotide, such molecules can comprise at least 15, more preferably at least 16 or 17, nucleotide bases in a sequence which is at least 90 percent, preferably at least 95%, identical to a sequence of the same number of consecutive nucleotides in either strand of a segment of polymorphic soybean DNA. Oligonucleotides for single base extension assays are available from Orchid Biosystems.

Isolated nucleic acid molecules useful as hybridization probes for detecting a polymorphism in soybean DNA can be designed for a variety of assays. For assays, where the probe is intended to hybridize to a segment including the polymorphism, such molecules can comprise at least 12 nucleotide bases and a detectable label. The sequence of the nucleotide bases is preferably at least 90 percent, more preferably at least 95%, identical to a sequence of the same number of consecutive nucleotides in either strand of a segment of soybean DNA in a polymorphic locus of this invention. The detectable label is a dye at one end of the molecule. In preferred aspects the isolated nucleic acid molecule comprises a dye and dye quencher at the ends thereof. For SNP detection assays it is useful to provide such dye and dye quencher molecules in pairs, e.g. where each molecule has a distinct fluorescent dye at the 5' end and has identical nucleotide sequence except for a single nucleotide polymorphism. It is well known in the art how to design oligonucleotide PCR probe pairs for annealing to a target segment of DNA for the purpose of reporting, wherein the sequence of the target is known such as the polymorphic marker sequences provided in the present invention.

For assays where the isolated nucleic molecule is designed to hybridize adjacent to a polymorphism which is detected by single base extension, such molecules can comprise at least 15, more preferably at least 16 or 17, nucleotide bases in a sequence which is at least 90 percent, preferably at least 95%, identical to a sequence of the same number of consecutive nucleotides in either strand of a segment of polymorphic soybean DNA. In this case, the isolated nucleotide provides for incorporation of a detectable label. This detectable label can be an isotope, a fluorophore, an oxidant, a reductant, a nucleotide or a hapten.

For assays involving use of Flap endonucleases (i.e. INVADER® assays). In certain embodiments, the compositions would comprise at least two isolated nucleic acid molecules for detecting a molecular marker representing a polymorphism in soybean DNA, wherein a first nucleic acid molecule of the composition comprises an oligonucleotide that includes the polymorphic nucleotide residue and at least 8 nucleotides that are immediately adjacent to a 3' end of said polymorphic nucleotide residue, wherein a second nucleic acid molecule of the composition comprises an oligonucleotide that includes the polymorphic nucleotide residue and at least 8 nucleotides that are immediately adjacent to a 5' end of said polymorphic nucleotide residue, and wherein the polymorphism is identified in Table 1 or Table 3. In certain embodiments, isolated nucleic acid molecule compositions suitable for typing the polymorphisms of Table 1 or Table 3 with the Flap endonuclease would comprise at least one primary probe with a "universal" 5' Flap sequence, at least one secondary or "INVADER®" probe, and at least one "FRET" cassettes containing the labelled base and quencher base that contains sequences complementary to the "universal Flap sequence" that is released from the primary probe upon cleavage.

Identifying Polymorphisms

SNPs are the result of sequence variation and new polymorphisms can be detected by sequencing random genomic or cDNA molecules. In one aspect, polymorphisms in a genome can be determined by comparing cDNA sequence from different lines. While the detection of polymorphisms by comparing cDNA sequence is relatively convenient, evaluation of cDNA sequence allows no information about the position of introns in the corresponding genomic DNA. Moreover, polymorphisms in non-coding sequence cannot be identified from cDNA. This can be a disadvantage, e.g. when using cDNA-derived polymorphisms as markers for genotyping of genomic DNA. More efficient genotyping assays can be designed if the scope of polymorphisms includes those present in non-coding unique sequence.

Genomic DNA sequence is more useful than cDNA for identifying and detecting polymorphisms. Polymorphisms in a genome can be determined by comparing genomic DNA sequence from different lines. However, the genomic DNA of higher eukaryotes typically contain a large fraction of repetitive sequence and transposons. Genomic DNA can be more efficiently sequenced if the coding/unique fraction is enriched by subtracting or eliminating the repetitive sequence.

There are a number of strategies well known in the art that can be employed to enrich for coding/unique sequence. Examples of these include the use of enzymes which are sensitive to cytosine methylation, the use of the McrBC endonuclease to cleave repetitive sequence, and the printing of microarrays of genomic libraries which are then hybridized with repetitive sequence probes.

In a preferred embodiment, coding DNA is enriched by exploiting differences in methylation pattern; the DNA of higher eukaryotes tends to be very heavily methylated, however it is not uniformly methylated. In fact, repetitive sequence is much more highly methylated than coding sequence. See U.S. Pat. No. 6,017,704 for methods of mapping and assessment of DNA methylation patterns in CG islands. Briefly, some restriction endonucleases are sensitive to the presence of methylated cytosine residues in their recognition site. Such methylation sensitive restriction endonucleases may not cleave at their recognition site if the cytosine residue in either an overlapping 5'-CG-3' or an overlapping 5'-CNG-3' is methylated. In order to enrich for coding/unique sequence soybean libraries can be constructed from genomic DNA digested with Pst I (or other methylation sensitive enzymes), and size fractionated by agarose gel electrophoresis.

One method for reducing repetitive DNA comprises the construction of reduced representation libraries by separating repetitive sequence from fragments of genomic DNA of at least two varieties of a species, fractionating the separated genomic DNA fragments based on size of nucleotide sequence and comparing the sequence of fragments in a fraction to determine polymorphisms. More particularly, these methods of identifying polymorphisms in genomic DNA comprises digesting total genomic DNA from at least two variants of a eukaryotic species with a methylation sensitive endonuclease to provide a pool of digested DNA fragments. The average nucleotide length of fragments is smaller for DNA regions characterized by a lower percent of 5-methylated cytosine. Such fragments are separable, e.g. by gel electrophoresis, based on nucleotide length. A fraction of DNA with less than average nucleotide length is separated from the pool of digested DNA. Sequences of the DNA in a fraction are compared to identify polymorphisms. As compared to coding sequence, repetitive sequence is more likely to comprise 5-methylated cytosine, e.g. in -CG- and -CNG- sequence segments. In one embodiment of the method, genomic DNA from at least two different inbred varieties of a crop plant is digested with a with a methylation sensitive endonuclease selected from the group consisting of Aci I, Apa I, Age I, Bsr F I, BssH II, Eag I, Eae I, Hha I, HinP1 I, Hpa II, Msp I, MspM II, Nar I, Not I, Pst I, Pvu I, Sac II, Sma I, Stu I and Xho I to provide a pool of digested DNA which is physically separated, e.g. by gel electrophoresis. Comparable size fractions of DNA are obtained from digested DNA of each of said varieties. DNA molecules from the comparable fractions are inserted into vectors to construct reduced representation libraries of genomic DNA clones which are sequenced and compared to identify polymorphisms.

An alternative method for enriching coding region DNA sequence enrichment uses McrBC endonuclease restriction, which cleaves methylated cytosine-containing DNA. Reduced representation libraries can be constructed using genomic DNA fragments which are cleaved by physical shearing or digestion with any restriction enzyme.

A further method to enrich for coding/unique sequence consists of construction of reduced representation libraries (using methylation sensitive or non-methylation sensitive enzymes), printing microarrays of the library on nylon membrane, followed by hybridization with probes made from repetitive elements known to be present in the library. The repetitive sequence elements are identified, and the library is re-arrayed by picking only the negative clones. Such methods provide segments of reduced representation genomic DNA from a plant which has genomic DNA comprising regions of DNA with relatively higher levels of methylated cytosine and regions of DNA with relatively lower levels of methylated cytosine. The reduced representation segments of this invention comprise genomic DNA from a region of DNA with relatively lower levels of methylated cytosine and are provided in fractions characterized by nucleotide size of said segments, e.g. in the range of 500 to 3000 bp.

Typing Polymorphisms in Soybean Genomic DNA Samples

Polymorphisms in DNA sequences can be detected or typed by a variety of effective methods well known in the art including, but not limited to, those disclosed in U.S. Pat. Nos. 5,468,613 and 5,217,863; 5,210,015; 5,876,930; 6,030,787; 6,004,744; 6,013,431; 5,595,890; 5,762,876; 5,945,283; 5,468,613; 6,090,558; 5,800,944; and 5,616,464, all of which are incorporated herein by reference in their entireties. However, the compositions and methods of this invention can be used in conjunction with any polymorphism typing method to type polymorphisms in soybean genomic DNA samples. These soybean genomic DNA samples used include but are not limited to soybean genomic DNA isolated directly from a soybean plant, cloned soybean genomic DNA, or amplified soybean genomic DNA.

For instance, polymorphisms in DNA sequences can be detected by hybridization to allele-specific oligonucleotide (ASO) probes as disclosed in U.S. Pat. Nos. 5,468,613 and 5,217,863. U.S. Pat. No. 5,468,613 discloses allele specific oligonucleotide hybridizations where single or multiple nucleotide variations in nucleic acid sequence can be detected in nucleic acids by a process in which the sequence containing the nucleotide variation is amplified, spotted on a membrane and treated with a labeled sequence-specific oligonucleotide probe.

Target nucleic acid sequence can also be detected by probe ligation methods as disclosed in U.S. Pat. No. 5,800,944 where sequence of interest is amplified and hybridized to probes followed by ligation to detect a labeled part of the probe.

Microarrays can also be used for polymorphism detection, wherein oligonucleotide probe sets are assembled in an overlapping fashion to represent a single sequence such that a difference in the target sequence at one point would result in partial probe hybridization (Borevitz et al., Genome Res. 13:513-523 (2003); Cui et al., Bioinformatics 21:3852-3858 (2005). On any one microarray, it is expected there will be a plurality of target sequences, which may represent genes and/or noncoding regions wherein each target sequence is represented by a series of overlapping oligonucleotides, rather than by a single probe. This platform provides for high throughput screening a plurality of polymorphisms. A single-feature polymorphism (SFP) is a polymorphism detected by a single probe in an oligonucleotide array, wherein a feature is a probe in the array. Typing of target sequences by microarray-based methods is disclosed in U.S. Pat. Nos. 6,799,122; 6,913,879; and 6,996,476.

Target nucleic acid sequence can also be detected by probe linking methods as disclosed in U.S. Pat. No. 5,616,464 employing at least one pair of probes having sequences homologous to adjacent portions of the target nucleic acid sequence and having side chains which non-covalently bind to form a stem upon base pairing of said probes to said target nucleic acid sequence. At least one of the side chains has a photoactivatable group which can form a covalent cross-link with the other side chain member of the stem.

Other methods for detecting SNPs and Indels include single base extension (SBE) methods. Examples of SBE methods include, but are not limited to, those disclosed in U.S. Pat. Nos. 6,004,744; 6,013,431; 5,595,890; 5,762,876; and 5,945,283. SBE methods are based on extension of a nucleotide primer that is immediately adjacent to a polymorphism to incorporate a detectable nucleotide residue upon extension of the primer. In certain embodiments, the SBE method uses three synthetic oligonucleotides. Two of the oligonucleotides serve as PCR primers and are complementary to sequence of the locus of soybean genomic DNA which flanks a region containing the polymorphism to be assayed. Following amplification of the region of the soybean genome containing the polymorphism, the PCR product is mixed with the third oligonucleotide (called an extension primer) which is designed to hybridize to the amplified DNA immediately adjacent to the polymorphism in the presence of DNA polymerase and two differentially labeled dideoxynucleosidetriphosphates. If the polymorphism is present on the template, one of the labeled dideoxynucleosidetriphosphates can be added to the primer in a single base chain extension. The allele present is then inferred by determining which of the two differential labels was added to the extension primer. Homozygous samples will result in only one of the two labeled bases being incorporated and thus only one of the two labels will be detected. Heterozygous samples have both alleles present, and will thus direct incorporation of both labels (into different molecules of the extension primer) and thus both labels will be detected.

In a preferred method for detecting polymorphisms, SNPs and Indels can be detected by methods disclosed in U.S. Pat. Nos. 5,210,015; 5,876,930; and 6,030,787 in which an oligonucleotide probe having a 5' fluorescent reporter dye and a 3' quencher dye covalently linked to the 5' and 3' ends of the probe. When the probe is intact, the proximity of the reporter dye to the quencher dye results in the suppression of the reporter dye fluorescence, e.g. by Forster-type energy transfer. During PCR forward and reverse primers hybridize to a specific sequence of the target DNA flanking a polymorphism while the hybridization probe hybridizes to polymorphism-containing sequence within the amplified PCR product. In the subsequent PCR cycle DNA polymerase with 5'→3' exonuclease activity cleaves the probe and separates the reporter dye from the quencher dye resulting in increased fluorescence of the reporter.

A useful assay is available from AB Biosystems as the TAQMAN® assay which employs four synthetic oligonucleotides in a single reaction that concurrently amplifies the soybean genomic DNA, discriminates between the alleles present, and directly provides a signal for discrimination and detection. Two of the four oligonucleotides serve as PCR primers and generate a PCR product encompassing the polymorphism to be detected. Two others are allele-specific fluorescence-resonance-energy-transfer (FRET) probes. In the assay, two FRET probes bearing different fluorescent reporter dyes are used, where a unique dye is incorporated into an oligonucleotide that can anneal with high specificity to only one of the two alleles. Useful reporter dyes include, but are not limited to, 6-carboxy-4,7,2',T-tetrachlorofluorecein (TET), 2'-chloro-7'-phenyl-1,4-dichloro-6-carboxyfluorescein (VIC) and 6-carboxyfluorescein phosphoramidite (FAM). A useful quencher is 6-carboxy-N,N,N',N'-tetramethylrhodamine (TAMRA). Additionally, the 3'end of each FRET probe is chemically blocked so that it can not act as a PCR primer. Also present is a third fluorophore used as a passive reference, e.g., rhodamine X (ROX) to aid in later normalization of the relevant fluorescence values (correcting for volumetric errors in reaction assembly). Amplification of the genomic DNA is initiated. During each cycle of the PCR, the FRET probes anneal in an allele-specific manner to the template DNA molecules. Annealed (but not non-annealed) FRET probes are degraded by TAQ DNA polymerase as the enzyme encounters the 5' end of the annealed probe, thus releasing the fluorophore from proximity to its quencher. Following the PCR, the fluorescence of each of the two fluorescers, as well as that of the passive reference, is determined fluorometrically. The normalized intensity of fluorescence for each of the two dyes will be proportional to the amounts of each allele initially present in the sample, and thus the genotype of the sample can be inferred.

To design primers and probes for the assay the locus sequence is first masked to prevent design of any of the three primers to sites that match known soybean repetitive elements (e.g., transposons) or are of very low sequence complexity (di- or tri-nucleotide repeat sequences). Design of primers to such repetitive elements will result in assays of low specificity, through amplification of multiple loci or annealing of the FRET probes to multiple sites.

PCR primers are designed (a) to have a length in the size range of 15 to 25 bases and matching sequences in the polymorphic locus, (b) to have a calculated melting temperature in the range of 57 to 60° C., e.g. corresponding to an optimal PCR annealing temperature of 52 to 55° C., (c) to produce a product which includes the polymorphic site and typically has a length in the size range of 75 to 250 base pairs. However, PCR techniques that permit amplification of fragments of up to 1000 base pairs or more in length have also been disclosed in U.S. Pat. No. 6,410,277. The PCR primers are preferably located on the locus so that the polymorphic site is at least one base away from the 3' end of each PCR primer. However, it is understood that the PCR primers can be up to 1000 base pairs or more away from the polymorphism and still provide for amplification of a corresponding DNA fragment of 1000 base pairs or more that contains the polymorphism and can be used in typing assays. The PCR primers must not contain regions that are extensively self- or inter-complementary.

FRET probes are designed to span the sequence of the polymorphic site, preferably with the polymorphism located in the 3' most ⅔ of the oligonucleotide. In the preferred embodiment, the FRET probes will have incorporated at their 3' end a chemical moiety which, when the probe is annealed to the template DNA, binds to the minor groove of the DNA, thus enhancing the stability of the probe-template complex. The probes should have a length in the range of 12 to 17 bases, and with the 3'MGB, have a calculated melting temperature of 5 to 7° C. above that of the PCR primers. Probe design is disclosed in U.S. Pat. Nos. 5,538,848, 6,084,102, and 6,127,121.

Oligonucleotide probes for typing single nucleotide polymorphisms through use of Flap Endonuclease-mediated (IN-VADER®, Third Wave Technologies, Madison Wis.) assays are also contemplated. In these assays, a flap endonuclease (cleavase) cuts a triple-helix created by hybridization of two overlapping oligonucleotides to the sequence that is typed (Lyamichev et al., Nat. Biotechnol., 17: 292-296, 1999). The sequence that is typed can be either soybean genomic DNA, cloned soybean genomic DNA or amplified soybean genomic DNA. Cleavage of one of the oligonucleotides that hybridizes to the sequence to be typed releases a flap that in turn forms a triple helix with a "FRET Cassette" oligonucleotide, resulting in a secondary cleavage reaction that releases a fluorescence resonance energy transfer (FRET) label. Embodiments where a single allele of a polymorphism is typed using a single FRET label have been described (Mein C. A., et al. Genome Res., 10: 330-343, 2000). In other embodiments of this method, two alleles of a polymorphism can be simultaneously typed by using different FRET labels. (Lyamichev et al., Ibid). High-throughput Flap Endonuclease-mediated assays have also been described that are suitable for creating sets of nucleotides for typing multiple polymorphisms (Olivier, et al., Nucleic Acids Res. 30(12): e53, 2002).

Isolated nucleic acid molecule compositions suitable for typing the polymorphisms of Table 1 or Table 3 with the cleavase can comprise at least one primary probe with a "universal" 5' flap sequence, at least one secondary or "INVADER®" probe, and at least one "FRET" cassettes containing the labelled base and quencher base that contains sequences complementary to the "universal flap sequence" that is released from the primary probe upon cleavage. When the typed sequence is amplified soybean genomic DNA, flanking PCR primers similar to those described in the preceding paragraphs can also be used. The design of such probes requires only the provision of about 40 to 50 nucleotides on either side of the polymorphic base noted in Table 1 or Table 3. General aspects of designing probes for Flap endonuclease assays are described in "Single Nucleotide Polymorphisms" (Methods and Protocols) Volume 212, Chapter 16, V. Lyamichev and B. Neri pp. 229-240 Humana Press. 2002).

Use of Polymorphisms to Establish Marker/Trait Associations

The polymorphisms in the loci of this invention can be used in the identification of marker/trait associations which are inferred from statistical analysis of genotypes and phenotypes of the members of a population. These members may be individual organisms, e.g. soybean, families of closely related individuals, inbred lines, doubled haploids or other groups of closely related individuals. Such soybean groups are referred to as "lines", indicating line of descent. The population may be descended from a single cross between two individuals or two lines (e.g. a mapping population) or it may consist of individuals with many lines of descent. Each individual or line is characterized by a single or average trait phenotype and by the genotypes at one or more marker loci.

Several types of statistical analysis can be used to infer marker/trait association from the phenotype/genotype data, but a basic idea is to detect molecular markers, i.e. polymorphisms, for which alternative genotypes have significantly different average phenotypes. For example, if a given marker locus A has three alternative genotypes (AA, Aa and aa), and if those three classes of individuals have significantly different phenotypes, then one infers that locus A is associated with the trait. The significance of differences in phenotype may be tested by several types of standard statistical tests such as linear regression of molecular marker genotypes on phenotype or analysis of variance (ANOVA). Commercially available, statistical software packages commonly used to do this type of analysis include SAS Enterprise Miner (SAS Institute Inc., Cary, N.C.) and Splus (Insightful Corporation. Cambridge, Mass.). When many molecular markers are tested simultaneously, an adjustment such as Bonferonni correction is made in the level of significance required to declare an association.

For the purpose of QTL mapping, the markers included should be diagnostic of origin in order for inferences to be made about subsequent populations. Molecular markers based on SNPs are ideal for mapping because the likelihood that a particular SNP allele is derived from independent origins in the extant populations of a particular species is very low. As such, SNP molecular markers are useful for tracking and assisting introgression of QTLs, particularly in the case of haplotypes.

Often the goal of an association study is not simply to detect marker/trait associations, but to estimate the location of genes affecting the trait directly (i.e. QTLs) relative to the marker locations. In a simple approach to this goal, one makes a comparison among marker loci of the magnitude of difference among alternative genotypes or the level of significance of that difference. Trait genes are inferred to be located nearest the marker(s) that have the greatest associated genotypic difference. The genetic linkage of additional marker molecules can be established by a gene mapping model such as, without limitation, the flanking marker model reported by Lander et al. (Lander et al. 1989 Genetics, 121:185-199), and the interval mapping, based on maximum likelihood methods described therein, and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y.). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL). The LOD score essentially indicates how much more likely the data are to have arisen assuming the presence of a QTL versus in its absence. The LOD threshold value for avoiding a false positive with a given confidence, say 95%, depends on the number of markers and the length of the genome. Graphs indicating LOD thresholds are set forth in Lander et al. (1989), and further described by Arús and Moreno-González, *Plant Breeding*, Hayward, Bosemark, Romagosa (eds.) Chapman & Hall, London, pp. 314-331 (1993).

Additional models can be used. Many modifications and alternative approaches to interval mapping have been reported, including the use of non-parametric methods (Kruglyak et al. 1995 Genetics, 139:1421-1428). Multiple regression methods or models can be also used, in which the trait is regressed on a large number of markers (Jansen, *Biometrics in Plant Breed*, van Oijen, Jansen (eds.) Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994)). Procedures combining interval mapping with regression analysis, whereby the phenotype is regressed onto a single putative QTL at a given marker interval, and at the same time onto a number of markers that serve as 'cofactors,' have been reported by Jansen et al. (Jansen et al. 1994 Genetics, 136:1447-1455) and Zeng (Zeng 1994 Genetics 136:1457-1468). Generally, the use of cofactors reduces the bias and sampling error of the estimated QTL positions (Utz and Melchinger, *Biometrics in Plant Breeding*, van Oijen, Jansen (eds.) Proceedings of the Ninth Meeting of the Eucarpia Section Biometrics in Plant Breeding, The Netherlands, pp. 195-204 (1994), thereby improving the precision and efficiency of QTL mapping (Zeng 1994). These models can be extended to multi-environment experiments to analyze genotype-environment interactions (Jansen et al. 1995 Theor. Appl. Genet. 91:33-3).

An alternative to traditional QTL mapping involves achieving higher resolution by mapping haplotypes, versus individual markers (Fan et al. 2006 Genetics 172:663-686) as one of the limitations of traditional QTL mapping research has been the fact that inferences are restricted to the particular parents of the mapping population and the genes or gene combinations of these parental varieties. This approach tracks blocks of DNA known as haplotypes, as defined by polymorphic markers, which are assumed to be identical by descent in the mapping population. It has long been recognized that genes and genomic sequences may be identical by state (i.e., identical by independent origins) or identical by descent (i.e., through historical inheritance from a common progenitor) which has tremendous bearing on studies of linkage disequilibrium and, ultimately, mapping studies (Nordberg et al. 2002 Trends Gen.). Historically, genetic markers were not appropriate for distinguishing identical in state or by descent. However, newer classes of markers, such as SNPs (single nucleotide polymorphisms), are more diagnostic of origin. The likelihood that a particular SNP allele is derived from independent origins in the extant populations of a particular species is very low. Polymorphisms occurring in linked genes are randomly assorted at a slow, but predictable rate, described by the decay of linkage disequilibrium or, alternatively, the approach of linkage equilibrium. Consequences of this well-established scientific discovery are that long stretches of coding DNA, defined by a specific combination of polymorphisms, are very unique and extremely improbable of existing in duplication except through linkage disequilibrium, which is indicative of recent co-ancestry from a common progenitor. The probability that a particular genomic region, as defined by some combination of alleles, indicates absolute identity of the entire intervening genetic sequence is dependent on the number of linked polymorphisms in this genomic region, barring the occurrence of recent mutations in the interval. Herein, such genomic regions are referred to as haplotype windows. Each haplotype within that window is defined by specific combinations of alleles; the greater the number of alleles, the greater the number of potential haplotypes, and the greater the certainty that identity by state is a result of identity by descent at that region. During the development of new lines, ancestral haplotypes are maintained through the process and are typically thought of as 'linkage blocks' that are inherited as a unit through a pedigree. Further, if a specific haplotype has a known effect, or phenotype, it is possible to extrapolate its effect in other lines with the same haplotype, as determined using one or more diagnostic markers for that haplotype window.

This assumption results in a larger effective sample size, offering greater resolution of QTL. Methods for determining the statistical significance of a correlation between a phenotype and a genotype, in this case a haplotype, may be determined by any statistical test known in the art and with any accepted threshold of statistical significance being required. The application of particular methods and thresholds of significance are well with in the skill of the ordinary practitioner of the art.

Construction of Genetic Maps

In another aspect of the invention the polymorphism in the loci of the invention are mapped onto the soybean genome, e.g. as a genetic map of the soybean genome comprising map positions of two or more polymorphisms, as indicated in Table 1, more preferably as indicated in Table 3. Such a genetic map is illustrated in FIG. 1. The genetic map data can also be recorded on computer readable medium. Preferred embodiments of the invention provide genetic maps of polymorphisms at high densities, e.g. at least 150 or more, say at least 500 or 1000, polymorphisms across a map of the soybean genome. Especially useful genetic maps comprise polymorphisms at an average distance of not more than 10 centi-Morgans (cM) on a linkage group.

Linkage Disequilibrium Mapping and Association Studies

Another approach to determining trait gene location is to analyze marker/trait associations in a population within which individuals differ at both trait and marker loci. Certain marker alleles may be associated with certain trait locus alleles in this population due to population genetic process such as the unique origin of mutations, founder events, random drift and population structure. This association is referred to as linkage disequilibrium.

In plant breeding populations, linkage disequilibrium (LD) is the level of departure from random association between two or more loci in a population and LD often persists over large chromosomal segments. Although it is possible for one to be concerned with the individual effect of each gene in the segment, for a practical plant breeding purpose the emphasis is typically on the average impact the region has for the trait(s) of interest when present in a line, hybrid or variety. In linkage disequilibrium mapping, one compares the trait values of individuals with different genotypes at a marker locus. Typically, a significant trait difference indicates close proximity between marker locus and one or more trait loci. If the marker density is appropriately high and the linkage disequilibrium occurs only between very closely linked sites on a chromosome, the location of trait loci can be very precise.

Marker-Assisted Breeding and Marker-Assisted Selection

When a quantitative trait locus (QTL) has been localized in the vicinity of molecular markers, those markers can be used to select for improved values of the trait without the need for phenotypic analysis at each cycle of selection. In marker-assisted breeding and marker-assisted selection, associations between QTL and markers are established initially through genetic mapping analysis (as in A.1 or A.2). In the same process, one determines which molecular marker alleles are linked to favorable QTL alleles. Subsequently, marker alleles associated with favorable QTL alleles are selected in the population. This procedure will improve the value of the trait provided that there is sufficiently close linkage between markers and QTLs. The degree of linkage required depends upon the number of generations of selection because, at each generation, there is opportunity for breakdown of the association through recombination.

The associations between specific marker alleles and favorable QTL alleles also can be used to predict what types of progeny may segregate from a given cross. This prediction may allow selection of appropriate parents to generation populations from which new combinations of favorable QTL alleles are assembled to produce a new inbred line. For example, if line A has marker alleles previously known to be associated with favorable QTL alleles at loci 1, 20 and 31, while line B has marker alleles associated with favorable effects at loci 15, 27 and 29, then a new line could be developed by crossing A×B and selecting progeny that have favorable alleles at all 6 QTL.

Molecular markers are used to accelerate introgression of transgenes into new genetic backgrounds (i.e. into a diverse range of germplasm). Simple introgression involves crossing a transgenic line to an elite inbred line and then backcrossing the hybrid repeatedly to the elite (recurrent) parent, while selecting for maintenance of the transgene. Over multiple backcross generations, the genetic background of the original transgenic line is replaced gradually by the genetic background of the elite inbred through recombination and segregation. This process can be accelerated by selection on molecular marker alleles that derive from the recurrent parent.

Further, a fingerprint of an inbred line is the combination of alleles at a set of two or more marker loci. High density fingerprints can be used to establish and trace the identity of germplasm, which has utility in establishing a database of marker-trait associations to benefit an overall crop breeding program, as well as germplasm ownership protection.

Methods for Selecting Parent, Progeny, or Tester Plants for Plant Breeding

It is also contemplated that the polymorphism provided herein can be used to select a parent, progeny, or tester plants for plant breeding. The ability to select such plants from populations of plants that are otherwise phenotypically indistinguishable can accelerate plant breeding and reduce costs incurred by performing phenotypic trait analyses. The methods of selecting plants for breeding comprise the steps of a) determining associations between a plurality of polymorphisms identified in Table 1 or Table 3 and a plurality of traits in at least a first and a second inbred line of soybean; b) determining an allelic state of one or a plurality of polymorphism in a parent, progeny or tester plant; and c) selecting the parent, progeny or tester that has a more favorable combination of associated traits. In certain applications, the parent, progeny or tester plant selected by this method is an inbred soybean line. In other embodiments, the favorable combination of associated traits provides for improved heterosis.

In one embodiment, determining the genotype of at least two polymorphisms will assist in the selection of parents for use in breeding crosses. This determination confers an advantage to the breeder for the creation of crosses wherein at least two preferred genomic regions are targeted in order to generate progeny with the at least two preferred genomic regions. In another aspect, the determination of the genotype for at least two polymorphisms can provide the basis for selection decisions among progeny wherein those progeny comprising preferred genomic regions are advanced in a breeding program. In yet another aspect, tester lines, which are used to evaluate the combining ability of inbreds in hybrid combinations, can be chosen for inclusion in an inbred testing scheme based on the presence, or absence, of at least two genomic regions in order to ensure crosses are made between distinct germplasm pools, i.e., different heterotic groups.

Hybrid Prediction

Commercial soybean seed is produced by making hybrids between two elite inbred lines that belong to different "heterotic groups". These groups are sufficiently distinct genetically that hybrids between them show high levels of heterosis or hybrid vigor (i.e. increased performance relative to the parental lines). By analyzing the marker constitution of good hybrids, one can identify sets of alleles at different loci in both male and female lines that combine well to produce heterosis. Understanding these patterns, and knowing the marker constitution of different inbred lines, can allow prediction of the level of heterosis between different pairs of lines. These predictions can narrow down the possibilities of which line(s) of opposite heterotic group should be used to test the performance of a new inbred line.

This invention provides methods for improving heterosis in hybrid soybean. In such methods associations are developed between a plurality of polymorphisms which are linked to polymorphic loci of the invention and traits in more than two inbred lines of soybean. Two of such inbred lines having complementary heterotic groups which are predicted to improve heterosis are selected for breeding. The methods for improving heterosis comprise the steps of: (a) determining associations between a plurality of polymorphisms identified in Table 1 or Table 3 and a plurality of traits in more than two inbred lines of soybean; (b) assigning two inbred lines selected from the inbred lines of step (a) to heterotic groups, (c) making at least one cross between at least two inbred lines from step (b), wherein each inbred line comes from a distinct and complementary heterotic group and wherein the complementary heterotic groups are optimized for genetic features that improve heterosis; and (d) obtaining a hybrid progeny plant from said cross in step (c), wherein said hybrid progeny plant displays increased heterosis relative to progeny derived from a cross with an unselected inbred line. These methods can also comprise traditional single crosses (i.e., between a two inbred lines, ideally from different heterotic groups), three-way crosses (a single cross is followed by a cross to a third inbred line), and double crosses (also known as a four-way cross, this is crossing the progeny of two single crosses) in step (c). Crosses can be effected by making manual crosses between selected male-fertile parents or by using male sterility systems. Development and selection of elite inbred lines, the crossing of these lines and selection of superior hybrid crosses to identify new elite soybean hybrids is described in Bernardo, Breeding for Quantitative Traits in Plants, Stemma Press, Woodbury, Minn., 2002.

Identity by Descent

One theory of heterosis predicts that regions of identity by descent (IBD) between the male and female lines used to produce a hybrid will reduce hybrid performance. Identity by descent can be inferred from patterns of marker alleles in different lines. An identical string of markers at a series of adjacent loci may be considered identical by descent if it is unlikely to occur independently by chance. Analysis of marker fingerprints in male and female lines can identify regions of IBD. Knowledge of these regions can inform the choice of hybrid parents, since avoiding IBD in hybrids is likely to improve performance. This knowledge may also inform breeding programs in that crosses could be designed to produce pairs of inbred lines (one male and one female) that show little or no IBD.

Libraries of Nucleic Acid Molecules for Use in Genotyping

Libraries of nucleic acids provided by this invention can be used in activities related to soybean germplasm improvement, including but not limited to using the plant for making breeding crosses, further genetic or phenotypic testing of the plant, advancement of the plant through self fertilization, use of the plant or parts thereof for transformation, and use of the plant or parts thereof for mutagenesis. The distinct sets of nucleic acids in the libraries can be sampled, accessed, or individually queried for any set or subset or combination thereof to type any of the soybean genomic DNA provided herein in Tables 1 or 3. In general, the libraries comprising at least two distinct sets of nucleic acid molecules wherein each of said distinct sets of nucleic acid molecules permits typing of a corresponding soybean genomic DNA polymorphism identified in Table 1 or Table 3.

In one embodiment, the distinct sets of nucleic acid molecules that permits typing of a corresponding soybean genomic DNA polymorphism identified in Table 1 or Table 3 are distributed in individual wells of a microtiter plate. In certain embodiments, each well of the microtiter plate will contain one or more nucleic acid molecules that permit typing of just one soybean polymorphism identified in Table 1 or Table 3. However, other embodiments where each well of the microtiter plate contains one or more nucleic acid molecules that permit typing of more than one soybean polymorphism identified in Table 1 or Table 3 are also contemplated. The microtiter plates can have as few as 8 wells, or as many as 24, 96, 384, 1536 or 3456 wells. The microtiter plates can be constructed from materials including, but not limited to, polystyrene, polypropylene, or cyclo-olefin plastics. The nucleic acid molecules in each well can be either in solution or in a dry (i.e. lyophilized form). In general, the nucleic acids will be distributed to the wells of the microtiter plate such that the nucleic acids in each well of the microtiter plate are known. However, in other embodiments where the nucleic cid molecules are associated with a unique identifier (such as a unique dye or other unique identifying label), the nucleic acids can be randomly distributed into the wells of the microtiter plate. As is clear from this description, libraries comprising nucleic acids immobilized on solid supports (such as beads) that are distributed in wells of microtiter plates are also contemplated.

In other embodiments, the nucleic acids that permit typing of a soybean genomic polymorphism identified in Table 1 or Table 3 are immobilized (i.e. covalently linked) to a solid support. Solid supports include, but are not limited to, beads, chips, arrays, or filters.

The beads used as a solid support can be magnetic beads to facilitate purification of hybridization complexes. Alternatively, the beads can contain a unique identifying label. In particular, beads dyed with fluorochromes that can be distinguished by their spectrophotometric or fluorometric properties can be coupled to the nucleic acid molecules for typing polymorphisms. Such bead based systems for typing polymorphisms have been described (U.S. Pat. No. 5,736,330). Dye labelled beads, analysis reagents and apparati for typing polymorphisms have also been described (U.S. Pat. Nos. 6,649,414, 6,599,331, and 6,592,822) and are available from Luminex Corporation (Austin, Tex., USA). As noted above, the bead-linked nucleic acid molecules of the library can also be.

The chips, arrays, or filters can also be used to immobilize the nucleic acid molecules for typing of the polymorphisms of Tables 1 or Table 3. In certain embodiments, the nucleic acid markers for typing a given polymorphism will be immobilized at a defined physical location on the array such that typing data from that location that corresponds to a given polymorphism can be generated and recorded for subsequent analysis. Methods of making and using arrays for typing of polymorphisms include, but are not limited to, those described in U.S. Pat. No. 5,858,659 (for hybridization based methods) and U.S. Pat. No. 6,294,336 (for single base extension methods).

Use of Polymorphism Assays for Mapping a Library of DNA clones

The polymorphisms and loci represented by the molecular markers of this invention are useful for identifying and mapping DNA sequence of QTLs and genes linked to the molecular markers. For instance, BAC or YAC clone libraries can be queried using molecular markers linked to a trait to find a clone containing specific QTLs and genes associated with the trait. For instance, QTLs and genes in a plurality, e.g. hundreds or thousands, of large, multi-gene sequences can be identified by hybridization with an oligonucleotide probe which hybridizes to a mapped and/or linked molecular marker, wherein one or more molecular markers can be assayed. Such hybridization screening can be improved by providing clone sequence in a high density array. The screening method is more preferably enhanced by employing a pooling strategy to significantly reduce the number of hybridizations required to identify a clone containing the molecular marker. When the molecular markers are mapped, the screening effectively maps the clones.

For instance, in a case where thousands of clones are arranged in a defined array, e.g. in 96 well plates, the plates can be arbitrarily arranged in three-dimensionally, arrayed stacks of wells each comprising a unique DNA clone. The wells in each stack can be represented as discrete elements in a three dimensional array of rows, columns and plates. In one aspect of the invention the number of stacks and plates in a stack are about equal to minimize the number of assays. The stacks of plates allow the construction of pools of cloned DNA.

For a three-dimensionally arrayed stack pools of cloned DNA can be created for (a) all of the elements in each row, (b) all of the elements of each column, and (c) all of the elements of each plate. Hybridization screening of the pools with an oligonucleotide probe which hybridizes to a molecular marker unique to one of the clones will provide a positive indication for one column pool, one row pool and one plate pool, thereby indicating the well element containing the target clone.

In the case of multiple stacks, additional pools of all of the clone DNA in each stack allows indication of the stack having the row-column-plate coordinates of the target clone. For instance, a 4608 clone set can be disposed in 48 96-well plates. The 48 plates can be arranged in 8 sets of 6 plate stacks providing 6×12×8 three-dimensional arrays of elements, i.e. each stack comprises 6 stacks of 8 rows and 12 columns. For the entire clone set there are 36 pools, i.e. 6 stack pools, 8 row pools, 12 column pools and 8 stack pools. Thus, a maximum of 36 hybridization reactions is required to find the clone harboring QTLs or genes associated or linked to each mapped molecular marker.

Once a clone is identified, oligonucleotide primers designed from the locus of the molecular marker can be used for positional cloning of the linked QTL and/or genes.

Computer Readable Media and Databases

The sequences of nucleic acid molecules of this invention can be "provided" in a variety of mediums to facilitate use, e.g. a database or computer readable medium, which can also contain descriptive annotations in a form that allows a skilled artisan to examine or query the sequences and obtain useful information. In one embodiment of the invention computer readable media may be prepared that comprise nucleic acid sequences where at least 10% or more, e.g. at least 25%, or even at least 50% or more of the sequences of the loci and nucleic acid molecules representing the molecular markers of this invention. For instance, such database or computer readable medium may comprise sets of the loci of this invention or sets of primers and probes useful for assaying the molecular markers of this invention. In addition such database or computer readable medium may comprise a figure or table of the mapped or unmapped molecular markers or this invention and genetic maps.

As used herein "database" refers to any representation of retrievable collected data including computer files such as text files, database files, spreadsheet files and image files, printed tabulations and graphical representations and combinations of digital and image data collections. In a preferred aspect of the invention, "database" refers to a memory system that can store computer searchable information. Currently, preferred database applications include those provided by DB2, Sybase and Oracle.

As used herein, "computer readable media" refers to any medium that can be read and accessed directly by a computer. Such media include, but are not limited to: magnetic storage media, such as floppy discs, hard disc, storage medium and magnetic tape; optical storage media such as CD-ROM; electrical storage media such as RAM, DRAM, SRAM, SDRAM, ROM, and PROMs (EPROM, EEPROM, Flash EPROM), and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to the result of a process for storing information in a retrievable database or computer readable medium. For instance, a skilled artisan can readily adopt any of the presently known methods for recording information on computer readable medium to generate media comprising the mapped polymorphisms and other nucleotide sequence information of the present invention. A variety of data storage structures are available to a skilled artisan for creating a computer readable medium where the choice of the data storage structure will generally be based on the means chosen to access the stored information. In addition, a variety of data processor programs and formats can be used to store the polymorphisms and nucleotide sequence information of the present invention on computer readable medium.

Computer software is publicly available which allows a skilled artisan to access sequence information provided in a computer readable medium. The examples which follow demonstrate how software which implements a search algorithm such as the BLAST algorithm (Altschul et al., J. Mol. Biol. 215:403-410 (1990), incorporated herein by reference) and the BLAZE algorithm (Brutlag et al., Comp. Chem. 17:203-207 (1993), incorporated herein by reference) on a Sybase system can be used to identify DNA sequence which is homologous to the sequence of loci of this invention with a high level of identity. Sequence of high identity can be compared to find polymorphic markers useful with soybean varieties.

The present invention further provides systems, particularly computer-based systems, which contain the sequence information described herein. Such systems are designed to identify commercially important sequence segments of the nucleic acid molecules of this invention. As used herein, "a computer-based system" refers to the hardware, software and memory used to analyze the nucleotide sequence information. A skilled artisan can readily appreciate that any one of the currently available computer-based system are suitable for use in the present invention.

As indicated above, the computer-based systems of the present invention comprise a database having stored therein polymorphic markers, genetic maps, and/or the sequence of nucleic acid molecules of the present invention and the necessary hardware and software for supporting and implementing genotyping applications. Such computer-based systems can be used to read, sort or analyze soybean genotypic data. Key components of the computer-based system include: a) a data storage device comprising a computer readable medium wherein at least two soybean genomic DNA polymorphisms identified in Table 1 or Table 3 are recorded thereon; b) a search device for comparing a soybean genomic DNA sequence from at least one test soybean plant to the polymorphism sequences of the data storage device of step (a) to identify homologous or non-homologous sequences; and, c) a retrieval device for identifying the homologous or non-homologous sequences(s) of the test soybean genomic sequences of step (b). Computer based methods and systems (e.g. apparati) for conducting DNA database queries are described in U.S. Pat. No. 6,691,109

In a useful aspect of the invention a data set of polymorphic soybean loci from Table 1 or Table 3 is recorded on a computer readable medium. In one aspect of the invention the soybean genomic polymorphisms are provided in one or more data sets of DNA sequences, i.e. data sets comprising up to a finite number of distinct sequences of polymorphic loci that are recorded on the computer readable media. The finite number of polymorphic loci in a recorded data set can be as few as 2 or up to 1000 or more, e.g. 5, 8, 10, 25, 40, 75, 96, 100, 384 or 500 of the soybean genomic polymorphisms of Table 1 or Table 3. Such data sets are useful for genotyping applications where 1) multiple polymorphisms that identify polymorphisms that are distributed across the genome of soybean are queried; 2) multiple polymorphisms that cluster within an interval are queried; and/or when multiple polymorphisms are queried in large numbers of plants. The data sets recorded on the computer readable media can also comprise corresponding genetic map positions for each of the soybean genomic DNA polymorphisms recorded thereon. In other embodiments, phenotypic trait or phenotypic trait index data is recorded on the computer readable media. In still other embodiments, data associating an allelic state with a parent, progeny, or tester soybean plant is recorded on the computer readable media.

Methods of Breeding

Methods of breeding soybean plants are also contemplated. The methods of breeding soybean plants comprise the steps of: (a) identifying trait values for at least two haplotypes in at least two genomic windows of up to 10 centimorgans for a breeding population of at least two soybean plants; (b) breeding two soybean plants in said breeding population to produce a population of progeny seed; (c) identifying an allelic state of at least one polymorphism identified in Table 1 or Table 3 in each of said windows in said progeny seed to determine the presence of said haplotypes; and (d) selecting progeny seed having a higher trait values identified for determined haplotypes in said progeny seed, thereby breeding a soybean plant. In certain embodiments of these breeding methods, trait values are identified for at least two haplotypes in each adjacent genomic window over essentially the entirety of each chromosome. It is understood that haplotype regions are chromosome segments that persist over multiple generations of breeding and are carried by one or more breeding lines. These segments can be identified with multiple linked marker loci contained in the segments, and the common haplotype identity at these loci in two lines gives a high degree of confidence of the identity by descent of the entire subjacent chromosome segment carried by these lines. Such breeding methods require the use of multiple soybean genomic polymorphisms that are distributed across the soybean genome.

In aspects of this breeding method, trait values are identified for at least two haplotypes in each adjacent genomic window over essentially the entirety of each chromosome. In another useful aspect of the method progeny seed is selected for a higher trait value for yield for a haplotype in a genomic window of up to 10 centimorgans in each chromosome. In another aspect of the invention, the breeding method is directed to increased yield, where the trait value is for the yield trait, where trait values are ranked for haplotypes in each window, and where a progeny seed is selected which has a trait value for yield in a window that is higher than the mean trait value for yield in said window. In certain aspects of the breeding methods the haplotypes are defined using the polymorphisms identified in Table 1 or are defined as being in the set of molecular markers that comprises all of the DNA sequences of SEQ ID NO: 1 through SEQ ID NO:7800, or as being in linkage disequilibrium with one of those polymorphisms.

To facilitate breeding by this method it is useful to compute a value for each trait or a value for a combination of traits, e.g. a multiple trait index. The weight allocated to various traits in a multiple trait index can vary depending on the objectives of breeding. For instance, if yield is a key objective, the yield value may be weighted at 50 to 80%, maturity, lodging, plant height or disease resistance may be weighted at lower percentages in a multiple trait index.

Soybean plants (*Glycine max* L.) can be crossed by either natural or mechanical techniques. Natural pollination occurs in soybeans either by self pollination or natural cross pollination, which typically is aided by pollinating organisms. In either natural or artificial crosses, flowering and flowering time are an important consideration. Soybean is a short-day plant, but there is considerable genetic variation for sensitivity to photoperiod. The critical day length for flowering ranges from about 13 h for genotypes adapted to tropical latitudes to 24 h for photoperiod-insensitive genotypes grown at higher latitudes. Soybeans seem to be insensitive to day length for 9 days after emergence. Photoperiods shorter than the critical day length are required for 7 to 26 days to complete flower induction.

Soybean flowers typically are self-pollinated on the day the corolla opens. The stigma is receptive to pollen about 1 day before anthesis and remains receptive for 2 days after anthesis, if the flower petals are not removed. Filaments of nine stamens are fused, and the one nearest the standard is free. The stamens form a ring below the stigma until about 1 day before anthesis, then their filaments begin to elongate rapidly and elevate the anthers around the stigma. The anthers dehisce on the day of anthesis, pollen grains fall on the stigma, and within 10 h the pollen tubes reach the ovary and fertilization is completed. Self-pollination occurs naturally in soybean with no manipulation of the flowers. For the crossing of two soybean plants, it is typically preferable, although not required, to utilize artificial hybridization. In artificial hybridization, the flower used as a female in a cross is manually cross pollinated prior to maturation of pollen from the flower, thereby preventing self fertilization, or alternatively, the male parts of the flower are emasculated using a technique known in the art. Techniques for emasculating the male parts of a soybean flower include, for example, physical removal of the male parts, use of a genetic factor conferring male sterility, and application of a chemical gametocide to the male parts.

Either with or without emasculation of the female flower, hand pollination can be carried out by removing the stamens and pistil with a forceps from a flower of the male parent and gently brushing the anthers against the stigma of the female flower. Access to the stamens can be achieved by removing the front sepal and keel petals, or piercing the keel with closed forceps and allowing them to open to push the petals away. Brushing the anthers on the stigma causes them to rupture, and the highest percentage of successful crosses is obtained when pollen is clearly visible on the stigma. Pollen shed can be checked by tapping the anthers before brushing the stigma. Several male flowers may have to be used to obtain suitable pollen shed when conditions are unfavorable, or the same male may be used to pollinate several flowers with good pollen shed.

Genetic male sterility is available in soybeans and may be useful to facilitate hybridization in the context of the current invention, particularly for recurrent selection programs. The distance required for complete isolation of a crossing block is not clear; however, out-crossing is less than 0.5% when male-sterile plants are 12 m or more from a foreign pollen source (Boerma and Moradshahi, Crop Sci., 15:858-861, 1975). Plants on the boundaries of a crossing block probably sustain the most out-crossing with foreign pollen and can be eliminated at harvest to minimize contamination.

Once harvested, pods are typically air-dried at not more than 38° C. until the seeds contain 13% moisture or less, then the seeds are removed by hand. Seed can be stored satisfactorily at about 25° C. for up to a year if relative humidity is 50% or less. In humid climates, germination percentage declines rapidly unless the seed is dried to 7% moisture and stored in an air-tight container at room temperature. Long-term storage in any climate is best accomplished by drying seed to 7% moisture and storing it at 10° C. or less in a room maintained at 50% relative humidity or in an air-tight container.

Selected, non-limiting approaches for breeding the plants of the present invention are set forth below. A breeding program can be enhanced using marker assisted selection (MAS) on the progeny of any cross. It is understood that nucleic acid markers of the present invention can be used in a MAS (breeding) program. It is further understood that any commercial and non-commercial cultivars can be utilized in a breeding program. Factors such as, for example, emergence vigor, vegetative vigor, stress tolerance, disease resistance, branching, flowering, seed set, seed size, seed density, standability, and threshability etc. will generally dictate the choice.

For highly heritable traits, a choice of superior individual plants evaluated at a single location will be effective, whereas for traits with low heritability, selection should be based on mean values obtained from replicated evaluations of families of related plants. Popular selection methods commonly include pedigree selection, modified pedigree selection, mass selection, and recurrent selection. In a preferred aspect, a backcross or recurrent breeding program is undertaken.

The complexity of inheritance influences choice of the breeding method. Backcross breeding can be used to transfer one or a few favorable genes for a highly heritable trait into a desirable cultivar. This approach has been used extensively for breeding disease-resistant cultivars. Various recurrent selection techniques are used to improve quantitatively inherited traits controlled by numerous genes.

Breeding lines can be tested and compared to appropriate standards in environments representative of the commercial target area(s) for two or more generations. The best lines are candidates for new commercial cultivars; those still deficient in traits may be used as parents to produce new populations for further selection.

Pedigree breeding and recurrent selection breeding methods can be used to develop cultivars from breeding populations. Breeding programs combine desirable traits from two or more cultivars or various broad-based sources into breeding pools from which cultivars are developed by selfing and selection of desired phenotypes. New cultivars can be evaluated to determine which have commercial potential.

Backcross breeding has been used to transfer genes for a simply inherited, highly heritable trait into a desirable homozygous cultivar or inbred line, which is the recurrent parent. The source of the trait to be transferred is called the donor parent. After the initial cross, individuals possessing the phenotype of the donor parent are selected and repeatedly crossed (backcrossed) to the recurrent parent. The resulting plant is expected to have most attributes of the recurrent parent (e.g., cultivar) and, in addition, the desirable trait transferred from the donor parent.

The single-seed descent procedure in the strict sense refers to planting a segregating population, harvesting a sample of one seed per plant, and using the one-seed sample to plant the next generation. When the population has been advanced from the $F_2$ to the desired level of inbreeding, the plants from which lines are derived will each trace to different $F_2$ individuals. The number of plants in a population declines each generation due to failure of some seeds to germinate or some plants to produce at least one seed. As a result, not all of the $F_2$ plants originally sampled in the population will be represented by a progeny when generation advance is completed.

The doubled haploid (DH) approach achieves isogenic plants in a shorter time frame. DH plants provide an invaluable tool to plant breeders, particularly for generating inbred lines and quantitative genetics studies. For breeders, DH populations have been particularly useful in QTL mapping, cytoplasmic conversions, and trait introgression. Moreover, there is value in testing and evaluating homozygous lines for plant breeding programs. All of the genetic variance is among progeny in a breeding cross, which improves selection gain.

Most research and breeding applications rely on artificial methods of DH production. The initial step involves the haploidization of the plant which results in the production of a population comprising haploid seed. Non-homozygous lines are crossed with an inducer parent, resulting in the production of haploid seed. Seed that has a haploid embryo, but normal triploid endosperm, advances to the second stage. That is, haploid seed and plants are any plant with a haploid embryo, independent of the ploidy level of the endosperm.

After selecting haploid seeds from the population, the selected seeds undergo chromosome doubling to produce doubled haploid seeds. A spontaneous chromosome doubling in a cell lineage will lead to normal gamete production or the production of unreduced gametes from haploid cell lineages. Application of a chemical compound, such as colchicine, can be used to increase the rate of diploidization. Colchicine binds to tubulin and prevents its polymerization into microtubules, thus arresting mitosis at metaphase, can be used to increase the rate of diploidization, i.e. doubling of the chromosome number. These chimeric plants are self-pollinated to produce diploid (doubled haploid) seed. This DH seed is cultivated and subsequently evaluated and used in hybrid testcross production. Descriptions of other breeding methods that are commonly used for different traits and crops can be found in one of several reference books (Allard, "Principles of Plant Breeding," John Wiley & Sons, NY, U. of CA, Davis, Calif., 50-98, 1960; Simmonds, "Principles of crop improvement," Longman, Inc., NY, 369-399, 1979; Sneep and Hendriksen, "Plant breeding perspectives," Wageningen (ed), Center for Agricultural Publishing and Documentation, 1979; Fehr, In: *Soybeans: Improvement, Production and Uses*, 2nd Edition, Monograph., 16:249, 1987; Fehr, "Principles of variety development," *Theory and Technique*, (Vol. 1) and *Crop Species Soybean* (Vol. 2), Iowa State Univ., Macmillan Pub. Co., NY, 360-376, 1987)

Methods of Genotyping with a Single Molecular Marker

Methods of genotyping with single molecular markers (e.g. soybean genomic polymorphism) can also be used to associate a phenotypic trait to a genotype in soybean plants. DNA or mRNA in tissue from at least two soybean plants having allelic DNA is assayed to identify the presence or absence of the polymorphisms provided as a molecular markers by the present invention. Associations between the molecular markers and the phenotypic traits are identified where the marker is identified in Table 1 or Table 3. In another aspect traits are associated to genotypes in a segregating population of soybean plants having allelic DNA in a specific locus of a chromosome which confers a phenotypic effect on a trait of interest and where the molecular marker is located either within or near this locus.

The methods of genotyping with single molecular markers (e.g. soybean genomic polymorphism) can also be used to select a parent plant, a progeny plant or a tester plant for breeding. In this case, the polymorphism is genetically linked to a chromosomal region that confers one or more desirable phenotypic trait(s). Selection of parent, progeny or tester soybean plants that contain the particular allelic state associated with the phenotypic trait(s) provides for accelerated and less costly breeding.

It is contemplated that certain soybean genomic polymorphisms disclosed herein in Table 1 or Table 3 can be directly linked to a given phenotypic trait in that they include certain allelic states that alter a regulatory or coding sequence of a gene that confers the trait or contributes to expression of the trait. Such traits include yield, lodging, maturity, plant height, fungal disease resistance, e.g. resistance to Asian Soybean rust (*Phakopsora pachyrhizi, Phakopsora meibomiae*), Soybean Anthracnose (*Colletotrichum truncatum, Colletotrichum dematium* var. *truncatum, Glomerella glycines*), *Phytophthora* Root and Stem Rot (*Phytophthora* sp.), White Mold (*Sclerotinia* sp.), *Sclerotinia* stem rot (*Sclerotinia sclerotiorum*), Sudden Death Syndrome (*Fusarium solani*), *Fusarium* root rot (*Fusarium* spp.), Charcoal rot (*Macrophomina phaseolina*), Brown Spot (*Septoria glycines*), *Pythium* seed decay (*Pythium aphanidermatum, Pythium debaryanum, Pythium irregulare, Pythium ultimum, Pythium myriotylum, Pythium torulosum*), Pod blight (*Diaporthe phaseolorum* var. *sojae*), Stem blight (*Phomopsis longicola*), *Phomopsis* seed decay (*Phomopsis* spp.), Downy Mildew (*Peronospora manshurica*), *Rhizoctonia* root and stem rot, *Rhizoctonia* aerial blight (*Rhizoctonia solani*), Brown Stem Rot (*Phialophora gregata*), Stem Canker (*Diaporthe phaseolorum* var. *caulivora*), Purple Seed Stain (*Cercospora kikuchii*), Target Spot (*Alternaria* sp.), Frogeye Leafspot (*Cercospora sojina*), Southern blight (*Sclerotium rolfsii*), Black leaf blight (*Arkoola nigra*), Black root rot (*Thielaviopsis basicola*), Choanephora leaf blight (*Choanephora infundibulifera, Choanephora trispora*), *Leptosphaerulina* leaf spot (*Leptosphaerulina trifolii*), *Mycoleptodiscus* root rot (*Mycoleptodiscus terrestris*), *Neocosmospora* stem rot (*Neocosmospora vasinfecta*), *Phyllosticta* leaf spot (*Phyllosticta sojicola*), *Pyrenochaeta* leaf spot (*Pyrenochaeta glycines*), Red crown rot (*Cylindrocladium crotalariae*), Red leaf blotch (*Dactuliochaeta glycines*), Scab (*Spaceloma glycines*), *Stemphylium* leaf blight (*Stemphylium botryosum*), Target spot (*Corynespora cassiicola*), *Nematospora coryli* (Yeast spot), and *Phymatotrichum omnivorum* (Cotton Root Rot), and other rots, blights, rusts, bacterial diseases, e.g., *Bacillus* seed decay (*Bacillus subtilis*), Bacterial blight (*Pseudomonas savastonoi* pv. *glycinea*), Bacterial crinkle-leaf (*Pseudomonas syringae* subsp. *syringae*), Bacterial pustule (*Xanthomonas axonopodis* pv. *glycines*), Bacterial tan spot (*Curtobacterium flaccumfaciens* pv. *flaccumfaciens*), Bacterial wilt (*Curtobacterium flaccumfaciens* pv. *flaccumfaciens, Ralstonia solanacearum*), and Wildfire (*Pseudomonas syringae* pv. *tabaci*), viral diseases, e.g., resistance to Alfafa mosaic virus, AMV (Alfamovirus), Bean pod mottle virus, BPMV (Comovirus), Bean yellow mosaic virus, BYMV (Potyvirus), Cowpea chlorotic mottle virus, CCMV (Bromovirus), Mung bean yellow mosaivc virus, MYMV (Begomovirus), Peanut mottle virus (Potyvirus), Peanut stripe virus, PStV (Potyvirus), Peanut stunt virus, PSV (Cucumovirus), Soybean chlorotic mottle virus, SbCMV (Caulimovirus), Soybean crinkle leaf virus, SCLV (Begomovirus), Soybean dwarf virus, SbDV (Luteovirus), Soybean mosaic virus, SMV (Potyvirus), Soybean severe stunt virus, SSSV (Nepovirus), and Tobacco ringspot virus, TRSV (Nepovirus), insect diseases, e.g., resistance to Soybean aphid (*Aphis glycines*), parasitic diseases, e.g. resistance to Soybean cyst nematode (*Heterodera glycines*), resistance to Root Knot Nematode (*Meloidogyne incognita, Meloidogyne arenaria*, and *Meloidogyne javanica*), Lance nematode (*Hoplolaimus Columbus, Hoplolaimus galeatus, Hoplolaimus magnistylus*), Lesion nematode (*Pratylenchus* spp.), Pin nematode (*Paratylenchus projectus, Paratylenchus tenuicaudatus*), Reniform nematode (*Rotylenchulus reniformis*), Ring nematode (*Criconemella ornata*), Sheath nematode (*Hemicycliophora* spp.), Spiral nematode (*Heliocotylenchus* spp.), Sting nematode (*Belonolainus gracilis, Belonolainus longicaudatus*), Stunt nematode (*Quinisulcius acutus, Tylenchorhynchus* spp.), and Stubby root nematode (*Paratrichodorus minor*), and the like, abiotic stress tolerance, e.g., drought tolerance, cold tolerance, heat tolerance, storm tolerance, nutrient deficiency, and the like, and quality traits, e.g., low linolenic acid content, enhanced starch content, enhanced oil content, decreased saturated fatty acid content, enhanced protein content, increased lysine content, and the like. When the soybean genomic polymorphism is directly linked to the trait in this manner, it is extremely useful in soybean breeding programs aimed at introducing that trait into many distinct soybean genetic backgrounds.

The use of molecular markers that are specifically associated with yield haplotypes is specifically contemplated herein. The soybean genomic DNA polymorphisms associated with yield haplotypes that can be used are from the group consisting of SEQ ID NO: 3122, 2914, 3984, 3608, 1448, 69, 1261, 3436, 1142, 80, 88, 980, 538, 1925, 3669, 2270, 1397, 3747, 888, 365, 2132, 1972, 459, 762, and SEQ ID NO: 1094. The soybean genomic DNA polymorphisms more closely associated with yield haplotypes are selected from the group consisting of SEQ ID NO: 3122, 2914, 3984, 3608, 1448, 69, 1261, 3436, 1142, and 80. Soybean genomic DNA polymorphisms with even greater degrees of association with yield haplotypes are selected from the group consisting of SEQ ID NO: 3122, 2914, 3984, 3608, and 1448. The soybean genomic polymorphisms that are most closely associated with a yield haplotype comprise the polymorphisms of SEQ ID NO: 3122.

Introgression of the genomic region associated with this single marker can be accelerated by using multiple markers to minimize linkage drag associated with genomic regions that may not confer agronomically elite properties. Introgression of the genomic region that is closely associated with this single marker can be accelerated by using multiple markers that immediately flank the single marker to minimize any linkage drag that is potentially associated with the closely associated genomic regions. Thus the use of a clustered set of 2, 5, 10 or 20 markers located with 10, 5, 2, or 1 cm of both the proximal and distal ends of a single marker can provide for introgression of the desired genomic region associated with the single marker while minimizing introgression of undesired immediate flanking regions. Introgression of the genomic region that is closely associated with this single marker can also be accelerated by using multiple markers that are distributed across the genome to minimize any linkage drag that is potentially associated with genomic regions located on distant regions of the same chromosome and on other chromosomes. This set of multiple markers may comprise 20 additional markers with at least one marker per chromosome. However, in preferred embodiments, the marker density is at least about 10 markers per chromosome, preferably about 20 markers per chromosome and more preferably at least about 100 markers per chromosome in order to efficiently discriminate between genomic regions from the donor and recipient parents. Use of multiple flanking markers that are either immediately linked to the single marker or are distributed across the genome can thus provide for maximum recovery of the recipient parent in selected progeny of a cross.

Methods of Genotyping with Sets of Soybean Genomic DNA Polymorphisms

Genotyping methods that employ sets of nucleic acid molecules that can type multiple distinct polymorphisms are specifically contemplated herein. In such methods, a finite number of at least two soybean genomic polymorphisms are typed. This finite number of soybean genomic polymorphisms queried can comprise at least 2, 5, 10 or 20 distinct polymorphisms that are represented as 2, 5, 10, or 20 distinct SEQ ID NO in Tables 1 or 3. Such methods of genotyping necessarily require the use of sets of nucleic acid molecules that can type sets of soybean genomic polymorphisms.

In certain applications, these methods of genotyping use a concentration of multiple molecular markers (i.e. soybean genomic polymorphisms) in a given chromosomal interval. High density fingerprints used to establish and trace the identity of germplasm can be obtained by performing the genotyping methods that use multiple molecular markers that are concentrated or clustered in certain chromosomal intervals and/or around certain genetic loci that confer certain traits. High density fingerprint information is useful for assessing germplasm diversity, performing genetic quality assurance functions, mining rare alleles, assessing exotic germplasm pools, and evaluating genetic purity. These high density finger prints can be used to establish a database of marker-trait associations to benefit an overall crop breeding program. High density fingerprints can also be used to establish and protect germplasm ownership. Sets of markers that are clustered around a desired chromosome interval or genetic trait can be selected from the mapped soybean polymorphisms provided in Table 3.

These methods of genotyping with multiple molecular markers can also be used to associate a phenotypic trait to a genotype in soybean plants. DNA or mRNA in tissue from at least two soybean plants having allelic DNA is assayed to identify the presence or absence of a set of finite series of polymorphisms provided as molecular markers by the present invention. Associations between the set of molecular markers and set of phenotypic traits are identified where the set of molecular markers comprises at least 2, at least 5, or at least 10, molecular markers linked to a polymorphic locus of the invention, e.g. at least 10 molecular markers linked to mapped polymorphisms, e.g. as identified in Table 3. In a more preferred aspect traits are associated to genotypes in a segregating population of soybean plants having allelic DNA in loci of a chromosome which confers a phenotypic effect on a trait of interest and where a molecular marker is located in such loci and where the degree of association among the molecular markers and between the polymorphisms and the traits permits determination of a linear order of the polymorphism and the trait loci. In such methods at least 5 molecular markers are linked to loci permitting disequilibrium mapping of the loci.

In still other applications, these methods of genotyping use molecular markers that are distributed across the genome of soybean. In these methods, the molecular marker can either be spread across a single chromosome, located on multiple chromosomes, located on all chromosomes or be located on each arm of each chromosome. In one specific embodiment, at least 1 of the molecular markers that is used in the genotyping method using a plurality of markers maps to each chromosome of all of the 20 soybean chromosomes, thus necessitating the typing of at least 20 soybean genomic DNA polymorphisms. However, other embodiments of this method where at least 10 soybean genomic DNA polymorphisms map to each chromosome, thus necessitating the typing of at least 200 soybean genomic DNA polymorphisms, are also contemplated. Similarly, still other embodiments that entail typing of at least 20 soybean genomic DNA polymorphisms on each chromosome (necessitating the typing of at least 400 polymorphisms) or typing of at least 50 soybean genomic DNA polymorphisms on each chromosome (necessitating the typing of at least 1,000 polymorphisms) are also contemplated. Embodiments that entail typing of at least 100 soybean genomic DNA polymorphisms on each chromosome (necessitating the typing of at least 2000 polymorphisms) are also contemplated. Sets of markers that are distributed across the genome of soybean can be selected from the mapped soybean polymorphisms provided in Table 3 for use in these methods.

Methods of genotyping that use molecular markers that are distributed across the genome of soybean can be used in a variety of applications. In one application, the methods of genotyping are used to select a parent plant, a progeny plant or a tester plant for breeding. A variety of applications of these genotyping methods to soybean breeding programs are contemplated. These genotyping methods can be used to facilitate introgression of one or more traits, genomic loci, and/or transgene insertions from one genetic background to a distinct genetic background. In general, the set of selected markers in progeny plants from out-crossed populations is queried to identify and select individual progeny that contain the desired traits, genomic loci, and/or transgene insertions yet comprises as many alleles from the distinct genetic background from the outcross as possible. Such methods can accelerate introgression of the desired traits, genomic loci, and/or transgene insertions into a new genetic background by several generations.

These methods also provide for screening of traits by interrogating a collection of molecular markers, such as SNPs, at an average density of less than about 10 cM on a genetic map of soybean. The presence or absence of a molecular marker linked to a polymorphic locus of Table 1 or Table 3 can be analyzed in the context of one or more phenotypic traits in order to identify one or more specific molecular marker alleles at one or more of said traits. In another aspect of the invention the molecular markers are used to identify haplotypes which are allelic segments of genomic DNA characterized by at least two polymorphisms in linkage disequilibrium and wherein said polymorphisms are in a genomic windows of not more than 10 centimorgans in length, e.g. not more than about 8 centimorgans or smaller windows, e.g. in the range of say 1 to 5 centimorgans. In certain embodiments of these methods, set of such molecular markers to identify a plurality of haplotypes in a series of adjacent genomic windows in each soybean chromosome, e.g. providing essentially full genome coverage with such windows. With a sufficiently large and diverse breeding population of soybean, it is possible to identify a high quantity of haplotypes in each window, thus providing allelic DNA that can be associated with one or more traits to allow focused marker assisted breeding. Thus, an aspect of the soybean analysis of this invention further comprises the steps of characterizing one or more traits for said population of soybean plants and associating said traits with said allelic SNP or Indel polymorphisms, preferably organized to define haplotypes. Such traits include yield, lodging, maturity, plant height, fungal disease resistance, e.g. resistance to Asian Soybean rust (*Phakopsora pachyrhizi, Phakopsora meibomiae*), Soybean Anthracnose (*Colletotrichum truncatum, Colletotrichum dematium* var. *truncatum, Glomerella glycines*), Phytophthora Root and Stem Rot (*Phytophthora* sp.), White Mold (*Sclerotinia* sp.), *Sclerotinia* stem rot (*Sclerotinia sclerotiorum*), Sudden Death Syndrome (*Fusarium solani*), *Fusarium* root rot (*Fusarium* spp.), Charcoal rot (*Macrophomina phaseolina*), Brown Spot (*Septoria glycines*), Pythium seed decay (*Pythium aphanidermatum, Pythium debaryanum, Pythium irregulare, Pythium ultimum, Pythium myriotylum, Pythium torulosum*), Pod blight (*Diaporthe phaseolorum* var. *sojae*), Stem blight (*Phomopsis longicola*), *Phomopsis* seed decay (*Phomopsis* spp.), Downy Mildew (*Peronospora manshurica*), *Rhizoctonia* root and stem rot, *Rhizoctonia* aerial blight (*Rhizoctonia solani*), Brown Stem Rot (*Phialophora gregata*), Stem Canker (*Diaporthe phaseolorum* var. *caulivora*), Purple Seed Stain (*Cercospora kikuchii*), Target Spot (*Alternaria* sp.), Frogeye Leafspot (*Cercospora sojina*), Southern blight (*Sclerotium rolfsii*), Black leaf blight (*Arkoola nigra*), Black root rot (*Thielaviopsis basicola*), Choanephora leaf blight (*Choanephora infundibulifera, Choanephora trispora*), Leptosphaerulina leaf spot (*Leptosphaerulina trifolii*), Mycoleptodiscus root rot (*Mycoleptodiscus terrestris*), Neocosmospora stem rot (*Neocosmospora vasinfecta*), Phyllosticta leaf spot (*Phyllosticta sojicola*), Pyrenochaeta leaf spot (*Pyrenochaeta glycines*), Red crown rot (*Cylindrocladium crotalariae*), Red leaf blotch (*Dactuliochaeta glycines*), Scab (*Spaceloma glycines*), Stemphylium leaf blight (*Stemphylium botryosum*), Target spot (*Corynespora cassiicola*), *Nematospora coryli* (Yeast spot), and *Phymatotrichum omnivorum* (Cotton Root Rot), and other rots, blights, rusts, bacterial diseases, e.g., *Bacillus* seed decay (*Bacillus subtilis*), Bacterial blight (*Pseudomonas savastonoi* pv. *glycinea*), Bacterial crinkleleaf (*Pseudomonas syringae* subsp. *syringae*), Bacterial pustule (*Xanthomonas axonopodis* pv. *glycines*), Bacterial tan spot (*Curtobacterium flaccumfaciens* pv. *flaccumfaciens*), Bacterial wilt (*Curtobacterium flaccumfaciens* pv. *flaccumfaciens, Ralstonia solanacearum*), and Wildfire (*Pseudomonas syringae* pv. *tabaci*), viral diseases, e.g., resistance to Alfafa mosaic virus, AMV (Alfamovirus), Bean pod mottle virus, BPMV (Comovirus), Bean yellow mosaic virus, BYMV (Potyvirus), Cowpea chlorotic mottle virus, CCMV (Bromovirus), Mung bean yellow mosaivc virus, MYMV (Begomovirus), Peanut mottle virus (Potyvirus), Peanut stripe virus, PStV (Potyvirus), Peanut stunt virus, PSV (Cucumovirus), Soybean chlorotic mottle virus, SbCMV (Caulimovirus), Soybean crinkle leaf virus, SCLV (Begomovirus), Soybean dwarf virus, SbDV (Luteovirus), Soybean mosaic virus, SMV (Potyvirus), Soybean severe stunt virus, SSSV (Nepovirus), and Tobacco ringspot virus, TRSV (Nepovirus), insect diseases, e.g., resistance to Soybean aphid (*Aphis glycines*), parasitic diseases, e.g. resistance to Soybean cyst nematode (*Heterodera glycines*) or resistance to Root Knot Nematode (*Meloidogyne incognita, Meloidogyne arenaria,* and *Meloidogyne javanica*), Lance nematode (*Hoplolaimus Columbus, Hoplolaimus galeatus, Hoplolaimus magnistylus*), Lesion nematode (*Pratylenchus* spp.), Pin nematode (*Paratylenchus projectus, Paratylenchus tenuicaudatus*), Reniform nematode (*Rotylenchulus reniformis*), Ring nematode (*Criconemella ornata*), Sheath nematode (*Hemicycliophora* spp.), Spiral nematode (*Heliocotylenchus* spp.), Sting nematode (*Belonolainus gracilis, Belonolainus longicaudatus*), Stunt nematode (*Quinisulcius acutus, Tylenchorhynchus* spp.), and Stubby root nematode (*Paratrichodorus minor*), and the like, abiotic stress tolerance, e.g., drought tolerance, cold tolerance, heat tolerance, storm tolerance, nutrient deficiency, and the like, and quality traits, e.g., low linolenic acid content, enhanced starch content, enhanced oil content, decreased saturated fatty acid content, enhanced protein content, increased lysine content, and the like.

EXAMPLES

The following examples are included to demonstrate preferred embodiments of the invention. It should be appreciated by those of skill in the art that the techniques disclosed in the examples which follow represent techniques discovered by the inventor to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims.

Example 1

This example illustrates the preparation of reduced representation libraries using enzymes which are sensitive to methylated cytosine residues in order to enrich for unique/ coding-sequence genomic DNA.

Genomic DNA extraction methods are well known in the art. A preferred method which maximizes both yield and convenience is to extract DNA using "PLANT DNAZOL REAGENT" from Life Technologies (Grand Island, N.Y.). Briefly, frozen leaf tissue is ground in liquid nitrogen in a mortar and pestle. The ground tissue is then extracted with DNAzo 1 reagent. This removes cellular proteins, cell wall material and other debris. Following extraction with this reagent, the DNA is precipitated, washed, resuspended, and treated with RNAse to remove RNA. The DNA is precipitated again, and resuspended in a suitable volume of TE (so that concentration is 1 µg/µl). The genomic DNA is ready to use in library construction.

Genomic DNA from two soybean lines which are to be compared for polymorphism detection are digested separately with Pst I restriction endonuclease which provides the ends of the DNA fragments with sticky ends which can ligate into a plasmid with the same restriction site. For instance, 100 units of Pst I is added to 20 μg of DNA and incubated at 37° C. for 8 hours. The digested DNA product is separated by electrophoresis on a 1% low-melting-temperature-agarose gel to separate the DNA fragments by size. The digested DNA from the two soybean lines is loaded side by side on the gel (with one lane in between as a spacer). Both a 1-KB DNA ladder marker and a 100-bp DNA ladder marker are loaded on each side of the two soybean DNA lanes. These markers act as a guide for size fractionation of the digested soybean DNA. Fragments in the range of 500 to 3000 bp are excised incrementally from the gel in size fractions of 500-600 bp, 600-700 bp, 700-800 bp, 800-900 bp, 900-1100 bp, 1100-1500 bp, 1500-2000 bp, 2000-2500 bp and 2500-3000 bp. DNA in each fraction is purified using β-agarase and ligated into the Pst I cloning site of pUC18. The plasmid ligation products are transformed by electroporation into DH10B E. coli bacterial hosts to produce reduced representation libraries. For instance, about 500 ng of the size-selected DNA is ligated to 50 ng dephosphorylated pUC18 vector.

Transformation is carried out by electroporation and the transformation efficiency for reduced representation Pst I libraries is approximately 50,000-300,000 transformants from one microliter of ligation product or 1000 to 6000 transformants/ng DNA.

Basic tests to evaluate the quality include the average insert size, chloroplast/mitochondrial DNA content, and the fraction of repetitive sequence.

The determination of the average insert size of the library is assessed during library construction. Every ligation is tested to determine the average insert size by assaying 10-20 clones per ligation. DNA is isolated from recombinant clones using a standard mini preparation protocol, digested with Pst I to free the insert from the vector and then sized using 1% agarose gel electrophoresis (Maule, *Molecular Biotechnology* 9:107-126 (1998), the entirety of which is herein incorporated by reference).

The chloroplast/mitochondrial DNA content, and the percentage of repetitive sequence in the library is estimated by sequencing a small sample of clones (400), and cross checking the sequence obtained against various sequence databases. Some repetitive elements are not present in the databases, but can nevertheless often be identified by the large number of copies of the same sequence. For instance, after sequencing a set of 400 clones any sequence that is not filtered by the repetitive element database, but yet is present more than 10 times in the sample is considered a repetitive element.

Soybean reduced representation libraries of the present invention are constructed by inserting coding region enriched DNA obtained from the following soybean lines: A2869, A3244, CX400, AG2403, AG2801, DKB31-51, AG3602, CMA5901C0C, A5427, N94-552, Hutchison, Essex, Accomac, Lee74, AG4201, AG5501, AG5605, AG4403, HS1, PIC, Minsoy, Noir, and Williams82.

Example 2

This example illustrates the determination of soybean genomic DNA sequence from clones in reduced representation libraries prepared in Example 1. Two basic methods can be used for DNA sequencing, the chain termination method of Sanger et al., *Proc. Natl. Acad. Sci. USA* 74:5463-5467 (1977) and the chemical degradation method of Maxam and Gilbert, *Proc. Natl. Acad. Sci. USA* 74:560-564 (1977). Automation and advances in technology such as the replacement of radioisotopes with fluorescence-based sequencing have reduced the effort required to sequence DNA (Craxton, Methods, 2:20-26 (1991), Ju et al., *Proc. Natl. Acad. Sci. USA* 92:4347-4351 (1995) and Tabor and Richardson, *Proc. Natl. Acad. Sci. USA* 92:6339-6343 (1995). Automated sequencers are available from, for example, Applied Biosystems, Foster City, Calif. (ABI PRISM® SYSTEMS); Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

Sequence base calling from trace files and quality scores are assigned by PHRED which is available from CodonCode Corporation, Dedham, Mass. and is described by Brent Ewing, et al. "Base-calling of automated sequencer traces using phred", 1998, Genome Research, Vol. 8, pages 175-185 and 186-194, incorporated herein by reference.

After the base calling is completed, sequence quality is improved by cutting poor quality end sequence. If the resulting sequence is less than 50 bp, it is deleted. Sequence with an overall quality of less than 12.5 is deleted. And, contaminating sequence, e.g. E. coli BAC and vector sequences and sub-cloning vector, are removed. Contigs are assembled using PANGEA CLUSTERING AND ALIGNMENT TOOLS which is available from DoubleTwist Inc., Oakland, Calif. by comparing pairs of sequences for overlapping bases. The overlap is determined using the following high stringency parameters: word size=8; window size=60; and identity is 93%. The clusters are reassembled using PHRAP fragment assembly program which is available from CodonCode Corporation using a "repeat stringency" parameter of 0.5 or lower. The final assembly output contains a collection of sequences including contig sequences which represent the consensus sequence of overlapping clustered sequences (contigs) and singleton sequences which are not present in any cluster of related sequences (singletons). Collectively, the contigs and singletons resulting from a DNA assembly are referred to as islands.

Example 3

This example illustrates identification of SNP and Indel polymorphisms by comparing alignments of the sequences of contigs and singletons from at least two separate soybean lines as prepared as in example 2. Sequence from multiple soybean lines is assembled into loci having one or more polymorphisms, i.e. SNPs and/or Indels. Candidate polymorphisms are qualified by the following parameters:

The minimum length of a contig or singleton for a consensus alignment is 200 bases.

The percentage identity of observed bases in a region of 15 bases on each side of a candidate SNP, is 75%.

The minimum BLAST quality in each contig at a polymorphism site is 35.

The minimum BLAST quality in a region of 15 bases on each side of the polymorphism site is 20.

A plurality of loci having qualified polymorphisms are identified as having consensus sequence as reported as SEQ ID NO: 1 through SEQ ID NO: 7800. The qualified SNP and Indel polymorphisms in each locus are identified in Table 1. More particularly, Table 1 identifies the type and location of the polymorphisms as follows:

SEQ_NUM refers to the SEQ ID NO. (sequence ID number) of the polymorphic soybean DNA locus.

CONSSEQ_ID refers to an arbitrary identifying name for the polymorphic soybean DNA locus.

MUTATION_ID refers to an arbitrary identifying name for each polymorphism.

START_POS refers to the position in the nucleotide sequence of the polymorphic soybean DNA locus where the polymorphism begins.

END_POS refers to the position in the nucleotide sequence of the polymorphic soybean DNA locus where the polymorphism ends; for SNPs the START_POS and END_POS are common.

TYPE refers to the identification of the polymorphism as an SNP or IND (Indel).

ALLELE and STRAIN refers to the nucleotide sequence of a polymorphism in a specific allelic soybean variety.

Example 4

This example illustrates the use of primer base extension for detecting a SNP polymorphism.

A small quantity of soybean genomic DNA (e.g. about 10 ng) is amplified using the forward and reverse PCR primers which are designed to have an annealing temperature of 55° C. to the template, i.e., around a polymorphism of a particular molecular marker. The PCR product is added to a new plate in which the extension primer is covalently bound to the surface of the reaction wells in a GBA plate. Extension mix containing DNA polymerase, the two differentially labeled ddNTPs, and extension buffer is added. The GBA plate is incubated at 42° C. for 15 min to allow extension. The reaction mix is removed from the wells by washing with a suitable buffer. The two labels are detected by sequential incubation with primary and secondary detection reagents for each of the labels. Incorporation of a specific ddNTP-FITC is measured by incubation with HRP-anti-FITC, followed by washing the wells, followed by incubation in a buffer containing a chromogenic substrate for HRP. The extent of the reaction is determined spectrophotometrically for each well at the wavelength appropriate for the product of the HRP reaction. The wells are washed again, and the procedure is repeated with AP-streptavidin, followed by a chromogenic substrate for AP, and spectrophotometry at the wavelength appropriate for the AP reaction product.

Analysis of Results.

The extent of incorporation of each labeled ddNTP is inferred from the absorbance measured for the reaction products of the detection steps specific label, and the genotype of the sample is inferred from the ratios of these absorbances as compared to a standard of known genotype and a no-template control reactions. In the most common practice, the absorbances observed for each data point are plotted against each other in a scatter plot, producing an "allelogram". A successful genotyping assay using the single base extension assay of this example provides an allelogram as illustrated in FIG. 2 where the data points are grouped into four clusters: Homozygote 1 (e.g., the A allele), homozygote 2 (e.g., the G allele), heterozygotes (each sample containing both alleles), and a "no signal" cluster resulting from no-template controls, or failed amplification or detection.

Example 5

This example illustrates the use of a labeled probe degradation assay for detecting a SNP polymorphism. A quantity of soybean genomic template DNA (e.g. about 2-20 ng) is mixed in 5 ul total volume with four oligonucleotides, as described in Table 2, i.e. forward primer, reverse primer, hybridization probe having a VIC reporter attached to the 5' end and hybridization probe having a FAM reporter attached to the 5' end as well as PCR reaction buffer containing the passive reference dye ROX. The PCR reaction is conducted for 35 cycles using a 60° C. annealing-extension temperature. Following the reaction, the fluorescence of each fluorophore as well as that of the passive reference is determined in a fluorimeter. The fluorescence value for each fluorophore is normalized to the fluorescence value of the passive reference. The normalized values are plotted against each other for each sample to produce an allelogram. A successful genotyping assay using the primers and hybridization probes of this example provides an allelogram with data points in clearly separable clusters as illustrated in FIG. 2.

Table 2. Examples of molecular marker assays using labeled probe degradation detection of SNP polymorphisms. Each assay provides two oligonucleotides primers, to amplify the region spanning the polymorphism, and two oligonucleotides probes, which have fluorogenic reporter molecules attached for SNP allele detection. Useful reporter dyes include, but are not limited to, 6-carboxy-4,7,2',7'-tetrachlorofluorecein (TET), 2'-chloro-7'-phenyl-1,4-dichloro-6-carboxyfluorescein (VIC) and 6-carboxyfluorescein phosphoramidite (FAM). A useful quencher is 6-carboxy-N,N,N',N'-tetramethylrhodamine (TAMRA).

| Marker SEQ ID | CONSSEQ_ ID | PRIMER SEQ ID NO | Sequence type | Sequence | Allele |
|---|---|---|---|---|---|
| 654 | 20052164-CON.1 | SEQ ID NO: 7801 | Forward Primer | CGTTCTCGACTTCAACCATATGTG | A |
| 654 | 20052164-CON.1 | SEQ ID NO: 7802 | Probe 1 | CCATGGTATCATAGGCA | T |
| 654 | 20052164-CON.1 | SEQ ID NO: 7803 | Probe 2 | CCATGGTATCGTAGGCA | C |
| 654 | 20052164-CON.1 | SEQ ID NO: 7804 | Reverse Primer | GCATGGAATAAAGCGGAAAGGAA AG | |
| 650 | 20052160-CON.1 | SEQ ID NO: 7805 | Forward Primer | TTTAACTCACTACTTGAGCTTGAT TTCATCT | |
| 650 | 20052160-CON.1 | SEQ ID NO: 7806 | Probe 1 | CTATGCCTAAGTATTCTT | G |
| 650 | 20052160-CON.1 | SEQ ID NO: 7807 | Probe 2 | CTATGCCTAAATATTCTT | A |
| 650 | 20052160-CON.1 | SEQ ID NO: 7808 | Reverse Primer | CAACAAACTTAGATTAACAACAC CAATTAGGT | |

To confirm that an assay produces accurate results, each new assay is performed on a number of replicates of samples of known genotypic identity representing each of the three possible genotypes, i.e. two homozygous alleles and a heterozygous sample. To be a valid and useful assay, it must produce clearly separable clusters of data points, such that one of the three genotypes can be assigned for at least 90% of the data points, and the assignment is observed to be correct for at least 98% of the data points. Subsequent to this validation step, the assay is applied to progeny of a cross between two highly inbred individuals to obtain segregation data, which are then used to calculate a genetic map position for the polymorphic locus.

Example 6

This example illustrates the genetic mapping of molecular markers in loci of this invention based on the genotypes of over 2000 SNPs for 476 $F_2$ plants originating from the cross of soy lines A3244 and AG5501. Before mapping, any loci showing distorted segregation (P<1e-5 for a Chi-square test of a 1:1 segregation ratio) are removed. A low alpha-level is used to account for the multiple-testing problem.

In one aspect, a map can be constructed using the JOINMAP version 2.0 software which is described by Stam, P. "Construction of integrated genetic linkage maps by means of a new computer package: JOINMAP, The Plant Journal, 3: 739-744 (1993); Stain, P. and van Ooijen, J. W. "JOINMAP version 2.0: Software for the calculation of genetic linkage maps (1995) CPRO-DLO, Wageningen. JOINMAP implements a weighted-least squares approach to multipoint mapping in which information from all pairs of linked loci (adjacent or not) is incorporated. Linkage groups are formed using a LOD threshold of 5.0. The SSR and RFLP public markers are used to assign linkage groups to chromosomes. Linkage groups are merged within chromosomes before map construction.

Other approaches to mapping high density markers are known in the art; see, for example, Winkler et al. (Genetics 164:741-745 (2003)), for the utility of IRIs for higher resolution mapping. See also, Jansen et al. (Theor Appl Genet 102:1113-1122 (2001)). In many conditions, the approach of Jansen et al. yields a close approximation to a maximum-likelihood map. Further, a map estimated by this approach agrees quite closely with the map obtained using JOINMAP 2.0. In addition, combinations of methods described above and incorporated herein by reference may be used to best leverage marker data under a range of population structure as well as computational constraints.

In another aspect of the present invention, Kosambi's mapping function is used to convert recombination fractions to map distances. Mapped SNP molecular markers are identified in Table 3 where "LG" identifies the linkage group or chromosome and "Position" identifies the distance measured in cM from the 5' end of a soybean chromosome for the SNP identified by "Consseq_ID". For certain of the mapped polymorphic markers listed in Table 3, the Mutation ID is listed more than once which indicates that the mapping was conducted based on multiple genotyping assays. The map locations for multiple genotyping assays generally serve to confirm map location except in the case where map locations are divergent, e.g. due to error in the design or practice of an assay. The density and distribution of the mapped molecular markers is shown in FIG. 1.

Example 7

This example illustrates methods of the invention using molecular markers disclosed in Table 1 and in the DNA sequences of SEQ ID NO:1-7800.

A breeding population of soybean with diverse heritage is analyzed using primer pairs and probe pairs prepared as indicated in Example 5 for each of the molecular markers identified in Table 1 based on sequences of SEQ ID NO:1-7800. Closely linked molecular markers are identified as characterizing haplotypes within adjacent genomic windows of about 10 centimorgans across the soybean genome. Haplotypes representing at least 4% of the population are associated with trait values identified for each member of the soybean population including the trait values for yield, maturity, lodging, plant height, rust resistance, drought tolerance and cold germination. The trait values for each haplotype are ranked in each 10 centimorgan window. Progeny seed from randomly-mated members of the population are analyzed for the identity of haplotypes in each window. Progeny seed are selected for planting based on high trait values for haplotypes identified in said seeds.

Example 8

This example illustrates the identification of polymorphisms that are useful for obtaining a parent plant, a progeny plant or a tester plant for breeding with a preferred trait. In this particular example, polymorphisms have been selected for usefulness in identifying plants with a preferred yield trait for illustrative purposes. However, it is also anticipated that other markers useful for identifying other preferred traits can be identified in a similar manner (i.e. by noting the location of a polymorphism's genetic map position within a haplotype window). It is further anticipated that the specific markers disclosed in this Example may also find other uses in addition to serving as markers for yield traits.

First, haplotype windows associated with yield were identified as disclosed in U.S. Patent Application Ser. No. 60/837, 864. The map positions disclosed in Table 3 were used to identify markers of the present invention that are located in the haplotype window(s) comprising the preferred haplotypes for yield and that can be used as markers for these regions. 25 polymorphisms coinciding with 25 haplotype windows that comprise the 25 haplotypes in Monsanto soybean germplasm associated with a yield advantage were selected. Two (2) markers are thus provided for most of these yield haplotype windows. The specific markers that can be used to identify plants for breeding with the preferred yield trait can be selected from the group consisting of SEQ ID NO: 3122, 2914, 3984, 3608, 1448, 69, 1261, 3436, 1142, 80, 88, 980, 538, 1925, 3669, 2270, 1397, 3747, 888, 365, 2132, 1972, 459, 762, and SEQ ID NO: 1094.

In view of the foregoing, it will be seen that the several advantages of the invention are achieved and attained.

The embodiments were chosen and described in order to best explain the principles of the invention and its practical application to thereby enable others skilled in the art to best utilize the invention in various embodiments and with various modifications as are suited to the particular use contemplated.

Various patent and non-patent publications are cited herein, the disclosures of each of which are incorporated herein by reference in their entireties.

As various modifications could be made in the constructions and methods herein described and illustrated without departing from the scope of the invention, it is intended that all matter contained in the foregoing description or shown in the accompanying drawings shall be interpreted as illustrative rather than limiting. The breadth and scope of the present invention should not be limited by any of the above-described exemplary embodiments, but should be defined only in accordance with the following claims appended hereto and their equivalents.

SEQUENCE LISTING (7808 sequences)

SEQ ID NO: 1 - DNA, 2252 bp, Glycine max
  misc_feature (86)..(87): n is a, c, g, or t
  misc_feature (94)..(94): n is a, c, g, or t
  misc_feature (113)..(113): n is a, c, g, or t
  misc_feature (345)..(382): n is a, c, g, or t
  misc_feature (390)..(390): n is a, c, g, or t
  misc_feature (766)..(766): n is a, c, g, or t
tacttaatatagaatactctacaaatcaattttgagtttctttatcattttatttatttattgacatacttctactttctgcaaannccctganctcgtgggagatatagggnaggttatggaagttagtgtattgtcatatctagctatctttgctaattgaaaaagccttccctttgtttacagatctggataaggttgcatgtttattcttttcaactgtgaatggttctttgcatcttttttagtatatgagattaatgttttaattaggaagaagcttttagaacatcacccgaatccaattcgttttggtttctgtgatcttgatgtaaatctatactnnnnnnnnnnnnnnnnnnnnnnnnnnnnnnnnnnnnnnaatgttcnttgctcaagtcctctaggacgaaaatataaatataacagggtatatcagatctctattcttctgtgggtaatgatagcatgtttctgttgttttcttattcttcattggtcatgataacctgctaattctatttgccacgattgagatgaaaaggtaatgaactagtaaacaataatgagaagaatatgtcgctactattgttgaaacggttacgccaggcacttgagtatgatgcactattttaattaatgcatttttttttgctttgatgagaacgcacattgttcattctgattcggtgagtttagaaactattgctgataatccttgatttaagattttagtcttgttcatgttcattaaaagtgttgtaanaaaatgcactgatatgtcatgtgcagattgtgtgaagatgggggcgggtggccgaactgatgttcctcctgccaacaggaagtcagaggttgaccctttgaagcgggtgccatttgaaaaacctccatttagtctcagccaaatcaaagaaggtcattccacctcactgtttccagcgttctgttttccgctcattctcctatgttgtttacgacctcaccatagccttctgcctctattatgttgccacccattacttccacctccttcccagccctctctctttcttggcatggccaatctactgggctgtccaaggttgcatccttactggagtttgggtcattgcccatgagtgtggccaccatgcattcagtgactaccagttgcttgatgatattgttggccttgtcctccactccggtctcctagtcccatacttttcatggaaatacagccatcgccgtcaccactccaacactggttctcttgagcgggatgaagtatttgtgccaaagcagaagtcctgtatcaagtggtactctaaataccttaacaatcctccaggcagagtcctcactcttgctgtcaccctcacacttggttggcccttgtacttggctttaaatgtttctggaaggccttatgatagatttgcttgccactatgacccatatggtcccatttactctgatcgtgaacgacttcaaatatatatatcagatgcaggagtacttgcagtatgctatggccttttccgtcttgccatggcaaaaggacttgcctgggtggtgtgtgtttatggagttccattgctagtggtcaatggatttttggtgttgattacattcttgcagcatactcaccctgcattgccacattacacttcctctgagtgggactggttgagaggagctttagcaacagtggatagagattatggaatcctgaacaaggtcttccataatattacagacactcatgtagcacatcacttgttctccacaatgccacattatcatgcaatggaggctacaaaggcaataaaacccattttgggagagtattatcggtttgatgagactccatttgtcaaggcaatgtggagagaggcaagagagtgtatttatgtggagccagatcaaagtaccgagagcaaaggtgtattttggtacaacaataagttgtgatgattaatgtagccgaggcttctttgaactttcccttgtgactgtttagtatcatggttgcttattgggaataattttgttgaaccctgatgttggtagtaagtatctagacagttgcatagcggttttgtttacagaataagatatagcctctctgaacagtttgattattgcaccatggtttgcaatcggtgcatgtcgaccaagtttctcaagactgtggagaagcttattcttgttccagttcttgaatccaagttgttaccgtattctgttattattgacttagaatcctt

SEQ ID NO: 2 - DNA, 192 bp, Glycine max
tggtacaagagaaagaaataagaaagcgcaagcaccacataggagaacacgagggatgtggtgaatgcgaagataaagaagaggaagagcaaagtagaagccgagaacgcggcgagtggcatgaacataaaggacaacaacatggaaaagaaaaaggaagagagagatataaggaaggtggtgaagggagag

SEQ ID NO: 3 - DNA, 200 bp, Glycine max
tcctctcatacctataaatcaccactcctcatgttctttccaattcaccaactccttcaaacttaattattaacacttccttagttcaatatagggaagcccttcactctctctctttcttccctttgcttgctactcttgtcgagtgcatgctttgctattagctccagcaagctcaacgagtgccaactcaacaacct

SEQ ID NO: 4 - DNA, 201 bp, Glycine max
acaaccctttcagcttcctggttccacctaaggagtctcagaggagagttgtggcttagagccctttttgcatgtgctaccacacttttgtccttttgggcactagttagtgtgcgtagcaataaataagaacgaataaaacaacaaaggctttgctgccctttgttaagtataaaataacgggtaatgtaattgtaccct

SEQ ID NO: 5 - DNA, 2251 bp, Glycine max
  misc_feature (86)..(87): n is a, c, g, or t
  misc_feature (94)..(94): n is a, c, g, or t
  misc_feature (113)..(113): n is a, c, g, or t
  misc_feature (345)..(382): n is a, c, g, or t
  misc_feature (390)..(390): n is a, c, g, or t
  misc_feature (766)..(766): n is a, c, g, or t
tacttaatatagaatactctacaaatcaattttgagtttctttatcattttatttatttattgacatacttctactttctgcaaannccctganctcgtgggagatatagggnaggttatggaagttagtgtattgtcatatctagctatctttgctaattgaaaaagccttccctttgtttacagatctggataaggttgcatgtttattcttttcaactgtgaatggttctttgcatcttttttagtatatgagattaatgttttaattaggaagaagcttttagaacatcacccgaatccaattcgttttggtttctgtgatcttgatgtaaatctatactnnnnnnnnnnnnnnnnnnnnnnnnnnnnnnnnnnnnnnaatgttcnttgctcaagtcctctaggacgaaaatataaatataacagggtatatcagatctctattcttctgtgggtaatgatagcatgtttctgttgttttcttattcttcattggtcatgataacctgctaattctatttgccacgattgagatgaaaaggtaatgaactagtaaacaataatgagaagaatatgtcgctactattgttgaaacggttacgccaggcacttgagtatgatgcactattttaattaatgcatttttttttgctttgatgagaacgcacattgttcattctgattcggtgagtttagaaactattgctgataatccttgatttaagattttagtcttgttcatgttcattaaaagtgttgtaanaaaatgcactgatatgtcatgtgcagattgtgtgaagatgggggcgggtggccgaactgatgttcctcctgccaacaggaagtcagaggttgaccctttgaagcgggtgccatttgaaaaacctccatttagtctcagccaaatcaaagaaggtcattccacctcactgtttccagcgttctgttttccgctcattctcctatgttgtttacgacctcaccatagccttctgcctctattatgttgccacccattacttccacctccttcccagccctctctctttcttggcatggccaatctactgggctgtccaaggttgcatccttactggagtttgggtcattgcccatgagtgtggccaccatgcattcagtgactaccagttgcttgatgatattgttggccttgtcctccactccggtctcctagtcccatacttttcatggaaatacagccatcgccgtcaccactccaacactggttctcttgagcgggatgaagtatttgtgccaaagcagaagtcctgtatcaagtggtactctaaataccttaacaatcctccaggcagagtcctcactcttgctgtcaccctcacacttggttggcccttgtacttggctttaaatgtttctggaaggccttatgatagatttgcttgccactatgacccatatggtcccatttactctgatcgtgaacgacttcaaatatatatatcagatgcaggagtacttgcagtatgctatggccttttccgtcttgccatggcaaaaggacttgcctgggtggtgtgtgtttatggagttccattgctagtggtcaatggatttttggtgttgattacattcttgcagcatactcaccctgcattgccacattacacttcctctgagtgggactggttgagaggagctttagcaacagtggatagagattatggaatcctgaacaaggtcttccataatattacagacactcatgtagcacatcacttgttctccacaatgccacattatcatgcaatggaggctacaaaggcaataaaacccattttgggagagtattatcggtttgatgagactccatttgtcaaggcaatgtggagagaggcaagagagtgtatttatgtggagccagatcaaagtaccgagagcaaaggtgtattttggtacaacaataagttgtgatgattaatgtagccgaggcttctttgaactttcccttgtgactgtttagtatcatggttgcttattgggaataattttgttgaaccctgatgttggtagtaagtatctagacagttgcatagcggttttgtttacagaataagatatagcctctctgaacagtttgattattgcaccatggtttgcaatcggtgcatgtcgaccaagtttctcaagactgtggagaagcttattcttgttccagttcttgaatccaagttgttaccgtattctgttattattgacttagaatcct

SEQ ID NO: 6 - DNA, 228 bp, Glycine max
ctggcttctcaaactcagtgcccagtatggatcactccgcaaggtacgtacatcatacatgttataaattaagctcaacaaatgttaaaaaatggtaatagttatatatagtaattaaaatgtgtgacgacaaagttatcttagcacttgcatatgcattattcatgtgctttttttttatatatagaaatgcccgaagttattaagtagtcacagtttcttgtgtcg

SEQ ID NO: 7 - DNA, 197 bp, Glycine max
cgatccattaaacttaaatgataaaattcaactaactaatttggagtaattaagaaaaatagttaatttagacaacaatattaaatttttgctaaattatatgtttttctcaaaattacctataacattaataagacatacttttatttttcaaagatttctacttaattaaccgccacaaattcatcctcgctggt

SEQ ID NO: 8 - DNA, 315 bp, Glycine max
aaaagaaattggacaacgttgtaacatgcattaagattagaactcttaagttctaatactggttacagaattaacaagtatttgttttgataaaatatacacttggcagagattctatcttgctgggaaccaagagcaagagtttctacagtatcagccacagaagcagcaaggaggtactcaaagccagaaaggaaagcgtcagcaagaagaagaaaacgaaggaggcagcatattgagtggcttcgccccggaattcttggaacatgcgttcgtcgtggacaggcagatagtgagaaagctacaaggtgagaa

SEQ ID NO: 9 - DNA, 445 bp, Glycine max
  misc_feature (17)..(17): n is a, c, g, or t
ttctccgcttcacaacncaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtccatcttgtccaaacttcacatataaatatataatagacttaaatatgtttaagggtttgataaatgagggaattttattttagatttttaataa

SEQ ID NO: 10 - DNA, 601 bp, Glycine max
ccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtccatcttgt

SEQ ID NO: 11 - DNA, 722 bp, Glycine max
atttggctctgtggccccattacaggtcttgtggtaggtttcactcttcctttaatgtttgaatttcatttcatgcttttgctcagagtttttactgctcctgcattggttcattttactgctccgttgaatgtatctatccattgtctgatcaatgacaatttatgcctaattgttggtggattcatgtttgtcactcttgctgcttcagccttgtgcattgtgatttagatctgaattcttctttggtaaaaattagtaactgatgtttgcattgtggagtactttttgcggaatatagagttatagatggtgtgatacatgcaggtttatgctttgttcttgttggtttggaactagaaaatcacgtatgtgtctcaatttttcataaggttcaaccatgcgttggtatttggagtgataaatgtacttcaaggtttggcagaagacggccgttcattctggcaggatctcttatgatatgtctggctgtaagtatctgtgacattgattgtttactttgattttgtttttttatgctacattacatatgtgctaagtcaagtcttgtaatttaggtgatattaatcggattttctgctgacattggatatgtattaggtgatacacatgagcattgcaggtttctgttctcatcctctggttcttttcttactcattttatttctttgacttttaaatttcacagatatgatgacctt

SEQ ID NO: 12 - DNA, 626 bp, Glycine max
aataaaagttgaaaactacacttgcacacatgcgcgagaacttagaatctcaatcttatattttttggcttttcaaactcacttttaaaactatggattctgggcaggtactaaaaatggagagtcaagtgttgaagtcgtctgaatatcaactgtatactcccactatacaaactttcctcaggtacttgtttgcatttttatcattaaatcattactatatccatacaaaagaatgataagatcataagaaaatttcaatgcgttatcgagagatccttaatgccattgttcttttacattgttggttcttaggaggtttcttcgggcagcacaagcttcatacaaggtgaaaacattgatcttggggcaatgctgccaaattgtttagttttgagtattagtaatcacttgcttacctgctgaaaaaatgtgcaggaccaaagccttgaattggagtgcctggccaattacctagctgaactaacactgatggactatggtttcttgaatttccttccctctattattgctgcatcagctgtatttcttgcaaggtggacactagatcagtcaaaccacccatgggttagtgccttacattcatatttcccttacatgtgaag

SEQ ID NO: 13 - DNA, 330 bp, Glycine max
agcagtccgatttgatcctctattggtgaatgatgaaaaagaaatggtgaagaaggaatatcaaaaagattttgtggtggctgaggatggcaagtgggtttggctggggtggaaagggcgtattctgaatgccatttctgcttggactcctgcttaagcaatgtccagaaagtgtcttgtaactagtaatctactcttaggtcggttaatgaaaatgcaataaactactatttactatttttctttctccatttgtttccacatttttagatattgctgttcaattcgcttcctagctggtatggcatgacacatttccttctttttttt

SEQ ID NO: 14 - DNA, 504 bp, Glycine max
agcgaagaagagggccgcagctgcaatatcccaaattcatggcaacgccgccaagaagaaacgcgtcgttttaggcgacgtcactaacgtttcctcaagcgacgtcgccgtttccgtttccaaaaaacccgttcagaaacataaaaatgttaaactcgagaaaccggccgcgccggttgccacgccggagaaggttgaggaaagacacgacccgcaactctgtgggccctacgtttctgatatatacgaataccttcgcggaatggaggtactaactagggttttcttttgctcctttttttttggtttctaatttcaatttcgtattagggtttctgatacttaaaacggcgtcgttttggggatgaaatgtgtgttttgtgtgacttaggtggatcctagtaagagaccattgatggattatgttcagaagattcaaagggatgttaatgctaacatgcgcggtgttcttgtggattggttggtggaagttgcaaaaaaata

SEQ ID NO: 15 - DNA, 384 bp, Glycine max
ttctttgttttcctaggaggctctatgttctgcctcctctctagcagcatgtgccacctcttttgttgtcactcccgcgacttgaacctgttcctgtggcgaatggactatgtaggaatagttgtcatgatcatcacctcctttttccctcaaatctactatgtcttcctatgtgaacctcactggcaaatcatctaccttgctgggattacagccatgggactattcaccatcgcaacgatgctctctccaacactttccactagcaaataccgcacatttcgggccatgttgttctgttcaatgggacttttcggcattgtgcctgcaatccatgcatgctttgtgaattggagcaatcctagacgcaacattaccttagca

SEQ ID NO: 16 - DNA, 361 bp, Glycine max
cgatctggaggtgaagagggttgtttccggtgaagggttcacctgcggcgaggtaaacgacggtggactaatctgctggggacccacttcggaaaatttgggaaacattaacatttccaatgtttccgacagttttgcggttctggtggctggccggagcgccgtttgcggcgttttcaacgtttccggcgagttaaaatgctggggcgacccggtttcgtattcggatcctccgttggattcggttcggttagtctctctatcagcaggggctaaccatttctgtggcgtgagaatggataatcacgaagttgaatgctggggtgatttgaattcctcggttgttccaaaaggtaatggc

SEQ ID NO: 17 - DNA, 834 bp, Glycine max
gtatacatcactctttacgtatagatgccctacgtaataatccaacaaaatttcaatgtccactactttaataatcaatttaaatttccagccacaccccacaaaaagaaaaaaagaatacttgaacatgacaaaatcagctggacaaaatatcatcacaagctttaaattcacgtttcaattgggttattttgtatttaacatagcttataattcaaaaattactgacatggttttgaaaacagaagaaaaaaatcagttttaccaaataagcacatgcactacaattagaacagcgtgacattacctgtggccacatattcaggagctgcatagccgtgtgtgcccatcacccttgttgtcacatgggattgactagctgaaggacccagttttgccaagccaaaatctgatatctttgcgttataggactgtagcatcacagaaattaattaagttgaccacccaatagtacacactaaactaaaacgatttctgatgttgaagatagaaaataagtaaaacattcattttttcatcatgctcatagcatggcaacagcaaatatatattgtgtatgcttattttgcgcagaacttaccccatcaagcaatatattggaggccttgaagtctctgtaaattactttctcggatgtatgcaagaatgcgaggccacgagctgctccaattgctatcttaagcctgatgtcccaaggaagtggttgaacagcagaaccccctacaattaaaataatgtagcttttagttgaaaatatacatttaatttgctatttcaattcatgtttgaacttataatacacttgccaagaca

SEQ ID NO: 18 - DNA, 320 bp, Glycine max
gtagtgggacccgcaggaggcgcagcttcaaggaacgcttcggattcatcggcatggggtgctgtggggccacctggggcttccgttccgacgcgctaagtgtcacccaaggagaacagcaacagcaggaaacggatccagagtgcgtgggtccagcaggtttgggttcgggtatgaatctcgcggcggcgttagcggcggagaggcagctccgggggccgcaggaggaggcagtgagagcgccggggacgccgtggagggtgtcgctgatgaggctgctggaggagaccgaggcggagaaggagaaggagaaagagaaa

SEQ ID NO: 19 - DNA, 379 bp, Glycine max
  misc_feature (18)..(18): n is a, c, g, or t
tactttcattctctttcnccattcttgctcttctcccaatcttcatcttcattctcatcaaaagaaagcaaagcaaacccaggctcaaccttcccccaggtaacatgggttggccatttcttggtgaaaccattggctatttgaagccttattctgccaccacaataggggaattcatggagcaacacatagcaaggtaaaataactagccacttaccaacggaggttgtgtctaacgaaagggattagtctcccacaacatagtgaactaaggttcaaatttctgttggaagagatgcctatatttagtgtttgacggagtctcgaacaggattatctctctccgaaggatgataactttgcgaaaaccggaaaaaaa

SEQ ID NO: 20 - DNA, 811 bp, Glycine max
gaggaagaagtttgactcaaaggagaagaacaaaacccgcaacatagacaaacctacttcaaacagtagcaatggactagggtcatcaggaacaggaaattctgatcacaatgagaagctgactaagaaaaggaaggatcaagatgaagacgaagatgaggagcaggagaatgatcatgacaatgacgacccatcagcccagaagaagcctcgggttgtttggtctgtggagctgcaccgcaaatttgttgctgccgttaatcagctaggcattgacagtatgttcttcactcttctacagtataaaacaattgttataacttttatcaatttcttcacgagcttattcaaattgttgttcttattttttataatcaagattttttaatatctggttagatgttagcattatcaatcaatgttcagaacatacatatattcagaattattatgatgactttctcaattactattccttattttaagcgacactttggataaatgtaatgtcacaattattccaattttatgccatgccacgtaattttcctttactgatatgactttgagcttcatgatattgttcttttgctggcagaggctgtacctaaaaaaattctcgatttgatgaatgttgaaaagcttacaagggagaatgtggcaagccatcttcaggcatttttctagtcttttatgctttaatttaatgtaacttataccttttcattcacggagtgtttctgctttatgaattggctgcagaagtataggctttatctgaaaagaattagctgtgtggctaaccaacaaa

SEQ ID NO: 21 - DNA, 386 bp, Glycine max
gtcttgcaaggtcaagaaatacttcctagccaaccatatggaagggccctgtctgttgacgaggcttgtggaaatggtcgctttggactttttgatggtttccaggcgatgagatccagaaatggatggtcttcccatgtgagcaacaattcctcacatttgcatcctcctgttccatctgggcaagtttcatctccgtcatctgtgttcatgttccagcaagctgtcaatccagttttaaactcggattataacaaccaaataggtcaggtgatgggagataaagtccatcagcgagtttcatatgcgtctgaagttaaaggcggaaaatttgtatcaaccccctatgagcctcttctccgtggactatctcaggaaggcacaaa

SEQ ID NO: 22 - DNA, 964 bp, Glycine max
  misc_feature (946)..(950): n is a, c, g, or t
tgtgagtgactttgatgtgtaacacatatacagctatagttagaatttgaaataacaatggataatgaatgtgttagaatttttaaaatctaattttgtcttaattttgtcttaatcttgtctctcttttttcgttcttccttctaggggccctgtctgaagagaatctcctctttctggaggcatggagaacaattgaccgagcgtacattgataaaagttttaatggacagagttggtttaggtatagagaagatgcactacgcaatgaaccaatgaacaatcgagatgagacatgtatagctttcattctcaactttttttatttgtttttctacttgctgcacaaagacaaaacatgctaagatggtaaattctctatgttttcaacatagaaaatcagccatgctagcctttttagttttccaacatggaagtttatattttctagccatcctaatgtcgatttctatcttctataaatgaaggttctaaactgtttcatgataagtcatatacatgattttgacatgtcagaaattgagtaggaatgcatcattctgtgtagtaaaaaatattcctgtttaactcaaattgttgttgctgcatttgtacgcagatacagcaataagaaagatgcttgccacattggatgatccattcactagatttttggagcctgaaaagttcagaagtttgagggtacaattccttcttactctaggttttcctttggcttattttacacattgtcttgggtgcactgcataataccatttgtacaatctagcagaatatatgcttccctacactttaatcccaaaagctatttttttgttgaaggcagtctggaactaaaggcgctctaactggagtggggttatcaataggctaccctaccaaagctgacatgcaacctggtggacttgttgtcatttcagcttcnnnnnctggtacggaggag

SEQ ID NO: 23 - DNA, 402 bp, Glycine max
tttatcttcccactccacctcctcccttgcaggtgcatgtcctcgtacccttcccccttgaaccacccttcgcgctcctcgctcgcctcgtattccctccacccctccgagaacccacacccatccgccggcgccgggaggaggcggaggaaggccgcgaaggccaagtcgtggttgccgcagaggaacacgtgcttctgccgcgggtaacgcgagggtaaggagatcaggaagtcgatgacttggcgggtggcgggccctcggtcgcagtagtcgccgaggaagattagggttgcggtttcgaattcggatcggtcgaggctgccttcgaggttcttccagaggctttggagctttgttatgaagccgtggatgtcgcccacgcagatgactgctctgatt

SEQ ID NO: 24 - DNA, 278 bp, Glycine max
atcgaacgaggctacgctgcgaagcatcatcaaaaagcccctcgcatttcccacctccacgccctccagtacgcttgaaatgcacgcgcgggacctcatatcagggttgctcaacaaggacccgaaccgcaggctcgggtccaaacgaggctctgcggacgtcaaaaaacaccccttcttcgcggggctcaatctcgcgctcatccggacggtcacgccgccggaggttccatcactcagaaggcataaaacgacgccgttttactaccccgccaacg

SEQ ID NO: 25 - DNA, 244 bp, Glycine max
cctcaagctgtgaccactagaactaccttttcatttgagggaattgtgtccaatagaaacaacaaaggctcagtatactgtgaaaaagtgtcaacatcttcaattttcttcatgttggctccagaagctgcaaggtcaagcactgtgaccttgtggccagcagattccaagcgtggcttgagcttataccaacaccatgctccatggcatgccccatgcaccagcacaaagtgcttcttatcaa

SEQ ID NO: 26 - DNA, 755 bp, Glycine max
  misc_feature (707)..(707): n is a, c, g, or t
gaggaccattgctcaggatggtaaagcacccctctaagaacctccgaaccaagcttcacggacactaaataaccacagtcaaattttccctcgatggttccatttcctgaaaggcatgaagtatctacacacaacaaacagtagtaaatttcagcattgaaagtgtagagaacttaaataaataagcacactgcacattgaaagttacaacatttttctaatcaagccattattcatttcaaattacgattgcataacattataagatttttgtgtgttgtagccaacctttacagcattcaacaagcatgcatcgaagcaggcactcaacgaagcctcacatgaagtcgaataaaatgtgtggaagacataaatatgcaaccaatagtctaaagactaaactccactacacatgaaaaatggagttttattaattagctaccggatgaatttattatagagggcaaagacatccacaggtgaaattgaaattaactaacccattccacgaagattaattaatagctagtttctaattaatagtaaccccaggaaacaaaacaatgtgatgttgtgaattgcttaattaccttcagcacgagattcaggactattatccataggcttaggcgaatattccacaatagctaattcaggtctccacgaagggctgttgccggaaaatgcatctgcacaataaataaagntggatccgcaaacacgaatttcattagtcaacgaattaacaagaagaa

SEQ ID NO: 27 - DNA, 325 bp, Glycine max
ctccacatagagcccagcctctcaagcccaagcccaagcccaagcccaagcccaagcccgttcataaaatcctcctgcagcagcacccagtacccagccctctgcgtctcatccctctccgtctacgcctccagcatccaacaggaccctcaccaactggttcagacagcactctccctctccctgaaccgcacccaagccaccaaaaccttcgtggctaactgcaacaaattcagaggcctgaaacccagagagcacgctgcactcaaggactgcgccgaggaaatcagcgacagcgttgaccgcctcagccggtcgctgaagg

SEQ ID NO: 28 - DNA, 336 bp, Glycine max
tctgcacaccttgcacctgtgaagttattgatagagttatttgagatgttcttcaaatggaaaaaagatagagaaattctgctgcttagtggggaactagacctctttgaacgcgggaaagtgatagataagtttgaggagcatggaggagcatcaaaggtactccttgcttcaattacagcttgtgctgaaggcattagtttaacagcagcttctagagtgatttttttggactcagaatggaatccatcgaaaacaaaacaggctattgcacgggcttttcgtcctggtcaagaaaaaatggtttacgtttatcagctcttggtaacaggcaca

SEQ ID NO: 29 - DNA, 517 bp, Glycine max
  misc_feature (508)..(512): n is a, c, g, or t
agccaaaagtgcaggtacagattccatgcactcttaaagttaagagagcaataatttcattattatttctcactgttttatactctctttttttttaacattattccaacatttcaggattgaagaggactggaaaaagttgcagacttagatggctgaattatttgaaaccagacattaagagagggaacctcactccacaggagcaactcttgatccttgaactccattccaagtggggtaacaggtaattattaatcaatgatctgtccataaaatgagtatttaaatatttatgcactcaaaaaatgccttgtgaaccacaatgagtttgagtttgacatgcttttgttgttgttcatttggggaataggtggtcaaaaattgctcagcatctgccaggaagaacagacaatgagatcaagaactattggagaacaaggatacagaaacaggcacgccaacttaacattgaatctggtagcaagagattcattgatgctgtcannnnnttttg

SEQ ID NO: 30 - DNA, 371 bp, Glycine max
tgggtggtgatgatgccgttcctgttcctggcctcaagagttgggaagtgaggaacttccaagctagccatgcacatgagtcaaagatgattgttcctcatgtggaggaaaatgctggtgaatcagggtccattggatcaatggcttatggtgacttgcaatcgttgagcttgtccatgagtcctagctctcagtctagcagtgtcacaagttctcaccgtgcttcacctgctgtcgttgattctgttgccatggatactaagaaaagggggcctgaaaaggttgaccagaagcaaattgttcataggaagtccattgacacctttggacaaagaacctcccagtatagaggagtaacaaggcataggtgg

SEQ ID NO: 31 - DNA, 749 bp, Glycine max
gatggcactaacttggactccacataccatttgtgccaacttgcatatcctcttcttaaagcatctggaaatggaagtattgtgtccatttcctctgttgcaagtcagacaagcgtaggttctggagccatttacgcagcaactaaaggtgagttgatgtaaaattatgtcatcaccggttcaaacatagattacaaactattttgaaagatattgactaaagagattcatcatgtttttttcagctgctattgatcagcttaccaaatattttgcttgtgaatgggcaaaagacaatataaggagcaacggtgttgcaccctggtataccataacttcacttgtggaacctgtaattctcttttaccctgttttatttccttttccaaggactagtcattttctcactatgaagattggttaattatgttgactaattaaaattgagttgaatgagaatggagaagtaaactgattggtcattagtaaattctatgcatgcagatagtattcttctattttgttgatcctgtcaccacctccatccctctagtcttcataccatgttctaaaatatcaatgcataatcttgtgctttgaagttcatacattcatgctccttttaagttttaaggattggtattcagcattataggagtattcagataaaaagagtgtttgtctatcggtcttttagattattgaattgggaaatctaattagcctgcatcttgggatgcctcattgag

SEQ ID NO: 32 - DNA, 465 bp, Glycine max
ctagaactcttccctgttttcaaagataacattccaaaatggattgggcatggtgaagacattggagatgtgctatccatcaatgtcttggctccaattctgctagttcttctgacttttattctctgtcggggtgttcaagaatcgtctgttgtgaattctcttatgacagtgaccaaggttcctttccatcctacaagttaccacaatatagtacttaacatcgccttgatgttagggtttatctgagagactgagatcgaatgataagttattttactgtttgttgcagataatcatagttatcattgtcatttttgctggagcatttgaggttgacgtttccaactggtctccctttgctccaaatggtttaaaagccatatttacgggagctactgtagtcttctttgcttatgttggatttgatgctgttgcaaattctgctgaagaatctaagaggcc

SEQ ID NO: 33 - DNA, 800 bp, Glycine max
atcgccaaggacgccaaggaaaccgtgcaggaatgcgtctccgagttcatcagcttcgtcaccagcgagtacacttctttgtttctcatgcgcgctttcattttttgtttgttattcgcgttaattgaatgaataaattgcgttgttgtttaacagagcgagcgataagtgtcagagagagaagaggaagaccatcaacggcgacgatttgctttgggctatgaccactttaggtttcgaggagtatattgatccgctcaaggtttacctcgccgcttacagagaggtaatttttagtttacatttttttttacctttttcaattagttaaatcagtgtttttaccctctgtgatttctgccgacaacaagactgtaacaggtataaattgttcatatattgatgtttaattgtttatagtacagcatgctgctctagtttcctgcaattgaactctgcttttcactaatgattttttttttattattatggtttatcgtgggccaattgtgaatgttgcagattgaggtaatttttttttctgtgtttatctacacttttgagtgtgtgagtgtgtgtttgtacacattgtggtttatgatttatgatcttttgatgtggcagggtgattcaaagggttcggccaagggtggagatgcatctgctaagagagatgtttatcagagtcctaatggccaggttgagaatgtatattattcgttattattggttgtgttgctggaaatatgattagaattggaatacaatgaaattgacatctgatgttggattattttatg

SEQ ID NO: 34 - DNA, 1226 bp, Glycine max
tggacaaggcattgcgccctgtgcaggtaaggtatttgtttatatgtctgcccatcaatctgtattgtgtactgttgcattgttgcgaaacttgagatgctgattgttgtggggtatggggcagtggtttcctggtcatatagcaaaagcagaaaaagaactgaaggagcagctcaagttgatggatgttgtgatagaggtgcgggatggacgaattccgatgtccacaagtcatccacaggcatgtttctttttttgaattaaagatattaactttgttaagtatccacttacagttgacatgaatgatgtttgtgtttaaattttatcctctgcacccgtctgttgttatcttgaactaagaggcaatttggataaacttatcagcacccacagaagtagaaagtaaaatgaattaaattacttgtataagttaaaatcaacttattgtcttatacacttcgacttatgggaaagttaggaggggaaaaagttcaggtgcataacttgattcattttgttttcttctgctacaagtgcttcttgagatgtatatccaaactagctatgattgacatttgattgaacttttttggttttcctcactttacttcctattatttaatgcctaagaggtttcttttttcatcttgggttttgtggaagaaatatatagttgtttcttgcagttctctattgttggttttagtttctttatttgatatgtaatttttattacaaagtgttacagtcattttacatggtttctttgttttatgaataatagtttatattttgcaccaatgctattttttttaatgtcacataatggttcatattggcacatgaagtattagcaagagtgtaagaccatacatcccagtacaatattaaggccttaggttctagggcgatacattcctagtcttcatcttactgttacttttgcttttgtagatggatctatggcttggaaatagaaagagaattttagttttaaatagagaagacatgatatcaactgcagaccgcaatgcttgggcagattattttactaggaatggcacaaaggttgtcttctccaatgggcagcttggaatggtattgaaacaagatctttttttctcccatggttctccatgctccaaagtttcatgtatagaatgtctgatcacatgttgtgagtacagggaacgatgaagcttggccggttagcaaagggaata

SEQ ID NO: 35 - DNA, 815 bp, Glycine max
  misc_feature (750)..(750): n is a, c, g, or t
cggagactctgttttgttcattaggtatattcattcattcatgcttttacgctttctacaacttttcaaatatcaccttcctcctcatttttaatttttaatgtttctgtctgtgtctgccagagatgaaaagcagcagcttcttttgggtatcagacgagctaacaggcaacccaccaacatatcgtcatcagtgttatcaagtgatagtatgcacattggaattcttgctgcagcggctcatgcagctgcaaataatagccccttcaccgtcttttacaatcctaggttcactattgcttccaataagattgcaaacgcatagatcagctgttttgtcaaatgtgtctttcatgttctcaatctatgcctttcttttgttcgcagggctagtccctcagaatttgttattcctttagccaagtactacaagtcagtgtacagccaccagccatcacttggcatgcgtttccgaatgatgtttgaaactgaagactcaggaacaagaaggtgcctcacttttaagtccatgtatatgatgtatgcgttgtaaaagtatggatgatggggttgaaattaatgccttcatgaagtaaacttgggtggttgagtgtcatatttggaagatgtagttagtttgtcttgtaatttagttggtgcttgtataagtattcatttctcaatccagtttcattaaaattggcattttatgtagcattcctggaataggggatgcttggctggaaatanatattatatatactggttgacaatgaaaattatatttaatcatttcaatcctgctgcagggcata

SEQ ID NO: 36 - DNA, 558 bp, Glycine max
gagaagaaggggtgctctgagaagaacggccttctccaccttacattttgtggatgaaagaccaatggaatgaggtaaaaacaggaaatcatttgggataattcattcaatttttcttattttctctctttattttgttggtttaagctcaatgttttttatgtattgatggcttggtgcagatcaagaaagcgaacccagaggctgaatttaaggaaatttcaaccatgctaggtgctaaatggaagactgttagtgcagaagagaagaagccttatgaggggatataccatgcggagaaagaagcttatttgcaggtgattgcaaaggaaaaacgtgaaactgaggcaatgaggttgttggaagacgagcagaagcagaggactgcgatggaattgcttgaacagtacatgcaattcaaacaagaggcagaaaaagatggcaagaagaacaagtaagttacatatacctccctttggaccattcttctttcttgtgtggttattgatgttttttatacatgttcacaggaaagagaaggatccattgaaaccaaag

SEQ ID NO: 37 - DNA, 386 bp, Glycine max
gatgtttactgcgcgaatttgaagagttgtttcttcctctccatcgcgcttcttctcactctctccacaatcgccttgacctacgtgaaggagaaaacggtgtcgtcagagaaaacggtgaggagttcggtggaggaggatgggtcccacgggggcatgccgtgcttcgggcagttattcggtgcgttccgcgaactgaagcgtcccatgtggatccttctgttggtgacgtgtctgaactggatcgcctggttcccttttttgctattcgacaccgactggatggggcgtgaggtgtacggagggacagtaggggaagggaaggcgtacgataggggtgtccgtgcgggtgcgttggggctgatgttgaactctgttgtgcttgg

SEQ ID NO: 38 - DNA, 375 bp, Glycine max
ctgagttgactgattcacttgacctcttctccggctttgttgggatacttgcatcctcggtgtttagtcaagaactattccttctccattttcactccacagaccatgttggacttgaaggccattaccactggctgctgcagctcatagtgcttgtctcactagtatcatctttggctgcaactatttttcctaacaatttcaacgcggctctcgtgctttctatttcactcatcttccaaggatgttggtttataaacatggggtttatgctatggattccatcttttgtccctgaagggtgtgcggtgaatttggccaagccaagtggccatgaaatcattggagcagtgacttgtagttccaaagaggctg

SEQ ID NO: 39 - DNA, 1444 bp, Glycine max
  misc_feature (892)..(892): n is a, c, g, or t
  misc_feature (905)..(905): n is a, c, g, or t
  misc_feature (921)..(924): n is a, c, g, or t
  misc_feature (1437)..(1438): n is a, c, g, or t
tgcatatgctttagacaatggtgcattgtgtgttgggataacaaacactgttggtagtgcaatagcaaggaatacacattgtggtgttcatataaatgctggtgctgagattggtgtggcaagtaccaaggtaaatgttgcatttaaggatgttgttttcttcatttcattttatattgtcttattacttgtttaaccaatgttttactctcatgcatttataactactgtaggcatatacaagtcaaatagtagtgatggtcatgttagctcttgcaataggaggcgatacaatttcaaatcaagccagaagagaagctatcatagatggtctttttgacctgccaagtgagtttctactggctgtgaattttgtacattttgcagtgtctggttaatcctacatgtcctgtcctattagagtataatttctaatgattcttaagttttaaaattcgattctctagggtgaatatgttggctactcgaaaatataccaatgatgacaacatcagtaaataagagttaatatcattatctgatataccatcacatcagtactagaaaatgtttacactagtggcataaagactatagaactaaaatactgaggggaaaaaataaaacataatagatttaaatttacatacttatggtcttactgtaaagtgctgaagttttagtattaaaattcttaagttcataataatatgctgactaattattggtgtattccacacaggttttgtaaattatttaaatagaatattttttgtaaaaatattgataatgtaaacacttatgtacactagcatcatatcaaatgttaacttctaaactaaatattatagaataaatcaatgatgatagaggtgatgatatcataatagtngcattaaaagggnctagtgatagaatagnnnnagcaaaaacaatgatatgtgcagaggtggaaaccaataaccatataccatacttggtaagagaataattgtgaggtggaaatctagaaagccaatgggtgttactttaactcagttttcatcatttcatggaaactcattaatagaaatagaatcatcgttaatgtgggttggtttgattggtagccttaactaaatggtttgcaagtaccaaaccctggcagaggcttgtggcatgcattgagcttgcttggaaaggagtaacctctcctcccccaaacttctcacaaaaaaattaaagaaattagattcttcaggaattctagccaaccctttaatcatgctaaaaattatattttatgaggtattgttcaaacatattataccaaatgccccatgaagcttctcaggacagttgtaaaagtaatctaagtaatctaattaacatgttggattgtagataaagtcagagaggtgctgaagcttgatcaggagatgaaggatctagccaagnnagttga

SEQ ID NO: 40 - DNA, 731 bp, Glycine max
ggtgcaactctaatggttcttcagattctaccaccacaagtgatcatgatgaagacagtgtccaacctgcaaagtaagcaaaatatacttttcttatatatttctaaaaagataaattaatataagagtcttgttaattaatatcttagaacattgattaagaaactaaaaataaaaaatttatcataaaaattataagagagcctaaaaaatattatgaacaacacaagttgacacatttgaattgaaaattttatcttcttagtttattaaccaattcctaagatttgtcttaatataataaatgaaaactgaaaagtaagtaataatgatgctaatggatgaaaattaatggatggcagggtacaagtagtggggtggccaccaattagatcttttaggaagaacagtctgcaacaacagaagaaggtggagcagcagggtgatggaagtggaacgtatttgaaagtgagcatggctggtgcaccttacttgaggaagatagatctgaaggtttacaatagctacccagaactcctcatggccttgcaaaatttgttcaagtgcacatttggtaagaaacatgcaccaacaaattaacaacaatctttttgtccttttcttttcatgtttttataactattaagaaatgaaattgaaattacatgagcttaattatgaatggtgatttatggttaattctgatatatatccaggtgaatattcagaga

SEQ ID NO: 41 - DNA, 721 bp, Glycine max
agatgataacagttctactgccaactttcagtcagaatctaataatgcaaaagaagagagattgatagatgagagaaaagaagacgatcaagtgtcacttgactccttgaagggagataatccatctcaatctgaaagctcactcagaaaggtaagatgagttctggtatgtcacttcagctgactgaggttggaatgcaccatttggtttggttcgaaccattgttgatgtcacacatatgttatgacttttattagtagacattgccgtttagccttcagatgtttgaccagttgtgctgggaatgcaattacttataggataataatatatgcaaaacctgaacagctggaataggatggttacacatgttgtataatgctctattagacatttagtttgaatggaatattggaggggatgagaaaaaattatctgacaaatgatatacatgtgtcacagagaattggaagcaatgtgaccaaaggtgataatctcgacgataatactgtagatagtgccacatataatgtaaaatcttcaaatgttaaggaaccagttagatcaccaacaagtcttgtgtttggttatctcaatcttttctctgatggagtggtaagttatattttttcctttgattggctgtcaattgtaatgaaggaaagtttttgatgtattcatgcaaaatatattaatattgcagcataacttcacctgatg

SEQ ID NO: 42 - DNA, 387 bp, Glycine max
cccccttccttccgcagcagtcgggcgcttctccggcggttcccaacggattcgccatctcgctcgccggaccgcaggggcagatcgtcggaggacttgttgccggcgggctgatggctgccgggactgtttttgtgatcgctgcctcgttcaacaacccggcataccacaggcttccgccggaggaagagggcgcctccgccggagatggacattcgccgccagtctccggcggcggagacagcgggcatggacaggcggagtcgtgtggaatgtccatgtacagctgtcacttgccctctgatgtgatttgggctccaacggctagaccaccgccgccgccgccgccgccttactgatcgatcaatcacacgtcgagtttctgta

SEQ ID NO: 43 - DNA, 305 bp, Glycine max
tcacactctgatgaaccacctccaatccactctccccaaagcatcaaccattctccaaaccccaattcgccaacaccactctctctgtccttcctcctccctcctcctcatgccttcatggtcctcttccccttctctcccttacatcggcgtcaaactcgttacccatttccctcaaaactcttctatcaacttacccggcgtgcagggaagctatgtcctcttcagttccaccaccggccaaaccctagcttccatggactccaccgaactcaccctttacagaacctcatgtgtctaaggct

SEQ ID NO: 44 - DNA, 741 bp, Glycine max
gggcatattgctgcgttgcgtaaactggatgatcctaaaataggtatttattccaaatttattattttcttctaataatttactgtgttcttttggtaaactcttgacattagcaaatattgtgaatgtgaattgaatgattaatttctacaagacagtgataaatttttatgtcgtgttactttagtaaataatattgttgaaactttggtctttatcgggcccaaagtatgatttatgtaaccgacctcatcacctagtgtgataaggttttgttgtcgtcatcatattactttggtaaaattttgtactgtttgcatatgcaggttgtgaggtttataacttgggaacaggaaagggaacatcagttttggagatggtaaacgcttttgaacaggcctctggaaaggtaacagacttatagctttatgtctgttcttgtatctactatccattatattataaaccctgctgcaattttttggcatttttatagaaatgcaatttggatctcattctggacttcaaatttgacagtgtaaccattcttctgacatactaaatctctcttatcagttgtgctctgataagatacaatgaaatggaagaaatgtgaatcaagctcaaacaaagtagaatttttggactgtcaattttcatgcaatatgtcccggtgcattcttgattcttttgaacctcaactacatgttttgtccctctgactggtagacacaacatgaa

SEQ ID NO: 45 - DNA, 105 bp, Glycine max
ggagattcaattggtgtcctttgttggcttgtttggagaccgtagatgggactttatagctaaggtatcaggtttgaaggtggcgggagaaagtaaaataggcat

SEQ ID NO: 46 - DNA, 309 bp, Glycine max
gttgaagggtttgttgggatgtgttcaggttgcatcatgtttagtcaacagtttcatgcatggtcacacggcacaaagagccggcttcccccgctcgtggtggcgttgcaagaggctggtgtgcttgtgtcacggtcgcaacatgccgcacaccaccggccaccgtataacaacaactactgcatagtgagtggagtatggaatgagtttcttgataagcataaggtctttgaagccttggagatggtattgtattttaaaacaggggttaggccaaggtcatggagtgagactgcctctgagtggatt

SEQ ID NO: 47 - DNA, 438 bp, Glycine max
gtgatcagagaagagggtttgaggaagtatggggtggtgaagttcggaggagtggcgtcggagcaggtggtgagggagagggtggagaagctgagggagagtttggagaaagatgggtttaaggttgttggagatttcttgttggggaggtacaaccctccttggacaattcctgcgttcaggaccaacgaggttatgatcccagtcgaatgaactcgaagggtgttacttaatgaataatgatatacagatttcagtgctttctgttacttctgcatgatgttaagttttattgttgttaagaagttgttgtagtgctgcttcttcttgttatgttcaaattaaatacacataatgaatgtttttgatgtgccaggtttttgttcatgttttgttgtctgcttggttatgattttggtgatcgttattgcgctttaa

SEQ ID NO: 48 - DNA, 504 bp, Glycine max
  misc_feature (353)..(355): n is a, c, g, or t
  misc_feature (361)..(379): n is a, c, g, or t
  misc_feature (386)..(388): n is a, c, g, or t
  misc_feature (393)..(395): n is a, c, g, or t
ggagctgacaccccagcagctgagccaatacaacggcacggacccatcgaagccgatctacgtggcggtgaagggccgcgtctacgacgtcaccaccggaaaatccttttacggccccggcggcccctacgccatgttcgccggcaaagacgccagcagagccctggcgaagatgagcaagaacgacgacgacatctccccctccctcgacggcctctccgacaaggagatcggcgttctcaacgactgggagaacaaattccaagctaagtaccctgtcgttgctcgtgttctcaattaatcatatgataacctaagtgtattttgtactctatcatgtgagtggcatgatnnntttctnnnnnnnnnnnnnnnnnnnggatggnnngcgtnnnggggaaggactgtaccgaatttaagcccgaaaggtggttggagaatcgagccgagagtccgtttcggtatccggtgtttcacgcgggtccacgaatgtgtctggggaag

SEQ ID NO: 49 - DNA, 398 bp, Glycine max
caaaatagtacttcacaggatttgccagaaccacattcacacagagataaaatgtataaagctgtatatagaagatcaagatcacatagggctgtgactaatttagctgacagtagtggccagggagaatccaattcaaatgggagaaacagtaatttcaatgctgcagcaaacttcagcaatggcacatatgaagctattcatacaaacggatccttagagttggagcccacctcttctgacccaaattatgagcggaataatctcaaagtgctgcaaggaccgggaaattgtattgttaaaagtccacagaatgtttccacaagtggaggacaactcacagaagaagaaaggtgttctaattcaaaattgactgttggtttgaggtccactagaaa

SEQ ID NO: 50 - DNA, 500 bp, Glycine max
  misc_feature (482)..(487): n is a, c, g, or t
  misc_feature (490)..(494): n is a, c, g, or t
ctcttttttctggacactactaccctcattctcaccgccacaaccaaaaccacaaccgcaacacatacccaaatcggaaaattgcttccaccattttgattaaactaataataataataacagcaattaataaataaataaataaaaatagagtgcgaaatgaaaagggtaccaggaatggaggaatggtaacggaatgaacaagttgatggtgaaatttggtaatggaattgatggaatcgtgtttgagttgttgggcgcaagagcgccaattggagatttgatttctgatgctaatgcgatttctagtggcagcgctactgcaattgctactaatgtagaggcatggctgcaatttttcaatttggaacgttaatagtaatcgttgtcactatgtgtgaatagagtgaattgaatgaaagacttacgcgaagagaaagagagcggaagtgcagtgtccaaacagacgccatgggaaacgnnnnnncannnnnactcaa

SEQ ID NO: 51 - DNA, 433 bp, Glycine max
tcacctcaaacagataatccaaagcctttctctcaaatatacaaacgaaggcgtcataacttgaactccaacaactctaatgtttctggagattcagtccgaaccagccaggatccgtgctcctctacaataactaccgctgcaactgcactcccaaccgcaactgttgctggcacggccaccaacactgcaccgaaaaaacattttctgtctgcactggtggagttttccctgctagaatcccttgaatcaaaggacaaccttgcttcaattaaggcaccggattttgacactgaaaatctcgagtcatccatgcctccaagttgcgcaaagttcatcaagcaaatgcagagtgagatgcagaagctttcagttgaaaaggagacgataaggtttgagatgatgagtgcacaagcgatgattaacattctcc

SEQ ID NO: 52 - DNA, 592 bp, Glycine max
ataaacttttgttctcctatttttgcctttactgtgttggattatccctaacatgttcttttcaattccctttaaaatcagttacgagatttcatccaacctgttatcctcaactggagtgaggatgaggtaatttatatttaataaacacttctctctattttttctgtaattaaaattcttaacactcatgttgtagtctgtgactgacttaaactggttacttgtaggtccatgagctttttatggtatttgacaatgataatgatggaagaattgacaagaatgactttctttcatgccttagaaaaactcctcttctcatagcattttttacacttcaactgcagcaaaaggaatttgaaggtaatggagtgatagaaatagtgtgatgggtggatttcgcatttgataaaatactctggctttttaggtcttttgtgtactagaaagaaaagaaatgggtagggatacctggggaatacatacagtataggatgcagtggcctcattttttttttcccttttctttttttcatttttttccccttgctttgataaatttcccgaaactatttggccaaaatctggg

SEQ ID NO: 53 - DNA, 333 bp, Glycine max
ctcgccggcggcggtggggattatgaagagattgttgcggcggtgttggtggagaaggaaggggcggtcatcaaacaggatcacactgcaaggttgctgctccattccatagcgccacgctgccacttcaacaattttcttgcttctcaatctccttcaacttgaacattgtttttttttctctctaccctaaattaataatatatatatactatttgagagtggatttggatgcacccttacctgacctcaccctgtaataatgtgattgtcacggatagacatggtgatggtctataataatccccttcctatttatgcctatgtggaggg

SEQ ID NO: 54 - DNA, 1078 bp, Glycine max
tttctttcttgcatattttctctcttgtctttaaaataaactttcaatttcatctctaaagttttattatcttctaaatagtttttatctccagtacattagaaatcattgatgagtattataatactatccatctaatcgataactgaatgttgtaaaaaaaatatcaatcaatttagagattaaactgatgtatattctcagtatttaaggataatatatgagagaaagaataatgctttagggactatatttctggtttattcgttttgtctttatatctaatttgttccttgttttgtgttgttaaacaggctgcaatctgaattgatggctttgatggtaagaaaagcatatacaattggctttggcataattgaaatcaataatgaatgatttaattttgtctagttgtgagaaattatgctgatttttgtttggatttgttagatgagtggagattctgggatatctgcgtttcctgaggaggacaacatattcttctggaagggaacaataacaggaagcaaagatactgtgtttgaaggcacagagtataagctatcactctcctttcccaatgactaccctttcaagcctccaaaagtaaagtttgaaacaacctgcttccaccccaattttgatgtgcatggcaacatatgcttggacatactccaggttatttgatgtgacaatttgtagatcaaatattaattgtgttcttccattcattgtcactctatattctgatgtgttcttttcttgtgatcttttgtttatttttataggataaatggtcatctgcttatgatgtcagaacaattcttctttccatccaaagtctgcttggaggtacctcacttgaaaaagcactcaatttaaatttaaatgctctctcatgtttgttttcttttttgtttttgtttcttacttcttctttttttttgtaacaatttagagccaaacattagttcaccactaaaccaacaagcagcacagctttggagcaatcaagaaggtaacaatatacatctttgaaatattaatgagtttgaatgtttaaagagctaaaatgagt

SEQ ID NO: 55 - DNA, 1306 bp, Glycine max
aggagtggagtctccttaccggcccggtcgccattctcggcggcgtagtcgtcgccatcgccgccgcaaacgtcatcttcgtcaagaatgtaagttcctttcttccactctccaaatcccatcactccctttgagcacttaattcaaccccttattggtttgttccaaaggagcgattttgattggtttttctggatttgggtgctgattaatgatctgggtcttcagtaatttattgaaattcttagtttttttagatttacttctgtaatctcgctagtctctgatatgctatctctcattagctaatttgtgttcatttaattcattttgattcttgaatgaaaatgaaatttttaagaaagtttagttggttgcctccaccggttggactatggatgttaattgcttgctcctgatcctgaagattagggattcctccgtataaaaataaaattaaaggcatattaattgggtttgtgtggagtcccctgtttgttttttttattgattaagagctagtactgggctgaagtattaatcaacttagctctatttttttgaaatggattattagatgtcataacataggaagacaagagaaccgcgtttgggtttcattcttgattttttgttgttcaaactttaaggggtccttcctcttccttatgtgtagcatgtgtgttccctggggtgttttgttggtgtatgggagtcaattgcgtagggttttccagttaatataaagaagacagaagttttctactcaaacatattatttcactttgtgataggccaaacaagggaccatcgaatttatagtaacaaccaaattatattctactaggtgaggttgcttagatgaatcaaccaagtccaagactattgaatcaaaaaacaaattctaagcaaaaatcatttgtaagaattgctttctcaatggtttgtcctaatatttagaggttgagttatatcactcagatcagtttttgttgcatttttctggttgttgttttaaaaagtgaatatattattaagtgattgtaatttatttttttattgtgctttacaggatcctttcctcaaaccagaggagaggaagtatgaaaatgaacctgctaccaagtaggagaaaagagacaacagaagtttgcgttttgatgtcttttaaaccctgatttatgagctctgtatactgttttgcaagacatgctctgggtagttaataagattgagattctgaatggagtctggactctggagcacgggcccttagtttagaactaaccttccaatgttctagaaa

SEQ ID NO: 56 - DNA, 493 bp, Glycine max
  misc_feature (455)..(456): n is a, c, g, or t
  misc_feature (485)..(488): n is a, c, g, or t
ttgtctttctgatcaacagcacaattttcacaaaacttaatagtaaagtgggaagaaacgtactatatgcactaaactgtaatgtaccgaagaacagccccgcggagcttctccatatattctgcagcctgtttctgcaacaaggagaataacttgtaaaacttgtcatgagggaaaatacaagcactaatgtgaacatcgcttacacaccaccacaggtttgattgtagggttcattattcaacaataaatcatgttccttcaatcctaattcaattaatagaaatgtgctactagttgagagcttttatttcgtttttgagaagtttctttaagtgctaataattgagaagtttttgtcaaacaggacctacaaaggattgacttattggttacaactgagtgatactaggattattctgcctcaatattggcaattccactcacagtctcannttccactaccacaaggaaaacgcatttcnnnntacga

SEQ ID NO: 57 - DNA, 404 bp, Glycine max
gtccacgtttcctccatcccaaggtggaacacatcccacgcgccacctgatagcgcgtggaacgcgtatcgcaatttcactgggtgccgcccgggaaaaacatataacggtctttcgaatctgaaaaactactttcattattttggctacatctccaacgtgtcctcgaagtcgtcgaattttagcgacgatttcgatgatgcgttggaggcagccgttagagcctaccagaagaacttcaacctcaacatcacaggggagctcgacgaccccacgatgaaccaaatcgtcaagccacgctgcggcgtggctgacatcatcaacggaaccacaacaatgaactccggcaagacaaacaccacggattcaccgacgttccacacggtagcgcattattctttcta

SEQ ID NO: 58 - DNA, 590 bp, Glycine max
  misc_feature (534)..(539): n is a, c, g, or t
gtggagattggctatctgaatggcctctttgtgctggcacgctccattggtctgattgggtaagtttaaattaattataccatttcatgtgaacaacactttttagacattgttgtagttttagacctttgtggctattttatccacaattctctagtggacttatgatccaaagagttatacattcagtagatggccttcataaccactactactggatatgctgtcgtttgtgaatcaattgaactgagaatatccatccatctaaaaaaaaataaaaaattatggcttggtctcattcattatttaaaatttcaggcacacctttgaccaaaagcgattgaagcaaccactttaccgtcacccatgggaggatgttctctacacaaagtgagaaagttttgtgcgactgtaagaactttggcatgcttcaaattagcaatcttttgggaaatcatgcacatctgaaatatgctggagtggttttgtagctgttagactagtgttgtacgatctattggtgaaaagtcatcnnnnnntttgtaacttgtattaaatttcataaagagagaacttggtcatttttaaaa

SEQ ID NO: 59 - DNA, 401 bp, Glycine max
ttcaaatagatccacagtataggatgtttctgtggtaatgtgctttcttctttgcagtgctctactttggcaccgactcatgggaagacatgtactctcaactaccttttctgggacaaacaagataagagcttatgcacactgtgcaaagcaatccgtgagtgaaatatttttatcacttcgatttggacacacacacacacatatatatatagggtgtgtttagataaagtcgtcagtaagtacttataagaaggtaaaataaattaagtttctccaacaagttaaaattaacttgtttataagttaaaatcagcttttggataagttaaatgagacaacttctataaaagttgaagtacaaaaactgattgaatttctataaaagctttatacattct

SEQ ID NO: 60 - DNA, 379 bp, Glycine max
gttcttggttcaaaaaggggttagagaagcctaccattactcagaatgaagatgaagaactggctcctctcgatgctgatggagtatttggagcttgtgagaatggagatcctattgaaccggcaaaaaactcaaagccttgtaataatttaaatgcttttgacatcatctcctattcctcgggttttgacttgtctggtttgttcgaggagaccgatcgaaagaaagaagagcggtttacatccgacaagccagcctcaatcatcatctccaagttggaagaaatttgcaggcgtcttcggctgaaagtgaaaaagaaagatgggggtttgttcaagttggaaggttccaaggaaggaagaaaagggccattgggtat

SEQ ID NO: 61 - DNA, 396 bp, Glycine max
ggaggagcagtgtccctcttgaacgtgctattgttaaggacaccaccggtgactatgagaaaatgcttgtggcgcttttaggacatgatgatgcttgacatactcctttgtgtttgtgtgtgtgtacttgtggcagagttactatatagtgtgcagtgtactgctttgtggttccatgttgttgtgttttctggccattattgtcttcctttgttgaataaaatgaaccactttggcacactttggtgggtttttgaagcccctagaattgattgagtgtcaaacataaatggaatcctgcaatatatatgtggttcagattttgtaaatcactagtgactttagggtcacttttctgaagttaaatatatatagagagacaactaagtttggttc

SEQ ID NO: 62 - DNA, 813 bp, Glycine max
ttcaggtttgattttgctttgcttgtccatcttgatatttactattagttttgcacaaggattatggttgttttcaacttgctgattgtagctaaatggattttctgaatcaccacgtgatatttgtctgattgtaactaaattaatgcatgtgggagtcctgaaatagtacatgttttgttgagtaatcgcctgagactgctgaaattaaacattacaaagcttgttgtgccatttaatgtgcctaaaaactgcaggttgcatttaggaattaggactaaggtaggtgttgagaaatgggagcttataggtagatgaacagggattatttaatatgtaaaagttgtctctgtaggatactcctaacttcagatatgttggcttgaacagtagttttcatgtctccattggcagattatatactggcgaaatttttgttattgaaaactgaactaattccactgtttttaggtccttttgtcaatttgctcattgttgacggatcccaaccctgatgatccacttgtacctgagattgcacacatgtacaagaccgacagggccaagtatgaggctacagcccgcagctggacccagaagtatgccatgggatgaccgtattgagtttttagctgttcaatgaagctgcaaaatcataatttatgtaaaagaacaaaagatattttgaacggaatttgaatgctttcttttattattagtgaaactccacaatggtaagaagagacccggttgccaatttgtgaatattttctttgctatggaagaatgtaatgttatgcaaacttttctgca

SEQ ID NO: 63 - DNA, 1224 bp, Glycine max
cttttgatgagccagactatgctctaattgatacactcttttcacttgcggaagcctacttgtttgctcaactggttgattttaaggattgcaatcctgacaagattcaggagggtgttgagtgagtcttaatctggattgcataatttttccttttgataattttaaatgccttttatttttataacaattaaatactaggacaaagcaatttttgttcattcaaacacaaggcaatcttcgatagttttttgaaagaatctttgtatgttatcattttacctcccggacagatttggcctctttatgtgtatgaacatacttacctacatgtgagctgtttagaaaccatccagcagccagtaaaatggctaaagcctacatgtgagcacaccatgatacatatatgatatatcctttaaatattgtccttccagttatgctcgcatgtacaaagatgttcgagctgcagttgacttgtgccaccgtgatggaacattgaagcaaatggttgctatagaaccaaagcggtatggatataaaatcactagcctatcaaagttagaaatggacaaacacttattatgtttgcaatgagatattagacttttgatgtgctaactgtttcttttagaagttgcgctcttaaattcatatgttgtctatgaattgttaatgaacttactctgattgtcattttttcattgaattttatctcaggtatattaatgaagactcctcaatagtgcccatgcttgaaatgctcagagactctggacaagcaacgtttttagtgacaaataggtagttatgattttacctaaacagagggaaaacagttatgagtaaataatcaaactatcctgtgctttttaatgattgatggaacaatcactgtatgtttgaaatacattttagcaccttttttttaaactaacatatagtgccaagtgggaaaggcatgttctaagatatcaaatgtacaagaaaagtaaaataacgtgagttgaaagattattagataaggattgaaaaatattttaaaaattatagtgaattgatttgacagaaaatgttgaaaaatgttttctcatagaatgctagttggtttcattctctatggacattttaacttggatttttcacactttcgcatgtgatttgcagtttatgggactatacaaacattgtcatgaatttcctctgtggatccagtatggcaga

SEQ ID NO: 64 - DNA, 332 bp, Glycine max
acaaggtctgggagtgaaccctcccgtgtacgaggtggacgaggaccacgaagccgccgttgctctccacctgtccccgcagggcgccgaaacggtgcagtttccggcggtgttcctggccggcaagttgttcggagggttggaaagagttatggccactcatatctcaggtgaattggttcccatcttgaaggatgctggtgccttgtggctctgactcttactctagctacctccatcttttttttctacatctgctcttttttttttaacctattttctcgagtgggaaattaattagatatagcgaaattaattttcttaggttcaat

SEQ ID NO: 65 - DNA, 393 bp, Glycine max
  misc_feature (384)..(390): n is a, c, g, or t
gcggacatcaagcggagcaccagcttcggctccgaaaccaccaccctaacggcctcctcctccgcccacctccccgccaacagcaagccccacgcgccctcctccgacccccgctgggccgccatccaccggatccgatcggactcccccagccgccgcatcctcccctccgacctcctcttctcccgccgccttggctccggcgacatcagctccgtctacctcgccgaactcaacgacggctccctctccgtcatgttcgccgccaaggtcatggacaagaaggagctcgccagccgcagcaaggagggaagagccaagaccgagcgagaaattctcgaatcgctcgaccaccccttcctccccaccctctacgccaccatnnnnnnnaaa

SEQ ID NO: 66 - DNA, 638 bp, Glycine max
tgttgttttggtgctcttgtgtggaggcccggttgatatcacttcggctaagtttgatgataaggttggagggatcttgtgggctgggtacccgggtgaacttggaggagtggcactggcccaggttgtctttggtgatcataacccaggtaaattttctactacacttgtctgagaacaaatgaacacccataacaaatatacatgaggttagaccttgctaaaaggtacataaggaggggaaaaaaagtaaacacttggtaaatttagaagaatgtttcttaaataaatgagcaaacttaacaatatattctttagaatttgattttcatatactataattgtgtaaataactaaacatctttacgttattaatcaattaattaaaaataacaaagttttagaggataaagtgacggatagcaaataaactgttttgatgtacatccataacaaatcatgtgttaaaatatcaataattaattttcttatcaataattacttttgcccttacccactttagaaaagtcaaatgcaagaattttaaaataattatcacaaaaattaaccatcttatatgataatttgtaattgaatgaaattgtaaaaatagtacactatcaatatattttaatttt

SEQ ID NO: 67 - DNA, 438 bp, Glycine max
cttaactacgtccaggtcacctccactgggccccacctttcctgcgctcaggatcagtacgaggtggagcagtggctcgctctcgacacttcgccttaccagctttgggccgttaggaaccactgccgctacagtttggaccgggcccagcccgtttcggagcgccccggatccggatccggatctgcgttctctattttgaatgcacgagcctgaggaaggtttttgagtcgctggtgttttatgtgtgcttcgtgtatttatatttattaatattgagaaacagatcgccatagtacttgaattggcatcgggtttgggttaacaacccgttttgtctatgtagtcttcaataataattggccctatctgtatggcctcgatgatctggatatgacagtactactatatgcttaatgcctcaatggtagccaacta

SEQ ID NO: 68 - DNA, 573 bp, Glycine max
tgttcattaaggtaagtatttgatatgcagtattgcagtcaatcaagttatatcttggacgccagctgatttgttatcatcattttcaggaatctagagtttctaacattaggaaggggacagatagctgatacttttttccatgctttagctgattgttctatgttgagaagattgaatatcaatgattctatacttggcaacggcattcaggagataactattaatcatgacagattgtgtcatcttcaattaacaaaatgccgtgtgatgcgaatagcagtcaggtaaatatgattttgtggtttaactgacatttagttatcaccttgctgatcaattagattgtggttatttattctttttcaggtgcccacaacttgaaactatgtcgttgaagcgcagtaacatggcacaggttgtgcttaattgtccacttttgcatgagcttgatattggctcttgccacaaacttcctgatgccgcgatacgagctgctgcaacttcatgccctcaactggtctcactggacatgtcaaattgttcatgtgtcagtgatgaaactctgcgtga

SEQ ID NO: 69 - DNA, 358 bp, Glycine max
cattttctactctagttttcgaaggggttttgtggaagaatcaatggtggaccggtggtgatgagtttaacacaccagttataaaaattaatcagtgaataaggaacctggaaacttccctgcatttctggcaaaaggaccaagaagtctgagtagcctcacagttttcaagatagctaattggtgttgaggttttccccactatgccggtgggcactatgaagatttatacattagcaaggcagtggttcatgaaaaaataactcaatataaaagacagtaaaattgtttgtttcaagattttattatgctacatgatgtaaattattcgtagctgagaaacagttagagctattcc

SEQ ID NO: 70 - DNA, 469 bp, Glycine max
  misc_feature (417)..(423): n is a, c, g, or t
  misc_feature (425)..(439): n is a, c, g, or t
  misc_feature (448)..(449): n is a, c, g, or t
  misc_feature (458)..(462): n is a, c, g, or t
atgactgatgcgttttgagggggacatctaataattagcagggcttgtgttcatttgatgattcaatcattaattttatacttcatttttttctgccctcctgcccttttgacttaatggctaggaaaattatttctatgccagcttgatatcatattcacgtgttgcatatatgccaaaaaaaaataaaaaatttgtatgcatgttaatgaaacatccaaaatgactcttcattgcagtggcatcggcgatttagattattcattgtaatgatcttgttagcttgcttattgtaaggcaataaaagaagtctattataaagttaatttcactatttcagtgcaatcagtgagtgatataacgccatgccatgacccaaaagcctcgtctgtatagtgtgctgaactcttatcactnnnnnnnannnnnnnnnnnnnnngaccaaacnngtgaaaatnnnnnacatata

SEQ ID NO: 71 - DNA, 846 bp, Glycine max
  misc_feature (223)..(223): n is a, c, g, or t
  misc_feature (262)..(264): n is a, c, g, or t
  misc_feature (273)..(274): n is a, c, g, or t
  misc_feature (284)..(286): n is a, c, g, or t
  misc_feature (296)..(298): n is a, c, g, or t
  misc_feature (302)..(305): n is a, c, g, or t
  misc_feature (346)..(347): n is a, c, g, or t
  misc_feature (378)..(379): n is a, c, g, or t
  misc_feature (798)..(800): n is a, c, g, or t
  misc_feature (805)..(810): n is a, c, g, or t
tgatgcttattattgatgcggtgttggctggtggtagagcaggagcatctgatattaaatactgcccattgatgtatagatggcatggaacaaggtacttgggtgcagcaaatggccttgctggtatccttcatgtgctgctacattttccacttccaagtgaggatgctgaggatgtcaagggaactttgtggtacctcatgagtaagcgtttccctcacantggaaactatccctccagtgaaggtaatccaagggatannntagtgcaanngggtcatggnnngactggcatnnncatnnnnttgtccaaagcagcagaggtaaattactttccaaaatactnnaatcattccatgttcttcataatgcatgtgnnttaaaagctttaaaatagaaacaccaaacttagatgcaaatgcagttttcttccaattaaaattgaagttttactattaactttaaatgcaaagtaaggtgaagctacaattcatattagaaaataacaccaaatacacatgaataaatttacttgaataattagtacttaatgtccacctttcctaaggtttacttagataactagtgctaaatggtgatatttgttgtactagttactaaagtgaaatcctctgttattgtattaagcttttttctataaaagaaaaacattatcagttctccaataggaggggcaaaatgcaaaaaatgctacaaaggaaacttttttccttttccatttccgttaacatggcagaacgtgtgcttcaagtatcaatgtaaatggttgataaaagnnnaccannnnnngattatgtgtgtttgcacggtatttcatacatgaca

SEQ ID NO: 72 - DNA, 714 bp, Glycine max
  misc_feature (582)..(584): n is a, c, g, or t
  misc_feature (594)..(596): n is a, c, g, or t
  misc_feature (682)..(687): n is a, c, g, or t
  misc_feature (693)..(698): n is a, c, g, or t
  misc_feature (702)..(711): n is a, c, g, or t
ttcctctaactctcactcccaaacccaaactcaataacagtaaccgtttttcgttcttcacttcctcactctctctctcttccaccacactcatggccactgctcacaaggtcctcgttcccatcgccgacggcaccgagcccatggaggccgtcatcatcatcgacgtcctccgccgctccggcgccgatgtcaccgtcgcttcctcctccgccaacctcgccgtccaagctctccacggcgtcaagatcatcgccgacgcctccgtctccgacgtcgccgccaccgcctttgacctcgtcgctctccccgtacctcgcaatctctcctctattttaaaattatttcgagagattgcgtttatctgttaatcaccaaattacagacgttttcgattaattgactggtcattagttgtaaatcattaattgattgcgttgatctgttacatcacgaattgattcattcagtggttaatttttgttaatcagtccatggaagtgcatttttaaccatctttgggttcacgaagagtgtcatttttataagaaaagtacataatgcttgtactgtggcactggnnnttttgtaaannnttttttttcaccttcgttgaatcacaaactgcggtgaaagataatgatttctgattggttgacactgtggaactatttttagaaannnnnngactannnnnngaannnnnnnnnntac

SEQ ID NO: 73 - DNA, 371 bp, Glycine max
gttgtggcgtagttcttgaggagcattgcagcatgagaagatgatgagagattgttctcactgaattgctattttatagtggagagttctcacaatggtgttaatgtttatggtttgagcatgtccatgggtgaccctaatcaggtatagttgtattgtattgtatgatatataataaactttctggcaggttaggttttttgagatcttatctgtttcactgtttgttgtatgcaaatgcaatctctaatgatgtccaaagtgtttggtatatgcttcggatttgaatcctcaaattatatatatgtcttcaagacaaaaaaaaaaaatgggcattttctttttcctttgaaaaaacttccccccataag

SEQ ID NO: 74 - DNA, 454 bp, Glycine max
gtcattttagatccacccctcaagttcttgccttcgttttccctttttatttgttataacaataattatgaaatttattgtaaattgcattgttcttttgtccccaggttttgaatgcagcattgcgaattgatgtggacaagaatactaagaaatcgcttactcgtgtcgttgttactcgagctgatattgatatgaaagacataaaggcagagtaccataatctatatggggtttctttaccccagaaagttgaagaggttgctagagggagctacaaggatttcttgctaaacttgattgttagaggaggctaattgaagaaattgaaaagagaacaaaaacttggaagatcaaataaaaaaggaaaattttttcctcccagttttccttgatttgttgctgatccttttcattgcatgatatttcttcatcttgtattactgtcgtcaca

SEQ ID NO: 75 - DNA, 782 bp, Glycine max
aggagaatacccacccaaagctgttgctaaggtattcactgtgtgttgtagtatatttttcttcctttctttttttgttattatgccattttccttgccgaggtgttgtgtgtggacttgtttgaaataggcctatgagttaacaaactaatcaaaattaccttagattagtcacctgcagaattcttatatcttttgcagttagtaaatgctatgcatgaggccaaaacttgaatctaaaaccttgttatataattccctttgggagaaattttattgagtgatttaattagttggacggcaatggctttccctgtagttttgttctctgtttttgaacttgagagccagtaacagatatcgtaacatcactaacatgagagcagataaatacttaaatatagtagtagtatacactttttagatggactgtcttaggaaccataggcacccaggatagcccttggaaaaattgactaattacttaactaaggccaatattaatgtataacagcaagatatttcttaattattacagatggccgctgttgctgccctgtgcgtgcaatatgaagctgatttcagaccaaacatgagcattgtagtcaaagctcttcaacctttattgaatgcaagacatgggcctgctggtgaaactccaaactaatctttgtctatatttatatctgtatcaatgagtatgtgcataagtgtgcacgtgagatataagaaagtgactgcttcagaagcggatggaaatttgcttgaacatgtttatatat

SEQ ID NO: 76 - DNA, 1105 bp, Glycine max
  misc_feature (622)..(622): n is a, c, g, or t
  misc_feature (1089)..(1095): n is a, c, g, or t
tatttcagatctacttgaagaaaatcaaacttgatcatgagccttcatattattctccaaggcttgcagcccttacacctggatttgctggagcagacattgctaatgtctgcaatgaagctgctctgattgctgcaagaggtgaaggaacacaagtcacaatggaacattttgaggcagccattgataggatcattggtggtttggaaaagaggaacaaggtatgtctttttaagttttatattactattaggtaggcttgtgagatgggaggggtggagctgggtgttttttagtttataaaataagaatctgcatatcattggaagttatagccttcatttttctcatttctttccgtcattatcattagagcaaatcttttagcataaaatatagtttagttgttttaacttttaatacattaattacacatttttgataaatttctacttgagaatgaaaatgtttgcctttactcacaagtcacaagttacagtggatatatatgtaataggaaaacaaggaacgtggagaaaaagtttaggggttcagtttttttaaatatattttttactgtaattattcaattacatatataatcctatacgttttatttgtntatctaataaacatactaatgaaatgacatttctagaactttagacagaaaaggtgaattaaatatgcttagggattctcttaattcatagtgaagatctgatttccttcccactatatggtgtgaaaaagctgttcttatctcctgaaataagacatttcacagaaaacttatccggccaaagttggctttaatgaatgtgagcaatatgatgtaagctgaatcttccatatatcaacctttcatttttatgtctgaaaggaccatccgtaatactccgtatgctttagtctattggtatctaatgtgcagaaatagttgatcttaggatactgttgtaagttaagacttcctgatgttgaagccatatgccgcattcgaaaatgttgaactaactgagatttggaaccctctctctccaccttttcctgtactagttagagtttctctaatatctatgtttcttnnnnnnngtaataagca

SEQ ID NO: 77 - DNA, 435 bp, Glycine max
tatgtatctttgccaagtcaaccagcaatgaagactgcagatgattcagaagatgaaagtagaagaaagagaagacgtgaagagaggaaggaggagaaacgtgaaaagcgtgagaagcatcattctcgcgaggataggaagcaagagaaacgagagaaacatgagagggggcattctcgtgattcagatggcaggaagagacacaagaaagataaggagaggagaagacatgattctgattgaatatactctatgggggattttcttatctattgtgaaatagcatgtttatttctattttcataacttaatatggatgctgtaccttggtaattgaccgtcctaaatgtctgcatgtttgtcctaacaatcaggcattctcatgtgttattttaaattttggaattcgtgaagtgaaatgaagccaattacgca

SEQ ID NO: 78 - DNA, 582 bp, Glycine max
ctccttatggaagggactttatcaaccatcaacccactgggaggttctgcaatgggaaactagctactgatattactggtgaggaaatatcatcaaaattgcaacttacttagcatggatagaaatagtgcacatatattattttcattcttgttgaaataatgtttccttttgcagctgaaacactgggttttaagagttatgcacctgcgtaccttagccctcaggcatcagggaagaatcttcttattggagcaaactttgcttcagctgcctctggttatgatgaaaaggctgctattctgaatgtaagtttggaataaacagtgcacacacatgcaaactcatcttggaaaactaatcattattttaactgtgtttttttgcagcatgcgattccattgtcccaacagttaaaatattacaaggaataccgaggcaagctggccaaggtagttggcagtaaaaaagcagcattgattattaagaatgcactctacatattgagtgctggcagcagtgactttgtgcaaaactattacgtcaatcctttgatcaacaaagccttcactcctgatcagt

SEQ ID NO: 79 - DNA, 979 bp, Glycine max
tactcatttaagattgctcttgaacatggaagtttcaatttagttataaatagattggccatttcctttaattcagggaagagttagtatacgttttggtccttggaagtggcaacttgtgttgcttaggtccctgaaaaaagtccatacagattagtcttttgtgggatagaattatttaagttcacggcttaaaagggtaaaattgttaactagttgacatattcaatgatcaatttgtatagataggcactttcaaggactaaagcaacacaagttgttttgttgctttaagggaccaaattgtatattaaatcaagcataaatctttaatgaagtccaccataatcaagaattttatcaatctaaaattcttagccaatggagaaagaaaaagttgttctgtacttctgtaactacaacataatcagcagagagaattccatgctttcatgtgtgtttcacaaaagcagcttgatacctttgagtatattttgtttttcaaaataatttaacaaaggcaagtaatcacaaaaacgaatttatgtcgtaatttgggtttcaacgttgcatcgctatatctaacgaggtttcaataacatgcttgcatatgtactaataaacaatttttgaaaaaatttgttttgggattgttgattacaaactaatttgaacaggtactggtcccatgtggtgaattgcaagagttgcaattctgcttataagagcctcaatgcggttgaagtaatgctgcagatcatatctgttgcttcaattgggattgttgccgtcatgaagcatggtacaatgtcagtggcaaaaagaaattcaatggttgccttagcagtgctatcatttgcactgtcacggtggttagctcacttcatatacaaaaacttccgttatcatgactatgagcatgccttccgctgaaatgtgttttccatatttcttcatgtctaaaaatatgtgtatagac

SEQ ID NO: 80 - DNA, 365 bp, Glycine max
tcatcacataaccaggagcacctctatgatgatattggcagcttaaggagcatggacaacaagcaaagaaacgttcgtcgttccgggcctttggattacagtgccagccgtagtagggtaaagtctgttgaaggctcaacttctggaagcactggccccagtccacttcctaggtttgcagtgtctagatctggtccattagcgtacaagtagttgtttgatataatacccaacagaagctggtaagttattcaccttctgctagtgatcagttctctataatgggtaaatcatccaaggtttgcacaaattttagcaaatgtatatcgcactaagcgtccttttgtaatcgcctgaatagttta

SEQ ID NO: 81 - DNA, 366 bp, Glycine max
gcctagtcccaagagcagccgcagcggccagatcgagagtcaccggaggggaaggtcgtcgtctttccacggccagggcgtcatgtccgtctctcagctccgccgtccgaagaccgtttccgaccttccgtcaatcagaagcctcgccggaacggcgacggcgactttgccggagggcttgcctagacatccgtcgaagatgctgctgaaggtgacgatgctgagaagcctcgcgcccgtgcagatgctgatgacgccggaatccaccgtccgcgacctcatagcggcggcggtgcggcagtacgtgaaggaaggtcgccgtcctatcttgccggccattgaagcctccgatttcgacctccatta

SEQ ID NO: 82 - DNA, 785 bp, Glycine max
gatgatggtcgtgatcttaaagatgcagaattttacaaacaacaagtcaaggctttgtttaagaatctctcaagaggacattatgaagcatcaaggatgtcagttgaaactggcccttatgtttttcagtatccttatagaatcatagatattgcataatgccataatatgaaggtggtagtaaaattagaacttgcgtacatatttcccttatcttgtttaaatacaattcagatggcgcttttatatattatatgcgtgtgaaaattgggatactatcttgttgatccacaacctttcttccttagcaagttcattagttacttccttgtcttcaactgttttttgggatccatcatttatgtgagttacatttattttttagaaaaattggcattaactttatttggaagagtttcatagcctaaattgaccttaacagagtcttagttatattatagaaggacgtgtctgttacttgacaatgtgtgatcgtgcataccctaagaaactagcctttcaatatcttgaagagctgaggaatgagtttgagcgtgttaatgggtctcaaattgaaactgctgctagaccttatgccttcattaagtttggtaaatatgacttcctatattgtcatataccattatagcattattctctttttcctctggtgcttaatctacctttttcttttcttttccttttaattgtttaaaagatacatttatgcagaagacaaagaaactttaccaggatacacatactcagcgcaatatgcaaaatga

SEQ ID NO: 83 - DNA, 403 bp, Glycine max
tccttatactcgtggagggccatggtttgaagcttggaaaaactgtgaatttgctgatctgtggctcaatgaaatggaagattacatgaagcaagccaaaaaagaatctgccaattagatgaatcaaacatcagcttaggcttgtcatttatggccatgtattattctttatgtcaaattcgttgtgaaaaatccgcatctgctgatgcatgttatgatgagagtcggagtatgagcactgctagtctataacttatcttagagtatttgtagtattctttaccgtattacattacattacattacacttacattggcatttcagagaaagtactcttcgtgatgtatttcattttttatttgtttaatgacctccctaggaccttaagaggaggtacaagca

SEQ ID NO: 84 - DNA, 427 bp, Glycine max
ttcctgttcaaacatcatcagtccccgtgatatcctccacagaagttatacctgatactcagaacgttgcttttagcttttaccttgaggaatctgatttaaaagcgttgttagctcccggttgcttctacaacactcatgcttgtttggagattgcggtgttttcagggaggaagggatcccattgtggagttggcaacaaaaggcagcaaattgggatttttagaatgcaggttggccccgagtggggtgagggaaagccagtgattctttttaatgggtggataggtattggcaagaacaaacaggataatggaaagccgggtgcggagttacatttaaaagtgaaactagatcctgaccctagatatgtgttccagtttgaagatataacaacattgagtcctcagatagttcaactgcaagg

SEQ ID NO: 85 - DNA, 438 bp, Glycine max
tttcctcacctttgacgatggcatcatatggggatggtattaagtttttcctttcaagaatttctttactaattgataactctagacttgactgagaaacatgatttctttcttttgtggcagtcatgaatgtgccaagttatgaatctgttaacagcaagttccatgcaaaatgaaattgcatgtgatccaccttcggctcatcatattttctggatcacaagcatgcctacttccaattttcaagagcaatatacaccgaatcagcaatgctgaaaataaatcccagagaatttttttgtgcggatctgaggaaccattgttcttgttccatgtttgtttgttttttttataacgatttgccttactgtattaggtgcatcggtcttatggctaatgtgcaccttaattttttattttatgaactaattctcaaga

SEQ ID NO: 86 - DNA, 663 bp, Glycine max
gctatgtaaagcttgaaagacttgagccttgtgaggagaaagaagcaagagaatacatagtgagtctcatttttcctttatagtagagtgcttttagtcttaagtaacaggatttgatgttaccatgaaaggtttgctacacataagctgcgttgcaactttcatttttatctgaaaaagctgaggctgagctattgtgtctgatagactagaagcagattgggtgttaagttccccttaaatttatgttccttttgtcttattttgagtgtctgggtctttatctggaaatttttcatgatatttttatgtatcaataatgcatctaacttgcttttcgcagaagcttccatcaagatatactcacatgaaatctaatagggaggttgaaccagccgaatttgtccatgatgaattcactaaagataaatctgttcctaagaaaattgtacgaaatggcaataaacgtggtcgagggactaatgaacaaggacggggtaaaaagctggctaaaagagtgtgcaattctaaacgagatggtggtcgtaagaatgctaaggtcactgacaatctaagtcacagattaaaacagcaggctcgaggaacacaaggacaaggtgctgggcgaggtcgccgaaccataaggaagcggagaatgggaaa

SEQ ID NO: 87 - DNA, 396 bp, Glycine max
gaacgaggttatcctgttatgggcatcgtttggattccggtggatgttcatgaagatgtagtcacagacaaatcagatcacctgtgcttattctattcgcctacgtatataggaattggagactggaaattaaaagtgaaaataatggacaggaaaggttttcctgtggaggtgaagaaatacgggtatcgtagggtacatgaagaggatctagatctagaaccatcactcaacacagcaggaatccggaagaggaaaaggggaactgatgaataaaatgattgttttggttgttagagaataatacaattttttttatcctttttatgtaactttaacgaagccagtgaattagtatgcttttactataacattgtcgaagacggattagacctc

SEQ ID NO: 88 - DNA, 365 bp, Glycine max
  misc_feature (356)..(357): n is a, c, g, or t
gaaaacaaaacaacaaagcacacataattttattactgttttattgatagatatttgataggaagaagcaagtgcagaggaaattaataggtgtaggtgggttcattatagatttagaccccctttgctgtccactgaaatttgtggggtttgtgattcatgttcatgccatagggattggcatagcgagtatccccaccaccccagttatgacgctcatatctcatttcatccaccttagccgtgactccaccaacatgctcctctgcataagactcctcgtactcctcggattcctccgaaaaatactcatggtgcccaccatggtttggaaaatgatgttgagaggcgttatnnttaccatg

SEQ ID NO: 89 - DNA, 629 bp, Glycine max
  misc_feature (378)..(378): n is a, c, g, or t
tcttcgaaatccgtggatctggacctaacaatcgtgtcggcgaagcacctgaagaacgtgaactggaagaacggcgatctgaaaccctatgtggttttctgggtggaccccgagcggcgcctggccacgaaatccgacgactccggcaacacctcccccgtctggaacgagcgtttcgccctccctctccctctccccctccacgactccttcctcacgctcgagatcttccactccaaaccctccgacacccccaaacccctcgtcgccaccctccgcctccccctcaaagacctccacgactcaactcgcctccgcaagttccccctctcccgcccctccggccgccctcacggcaagatccacctcaaactcggnagctagtaatcttccaattcgttgaattattttttaaatgtttgtctgtcacccaccctatactttgatttgttctaaccatcaaccaattccatcgcagaaatactacatggcttcctcaagggaactggttcgtattgttagcatacagaagtctccaattatacatctttttggtgaatcaattgctggagcatccaccatcaggggttttggacaagaaaaaaggttcatgaagcggaacctctatc

SEQ ID NO: 90 - DNA, 386 bp, Glycine max
acctcctttcatctggcgtcattagtggcttacaatcccttcttgtaggcgagggggattgcatttggacagaaaaatgcgtagctgttttgataaatttagctacttctcaagttggaagggaggaaattgtatctactcctggactcattggtgcattggcttcgatattggacaccggtgagctcatagaacaggagcaagctgtctcttgtcttctaattttgtgcaatagaagtgaggaatgcagtgagatggtcctgcaggaaggggttataccagcattggtttcaatatcagtgaatggaactccaagaggtcaagaaaaagctcagaaactcttgatgttgttccgagagcagcgacgagacccttcaccagttaag

SEQ ID NO: 91 - DNA, 304 bp, Glycine max
agttgagcgaagccgtgtggaccccacaaagctcatagtcacctacgcttatgaacacaaccactcccttccttttccaaaatcaaattcttccgccgcttccgccgccgtaagcgacggcgcagccgtcttgccgatagagtccgccgccaggtttccgccggaggaggagatgacggtgttcgcgacagactccgacctcgaactcgccggcgacgcggcggttcttctcatccaccaccaccaccacttcggctggttcgatgacgtagcgtccaccggcgtcctagagagcccgatctgc

SEQ ID NO: 92 - DNA, 577 bp, Glycine max
  misc_feature (53)..(55): n is a, c, g, or t
  misc_feature (507)..(507): n is a, c, g, or t
  misc_feature (522)..(524): n is a, c, g, or t
  misc_feature (536)..(547): n is a, c, g, or t
  misc_feature (559)..(572): n is a, c, g, or t
gtgctattgactaccatgaatgggggcgtaggactaccccttcattcaccttnnngttaccacagctctacctatgacaacaggtaaagttcatatagatggatagtagtataaaatgaagttgagattcacataatgcacaaggaagatgatttgccaagattttttacatgttcatttcatgcttaccgtttggttattcaacaggtttgcattttgtagcgttaaaaggtcattatctgcatataatctgattttttctgcataaaaagttcatcttgtggttgctgtctgattgctagcaacttcagattttgtggcttgctgtttagtcactaacaggtttagtttgtgaccctgaagccatattttgtaaaatgccctatccccattcagataatgtttttcaagtattttgaggccattctacagatggcaaaatacttacatgtttctaaagtttcacatgaaatgatgctacatgggcacatatccgagggtgtacangatcctacacaactnnnccagtgattaannnnnnnnnnnngcatcactctannnnnnnnnnnnnntctgc

SEQ ID NO: 93 - DNA, 519 bp, Glycine max
ggacctttctgaagggaaaatcagaaacaacttggaggctggagtcattgagcctgcaatgagcaaagtaaaaattattcaggtatgtatttagttaaatatcaacagttgttgacttcaatatacagcttccttacacagctgcgtgagctagaagtttttttacttccccagtttgcaactgaagctgccattactatccttcgaattgatgacatgatcaagcttatcaaggatgaaagtcaaaatgaggattaaagtataactgaatctaggaggcatctactccccagtgcttacaaaagggagggttgtgttagtgtgcatttgaagagggtatctgcatttaatcttcaatgcccttgttcttgaaggaaaactgttctaattatttttctgaaagtagctttattatatttacatctttgcattttatattccaacaatttttaggcaaacatttttggtcatgcattggctggttgcatgtttgtacatttctttgaggcagtgtttgat

SEQ ID NO: 94 - DNA, 752 bp, Glycine max
agtctttttgagcagcttccttctgggttgcttcttgtaactggtgagttttgtcattaatatgatacttcttattgctgagattttgcatgctaagcatattgtttaatgtgtgatgttttgactgttgttatcatcaattgaatttatattgtaattgttgttgataattggtttgtaagtgttgcttgaggtctgtacttctgtttcaactcacaattttgtttgttgttatgttgcttttccattttgtgtatttttatgtgtgtgcgtgtaaatgttagtgattattttgggggtgtgctttagtttagaatgtagattgacattggttttttggtacatgttgatttcaaattttaatagcacttgactcttgcttttctgagatgtactctgtgctccatccatttctggtctggcttatgtttgtcacttgccacttcaggtcctttcaagattaatggagttcctttgagacgtgtgaatcagtcctatgttattggcacttcaaccaaagcaaatgtctctgctgttaatgtcgaccagtttgatgacaaatactttgcaaaggaagcccagaagaagaagaagggagagggtgaattctttgaggcagagaaggaggtgggattgtctattttcttattttgttgaagttcttgttatttgtagttagttctgcatgctgatctctgtctttttcttctttctgatgcaggaaaagagtgtgttgccccagcagaagaaag

SEQ ID NO: 95 - DNA, 439 bp, Glycine max
ccagtacctacttgaaaccgagtgaaaaaacctactactcccactcccagtgactgagtgaaaaaccacaacctagaaagaaatgaagaaaatacagcactctgaacaaaaagcaacggaaccaaccaaaaaggattcaaagggcaacaaacaagaaggcacagactcagagtcagagcaataccaaaacgaagaaaatcaactccacacgctttcggaaccatcaccatccttctctctccgttcccgcaaatccccttcgccaccactccactccctctctgactcccccatctccgatgcccacctctcccctgcgccgcagaagccgccgcccgattcctcgccggactcctcgatctccgacggccacttcacgatcggtgaacagcgcctctccccggcgccgccgaccgtggtgacggctcatcggttgaag

SEQ ID NO: 96 - DNA, 648 bp, Glycine max
  misc_feature (623)..(625): n is a, c, g, or t
  misc_feature (632)..(633): n is a, c, g, or t
agctactctaggggagataccagatgaattcctggatccaattcaagtatgttttccgcttttttgtgttcatatgtttttattgtggtggaagtgggggtgtcactcgtaattgatttgcaagtgtaaaatttgatagtgactagatgcgtgattactcttcattatttttaggggtaaaattgctttattttttcagaaagctctaaaaagttgtttataagctgttttgaataacaggcaagctaattctgacacaacatacatgcccttttctatattacagtacactttgatgaaggatccagttatcttgccttcttcaaggatcacggttgatcgtcctgtcattcagaggcatcttcttagtgatagtgtaagttaacatctttgacattactggtgttcatgtatttaagagggttcattggtttatgcttttctgtttgtttgtgcagactgacccattcaaccgttctcatcttactgcggatatgttgattcccgatgatgcgctaaaagctagaattgaggagtttgtcaggtctcaggaaatgaagaaacacttgagcctacagagtaccaaggccacaattcagactacaaatggggaaacaatgttnnntgattannaaaatatcttgagtt

SEQ ID NO: 97 - DNA, 372 bp, Glycine max
attttgaaatctctctgtagtaggaagaccatgggacgagcttcatcattacttataatttttttggttcttggttcttcctttgccacctataatgtggtaacgatgataaggcactacggatcttcagaaggtgtggctgttaatgatggtgcattgttttttgaccctattactgagatgcctgatcatgtaaagaatcggaagacatctaaagtgccctttcatgtcgcgttaacggcgacggatgctccatataacaaatggcagtgccgcgtcatgtattactggtataaacaacaaaagaagttacctgggtctgagatgggaggattcacgaggattctacattctggaaatcctgacaacttg

SEQ ID NO: 98 - DNA, 348 bp, Glycine max
gtgcagtgttgagtgttgagtgttgagtgttgagtttctctctcactctcagcttctaaggttccatcgctattctgaacaatcgaacattgtggattcaatcagctacttgcagcaggttagggtttcgaatctgtttctctcgtagcatgaagaaccatactcagactctccctctcgatttgatagagctaattctcctgaaattgccggtgaaatctgttacgcgtttcaagtgtgtctgtaaatcatggctctctctgatttccgacccccaatttggcttttcccattttgacctagctctcgctgtaccctctcatcgactccttctcagatcaaatgaaa

SEQ ID NO: 99 - DNA, 394 bp, Glycine max
tggatgagagagaaccggccacattgccatcttcactcagaccaaccttctctgagaaggtggacaccaccccattcgggactgtagttgagaatttctatatgactgatgccattaccagggcatcaaagataatggcacaatgcagtgccatgctgttgaagtgaaacatggattttttattttttggtttcaataatgaagattcacgtttttcctttcctggccatgcaagactttgcttgcccaaaacttattggatgtttgaagtatccaataaattaaaactaggatttatctgtttccatttgtaatatgcggtgtgaaagcaccactttttagaactgttgccatgtaaaatttgagttatccgactgattgtgaaggtttactc

SEQ ID NO: 100 - DNA, 454 bp, Glycine max
atggccttgtatcagtaatcagggatggacctggtgaagcagttgtagttgcccttgagcagactacagagacaccagaacttgtatggacgccagcgatggcgacttccttatctgcacaaatttccactatggcatcagagctataccgtgagcagatgaaagggcgtgttgttgattgggatgtgcctgagcaggcatctggacagcaggaaatgagagatgagccacaggtattcaccagatatatgtgatttttttttataaaattatgtatagaataatatattttctcataaatggatttcaacttttgtgtggatgcaggttggtggcatctatgttaggctgtttctgaaagatcccaaattccctcttagaaaccctaaaaggttcttggaaggtctactagatcagtatttgtcgtccattgctgccacccattatgaggcac

SEQ ID NO: 101 - DNA, 386 bp, Glycine max
tgtgctctcatcaagaatccatcatctttgaggtctgtgaagaacgtgtctaaagtatttggattgaaatcatcttcctttagagtgtcagcgatggcggtatataaagtgaagctgattggaccagacggtgaagagaatgaatttgaagcccctgatgacacttacattctggatgcagctgaaaatgctggagtggagctaccttactcatgcagagctggagcatgctctacttgtgctggccatgttgtttcaggctctgtggatcaagcagatcaatcctttcttgatgaccatcaaatcaaaaagggttaccttctgacatgtgtttcatacccgaaatcagattgtgtgattcacacccacaaggaggaagatctcgt

SEQ ID NO: 102 - DNA, 435 bp, Glycine max
aggggttcaccaggggccagcctgtttcgacgctctgggtgcgaagctcatagaatccgctggcttcccctactgcatcaccagtggcttctccatcgccgcttccaggttggctctgcccgacaccggcttcatctcctacggcgaaatgctggagcagggccaactcatcacccaagccgtttccattcccgtcattggcgacgccgacaacggctacggcaatgccatgaacctcaagcgaaccgtcaagggtttcattgccgccggtttcgcaggaatcattctggaagaccaggtaagttttgtttaatctccgatgatcatggtttttccataattaattaattggatcgattagattgcgccgaaagcgtgtgggcacacgcgcgggaggaaagtgataccgagagaggagggcgttatgaagattag

SEQ ID NO: 103 - DNA, 365 bp, Glycine max
tacaatgcagcagtggtgcacttcaatggcaacatgaaaccatggcttgacattgcaatggctcagttcaagccactttggacaaagtatgttgactatgaattagatttcgttcaggcctgcaattttggtatctaaatggtcaagtttcttctcacatggtgatgctgtgttaggtgccacagcagtttatttgctgtttagttttgatacataatgcttatacgtttaacagagttcctagctggtgcaggaaaaaatcttgcttctttcaattgtaaaataatactttagtacagctattctcgtatgtcttcctcttatttattcataacgtttagacaataatgttatcttaaagacgt

SEQ ID NO: 104 - DNA, 618 bp, Glycine max
  misc_feature (447)..(453): n is a, c, g, or t
  misc_feature (487)..(487): n is a, c, g, or t
  misc_feature (506)..(508): n is a, c, g, or t
ctatgtatgccatggtggctttagttcagtgattgaagctatggtcaatgagtgtcaactggtgctgttgcctttcaagggtgaccagtttttcaattctaaactcattgccaatgatttaaaggcaggggtagaggtgaataggagtgatgaagatgggttctttcacaaagaggatatactggaggcattgaaaactgtcatgttggaggataacaaagagcaagggaagcaaataagagaaaaccacatgcaatggagcaagtttttatcaaataaggaaattcagaacaaattcatcacagatctggttgcccagttaaagtctatggcttagtcttgtctcttccaatggaaaataaagtctaccaagactagaaagtataaactatagttcaaaatgatcatattatcatatatcaattgagatatgcgtggtcagtctcnnnnnnntgatatgtgataatatgatcattttgaactatgntttatactttctagtcttnnnagactttattttccattggaagagacaagactaagccatagactttaactgggcaaccagatctgtgatgaatttgttctgaatttccttatttgataaaaacttgctcc

SEQ ID NO: 105 - DNA, 1398 bp, Glycine max
gttgctagttactataatggcttacacatgaaaatgttccagctagtaagtataatgctaagatataggtgagaagaaattccaccttgtactcaggcttatcaaccttcctcaccaccttcatgcccaaagcctgagcaaatatgatcccataagaaaattgcctcatggttaagtaatgcatttggtttaacaaaaatttaaatcataattcatcaaatgtagttttgtgattctattttgtgcagcacaagcaaaaactaccaattcctactccggatcctttttttggtatgcaatccaattttttccatgcaaaataatcaaatttcttgccaccaattgtaaaccacgacaatgcagttagctgatcttccagtcttgtaacccactgacaaaactcatcatttctataaagaaaaggttaaatggataagaagagtacagggaaaagttcacacttcagaaaagaatttccatggaactaacagagagccataacttgttttggtctaaaactttaaataagaatgcttcacttggatgctgatactgaatgctgctgattgaatacagttatagagcatacacacactttagaattattcccctgcttcagtccatgtggcatgggcctataatagttttttagcttatgcacacaaaagcagaaaaattcatggaaaatttctcaaagtcacagaagcctgaaacagttttgactgcagcaacaaaactggattacatataagaaagaaaaaaaaaaagcagagagagacttggattgtcaccttttcataaaacttaattgagcgctctaaatcaccaacacgaagcattacttgacaaaatgggtcatggactgtaggtctttggataagtccaaaagtataaccatcaggatccttaacaaaggcgataacagtagttccaccttgaactggaccaggttcccttgtgatgtttccacccttggccctgatgtgctcaaccaatttataaatctaaaaattgaaacaataaacagttcattttaatcactgtgtaacattaaatagattgctcgagcttttgtaaagatggacttttgtcttacgtcctgagttgcaattgcaaaatgtccaaagccatcgccaatgtcatacgaggtaaccccataatctgacaataataagataatatatttaaatagttagaagaatataaaaaatccatgtttgctttgcaatatatgtagtacaacacaaagaaatagtagtatcaagcaattgatcaaaactttatcattgtactaaaaaactacacacaatcagagaaccacggtttgcatgaacacatatgcaacaaggacaagattagtagagtaacatactatatgttaattcaacaacaaaatgg

SEQ ID NO: 106 - DNA, 367 bp, Glycine max
atttttttgggcaaccaaagcagatccaaggagctgaaaccctatatcagaatatcataaatccatatgtgacttcttctgtgtatgggaaccttactaatacatatcctgctatgccaatgctatcgcagactcagccagcactttctggctacgaagtgtctcctggtatagtaaatcgtgtgaacaattctgtggactcagtcaagccccaaatcatgactcctcaggagaaaattgaaaaattgaggaggcggcagcaaatgcaggcaatgattgctattcagaaacaacgccaacaattgggccatcaagttcctagtaaatcaagcactcaaaaatgtcctccagaaattcaaagtcaact

SEQ ID NO: 107 - DNA, 367 bp, Glycine max
cacctcagcaaccaggcccgacccgagaaccaaactcggatccggagtcaatggagcgagaaaacgggtcaaagcgcgaagagagagacagagaagcgttgccggagtgtttgttgctgatgatgtgcgagccgaagctgtcgatggaggtgtctaaggaaacgtgggtgtgcagcaccgacttcatacggtggctgccggagagaaccgccgcaggcggcggcaacagggtcgccgcagaaacgcttgcaaagtccaagccaaaaccgaagccgatgatgcagccaccgcggtcgtcgtgctcgttcccggcggcgagaggcggcgccggggtgtcgatggcggcgatgattgagcagaagctgat

SEQ ID NO: 108 - DNA, 409 bp, Glycine max
  misc_feature (255)..(257): n is a, c, g, or t
  misc_feature (261)..(267): n is a, c, g, or t
  misc_feature (279)..(281): n is a, c, g, or t
  misc_feature (292)..(296): n is a, c, g, or t
  misc_feature (299)..(303): n is a, c, g, or t
  misc_feature (308)..(324): n is a, c, g, or t
  misc_feature (333)..(349): n is a, c, g, or t
  misc_feature (351)..(365): n is a, c, g, or t
  misc_feature (370)..(374): n is a, c, g, or t
  misc_feature (377)..(381): n is a, c, g, or t
  misc_feature (398)..(403): n is a, c, g, or t
ggcgcctctagttttctcactccgcaaccaaacgacacccatcttcgtgttgtctcccaaaaacgacaccgccgaagcagaaccctaatactttgcttcaacgatgcagcacgacgaggtcatatggcaagttatcaggcacaaccattgcagttacatggccaagtaagttccctcacctcttcaattttccttttcttacgccctcttcagatttatgttttttttaaatgttattcgttcattttttttttnnnaaannnnnnnaggggaattttnnnaaaaacccttnnnnnggnnnnngggtnnnnnnnnnnnnnnnnngccctttgnnnnnnnnnnnnnnnnncnnnnnnnnnnnnnnnaaggnnnnnttnnnnnaaaaaaaatttttttgnnnnnntttttg

SEQ ID NO: 109 - DNA, 1008 bp, Glycine max
agatggcaaatgatccctatactctggtatgtgttcatgttgatttgctgcaattcttgtgcatatgattgagtgccagatgtgtctcatggaacatatttcttgccttttctgttattttactaggtcttagactattgtctttgtattcaagccctttgcagtcatacatattataataaattttatgctagttagctactcatgctccttggaatcgggccatctgcaggccctctttgaacattgaagtacatgttgagcaaatatattgcattttaatatgtgttccctacctatctatggttttgaactaagatgttgaatgggtatgtgtgcaattgtgctttttgtctattttattctatgatgaggaggatgtgtgtagtactaccaaaaaactgaatgactttatgctttgcaagaataagttgcatgtttgcatgcgtgtgaatccattcaagaataaatctaatctcatttgtccattttcatgggttatacctgatgagtttatcaaaaacatgtggatattgactatttgagtaacctgatttgtttgcattctccaaccaaaaaatgggagccagtaagattgagacagtgagttgggaaatgtggcgtggctttgccttcgtaactattgacagtaaaggaaagtagacaacaagtttactccatgataattgttatggctttctttttgacaggttatagctttgaatagttcccaagaagctgagggtgaactctacattgatgatggcagcagctttaattttctgcaagggggctatatccatagacgatttattttctcgaatgggaaacttacttctatagacctggcacctgcttccggtagcaaggggcgttatccatcagatgctttcattgagaggattatcctgctgggacatgctcctggctcaaaaaatgcactcgttgagccatcaaatcaaaaggttgatattgaacttcgtcccctttgggttctaagagctcatc

SEQ ID NO: 110 - DNA, 681 bp, Glycine max
actgagagcatcttcactttcattgctgaaaagtaagcagaactgcacaattttaatttattacatgcagtttagactttagggtaaatcttgtggataagttgttttctgattattgtgctaagtactgactagtctggcattattaggctataaatttgactcattttagtatagttttaatgccgttagttcacattaaatagtcttcatttacttaagttgatatcctaggatattgtatatctcttgggctggaagaaaattgaattaatgaaggtggtgttactaagttgatatccttgggcattgtatatttttcttatacaaaatccttctactcttttgccagtgcctgttctctccatacattgcgactgccaaggagcagtatgaatgattccattgtggaacagattgctgggaggctttctatgatttctttcttggatgtgagctactgtattaaaatcggtccctatgcacttgagatgattggcaagaactgcaaactgctagaagggttgtgtcgaaacatgcacccgttggatactgcaagcaagccgtttcaagatgatgaagcatatgcaattgcctccacaatgcctaagctcaagcatcttgaaatggcttatcatcttatcagcacttcgggtgtccttcaaatacttgcaaactgcc

SEQ ID NO: 111 - DNA, 920 bp, Glycine max
  misc_feature (390)..(391): n is a, c, g, or t
  misc_feature (450)..(453): n is a, c, g, or t
  misc_feature (457)..(457): n is a, c, g, or t
  misc_feature (466)..(471): n is a, c, g, or t
  misc_feature (476)..(481): n is a, c, g, or t
  misc_feature (487)..(487): n is a, c, g, or t
  misc_feature (497)..(497): n is a, c, g, or t
  misc_feature (499)..(500): n is a, c, g, or t
  misc_feature (502)..(510): n is a, c, g, or t
  misc_feature (512)..(518): n is a, c, g, or t
  misc_feature (522)..(527): n is a, c, g, or t
  misc_feature (548)..(554): n is a, c, g, or t
  misc_feature (556)..(560): n is a, c, g, or t
  misc_feature (577)..(584): n is a, c, g, or t
  misc_feature (588)..(593): n is a, c, g, or t
  misc_feature (609)..(616): n is a, c, g, or t
  misc_feature (618)..(624): n is a, c, g, or t
  misc_feature (628)..(630): n is a, c, g, or t
  misc_feature (633)..(644): n is a, c, g, or t
  misc_feature (646)..(646): n is a, c, g, or t
  misc_feature (653)..(672): n is a, c, g, or t
  misc_feature (676)..(676): n is a, c, g, or t
  misc_feature (679)..(680): n is a, c, g, or t
  misc_feature (685)..(686): n is a, c, g, or t
  misc_feature (688)..(688): n is a, c, g, or t
  misc_feature (690)..(690): n is a, c, g, or t
  misc_feature (694)..(694): n is a, c, g, or t
  misc_feature (700)..(707): n is a, c, g, or t
  misc_feature (710)..(722): n is a, c, g, or t
  misc_feature (729)..(730): n is a, c, g, or t
  misc_feature (734)..(737): n is a, c, g, or t
  misc_feature (739)..(741): n is a, c, g, or t
  misc_feature (748)..(756): n is a, c, g, or t
  misc_feature (762)..(766): n is a, c, g, or t
  misc_feature (773)..(773): n is a, c, g, or t
  misc_feature (776)..(787): n is a, c, g, or t
  misc_feature (792)..(792): n is a, c, g, or t
  misc_feature (805)..(821): n is a, c, g, or t
  misc_feature (827)..(830): n is a, c, g, or t
  misc_feature (832)..(838): n is a, c, g, or t
  misc_feature (842)..(845): n is a, c, g, or t
  misc_feature (851)..(854): n is a, c, g, or t
  misc_feature (856)..(857): n is a, c, g, or t
  misc_feature (863)..(866): n is a, c, g, or t
  misc_feature (871)..(875): n is a, c, g, or t
  misc_feature (881)..(882): n is a, c, g, or t
  misc_feature (891)..(896): n is a, c, g, or t
  misc_feature (905)..(906): n is a, c, g, or t
gtttgttctctgtctctcatctcaattctcgttgtctgtcttccgttctcatggttgcctgatttctctctgtttggtctctccctgttcaagcagatacaaacctgattttcgtccctctctaccgtataaggtgttatttgtcttgacttgaagtatattttcatgtctgagaaatgctgaaatactgggagttttaatttcagcatttaaaattttgggaattggcagttactagtcgactttatggtgcctctacaattttacataaacacttgagtttagtttgacaaccttttctgtatggtctattgatttgttgatctaagccgataaataaaaatgtaatggaaattgatttctatgctctttttatgttgccaatattannagtcttgtttatttgcttaaatgtgtctttttgaatggattcaataaaaaaaaaaaatnnnntccnaaaaggttnnnnnnaaatnnnnnntaaccngtccccccantnncnnnnnnnnncnnnnnnntaannnnnncattcccctctcccccccttnnnnnnncnnnnnatttaaaccccccttcnnnnnnnncccnnnnnnttttctcccctacccnnnnnnnncnnnnnnntctnnnccnnnnnnnnnnnntnttttccnnnnnnnnnnnnnnnnnnnntttnttnnttccnntntnaccncccttnnnnnnnnttnnnnnnnnnnnnncctcccnnctcnnnntnnnttttccnnnnnnnnncccctnnnnnccccccntcnnnnnnnnnnnnccccnattctcccccccnnnnnnnnnnnnnnnnnctcatnnnncnnnnnnnattnnnntctctnnnntnnccctcnnnnttttnnnnncccccnncccctcccnnnnnntttataatnnctaatccccttatt

SEQ ID NO: 112 - DNA, 383 bp, Glycine max
gcgggtggaactcggtggtggaagggttggtttcgggggtggcgatgctgacgtggccgatgggtgcggatcagtatacgaacgcgaagcttctggtggatgagttgggcgtggcggttcgcgccgcggagggtgagaaggtaattccagaagctagcgagttggggaagagaattgaagaagctttggggagaacgaaggagagggtaaaagcggaaatgttgagggatgatgcgttgcttgcgattgggaatggtggcagctcgcagagggaattggatgcgctcgtgaagcttctaagtgaagttcagcgtgtggaaagcacttcttgaaaacgtgtttcttttttgttggggttagggtaatttgggaaccattgggat

SEQ ID NO: 113 - DNA, 402 bp, Glycine max
cttgatgatactactagtcctgagatgataacatcaaacttcgcaataacaacgaaacttccttataatttatctttctctctttctttctttcttccttccctctcttctattctcttcttgtctttacatcacaccctctttccccctttgccaaagctctgatcttttccctctccaatccccgtttctccacttttcttgatcagggtgcctcgttttctcagtttctgaatcattttttgttctgggcctctctccacttcggaaaaagatctgatttttcgcccccttttttttgtttcgaatccctcgtgaaccctcttttctcgatctggggtgtgaaggaaaccgctttttatcgtttcaattatgaggaaaagggagagggagaatccttgt

SEQ ID NO: 114 - DNA, 359 bp, Glycine max
tcttgaccaggcagaggaggaagggcttgagcttccctactcatgcagggctggttcttgctctgtgtgtgctggcaaagttgtatctggcaaagttgacaattcagatgccaccttccttgaggatgaacaattagaagcaggatttactctcacctgtgttgcttaccccacctcagacgttgtcattgaaacccacaaggaggaagacctctctgctgcttaactttcttcctttctcaccaacatattatgcattcatgagcattcattacttccacctgtagtagcaactgaacttcattgttgtattgtaactctataataatctttccttactggttttgcacacaatggtt

SEQ ID NO: 115 - DNA, 561 bp, Glycine max
gaaccttctttttatctttatagtcatttgtgtgagaatgattttgtttatatgtggagactaatatagttttttttttctttggttaaggaatgggttttagcttccagaattgcagtgcctgacaacctgggtcttcgaatgcgtgggaggaccatggtccggccagctccaccatccaacaaacgagaactatcgtgggtcggcgatgttggttttgttgttgatgcttggtggcatgatggatggtgggaaggcattgttgttcaaaaggactcggaatctaattgtcatgtttatttcccaggtatgaatttctgctctttctatgttaattagcttaggttggtaactgttcttttggtacttagattattagttcgtttttttatttttgattaattcctatggtaatgtctttgcaggggaaaaagtggtgtcggtatttggtcctggtaacttgagagagtctcaagattgggtggggaatgagtgggtatttgtgagggaaagacctgatcttgtggcttctgttttatctagcttgaaaacaaaacaaaa

SEQ ID NO: 116 - DNA, 397 bp, Glycine max
cacctttcactgatatttgcctatatgatatcaaccttcatggagtgacgggacctagaactccaccttggaagtgttctgatgtgtctggatttgctcatcaagttagcccttggccatgttctgagcttagcagcaaccagcagggatcatgtgccaattactcctgagattatgggaatatatttccacttttcaagcattgacatgggcaaccaagggcttctttagttgatttatcataatgtaaggcaatgaattactatgaaatgcaaaatgaagacttgttggctttaaaactgagtagaattggttttgacagaaataattttgaattactgaatgtaattgagatgtatgtctaaattagtttcagtcatagattttacattaacac

SEQ ID NO: 117 - DNA, 444 bp, Glycine max
gggacactaggaggagcacccaaaccagtaggctttttaccaggggctttcttctctgcaagaggttgagacttgacctccctggggactgaatcaatgtcaaaagcctcttctgaaggctcctgcattcacattaaaaacatgcaatatgtccataagaccttaaccaatgaaaagcaagaaaataaaatacagagaacttacgtagtttttcaaactagtctccagattgacaagcgggatatcaaatgacccaaagaggaaatctttcacatctttatctgtctcaacaactgaaccatcacctccaagtgtgttcagataaagtgttgctctgtcacgaacctatgaagaaatcaaaatcattcagatataaatcaaagcaagtaacagcgttaaagtttacacacttctagagttgcaaattgtatgatctcataaagc

SEQ ID NO: 118 - DNA, 404 bp, Glycine max
gaggaacagaatgaggcaaaggcagctacaactgaaacagtagagagtgtgaaagttgataatgatagctcaatagttgatgacaagaaggaagagaaaactgactcaaaggtggaagaaatctctagagctattaatgaacctgttagagaaacattggcatctaaatttgaagaggaaactgttgaacctggagcggataaggtagagaaagaacaaactgtggagcctgagaaaactgaggaggttcaagccaccaaggaaagtgatgcaacaaaaacatccaaggaccttccaaaagaaactccagcaaaaccagctcaaaagcaatcaaataacatcatatcaaaggttaagcagtcactagtgaaagcaaagaaagctatcactgggaaatctccatc

SEQ ID NO: 119 - DNA, 1376 bp, Glycine max
  misc_feature (1360)..(1373): n is a, c, g, or t
aacttgtagttattactcatttttttggtttgtaattttaaagttagtcacaggaattagggtaaggggcagtgtatcttaactcatgatctgatcactctccattttttgtcaattattgtgcagtttttactaatcaattatggcttacgagataaccgagataaagagtaagtaagaagcattgcaatgccactgcattctcttttttgtttattctaatttaagtgtttgaacatcattgacactgtgtgtgtgtttgtgtgtgcatgtttgaccttggacagagattggtataggcctaattggtttcggcttatttttcacatttcttggcataattcttttctttgaccgtggtttgcttgctctgggaaatgtgagccttaattttcttcaatctaatttatctttcgtcgaattgaggttgctataaagaaccctaatttcggttttggtatcagattttttccttggcaggggttggcattttgcttggttggcgttccacgtgggcacttttcactaatagagccaactttaaggcactcttctctccttccctcttcattacaaaattgtctgcattaaaatcatagagcttgaattgaatgcagattgtggatctgttaaactagttagattgctttgcctgtcatgtagcagatgatagttttgtaaagtgatggtaacgaatatatacatgacaagaagcgtcttcagatacaacttaaaatatctgtcatcaaattctaaattatgttcagaataatcagagctttccttccagcactccaacaaaatgcatgtgctagttgtgatatatggagtatctcaaatttatttttgacatacataacccataaaatttccaagtttcctgatgcctcagtaatctgtcttactccaagtactaaccttgatgaattaaagatttatttgctttggatttccagcatctctttctgtaatgaaacattaagccccgcaaatgttctatttgaatggatgcctgtgtgttttatctttcgtcctttgttcttctactactacatcatgtcttaacgttagttgtgagtgtctttatccaccttgatatagaatttcaaaatactttatgaatcaataatgaaacattctatatggagacaactagcttgcattgccatttttgcagggttctgcatcatttcttctaggtctctttttcatctttgtgaggtggccaattgttggtataatacttgaaatatacggttgtgtttttctcttcaggttagttgatcacatccttcttgaactctatgagactacaaaacttattctacactttattattgatgcttttggttgcagtggnnnnnnnnnnnnnntca

SEQ ID NO: 120 - DNA, 1187 bp, Glycine max
tcgggacctattcatccgagaaggttaatttcatatatataaattttaatgtttcttaatgagtagtgaaattctattaggctttgaaaatcttgcttttacaggttatcagtttgattatgtatttgattggactatgctgaagtatcctcaaattggatccagttctagagcccgagtgagtacttaactagtgtggtttcattgcatttctagcgaaaattaaaggttcttgttaatcatttttttgctgcattttcaacagccaagtgggaaaccagtcataaaccccggacaatcaggagagagaatagaacggccttcaggtttcatcctgctacagttagatctgaaatctatcattttaagcaattactgctatgctgataaatagttttggtgtcctgtatattaataatccttaaagttctatttattattttttatctttatgtgctttcattctcattttgtttttgttcaaaaaacagaaacagaacatcaggacagcaaaaatataaacatataaagaagagaggagcaaaaaccgatatgatatatttcagatttgtaactcacattttgcacactttgaacttgttacagcaagagcttaaataggaaaactagcaagtccctgattgggtgaaataaacatcaaattatggccagctaaaactaggcatcattagcaacagctacaagttgctttttcttagcacaagcaaactttaaacaaacttacaagcaaccacaaaaactgctgagacattaaaatattttataataacagcttggaaaagtctcaattgccaacagttttgaaactgatattattttcacctttcaaaatatgtgtctgtacattgtgcacgacaaagtagtttattatttcaattctacaaattgtatgagaaaggatttcttcagccaaagattttcatctatgttttagggggtttctcaggtgctgttgaggcatttgcaaggaggaatggctctggacttgttctgcaaagtgagcattctaggcataggtcttcagatgatgtgccatcttccaaagacgtggttagtatctgtgtcattattgttttctctctatgaattggtggttaccctcaaacttcaatatgggactgcttatacttaatcttcttgtcatgtaacacttatccttgcagcaa

SEQ ID NO: 121 - DNA, 580 bp, Glycine max
  misc_feature (539)..(555): n is a, c, g, or t
  misc_feature (566)..(574): n is a, c, g, or t
cgagcttcctcttcaaactccggcgaggaagctggtcatcatcacattggatcgggtcaagcgcggtcgcggccccgtcgtcgtcaagaccgtcgccgccacgctgctggtggttctcgcttcctcgctctacagcatcgccaagatccggcgtcggaacctcgacgctcccgtcgttaaccccaccgaccaagtactcgtgtccaagcacatgctcgaggcttctcttatgggtaatctagtttctctatcgtttctgttaattaggggaatattcgatgctctcaaactatgcactatgcaatgatttcaaattcgaagtctatatctgaagaatgaattgatggtgactgtgatacgctggggctagggctagagctttgtgatatcatattattatttacttattttatagtaaaaaaatagaataaaaaatcgtttaagctataagtttaatttatttttgaaagaaaaaggttatgcactaaattttagtgccatcattcaatcgtaaatcttatgtatgtatgatatgtttnnnnnnnnnnnnnnnnnagtctcaaatnnnnnnnnntgtatg

SEQ ID NO: 122 - DNA, 1099 bp, Glycine max
cttctcctttgcggggacttcatggaagactatgaagtaactaactacctaccttcttcttcttcaataacttctattctcttacgtgtttctgtgttgcttgtaggccatggttccatttcaggcattgcaagccttcggtctcgccgtcgacgccgtctgtcccggaaagaaatccggcgatgtctgccgcaccgctgtccatgtacttgccggcgcccaggtctctttcatcttctcttctgcttttgtttccttacatagtgtttccaatcattgaaatctgcaattcaattgatttgcaaaaaagacggcttggcttggttttttaattttatttttatcgatgaatagaatttcaactttttttatatggtgtgaaataaaaattataaatattagtcatataaccatctatggaaggtaaaaaatacttaaaaataaaataaaatcatatatacatttttattttaatcttggttatttaaatatgatctagtgatttatatttgtagctttcatttcttacattcggaagaactctgatttgatatgttctcaacaacttaaaatcagatctaatataattgcataggtttagagaaaagaaaagaaaaattcatttggacagtttggtatgagaattttattttctattttcacttttaattacaaaaatgccaacctgttttcattttaatttcccttttcaaaagtttataggaaatagtgaaaaaagtgtcatttccgaacaaatttttgaaaacaggacaaaaagcttgcgtcattttttttaaaaattaaaagtgaaaacaaaaaatgttttcttatactaaacaactcttaattaatcaattcccagaattgtagttccaagcctgctctcatagttgactttgtaattgatatggtggataattttgggtaatgcattttggctgctttcagacttatagtgagacggttggtcacaatttttcactcaatgcaacgtttgatgaagttgatgctgcaagctatgatgggttgtgggtgccaggtgggagggctccagagtatcttgctcatgttcctggtgttgtggaactggtgaccaagt

SEQ ID NO: 123 - DNA, 457 bp, Glycine max
ctgataagcagagaagaataagaaaatgggtgtgttcagtacagtgctgctgtgccttatgtccctaatgtggatggtggatgctcgaattccaggcgtatactctggcggcgcttggcaaaatgctcacgctacattctacggaggatccgatgcttccggcaccatgggtatgtacttgtgtagtactatgttatgtaacaagtagaaagaaaaactgagactttgttttgttgtgttcaggtggagcatgcgggtacgggaacctgtacagccaagggtacggagtgaacactgcagcgttgagcacggcactcttcaacagcgggctgagctgcggagcgtgcttcgagatcaaatgcgcaaacgacaagcagtggtgtcactccggcagcccttccatcttcatcaccgccaccaacttctgtccccctaactacgctcttccaaacgacaa

SEQ ID NO: 124 - DNA, 941 bp, Glycine max
  misc_feature (925)..(927): n is a, c, g, or t
  misc_feature (932)..(936): n is a, c, g, or t
gcatagcccttagaagaagaccctcttcctctcagggaatgggcggaagatggagaaccctctcttcgttctataaccgcataaccacttctttttcttattcttccaaaccccattttccctccttcaaccgctccatctctctcgccgccgccgcaacttctgaaatacccgacccggatcaattcgggttcgtagacccggaactcgatccctgcgtcaaaatcccagtcaaagcttatttcctctccaccaggtacctccccaataccctatccttttcaagttccttaatttctctcgacccttttgttgttttgtggaatgcgcaaatgggtcgttctctgaatctcgtttctctgctgctacttatgacttcttttactgttccatttaagaaagagaagatcatgttatctgggagttaaagtttgtactgttagctttttttggtgatggaaggtaaatttgtacttttacctttcatcttagatttggaatttagagttttatgattatttttatttttatatgtttctatttgtcctatgttttagtgttcgatttagaagactgtgctgtgttttgtgggggggactgtaattttttttgcatttatgatattagattgggattttggacttttttattttttattctttttagtttattattaaagtggtaacttaatgcttgtatgtgatttataggttgaggttttctgggttttttttaatcttttgttatagcgatgcattgtgtttttccttggtttttgggttggaattgaattgaattgaacccgtttcctcttacttgtctttttgttgtcctgtttttgttttctatgatttggctgtctcagattcataattttggcagtataaatttgaagggcattcaggctgataatcacagaaacgtnnncctcnnnnncccgt

SEQ ID NO: 125 - DNA, 360 bp, Glycine max
  misc_feature (310)..(310): n is a, c, g, or t
  misc_feature (312)..(312): n is a, c, g, or t
  misc_feature (328)..(330): n is a, c, g, or t
  misc_feature (341)..(343): n is a, c, g, or t
tgaatttaaggagaaccatgtaaaatggttagaagatggtaatcttcattctgcagttttcagtcctgctgatgctcagttaacggaggctggtgatcccaagttaattaaggatccaaagcctaaatacagaggaaagtatgtttagagttttaaggtgatggtcttgtccctcaccattacaatagacagcactgtatttttcaatgtccaagcggaaaacgtatttcactctatggaagccaatgtgccctttttaattcaatctagtgatatttttcagatgttttttttttaatattatttcatnantatgtccttttcttannntttaagcaggnnnaaccccattaggtctca

SEQ ID NO: 126 - DNA, 364 bp, Glycine max
tgatcttccaaatttgataagctttcggccagaatagaccaggagaatgagagaattctgttatgtgtctgttgaacaattatctgtacatatttatggctactgtctggatagttgaaaaatgtacataaaatgacatgcaagaatgtaattatgcctttattttgcatgtttgtatttccccgtctaagaaaaattgtacataaatctttctttccccctttctcctctgggtaaatatgcctggtgtggctatctaaagtctgcgcataatgtaatgtgtaataaagatgtttggaccagggtgatggtgctcattattatgttcgtatagtaatgaattgtatttgaccgagcagagagt

SEQ ID NO: 127 - DNA, 313 bp, Glycine max
gattgggatgatgatgatgttagtgatgatttttctctccagttgagaagggagttggagagcaacaccgagaagaactaaaccacctgctagttattattgcttgatatgacatgcgctatgtcttgggttgggtgttcgagctcttggaaggagatgaaaactatgccttgtttggaaggaaatgtaagaacatagagacatgatttttctgtaccttcttgaatatatatgcttttaaagttattgagtgcttgtattgttcttatttttattttggggttgggtgggcatgcttttctatgaaccagtc

SEQ ID NO: 128 - DNA, 360 bp, Glycine max
gggtcgcggtgggaacgtgaagtggcgcgctttgaggcttgatactgggaactactcttgggggagtgaggctgcaacccgcaagacaaggattcttgatgtggtgtacaatgcatccaacaatgagcttgttaggactcagacattggtcaagagtgccattgttcaggtcgatgcagcacccttcaagcagtggtatctgcagcattatggcgttgaggttggccgcaagaagaagagtgcagcagcttctgccaagaaggaaggggaggtacaacaagttgaattgaactgtgtgctaaatgctaatacatgtttgtttgttatgtacagtttctgttttagatgctttccaagatg

SEQ ID NO: 129 - DNA, 510 bp, Glycine max
  misc_feature (57)..(58): n is a, c, g, or t
  misc_feature (380)..(380): n is a, c, g, or t
  misc_feature (391)..(391): n is a, c, g, or t
  misc_feature (478)..(478): n is a, c, g, or t
tgtctcttcgcatgtaactcctctcaagttctttgttttcctccatatcacggactnnaataattgaaagtagttgagatgcaaaacctcttcgactttcttttgttatattagagagtaaagttgacaaagaaggctctgtaaggatagtacgtcgagataggaccttaattttgaaaaagatacaaaaattcgtcataaattattagcaaattgggatcctcatgcttgtgaaagaaagagcataaattgtaaaacctacctcatgccacttccttgtgtatcgtttggtgacatcataaactccatcttttgctatggctattacataatttaattttttcccccacctatgccacagattttaaaaaataataatnaggaaacatgnaagaaagatgtaaattactaatgaggacaagaacaactattttctcactatcaattagatggatgatagcaatgaatacagtaaagngaaagtactgcataaatgaataataccctttt

SEQ ID NO: 130 - DNA, 396 bp, Glycine max
ttccctgccttcacgccctcgccgccgcgaacaccgccgccatcctccgcgtccctgaatccaccgccgcctgggccaagaaagccctcgacctcggcccgcagggcctcatgttccccatgatcgaatccccattatccgcccaggacgcagtctcctactgccgctttccccccaccgggctccgcggcgcggcccatcccatcgtccgggcctccaagtacggcctggacgacgagtatctcggtaattacctcgacgagcttcttatcatgtgccaggtggagtccgaggagggagtggcgaacactggcgcgatcgccgccgttgatggcgtagactgcgtgcagatgggccgttggatctgagcgcgagtttagggtacttgtgggaccc

SEQ ID NO: 131 - DNA, 321 bp, Glycine max
tgtcgaaccgcgagtcggcgcggcgatcgcggatgaggaagcagaaacagctggaggatctgaccgatgaagttagcagattgcaaagcgcgaacaagaagcttgcggagaacatagaggccaaggaagaagcgtgcgtcgagaccgaagcggcgaacagcattctgagagcacagacaatggaactggccgatcgattgcgcttcttgaactccatccttgagatcgctgaagaggtcgaagggttatccgttgagattcccgagattccagatcctctcctcaagccctggcagattcctcatccgatacaaccgatta

SEQ ID NO: 132 - DNA, 297 bp, Glycine max
aagtactacatctcctacggtgctctttctgctaaccgaattccttgcccgcctcgttctggtagatcttactacacccacaactgctacagggcacgaggccccgttcacccttactccagaggatgctctgccatcacgcgctgccggagatgagtttgatgtgagttccgatctgatcacacgcttcagatcggagatggaaataaaaaaaccgagtaccgtttatggtggttttgttttgttttgttttattggtgtactagatttatattgtggatttaaggcgtcgttagt

SEQ ID NO: 133 - DNA, 391 bp, Glycine max
agaggacgcggaagccgaatagaaggtatcatcataataccacttcttcctcttcctcttcttcttcttcttcttcttcttcttcctccacgacgtcgtttaagccgcaccggcgcgggaacagaaccaagacgcggaagcccaagtttgtcagcctgcggcttcagttatccgatcctaagaaaaagatgaaaacaacccagcccaagcccaagtccaagcccaagcctaaggcccaacaacaagaacagcagcagcaacagccgcagctgaatctcttccctctccatccggaccaccatgacatgcacgaggagcagaacgtggcgcttctctttagctccgatggtggggccacactcaacggactactggaggaggagacgactac

SEQ ID NO: 134 - DNA, 472 bp, Glycine max
  misc_feature (381)..(381): n is a, c, g, or t
  misc_feature (387)..(389): n is a, c, g, or t
  misc_feature (407)..(424): n is a, c, g, or t
  misc_feature (432)..(435): n is a, c, g, or t
cttcaccatttccttctctcttctttcttagggtttcagtttcaattcttcacatcaagtgttataaattcgaaattcaaaattttatttgtattatgttttccaattgatttaatttaattttgttcgttgttatataaacaggtagcattttcggtggtggcggtggtggccgctctcgcgaacccaaatacaagatcgaatttcatcccgaagattccccttttcaccctgtaagctttttgatgtgtttataataacaataattgttgttgttgttgttgtgccatttcttatggatacgatcttatgttcggtggttttagttgtaatttaagtgagtgttgaatgttctataaaatgcttatcctaagttttagnaaggannnaagattttcattgagttnnnnnnnnnnnnnnnnnntaagtatnnnngctcttggacatttcaaatttatttctttttatttac

SEQ ID NO: 135 - DNA, 226 bp, Glycine max
cacgaaaaggaaatgagtaccatgacctgaaccatttttgccacagactacaatgccttccaaagctaacaacatcgtaacatgagaatatactaatgtttataagttatgatattagacaataaaagcatggggtgacaggtccaagctggtaaatccttgtcctaagaactaaatttgactaaaaactagaaagcattacaaaaggcaggaagatgacaattta

SEQ ID NO: 136 - DNA, 390 bp, Glycine max
atcactgcaaaccaatataaggacagcaacacaaactcaagcaacaacacagactcaagctaccacaatggcagcaactcagactcaagagcaggatgaatatacagagactacaacagagcagagggtgcaattagtagctaggcccaagagagcagtcatcaaaccatcttacctgaaagactacgtctgagggtgagatgggaatttagctttgtaattttagctttgtaattttccttgcttgatgcttgtctggtagtgggagacaagccgaactttgattcccttatttcccttgcaagcaaaatatcccaattctgttagagacacttagtacaaatagctatgtgaataaatcaagcaaggcatgaatgagaattagctttc

SEQ ID NO: 137 - DNA, 362 bp, Glycine max
ggtatgtgggtgaaggaatggaagaaggtgaattctctgaagcccgggaggatcttgctgcccttgaaaaggactacgaagaggttggagcagaaggcgaagaagaagaagaagaacccgatgattactcaaagtagtcaatcattcatcaccagctaccttacctacatctaccttctttcctctgtctaatgtctatccttgtccattgaattttaagcatctttctgttgtgtgctagctctgttagtgttgggtgagataattgctttcctcatgagaagcagtggtttatttgtcagtttgaatcacttttaagtttcagtgaaagagcaaaataaaggatagcgtaggagtgctgc

SEQ ID NO: 138 - DNA, 358 bp, Glycine max
acaccccatacgcgccgccccctaccaccgcccaatgcccacgcgctaccaggaacccgacgatgatgaggacgacaacgaacccgacgatttcgacgacgacgaagctgaaaacggttacgacgacgaaaacaacatcgccgcgtatcctcggatcccgaagaagcgcaaggtagtcggcactgcagcggcaggaggttcttacgagttcgcgccacgtgtcaatttctcctacggaaactcccgcggttcgggttcgggcaaggagtggaacgagcacgagactttcgtactgttagaagtttggggagacaagttcctccagctcgggaggaacagtttgagatccgaggaatga

SEQ ID NO: 139 - DNA, 391 bp, Glycine max
gtgggtgaattgtgaaaagggctatgtctcatccacctctagaccagcccgttgtggctctgctcagtgctcgcttttcgggttatatggttgcagtactgaggacaaaatttgtggccgttctccaagcaacactgtgactggtgtctccacatatggtgacattcatgcagatgttgttactgtcaattccactgatggaaacaatcctactaaggtggtttctgtgcctaaattcctcttcatatgtggatcaaatgttgtccaaaaaggccttgctagtggtgtcacaggtatggctggtcttggcagaactaaagtttctcttccttctcaatttgcctcagctttcagctttcatagaaaatttgccatttgcttgagttcttct

SEQ ID NO: 140 - DNA, 484 bp, Glycine max
catttaaggaaattgagggctccgaggagattattgaggctgacctagttttactggccatgggattccttggccctgagtctgtaagtattcataatagcttcatctctttatgtttacagaatgtggtatttgactctactgtttgttggtagttgagaagaagttgcaacaataaattgaattgaaatgtccattattaggaagtggctaatgattgatatttctgctcttggttttgcagacaattgcagagaagttgggtatagagcgagacaataggtcaaacttcaaggcagagtatggtcgcttctcaaccagtcttaaaggggtgtttgcagctggagattgtcgacgtggtcagtccttggtggtatgggcaatttcagagggacgacaagctgcagcacaagttgacagtttcctcacaaatgaagatttagagcacaatgttgccgggagtccagacgaacttatcaagaag

SEQ ID NO: 141 - DNA, 495 bp, Glycine max
  misc_feature (489)..(489): n is a, c, g, or t
tgaagctgacaagtggatatagttcacggcgggtcaaccttatggcagaggagggaattaactttgtggtgaatgctaatatcgggcatgatcctttacattctctcgatagacttcgggaggaaaataatgctattgtcttggctgtaggagccacaaaaccaaggtgagacgtagtgccggagtcctatatattattattgtttgtatttttagttcaatttcgcttggaatggatgtatattagaaaaaggaatttttgttgagagatgcttcaaaggaagttttttttactttcaatgcagggatcttccagtacctgggcgggagctgtcaggagttcattttgctatggagtttcttcatgcaaacactaaaagcttgcttgatagcaatctccaggatggcaacttcatttctgccaagggaaagaaagttgtggtcattggtgggggtgacacgggcacagattgcatagggacatccatncggcat

SEQ ID NO: 142 - DNA, 388 bp, Glycine max
tgggaagagccggcgtggggattgacaacgtggatttgcaagcagccaccgaatttggttgccttgtcgttaatgcgccaactgcaaacactattgccgctgccgagcatgggatcgctctcctcgctgccatggcccgcaacgttgcccaggctgacgcctccaccaaagctggtaatttccatcttcttcttcttcttcttctttaattcatgttgcttgagaagagttgttgatgcctggtgttaattttgcaggaaaatggcagagaagcaagtatgtgggtgtttccatggttggaaagacattggcagtgatgggtttcggaaaagttggatctgaagtggccaggcgagccaaagggttgggcatgcacgtgattaaaaaa

SEQ ID NO: 143 - DNA, 371 bp, Glycine max
taatcagacatctgtattagatagtattttgcagggagaattgccctgtgaactggagaaatctaatcctacatacaatatattggcattattgcgggtgcttgagggtttgaaccaacttgcatctcgtttgagggcccaagtggttactgatagctttgcagagggaaaaattttggatttagttgagctaagttttaccagtggtgctagggttcctacagaggaatttataagcagcaaacttactccaaaattagctaggcaaatacaagatgcccttgccttatgtagtgggagtcttccctcatggtgttaccagttatctaaagcgtgcccttttttgtttccttttgagacccggcgacagt

SEQ ID NO: 144 - DNA, 243 bp, Glycine max
ttctgaagcagtttatctgatgctttagactagttagaacttccatatccgtgtaaattgtactattgcaggtctagttttcacttcacttatgaagtgcttggtcctttgagccaatggtttgtgtttttattatatttaacagaagtgcagaataaattttgtagtttagtacagtatgtaaagaaagatatgacaaacctgcatgtgacgcggagaaaatgaagctacagaagctagcag

SEQ ID NO: 145 - DNA, 374 bp, Glycine max
attcgactcctccccaaccaagagagctcgccgtgacctcctcgttctcgaagacagccacctcaaccccgcctcggccccgcaacagcagcgccgtctctgggtcaaggaccgctccaaggactggtggcagcggtgcaacagcccggacttccccgaagaggaattccggctccacttccgcatgagcaaggccaccttcgacatgatctgccagcacctggactccgccgtcaccaagaagaacaccatgctccgagaagccatcccggttcggcagcgcgtggcggtgtgcatttggcgcctcgccaccggcgaccccctccgcgaagtttcgaagcgcttcggcttgggaatctccacgtgtcacaagc

SEQ ID NO: 146 - DNA, 491 bp, Glycine max
  misc_feature (441)..(441): n is a, c, g, or t
tgcgtgcataaacagtaataaagaaagtgacgattaaaagtacagtcaagttcaacattatttacccaccaaatgttatggtagttacactatttttgcaatcagaaatttaatcaaaatccaattgatcgcctatggatgagatcaaaggaaagcatgtttattcaggtactaaacagagttcaatacattggccacaaagcacagaaccaaaactcaaaaacagcaatttccgaagcagcttgaaaggcagcattatcagttcctaactacgaatttcaattcttcttcacagtagcagcgtttatgatgtccacaaattccgcctaattacagacaagtacaaaaagtcagttgcttaaatgcaaagcaagaagtaaagaaaaccaaccacaaccaaaataattgggggggggggggggggaaacccctttggggggncccccccacaaaaaaaccccaaaaacggggggggggggggcaatttttgg

SEQ ID NO: 147 - DNA, 361 bp, Glycine max
tctgatcttgtttttattattgatgagaaacctcatggtgtcttcaaaagggatggcaatgatcttgttgtcacacagaagatatctcttgttgaagctctgactagttacacaggacagctgacgacacttgatgggaggaatcttacagtctccaccaactccgtcattagtccgatatacgaagaagttattaaaggagagggtatgccaattcccaaggaaccttccaaaaagggaaacttgaggatcaagttcaatatcaagttcccctctagactcacatccgagcagaaaactggcattaaacgattattgacatcttaaactctggtgatgcctctccttatcacataccgaa

SEQ ID NO: 148 - DNA, 362 bp, Glycine max
taaaagccttctgttgcaagtgagtaaagtgcgttgaaggctcaccttgaagatcctgtgtcctgacttatggacattcagacttctcttgtacacagtaattaattggtttgttaattctgtcttaattgatcgttcaacacattttgagatcacacttttgacttattttttcacctattgttgcaaatcgaaacttggaaggcaattgacacttgaatggaggttgcatttttgtgtttcatcctcaagtagattaagaagattcttgtttctccatggttataacagtttgactttcgagctttttaattatacttgtttgagtttgattctcacccgttgtacgtgatttagtgaat

SEQ ID NO: 149 - DNA, 637 bp, Glycine max
tcttttgttgtcgtctttatttttttctatcctatctctatgtgtatggtgtagataattataatgtgtcctctgtataccaccaggtatcaattgatcaaagtgttgtggatcttgacattccttttagacttggtggatttgcttcaactacaatacagcttattggtattgttggtgtaatgacagaagttacatggcaagttttgctcttagttgtcccaatggctgttgcttgtttgtggatgcaggtaattagaaattgtccagcttaaaatctttgtaactgcttttcacaaagatttacataaaagaaaaactgttttgttttggggaaaagtgagaattatattccggagggaaagagcggatacattgcaaagtgctagtaatcttccaattcgttgaattattttttaaatgtttgtctgtcacccaccctatactttgatttgttctaaccatcaaccaattccatctcagaaatactacatggcttcctcaagggaactggttcgtattgttagcatacagaagtctccaattatacatctttttggtgaatcaattgctggagcatccaccatcaggggttttggacaagaaaaaaggttcatgaagcggaacctctatcttc

SEQ ID NO: 150 - DNA, 401 bp, Glycine max
cgctggcctctttggcagtattttcaatccttaaataaaatgttagggttttacgatttctgaatctcaacgacgttttggcgctcagaaatggaagaacaacaatccaaaacgacgcaagagttggcgatggaagggcagaagtacttggaagaaaccatagagaatgctttccagatcctttcttccatgaacgacgagctctgcaaccccgttttgtggtccacctctccctccgcctcctcctcccccaacgccgacgccacttccgaaaactccaaccaccacgccgacgccaccaccgccgctgctggcggcggaggcgccctcgaacaggcccgatcccgatacaagaaggcagtcgccgcgcttcgcaccattctcactgccattcctaactc

SEQ ID NO: 151 - DNA, 669 bp, Glycine max
agttttagacagaggagtctgatcaacatgtaaactgtaatcctaaccttcaattttttgtttaaaaaatgctatagatctttatataactgttttatttgtgtataaaatcaggaatggtgaaaagagacacttatggcatgtttgattcccatctcactgttttgttttaaaaaatgattccacactactcaacagacaattacccatccgaaatctattaattgttttaaaaaccaataaacagaaaaattgttagaattttctccttttggattttcttcgagtgctcggacaaatttttagaatacagaaatgtgcttaggggatgaacactttcaaattaggaaacactaaacaaacaaggccttagttttttttttcctgacatgtttatttggttctacaggcatcctgtatattctgttgctttcagtcccaatggcgattatctagttagtgggtctcttgacagatccatgcacatatggtcattgagggacggcaagattgtcaaaacatacacaggcaatgggggcatttttgaggtctgctggaataaggagggtgacaagattgctgcatgttttgctaataatacagtttgcgttttggattttagaatgtaatatctgtgaagcgccaatttctcctcaccagtacattaaa

SEQ ID NO: 152 - DNA, 848 bp, Glycine max
caggctctcttgtcatgctcacctttcgttcatcttttacagcaattaagaactcgcaaccttcctaaggttagtttttctgctgctgcatgtcaactattaaccaattaactaatactgccatgtacaggttttagcttaacttatagatgagataataacattaaaggaataaagacctaaaagatgtattatgcattcagatttcccttatgctagaaaattattgaactgatattatttcttgtttattattctatattatattaggttgggtatcccacattgacggcatttgctgagttcatagcccaatttgatatgccaagcacaactaaagtaaagaagcaagatacagatacgtttgagtctggaaggccatttcgccctgttatgtttgaagttgtcctaaagaattttactccggatgtgccaaatagcatttcaggaagaccaaggttggtaatagggacttgtttataatattattttacatgaatagtcaaaatcttcatttgctttctttctcaatcctccattcctacacttcaactgtgatttcacaatattcctatcatttaaacaattttgtctgtcgtaccaatgtgtctgagattttatagactcgtcaagaaagttatttggtaatttgaaagtgtggaatgcccaagtgtcatgatctaattggtaacataaacttgcaactttgtaatatacttggtttcaacatgtcactttcagacaggaagatgctcaggaatttctgagctttgtaatggatcaaatgcatgatgaattactgaagcttgaaggacactcttcaagtcttaacggcagcaaatcttctc

SEQ ID NO: 153 - DNA, 944 bp, Glycine max
gtagagagcgaggcatgcttgggttgctttctgttgaagaaatgcgccaacaggttttgtgttggaaacagttcatgatttgtgttctatttgagtactggatcttgacgaggatattaaaacctcagttttcttgaatatcaaatgttacttttgtgtttctattctaaaatttgtcaacctgcctgtgcagcttcgagattggctggacttatctctgaatcactctgttccatcatctcttttgatactttcaaggtaattctaccatggcttcctccctcagtcccttgatggggccaaatagtaagttaaagaaaaaacctgctggatatgtattttgaagtctcactcgatatcctttataggtcatttactgtgtctgggagattgaaaccagaagaagctgtacaggctacactttcttctctccctgatgaggttgtagatactatacaggttacatctttgccctctgaggattctgtctcagagaggaggaggaaattggagttccttgagatgcaagaagaacttattaaggtaaactatggaattgcattgctctagatacttatcctgttaaaaggtatctttgttgtattaggatgacattgacaaggttattctgtttgatagtgtttgatatttgctctggttcatatgagaagaatctactaaaaaatactaaatgatcagtgacataaaaagaattatttcaatattttgtttgacagaattcattgggagtctaattagtaagtttaacaaatgtgtgttgggtgttgatatgctagagttcaccataaagttcattttctggttttaaataactattgatgaaaattaagtagctttcttttgatctaagattccattttaccaaaaaacacaatgcgtaacatagtattataaataaaatgcaggaggaggaagagagagag

SEQ ID NO: 154 - DNA, 606 bp, Glycine max
catcctttcctagatgatacaacttagttacagaattctatcaatagtcctgtctaccaaattcaccattccatgtgccacattctctttaaaggaagtcttgtagtaacagtgtaaaaagtgaggaacagcgtaattataggaaccatctaccttaccatgcactaaatgttggccaaattgactaagatttatggttttgatgcagactcttgcacaaacacgcgaattgaggactgttacattgtctctggggatgactgtgtggctgtgaagagcggttgggatgagtatggtatagcttatggaatgccaacaaagcagcttgtaattagaagactcacttgtatttctccattcagtgctgtgattgctttagggagtgagatgtctggtgggattcaggacgtcagagctgaggacattgtagccatcaattcagaatcaggggtcagaatcaaaactgctgtaggaagagggggttatgtcaaggacatatttgttagaagaatgaccatgaaaaccatgaaatgggcattttggatgacaggaaattatgggtctcatgctgatgacaactatgatcctaatgcacttcctgtgata

SEQ ID NO: 155 - DNA, 569 bp, Glycine max
tggactgattaatcagtcagatgtggcattacacctgcatgaagaaataaaatctgttgctgaccttggagattactacgaactcaactcaacaaaaggaaacagttacagatgtgaagttgctgtggttgctacaccactggatgagttagatattcaatttattcctccaatttcaattcctgagagaaaattacagcacacatttacaacttttgtcaggggccttctaaaccctgtgagtattttgagacctgactcctgagtcagaaacttactgacatcatgtaatacatattttatctttcagtcttgtatacttctccttttatgttggttggtgctacttctaagttctaatggagatgctttgttgtggactaggcatattttggtctgaaggctgtgacaaaaattccagatcttgtgggcacaatagaggaccctgagcttccattttcatgcattgcagttctcaagaagcacaatgaaaaagaatctacttataaattattttctcgtcaaccaatggcagacacattactggatagcatcttcagtgtgaggaa

SEQ ID NO: 156 - DNA, 378 bp, Glycine max
gaccagagtgtggtgttgtttcgtgatgttcctctctctcaatgctcttgcaatagcattggaagatcacaaccttaaaacgacgtcgaaggatgacatcaagtgcactccttgcggtcaaattccctcgccgcctccaccttctccgccgccgccagctccgaccactacctactgccctccgccgccatcgcctccaagctccggcggtggtggtgcttactattactccccgccgccaccctctcagtacacctactcctcgccgccgccgccggcgtccaccagcggaggcggtggcggtggcgcgtactactacccaccgccgagagggtactacccaacgccgcctcctcccaacccaattgtgccctattt

SEQ ID NO: 157 - DNA, 341 bp, Glycine max
  misc_feature (123)..(123): n is a, c, g, or t
  misc_feature (178)..(178): n is a, c, g, or t
  misc_feature (298)..(300): n is a, c, g, or t
  misc_feature (305)..(308): n is a, c, g, or t
  misc_feature (312)..(338): n is a, c, g, or t
agattgataaaatcagagtcaccagggaggagaaacaccataagaataggttattctttgactccatctttttattttaatctgaaagttttataagtacaatgtgttttctttttgctctcngctgacattttgtgaaatctctcgtaggatgaaaggcaagaagcagaagctgcanatggaggcagctagggagttggaacagggcataagtctggtcaaagctccatctgtgcttcaaaaggacccttctctcactttacccaagatcaaagttggggtttctcaacaacaatcnnnggacnnnnatcnnnnnnnnnnnnnnnnnnnnnnnnnnnctg

SEQ ID NO: 158 - DNA, 355 bp, Glycine max
gtatatctaaacacaaaatcacatggaaaaaatgagccaggttcttctcaaaagatatatctcccaaattacaaatagcttgaagagtggtgagaaccaatgcagctgtctaccatgaaaagattcagatacttttccagaacctgcaacttcaatatacaaaatcgaatgagatgtgtctcgacctcaacctcctcataactaggaggtctgtccacagtgaggttctgtaaaaatgtgaggcatagttggtaggattcatgcattctccaggcgtaacagtggagggtcttgcatttgagtcatagagccaaactcttgtaactttgaacgtaaaataatattgctgttaatc

SEQ ID NO: 159 - DNA, 1143 bp, Glycine max
  misc_feature (1129)..(1134): n is a, c, g, or t
gtggggaatcagcgactaatttcttgttaaatgatctataattactggtaggtttgaagagagagaggagggatccacttactccaagagcaagtttgaagatttactccttatcttgtccattcgtttatttaaaatctaacggtatagattaatttaagacattgtatcatgtgactcattttctcccttcctcgttgtttcacgttcatatcgaatgccttctgcagaaaggaaaaaaaagatagggaaccatatttccctttacccttttgtttcctttccatatgccatttcagaaagaagtgaagttgaacatataagtggatccctcctcagtccacacacacacaaatacatgcatgcatacataaatacatgcatacatacacacacacacacacatacatgttaaaagcgattatattatgtatggggataagagcctttaactgaaaaattgtacaatttcttttagtcttgatgtaagttaatgtcccttacataacatccttaacattgtcatgcaggagatgtcatataataactacttggatgctgatgctgcttggaactgtgtatgcgagtttaggaaccccacgtgtgtagtggtgaagcatactaatccatgtggggtagcatcgcgtgatgatattcttgaagcctacagactagctgttaaagctgatcccgtgagtgcatttggtggaattgtagctttcaatgtggaaattgacgaggtaaatgttctatttgaattttagtctgttaggaatctggggaacatgtgcaatcgagctagcaatttgatttgggcatacaaatgtcaaaatagtcaactccacctagttggatagtgcttgattgttactgttgtttttgcattgttgtctaaattcaaatatattttttcttcttttcaagtgatgcagggtgacctagtccatggtttcacattttaagccaggactagggtcttgtttgtcttttttatgtagatacaggcactttccctacttaccttttaagatcccatcttggcaatgaggaggaacagtgatataaaattaatgctttttaatatttaggcacttgctaaagaaattcgagaatttagaagccccacagnnnnnngagacaagg

SEQ ID NO: 160 - DNA, 520 bp, Glycine max
  misc_feature (372)..(372): n is a, c, g, or t
  misc_feature (379)..(384): n is a, c, g, or t
  misc_feature (386)..(393): n is a, c, g, or t
  misc_feature (404)..(404): n is a, c, g, or t
  misc_feature (414)..(415): n is a, c, g, or t
  misc_feature (445)..(445): n is a, c, g, or t
  misc_feature (455)..(461): n is a, c, g, or t
  misc_feature (465)..(470): n is a, c, g, or t
  misc_feature (495)..(498): n is a, c, g, or t
  misc_feature (517)..(517): n is a, c, g, or t
caatcgtgtttctctgataagctcgccaaaggaaacttgttaaatctggaacaatctcgtagcaaaaatatttctctcgaaaggcgctggagtcttgaggtatctattgagaaagtgattgggcatgattcaagattaggatcaacagattctgtagcagaaaatggagataaagtcccaattttggaacgcgagtatatgcaaggtgtgttaataagtgaattagttttaaataatagtttttcatcaatgtctagaagggcaaaacagctccaaaaaaaacttgccaaagaaattaaaagacctggtgaagcaatcattaaaggtcaccggagctatgatctgatgcttagtttgcagcaaaatcagatnatagctnnnnnnannnnnnnngattgcttcanaggtcttttnntttctttggcagttttttttggaactgttntgcccttctnnnnnnngatnnnnnntattatttaaaactaattccttatnnnnacaccttgcaaatactcgngtt

SEQ ID NO: 161 - DNA, 676 bp, Glycine max
tacaaatcctgttttccatttgtttgattcagaccaccccataccaaatcacatgggcatgttttactacttggaaatgtctcaattcacttcaccaatcaaatatttgaactattgagcaaattgcatgccaagatatcataaaaaattctatctgtgaaacatgtgtatctatgactaaagcatcatttggatttaattcaaaggtacaagatgagaattcaatcagcagacataaaagggcagctgtcttgacaaaagaatcaaaaggggatttcctgtcacttctaggagatatggatgacaaaaaataccctatctacatgactggtaaattgaagacatctcacatctggatcccttcttgtagatatactcttgattatcactttttctttctcctattctcaggtccattacttcacaccctttgtactgcccttatcgatctggacaaacagacactatcaattattgaagggaatccaaaaaaaggagatgtttcacatgttttctctatcgcccctcaaaagtcaccatgattctaaagcagcctaaagtcattataattgcaaaagaacctgttactgcagttccttttttatgctggtttatagaggcccaagatatgcccatcaatacaccgcatagctgcaacctgatcacaaagggacct

SEQ ID NO: 162 - DNA, 408 bp, Glycine max
aagtaagcaagcattctctgaaccctaatttagtttgaaggaatctaagcggcgcggtttttggcaggatggttcgcgtgggaagaaattcacgaaacggagagagcagcattcaaggaatacttcgacggaagctcgatatcgcgaagcccgaagatatacaaagagtaccgagacttcatcatcaacaagtacagagaagagccctccagaaggctcacattcagcgaggttcgaaagtcgctcgtgggagacgtgacgtttcttcacaaggtcttcctcttcttggagcattgggccttgatcaactacggcaccgcagaggatgtggaggaggaccattgcaaggttcgcttcgaagaaggcgcccccagtgggattcgagtcgccgccacgcccaattccttg

SEQ ID NO: 163 - DNA, 447 bp, Glycine max
gtgtatggttattacttgttgatgtgcaatctaaaataatttcaatgtttctggttatttgaagtggtgaaggttcacacctgcgttcttaggtaacataattatataaattagttgcatcatttcctgcatttgtacttcttagttatcactggttattatccagaaaatactaaaatgaagaggattgattggttatttttctgaagccagtttctacgtaggagcaccactatcgctgtgtggtggttgtgcagtagaggtgtttaacttcctagcaaatctagtgactgagttcattgtcaagggcaagaatcagatgcaagtaacagagttagaattctggcaagttgtgaatcctctcttcaagcttgggtggaagcattggattggtgctgctgttttcttatggggttggattcatcaacaccagtgccataagaatct

SEQ ID NO: 164 - DNA, 403 bp, Glycine max
cttcttgacgagagtaaggtcgtgccggtgtcggtttccggtgatttggagattgaaatcaccggaattcagcacgattcgaggattgttagttctggtgatttgtttgtgtgttgtgtggggagaaaaaccgatgggcatttgtttctgtctgaggctgataagagaggtgccgttgcggttgtggctagtaaagagattgatattgaggacactttggggtgcaaggctttggttattgtggaagatactaatgctgttcttcctgctttggctgcctcgttttttaaacaaccttccaccaaaatggctgtgatcgggataactgggacttatggcaaaacgaccaccacctgtttgattaaaagtttgtatgaggcgatggggctgcgcaccggtatgt

SEQ ID NO: 165 - DNA, 672 bp, Glycine max
  misc_feature (464)..(466): n is a, c, g, or t
  misc_feature (475)..(476): n is a, c, g, or t
  misc_feature (478)..(478): n is a, c, g, or t
  misc_feature (490)..(492): n is a, c, g, or t
  misc_feature (521)..(523): n is a, c, g, or t
  misc_feature (527)..(529): n is a, c, g, or t
  misc_feature (545)..(547): n is a, c, g, or t
  misc_feature (550)..(551): n is a, c, g, or t
  misc_feature (554)..(558): n is a, c, g, or t
  misc_feature (566)..(572): n is a, c, g, or t
  misc_feature (585)..(586): n is a, c, g, or t
  misc_feature (589)..(590): n is a, c, g, or t
  misc_feature (592)..(598): n is a, c, g, or t
  misc_feature (600)..(606): n is a, c, g, or t
  misc_feature (611)..(622): n is a, c, g, or t
  misc_feature (628)..(630): n is a, c, g, or t
  misc_feature (632)..(634): n is a, c, g, or t
  misc_feature (636)..(640): n is a, c, g, or t
  misc_feature (645)..(653): n is a, c, g, or t
  misc_feature (656)..(657): n is a, c, g, or t
tgagattgtatacaaaaaatctacagtttaagcagttttaaattcgctgactggtggagggtgatgatgtcttcccgaccttcagagcaagcaataggaaaatgcagaatgagaagcaaaggagagcaagcataatcacaagcacggctttgaacgagacgagcggggcgaaaaagaacacgatagcaattgtagcgcattgccatatttttagctgagcaaaagccccttcctgcacaagaaagcaacatagacttggcattaattataaaagaaaaatttaaataaaaaaaagtatcagagctaatggaaaaataggtgattagagaaaaaaaaaaaaaaaaaaaaaaacccccaaaaaaactggggggggggggaaaaaaaaaacgggggggggggcaaatggggaaaaaaaaatgggggaaacccaaccctaaaaaccggggagaaaacaaaaaaacccnnnaaaaaaccnncnggggaaaaaaannnaaaccttttaaaagggaaactttttttannngggnnngggtaaaaaaaaatcnnncannagnnnnnaagggggnnnnnnnaaacccccccccnnccnncnnnnnnncnnnnnnnaaaannnnnnnnnnnncccccnnncnnncnnnnnttttnnnnnnnnnggnngggggaaaaaaaaaa

SEQ ID NO: 166 - DNA, 378 bp, Glycine max
aatgcaagagtggacaacacttcaaaataaatgtgacttatggacaagggttgccaaagagtcttaaatccccagaagatgcaccatctcctgctagtcctgttgctggagatgatgaatcagcgccagacactattgttccttctaatttcagtcaccccaaagaagaaagtgatgatgacaaagctagtgatagtgacaaacagaaatcatctagttctatttcaatctcaatgtatgcacaacttcacattgtcttactagggatactacttttcttgttttaaagagtggagatttattttatattattttttaattatagatatatgctactattattttatctatttttttattgggtgtgagtgagacagt

SEQ ID NO: 167 - DNA, 370 bp, Glycine max
atctgactgggatctggaactttactaacccaggagtggttagtcacaatgaaatcttggagatgtacagagattatgttgacccgaacttcacctggaacaacttcactctcgaggaacaggccaaggtgattgttgctccgaggagcaacaatgagcttgacgctgccaaattgaagaaggaatttccagaactgttgtctattaaggattctcttattaagtatgtcttcgagccaaaccagaaggttaaagctcaagtctaaaggttcaagcttttctcatttttatcatcatcattattattattattattattgtcctcgtttgatttaagtttgtgtggattttgtgtagatgtcactctccc

SEQ ID NO: 168 - DNA, 443 bp, Glycine max
agcagctccagctttgtgttattttaactacttttgttggacaaggtgaagaagaattgtggtgtcaacattttgataaacggagtcaacattttatgggcttctctatagctccgtgctgaatttttgggagggctatgatcaatgctgttgctcatggctttactattattatatttaagagtgtaatttagggcaaaaaagtaatgtaaatgtagtttggttagcatagttttagtaaaatattgaaatcagttcttctcaattctcattatcacgtgtattatatgtaaaacttcggttaggattatctttctatatgctagcctgtttgttatggttcaattggtttcctactagtatgtgagacacatttagtcaaattccatctttccagcgaattcagtttttcctctcaaattatcctagttcatgccatgcag

SEQ ID NO: 169 - DNA, 612 bp, Glycine max
  misc_feature (454)..(454): n is a, c, g, or t
ctttggtccactctttgtgatcatcttccaacattggtggaactgaaactggtatccaaactccagtatcttcttgcagtggagtatcataatagaagtactttccccgcttctgaagattagctgaagactccatgtcctcgttattcttttccatttgtttttcgggtgattcaagatataatctagaagaatttatacaatgcccttcagtgctatcattgaaaaacgaatcacaatactctttagtaacacaattgctcctccgaccatccacctcatcatcctgtcaatgatatcaagcacaataaacaaatcaaccatataaaccatagagcaccaaactacaacctgtctcaaagggagaaaatcaatatcatttgaactttaaagtaatatattataatttaatgtccgtaaacgatccatgaatagttcccttattcctttttcncttccagtttcatttttaaacgcaacatcaaaacatcaaattaccccccaataaaaaaaaagatatgcaaggttaaattccacacatacacaaacaacacaaaaatccaaacaggtgcagaaatttccaattccccaaacaaaaacacatgcatatct

SEQ ID NO: 170 - DNA, 811 bp, Glycine max
tagctgagagtttaggatcggaattctgccaccgttcttcttcatctcacctacaaccttaacctcgtatgtcaccttcttttaccttattttcttcgaattcctatttgacacaaagataataatatatttctttaatccgaagattcgttgttttcttcgttcaattgctttagcttctcgtctcggcctttgattgaatgccttgaaacccattcaattttggtctctgcaaaattcccttctgggttttgttccgtgtttttggcttggctttatacatttttctgctttcgaattcatgtggctgatgcatagtttcgtactgattatccaatatatttgaagccctgctgaaattacaacatgtgtgattgtatcattgattttgggcatcgatttctttttcgtatgatgtttttctctcatatttaagatggttatgtggatttggggcacttgacttttcatcaatttttcttaatattattttgattaggggattaaagatgtcatggctatatggggtgcttgatggagggtgccataggttattatttggtttcttttttgcttgctttcattcttttagccttttttttcctttctatcttcattgataggaatgcatttcttctttctcctgatgggaagaaaaattgatttggatcactttaaccagttgaacgaacctgtcttggcagtttcttcaatcatccatttgagtatttgtagaagtctaaaatgctgattatcatgtctttttgggctagctgtagaatttgttagcgttagaaagtttctttttttt

SEQ ID NO: 171 - DNA, 815 bp, Glycine max
atacaggggagttactctgcataagtgcgggcgatgggaagctcgtatggggcagtttcttggtaaaaagtgagaaaacaaaactatttggttgaataaagttttttcagttttctatttccatgtgcattaatatgcgagattatgtggattcctttgctcgtgataaatcagaatttaagttggccagggtttattgcttgcttgcaggtatatatatcttgggctattcgacagtgaattagaggctgcaaggttttaccaattaattgaatatctcagcctaaattccttaacattttggattctgtatatatacatatatacagacacacacttgatgtgttattttttacttgctgtgtatatacataattccagagcgtatgataaggcagctataaaatgcaatggaagggaagcagttacaaacttcgagcccagcttgtatgaaggggaggtaatttcccagtctgataatgaaggtaccacttatttatttatttccattgtttcataatctgcttattgattgatctatataaagttatggattaaaacatttaacgccaccttcactgcgacactatttcagataccaagcaaagtcttgatctgaacttgggcatagctcccccttcttactctgatggtcaaatcaagaacacacccagcaacgggagtggtatgatagctccgcagagctgggatgatatccctctcgataagcgagttatggtaaggttgaggagtgttgtatgatggcccatatggttggattcaattattctttgagtctgcatttttcatttgtt

SEQ ID NO: 172 - DNA, 418 bp, Glycine max
agacgacgcccttcaccactcaagactcttccttttccaattgggtcacatagccttcagcacccaagcccatatctcccgcctgcccagaatggaacgtgctcttaggttaatttggacaacactcactccttctccttctccttcttcaaccgccgataactcccaattcacacaacagagcttctacgacctttccatgctttccctttaatcaccaccactcactcactattagagaaaggggtaattctatttatactgatataagtaaagagaataattgtaatttactcggtttttcctctatctctttcttactcatcttctccacttttcttagtaagtttgtgcgtgtgattcaagtttttattgtttgatttgtgctagattaatgttctagatccaacactcactc

SEQ ID NO: 173 - DNA, 555 bp, Glycine max
  misc_feature (52)..(57): n is a, c, g, or t
  misc_feature (490)..(491): n is a, c, g, or t
  misc_feature (513)..(519): n is a, c, g, or t
  misc_feature (528)..(530): n is a, c, g, or t
  misc_feature (536)..(548): n is a, c, g, or t
aatagaggtccatgacaaataaatgaaaaatggctgccaaagcagccatccnnnnnnataaatcttgtaaatttgaataaaacatttgccagacctccaatgaagtttaaatgaggcaaaaaaactataatgaactaatagcggttccagtaggttctgcgtcggaaccagttgtaatcaggcaaacgctgaataggacccgtggcagcaataacaacatcctgcaagagaaacatgtgacaagatcataaattctaaagagacatgacaccactagaaagctccaaggaataaactaggtgtctctactactaaatagtaaggatatgtttcaataactaccttgtcatagataaatcggttcgcaacacgtttaattgtactggcatcaacagcatcaattctagcaaacaattcagcaaatgggattcttcgaccatatgtgagtagctgaaaacaaaataaaagaatgaaacatcaaatggtagtnnagcacatattgagagaaagagnnnnnnnacaaattgnnnaggaannnnnnnnnnnnngacatta

SEQ ID NO: 174 - DNA, 448 bp, Glycine max
  misc_feature (380)..(383): n is a, c, g, or t
  misc_feature (388)..(397): n is a, c, g, or t
  misc_feature (403)..(405): n is a, c, g, or t
  misc_feature (415)..(421): n is a, c, g, or t
ctaccgccagctctccctcggcacccgcgtcctcgacatccgcgtccaagaacaccgccgcgtctgccacggtatcctcctcacctacggcgttgacctcgtcctcaacgacgtcaagaagttcctttccgacacgcagtccgaaatcataatcctggagattagaaccgagttcggccacgaggaccctcccgaattcgacaagtacctggaggaacagctgggggagcatctgatccatcaggacgacgccgttttcgggaagaccgtggcggagttgttgccaaagagagttatctgcgtttggaagcccagaaaatcgtcccagcccaaacctgggagtcctctctggagtgcgggctttctgaaggataattggnnnnacacnnnnnnnnnntggaannnctactagatnnnnnnntgtcgtccattgctgccacccattatg

SEQ ID NO: 175 - DNA, 377 bp, Glycine max
tcatgaagtttgtgactgaaatcaaatcactccgactcccatttcagccagaatccacacctaatgcaatggaagcggagtccttgaatgaaaagagtatcaggagaatccacaaggcattggactctgatgatgttgagctactgaagcttcttctaaatgagtctagtgtcactctagatgatgcatatgccctgcactatgcttgtgcctatagcgattctaaggttattcaagaagttcttagtctaggcatggctgatattcttcgtagaaattcccgaggatacacagttctccatgtggctgcaaggcgaaaggatccatccattttggtagcactactgaataaaggggcacgtccatcagataccact

SEQ ID NO: 176 - DNA, 321 bp, Glycine max
  misc_feature (313)..(313): n is a, c, g, or t
agagatcagcaaccatggagataatcaaagatgcctgtgagaactggggtttctttgaggtactcttaaacaacatctattctccttaattgatgtttttgtttcaaaatgaaaagctaacatattccttgtttttcttttattaagttggtgaaccatgggatatccatagagttgatggacaccgtggagaggatgacaaaagagcactacaaaaagtgtatggagcaaaggttcaaagaaatggtagcaagcaaaggtttggagtctgctcaatctgaaatcaatgatttggattgggaaagcactttcngcactttc

SEQ ID NO: 177 - DNA, 502 bp, Glycine max
aaattaactccttaccttcctccaatatttctcttaatcatacttaacgtgcactcaaccacattcatcacaactcacacccttcataagctttgtgttttttcgtagaaacaaagatctgatcatgactatgatgagcagcagcaacaacaacgttggagaatttggagacaccactctgaccaaggtttttgttgggggcttagcttgggagactccgaaggatgcccttaaagaccactttgagaagtatggtcagatccttgaagctgtcatcatttccgataagcacactggcaaatccaaaggctatggctttgtaagtaattaaattaattaattcatgattcatatatattgaaagctagctagctatagtaatcagaaatgttaatcaattaatgttgtaatctttgtggtaaatatatataaaaggtgactttcaaggaggctgaggctgccaagaaggcttgtgagaattcaacaactctcattatcaatg

SEQ ID NO: 178 - DNA, 385 bp, Glycine max
attacatgcgtatgtcaaaccgccttcagttgagacatctgctagtggaactaagaaatcatttaaaacaccgaaagtggcaggccgcggtaatcatgcagaacccaacaagaatgcgagtagcagtaatcaggaaaatcagactccaactgtagttagtgaatcaaaaacatcgcaaaaggggaaccaagtgaattccaagaagaagaaagccgggaaagttgtctcacttgctgaggctgccaaaggatccattgtgttccagcagggaagaccatgctcctgtcaagcacgtcgtcacaggctggtcagcaactgcttatcttgtggcaaaatagtctgtgaacaagaaggagaggggccttgccatttttgtggtgcactt

SEQ ID NO: 179 - DNA, 1359 bp, Glycine max
  misc_feature (1304)..(1307): n is a, c, g, or t
  misc_feature (1347)..(1349): n is a, c, g, or t
gcagtttgatatatatttgctgagacctccaaaatcgaaatgattcaattcttttgggaaaatgaagcttatgttgccactttagtttatattcctcaattttaaatgccttgtgcttttctcaccaaaatgttaagaatctttgaaaatagaatatattagaggattaattatttttcataaacattcagaggctattgtcccatatgtattccagaatagagcatttgatttagatgcaacatgcatcatccactcatgagaagtgagacacatacacatacacatacatgtggctcatatgtgttgtcagtttttagtaactattgagtgatttaataaaaagtgactatcctactttaaccattttgtggatataaatggaccaaaatagtacctttttatgttcattttgttacttttttctacagatatgcaatgagttttgctgcaaatgagctgaaaatgatgtatgtcaacagaacacctaagtcaaacaaagcaattcatattgtttctagtgcttacaaggctactttaacttggaataatatgcgcactctccaggtaagtattactattatactgggtttgatagataatatgccattgacctcactagggttctattaatgcatgaaataggaatgtcgtgaagcctgtggaggacaaggagttaaatctgaaaatcgtgttggcaatttcatgggtgaatttgatgtgcattcgacatttgagggggacaacaatgttctaatgcagcaggtaaaatgagtattctgttatatatgaaatttgaataataattaagcacaacatttttaaattcaaacctaggagacatgatgagctgattgcaaagcattaattggatcctaacaagttgtgttagtttatttacatttgacttttaagaggtagtgttagggcctgttttggtaagcttctttagaagcacttctaagagaagaaaaaaagaaaaaatgatatgagcttctacataaactaaaatgagctttgcattagctaatcatttgctaatttgtacttgctagggctttgagcttcaatgcttcagtagcccttaatatgaatacttcatgttactatcaatttgttgaattctaatttaggagaacctttgtatgtagactttctagctaatgattttttacttgctcacttgaagaattacgtagcctgaaataattcatgccaaatttaggcatcaatttctcaattttattcaatacagtgttcacgggttcttcatttcactccagattagcaaggcactctttgcnnnntatgtagcaagtcagaagaaaaagaaaccattcagcggtnnngatagaacac

SEQ ID NO: 180 - DNA, 344 bp, Glycine max
  misc_feature (326)..(332): n is a, c, g, or t
ttatcctttaatatttatgtttgattcttacgtataaaaaaataaattcattagacttgtccaggtctcatggtcattgaattgctcgtgttaatgtgaagtaatttaataaactctcgtgcttgatttttgttttccatttctctgttccaaaactaaaaatgtgttgagatttgagtattgctatcttaagaagggttgtttgccaatgttgcctgagagtcttatccacattttccctggttgatacatgtcgggctaaggatgctatttgtcctttactatcacgcatgttttaattatttccgttgtccacacgtctaaannnnnnnggtgcggagccc

SEQ ID NO: 181 - DNA, 452 bp, Glycine max
gtaataaactatatatatcttcttgcataactagagttatctaattaatgtcaccatgctaggtgtgtgtatatatatatatatatttgtatgtataaatatcatcatgtagatcgtagattagagtttatatgcactgatcatccctttcttttctcatttacaggtttgctgtctaaggagagaatcgagaggccatccctatttcctagtgatagttaccttttcttttttgttctcttgcttccatatatgctactttcttcatcatctcatgcggatatttatttttgcttttttttttcttttcttccagctaggaagctttaggtgaattatgattttgaggttttgttggccctgagtgagtctggtatatgatgactcagcagctagctcatgtacttttttaagtatcaacaatttaatatcagtgttaatgtgtatgtttc

SEQ ID NO: 182 - DNA, 1308 bp, Glycine max
  misc_feature (209)..(209): n is a, c, g, or t
  misc_feature (211)..(211): n is a, c, g, or t
  misc_feature (247)..(248): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (304)..(304): n is a, c, g, or t
  misc_feature (450)..(450): n is a, c, g, or t
  misc_feature (452)..(452): n is a, c, g, or t
  misc_feature (472)..(476): n is a, c, g, or t
  misc_feature (510)..(510): n is a, c, g, or t
  misc_feature (552)..(552): n is a, c, g, or t
atagttttcaatgtaataagcacattatatcttcggtaaaactaaaatttagcatgttgaacgtaactagctttcattctaaagcaacaagggacttgtttctactttcttgtcttggaaagtgggaaaaccccgttgaatgtggtgtcttcggggaaccagacacactctaagtgccaaacttttatgcttgattttttttttcaagngnattaatatgtcaatataataaataaaattacactannggatactatttcaattngntnattgctttcaaaaattttcactaattttaattttngcatgcaatcaaaccccacttaatctttttattgccagggttggattgacttttctgacgggtcctaaatcccagtcctttttttgtcttttaaaaccatcaaaaacttatttcccatacatcatatactaaattatggtttcatngntcccaccatttcattgatgnnnnncagatgaaacaaatatatcttatggacaattagncattaatattgtatttttttccctgaatacatgtaatcttgncatgttgataggaaaaaatagttgaatgcttgtaatcatgttgacaagaaaagatagtttttggattacaagtttagatttgccaaaatataaggataaacctttaataaattatttaaactgcatttagaggtttttctatggtatccaagtacatgttgtaaatcaagcatctaaaagatcccgagatattcagtaatatgtatatgtagttcttgaccaatttgtgtgtggttaaccctcagtaaatccatataacaatgggcactatggaattgcgtactttatgaatcaagcttttcatttgcaacttaattcacgtataaacttttctccagatatttattcagcaattcgagcttttacagaaagcttgcgttcctgatcacatctcatatgtgacattcaaggagtcaactatgcatgctaatttctctgtgagtattcttctgaaaactattcggtgttgttgcttttagagacaggtttttacttgtttgtttccccttcagaccctagccatctgtgatcacttcaaggaagctcagaagatagcaaaagaggtgaaaagtagttttgccaatgaccctgacacgatggccgagctgcgtagagtagagcaagtagcagaacgcaacagcattgccttgaatgtttgtcgggcaggagcccttgatccaaagttgaagactttttttacattctgtcatcatcctttctatgctactgctattgtgaagagatcctgatagtaga

SEQ ID NO: 183 - DNA, 537 bp, Glycine max
tccgtcagagtatacctgcatgaacattgttcttgtacagagtgatgaagggaagaaggcacctgaacaatttctgttgcaaaaggtagacctttgtcttggatttaagaaaaataagggcaaattttaccttcatctacttcgaaaattatctgaatagttctattttccctttgcacaacctgtctgaatacctatgttcctacaaaacaggcgtacaacaaacttagcttccagaagttggaactcaacaaccagaacttattccttggagggttgaatcttggatttggtgacttgaaagcaactgctgagaacttgccaccagctataaaagaagcaaaaccacctgaaggactactggggaaggctgcttccaattgttgtggtcgattggctgatacctgttgtggcatgtgtctgttgcagacttgcacttttgtgaatgaccagtgcaccatcgtttgcactcagatatgtgcagccctggcctgttttgagttaatcaaatgctgtgttgagctctgtgactgagat

SEQ ID NO: 184 - DNA, 356 bp, Glycine max
gcttctttcaaatggtaacatggtccttcttgatgcacaaggcgggttcgtttggcagagttttgatcaccccacagatacccttttggtcggtcaatatcttagagcaaaagggccatccaagttggttagtaggctctcagagaaggaaaatgttgatgggccttatagtttggtcttggagcctaaagggttagccttgtactacaagagcaagaattctcctaagccaattctctattggttttcttctgattggttcaccattcaacgagggtccttggaaaatgtcaccttcacatctgatccagaaacttttgaacttggatttgattaccatgtggccaattcttcat

SEQ ID NO: 185 - DNA, 323 bp, Glycine max
atcataataactattgtacagggcatttaccacttatgatgttataaaaagtagtcaatgtgtatggaaattagttggacggatttacctttggagaagctttatctctttgaagctatttgattttcagaggatgcatcttccctcttcttacccacttcacgttgtgtttagcatgtggtatgtatgtaaatcaagtaagacatcacgatgtcatatttttgcacctttcactacagaatgtgctgaatcagtctgtttaggggttgacccggtccttatgctcatagttcatgccatcccttttaataagtttaggtgga

SEQ ID NO: 186 - DNA, 398 bp, Glycine max
ttcctttctgctccaaaaacaatggaaagcaaccaatcggctaaagagatcacggtggaagtagaagagttcgaggacttgctgcctgtgatggcaaagaagttggatgtggagacctttgtgtcggagttgtgtgggggtttcaatctcctggctgacccagaaacaggtttgatcactggtgagagtctcatgaggaattcaactctgttgggtatggatgggatgagcaaagaggaagcagagaccatggttagacagggagatcttgatggggacgggaagctcaatgaaactgagttttgcatccttatggtgaggcttagccctgggatcatggaagatgctgaggcctggcttcacaaggcacttgaacaagagctcaccaaatcctcaac

SEQ ID NO: 187 - DNA, 398 bp, Glycine max
tgcatttcctgctgctagtattgcccaagaggaaaaatgtctttgggacagaaacaagagactagctatctgtggagacttctgtgtcagtcccaatgttgaaggtgccatagacagtgccttcgcagcagcattaaggcttaaagatagtgtcagctctttatagttggagcattacaatctgtagttctccaaaccttgcatgcctttatttcagttttttctcctgggaaaacgtgttcaaaatttcttttaagacatttctgtattactaaacgcgaacaaatttcccttctacgacgaagccttgcacactacaaagtatgagaaagaggtacagggtggttgcactttgccgtgccaagtttgcaggaaaatggtgatgaaaccacctttga

SEQ ID NO: 188 - DNA, 398 bp, Glycine max
ctacacccatgtcgtgtccccgcaccagtgctgctccgccgtggtgcaggagatcgccgccccggtctccaccgtgtggtccgtcgtgcggcgcttcgacaacccgcaggcctacaagcacttcgtcaagagctgccacgtcatcctcggcgacggcgatgtcgggaccctccgcgaggtccgcgtgatctccggcctccctgccgccgtcagcaccgagcgcctcgacgtcctcgacgacgagcgccacgtcatcggcttcagcatggtcggcggcgaccaccgcctctccaactaccgctccgtcaccatcctccacccccgctccgccaccggcaccgtcgtcgtcgagtcctacgtcgtcgacgtccctgccggcaacaccaccgaggacactc

SEQ ID NO: 189 - DNA, 350 bp, Glycine max
gcttatttctaattgatccttttcctgtcttgttttcatgacataaactatcatcaactgttgctttccattttggctataattccacaaaatgtgccattcattgcaagtgtaatattactagcatttccatatatcagtccatggcctccttaatgctcaatggagctcatcaaaatccaaacctcattagtggcatagctccaaatggccttaactttcacaacaagtgtttattccaaaagggtgtgctgtctcatggtaacaagttaagggtggtcagaaaaaacttcactcccaaaggcagcatgtcagcatcatcatcatcatcatctaggcctggttctcag

SEQ ID NO: 190 - DNA, 365 bp, Glycine max
taaagctgcacgtgaagagatggaaaagtatgattggaaggcagccacgcgaaagattcgcaacgaacaatacaacgctgccatttggttctggcgcaagaaaagagcccaactattgagacccttccaacggctggcaaaacgttttttcccatccccacaagtcaactacaggtgatgcaacttcacctaccaagcttaggctggtcccttgctagctttctttggcttcatagaagacttgtattggataaatgtgtggttgatagtgtaatggattcattctttttgaatgtaaaggaacatacaatatggtggcttgcaccgtattttgtgcttttataaagggaatcagtgccacaggt

SEQ ID NO: 191 - DNA, 651 bp, Glycine max
taatggactctcaagactttgatcttgatgatctttgttctatgggcagctttcatcttttttctccctgcaaagcctgtgaatgagttgttctcaaaatggaatgatctcaaccgtgacactccttttggagtcacaggttattttttcttactctttgcttagtttttttcactttgtttgtatgtggcgtgagttcaaaactaactgtgtgttttgtttgcaggaagcatttttctggtcttcactgctccaattctcataattgcatttcttgccattgcacaccaaattcttactggggaggatcagcttcatgagtatgtgatttccccaaacttacctttctgtgcacaacatttcatcatcattatagcaaggttttcaattaccgtcacagtttcgacacaatctttgatattgcgggaaattgtgatcacagacagatttttgaaacctggcattatagtatatgttgagtactttgtttttgatttggaatttgatggcaggaagaagacttccaaacttccaaggttccgcctatggacgtttcctgtgtttgtgaagggaccatttggggttgtttctgccacagagcttattgggattgtcctcgttttgttgtatgttatctgggctctctatgct

SEQ ID NO: 192 - DNA, 384 bp, Glycine max
  misc_feature (376)..(376): n is a, c, g, or t
ttttttgttctaggaagcctcgtataatattattgtgtcacaataataatgtctcactccattaattcagagttcaagtttgatcccaaggaaccctccatgcccatatcgtatccaataaagaccctcaaggagttggagtcacgctcctactttgagtcctttcattatccttttaacaaagcttcagttccaattgaaagtgggtattctgaacctttgccaaatcgtagaagaatactagtgtgccatgatatggctggagggtacttagatgataaatgggtccagggagggactaatgctgaagcctatgccatatggcactggcatttgatagatgtgtttgtctacttctctcataatctcgtcactnctccctcc

SEQ ID NO: 193 - DNA, 519 bp, Glycine max
  misc_feature (333)..(333): n is a, c, g, or t
  misc_feature (335)..(340): n is a, c, g, or t
  misc_feature (350)..(356): n is a, c, g, or t
  misc_feature (383)..(394): n is a, c, g, or t
  misc_feature (398)..(406): n is a, c, g, or t
  misc_feature (408)..(411): n is a, c, g, or t
  misc_feature (415)..(425): n is a, c, g, or t
  misc_feature (427)..(433): n is a, c, g, or t
  misc_feature (451)..(453): n is a, c, g, or t
  misc_feature (459)..(468): n is a, c, g, or t
  misc_feature (483)..(491): n is a, c, g, or t
  misc_feature (498)..(502): n is a, c, g, or t
  misc_feature (513)..(514): n is a, c, g, or t
tgctaaaaagtacattgaattacttgaagcggagattgaggagctgaatcgtcaagttgggagacaatctagcaatggacaaaatgaactgttggaatacctaaaatctctcgaacctcgaaatttgaaggttaattctacttttcattggtcaatataaaatacttcctttcctttatcctgctgacttgtgctgtctgctcagtgtaagttttcacatgttgatctgtactttgttactactgtagcttttattgagattagttttacatgatctactattgttgaatcactgttgaacattctggtgttgcattttttttttcaaaactngnnnnnngtttggggtnnnnnnnatcatcacaactataaatccacaattnnnnnnnnnnnntttnnnnnnnnngnnnntccnnnnnnnnnnntnnnnnnntgtaactattaatttgannntcccannnnnnnnnntcaacttgatcaatnnnnnnnnntcatttnnnnnaataaaccttnntttta

SEQ ID NO: 194 - DNA, 887 bp, Glycine max
tatatgatcatgtattcgttgacactgaaacccttcttcactcctcaattagtttcttcgtcttcttcaacttccacttcgtcctcttcgatttctctcgtgtccttcccatctcgttcggtctcatcaattagctttcccagaaatttaaagcacaaaggaagatttggtctcagagttgaagcatacgattcctccaataatgacacttccaaccctgccagtgctggcggcgactccaaaccccctaatggcactttggtacttcttcatcttcttactctttcaaattcagtattacccctatctcatttttaattttatatattattattttaatataaaaaaattagttcatgaaaacctcttggaataggttagtgtgacccttaataagtgaatgaatatatcaaatatttaaactctcctatagaattggcgaccatgtgcattcatgtccgtatacctactacttggtgtggtttatctttcatattttcttccaatttattgagtcattatatgaaatcctaagtttcttcagcattatatgccctagcccaagtgattattttggtacatataaaattaaaatgggatctgtagtcaaaataaattgttctggaaacaagtgtctacctctgccggagctgttatctgactagtgattaaatgttttgaaatcaacagtcaaagagcaggagagaaattttactggaatatgttaagaatgtgcagccagaatttatggaattgtttgtgaaaagagcgccacaacaggtatgttgttgtcttgctatgaacaattatctgactgttacttgattgtgagtcaaagtggctgttgattaccctcttagtgaatgaaactttcgttggtgattagg

SEQ ID NO: 195 - DNA, 1351 bp, Glycine max
  misc_feature (1336)..(1336): n is a, c, g, or t
  misc_feature (1341)..(1347): n is a, c, g, or t
gagggctcaggctgaggccgatgggaagcctgttgaggccaagaagcctattgttgtcaaatacggtctcaaccatgttacttaccttattgagcaggtctttttttctctcttttttttattgttgcgattttcgtcgtcgttgttgctattgttaattgtggtgtcaaggtcttaaattgcggttgcggttattacaatccttaacattgtgtgaaattatggatggttgactgcatttgtggttgtggagaactcaataatgtggttgaagttgtaggtttagactttatactgtgttttaaaacatggtgtagtggtgtaaatacgcaatttgcatgtgaaatatgtttgttgtgttgttcttgtcatttggaattgttgagttcctagcctttggtgaataattataataggagaatttggttttttattaagtttagtctgatgaggatattgctgttgtttgaaattgtcaaacttcctgtgctttgtctatttgataaagaatgacctaagaataataggtggaaccaagttaccatttgtatagcttagatattcttatgatgttaacggaaaaacagagtggtttgtcttgagccctgtggagggaaggaaagaaaaagagggtcattggtggaaacaaaatgcatttcatcttttttcttcgccattctgctccatcgtactttaaacaattcaaactacggagtctattttcattattctgttctgttccactgcatctcttttcatcaatcccaaaagtctaacaagtttatcttttagaaacccgtgcaagggaactctttaagagaaaagaaatacaagtaaaatcttttgtaaactaaatatattttcccttttcattgttatttatttgattattgcaagggaatgaatgaatatgcataaacaattattctcttgtgatatttgagtgatgattcttttatttattttgtcagaacaaggcacaactggttgtgattgctcacgacgtggacccaattgagctggtggtctggcttccagcattgtgcaggaagatggaaattccatactgcattgtcaagggcaaagcacgcttgggaacggtaataaattgatttgaccaaaacaacgttttcagaactaatgatttatggttattcagttgattcatgtgtcccttttgacagattgtccacaagaaaactgcttcagttttgtgcttgacaactgtcaagaatgaagacaagatggagttcagtagaatcctagaagctattaaggtagtttagattgtatttcgtttgtttggtacctgttcaatggatgaaattaactgaanctatnnnnnnntaac

SEQ ID NO: 196 - DNA, 590 bp, Glycine max
tcaggtttgtcctggaatatacttttagaatccaatgcaaagtgaacttcatgatgttgcttcactcttattatcaaaagtttaatttatatacattttcatgcaaacatccaataagatttgaccattctaccatatcatcgtattctaacgatactttttctagaattattcttcactttttctaaataaaaaactgcatagtaatctttatttgattgtcaatgcagtttgcaggagggtttgatgcagaaacaatgcatgcattcgaggagcttcgcaatctggcctctcttcttaacaaaacatgagcgaatgatggttgatgatggatttcagcttaccatctcagtaagccatatattaaccctgttcatagttgcaaaagattggtttggtctgtgattgcattacattttggtagtgaaaaataggcaagattttgttatatgtacaaaaccggtctttttttctgagatcagttgttgctaaaaatagcatagcaacttcaaaatcaaattatgttgtgtaactcagtacaactgagaaaatataatatattattatttggtagagtgaaatcctccagc

SEQ ID NO: 197 - DNA, 367 bp, Glycine max
gatcaaaccttaaaaaatgctaatacaaggcaggagtgtgtggaggcggtggcggtggcggtggcggtggcggagacaacaacggccacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggcttggtttttgttgttagttttttggagtgaacagtgtctgtactggttttttattagtagtacggatactagttataggtggaaagattgcgagg

SEQ ID NO: 198 - DNA, 1097 bp, Glycine max
atatttaatgtattttctttaagtgtgcttgtttgaggacatgaaaggtagaaatgaaacctgatgcttgtcataataaaaatgtgggatgactgaaactagagtgccaattcaccattcaaattttggacacttctgttgcttgaaagtgagttgaaagtggtcttatcctttaggaagcaataaagggcagttgggttatacatcatcaccctttaccaagcaataaagagtaaaactcagcctccatccctgtgttcagtcctctcataactttccactttctcattttccacctccttgattaagcataccctaaattttatacatgtttatgtgtttgatcaaattttatataatgtagggctctaatatgaggaagtgtgaagtgggtctcagtttgacaggaaaagttcaacaaatttatttttctttttagctcctatttatgttctgataatggttggatggctctacttttaataacaggagcagattaaaactatggttatcgtcaatctctaaattttactctcttaatgttgagcagatggtcgagtctagattcagggaacttctcctccactccaagtaccttttaaaaaagaagtggctgtttggaatcctggatgattttatcacaaagcaacttccacataatgtgacttggggcttgagcttaatatatgccatggaacacaagggagaccgcgcatcagtaactactcagggtaagatatttgcattgaatcatttactctctatatttctcttgttgctctcctctctcacagacaatactatactaataggtgagctggcacatgcactgaggtttttggcatctgttgtttctcaaagctttttagctttcggtgatattcttgaattgcatagaaagtttgtagaactctctggtggaattaatcggatttttgaacttgaagaacttcttgatgcagcacaatctggtatttaattatccttctttagttttataatcaatcatataaatcaatatcttgctgtttgtatggcagtaaatctctttaatagccatcgaattatgtgctaatatgaccttgtactgtacagag

SEQ ID NO: 199 - DNA, 719 bp, Glycine max
  misc_feature (684)..(690): n is a, c, g, or t
  misc_feature (713)..(715): n is a, c, g, or t
cacctcatcttgacgggtatacaatctttgaacgttttagtcccaaaattttcactgttttgtttttcagttttttggctgctattgtttaagcatttcttgttcttgttcatggcccccacaattttattaatgttatttttcagtttctttttattgctgttgttgtttttgcaggcttgtttcattattttcatttgctaaaaaaatttgagtttgtaatgtccataatctttgctttgttgaagtggtggtaggtttttttattatagtctttcacatgatgatgcaggaaacatgttgtttttggaaaagttgtcaacggaatagacattttgaagaaaattgagcaggtgggaacatctgatgggaaacctacccagccagttaaaattattgattgtggtgaagtctctgaaacaaaaattcagcatactgcagagaaggagaaaggtacttgtgatagggaatagatattgatgaatattattattatattataaaccttgttgtttcagtctactgctaaatgtaattgcttgtaatatgttaactacttctcattttaggaaaaaggagaaaatctgggaagtccttatcttctgatgatggttctgacaaaaaatcaaggggaaaaaggaaaaaatcttccaaagacacaaggaagagaaggaggagatactnnnnnnntgatagtgatagctattcctcannnttct

SEQ ID NO: 200 - DNA, 941 bp, Glycine max
  misc_feature (226)..(226): n is a, c, g, or t
ggacggaacgcacctgagaggcgtcgatctgtccttaggcgacgacggtccattcaccggagctaaaatactcgacattgcccattcccgcgcctcttcttccctcttcggtctctcattacccgattccctcaaagtctctgctctcacgcgcctccgcacacccgacaccgatgctttccgctccgcctattactccgccgacaaggcctccgagattcttcgngactacatctccgccatcgccgatgaactcaaaggtttattatcttcttcttctgatcatcacgcaaagcactgtaggtcaacttgtgcgtgcgtgtggtcaacctaacctcctcagtcacgctgaaaataataagcgcacaattattttaaggtttaccgatttctctcaggatacagggaagttacatagtccctgcactagtagatgatcgattaagtgctcgtaatttttagtattaaaatatgcgttctctaatctcgatttctcgatccgtgactctgatgcctatcctctttttaaattcgtatgaaataagtctaaattgattttactatttctctcagttcaaattgcaaagagtcttgttatttttttcactaattctcgtctcgattgtgtagatctaggctccttttcttgctataattttcagttgccggttgctcaaaatactgaaataggtcgattgtagagaaagtaattccttaaagcacaaaattcttgagttccctgtttgatcgaatttgactgaaacgtgtcttggatgataatatcgttacattgtagaacttgtggatttgttttcgtgtttttgtccatgcgtgttattcttttacgggcaaataattggttcttggattttttttacaagaaaattgatactgctttacatttgtgtgtctctgtagataatcctcttgttgtatcaatc

SEQ ID NO: 201 - DNA, 416 bp, Glycine max
tttagaattaaaggccagatggaaggggagacatctcaggttcatacagtatagatcatgatggggcattttgttgcttgatgcctattttacatgcttagcagttagcacaaagcggagcttttgtcctggatagttattttacttcgcagtgcaaggctgccaggtaaaatatgagacaaaatgttccggtagtgaaaagagcaattaaacaaaaatgtttaggtgaggctctggtagttttcagttcttaatcactacatgaatgatatcattttttgatagagaaattttggcagtctatgaacttgagatatttctgttatttcatttcattggaggttaaaacagatcatcatgaattcaccataattgctgtttgacagttgtatgtattggtgtcgtgctaataggga

SEQ ID NO: 202 - DNA, 344 bp, Glycine max
ttatctttacattatctattgggagcttgacaatatattcctatgcacatatcttaatgtattatctatccgtttactccatctggctagttttttttactttcctggtttttattatcatgtatgtaacagtatagtagatcattctagaatgatacactactaacaagtcactgcccgtttatccccttgtttgttttacctcgttttttgtattcgtttttctcgtttgtagttcagtgttaatttgactttgtagtttggcatgttgaaacaattaatgaagtatctgattcaaaagttgtgtttgggtttttgttttctcccactctaactcaattgca

SEQ ID NO: 203 - DNA, 723 bp, Glycine max
  misc_feature (717)..(720): n is a, c, g, or t
tcaaagcgaaagcggtttctcgtttttggaccttatctctctttctaaggttcgattctgcgtactttgggaggaacagacacacatgaaggattcgaattcgaattcggatctgtttgacccggtcatggcgatggagtccgagtggtctcgcggcggcaccacctccgatgccgatttcgccttcgccttcaacgacagcaacttctccgacagggttctccggatcgagatcatgcacgaccccgtcgacgcccgccctgattccgacgcctgcgccaccattgccgactgggcccgccaccgcaagcgccgccgcgaggatatcaaaaaggataacggtcatctctctctcacacccactctctttgttttttttaaagaaaaacaaaacaacttttagggtttctggaattgctcactggtagaagtggaaatggatgtgattttgcacgtgcaacgtgtttttttacaaaattagaaaaaaatgggaccatgaaagtgttaaaattggaaatttaaattgtgtgttttttgtgcgaatttgaaagtttattttttactgaaaagggtatgttggatagtgtttgcgtagaagcttgtgttttctcgtgctatgcctaatatgtatatgtatgctgttttggttggttgcaggtgcggatcttgcttcggtgccagacgagcaagttttgaacgggcatcaatctgaagcgnnnnagt

SEQ ID NO: 204 - DNA, 1212 bp, Glycine max
tatgtggagttaaagacaagttgtgaggttgacatatttccggctgtcttgtgttatactttagtctcagttcttatttttcttttctaatagcgcatttattttggcttgacgatatacaactgtcatttcttacgatgcagttaaattatcacaccgaggaaagattcgagagggagaaactgttgaagttttgggtacatttcctatcttttgtcatcaatctttttttactttcttaggtgctcgttttcactagtgtgataaattcaacaagcctctttttctgcttgcagattcagtcatttctggctggtgttccatatattgtcataggatttaggtaattgtttctgtttcatataattacagtattacacagttcaacttgatttggaaaggttgatttccgcttattgaaacttaatcctcttcttccatttggcatgtttgacaaatgaaaaaaatcataccggtagtggtttctagcctgtgtgtatgttaatataacttggctgtgatacagggatgatgcaggtcgtcttgttcggacagaaagacttagaaccaaagatataacacagagagtgaaaatgaagaactactggcaggtacattttagctgctgtgaggtgcatggtggctaatctttgttttggtcggccaatgcattagttaattaaaagtatagtaaacttccctgtggggctcggaggatgttccaaattgtttccttctccaacatcagcgagtatgtctaaataagtacctacatatacgtgcaatcacaaggcatagctaactaaggatcatttaataccttcttaattggataatacatcagaaagtcatatttaactgaagaaaatgctgaatgtgacctgttttcctcccataatcaacaaaatttgttggcagggaggagtctgcttggcgtttgctgacgaggtattatgctggctgtatggaacagtcaaagaaggtgagtatactagatcccacctgttttgtttggctgtttcactcactaacattatagaaatgatgatgatatcttgaaggaactccttttctaataaaaatacagttcatatacagtgaccaaatgcttttattttgtgttaatgtgtatgttttggggtttcaggtgaagattatattttgcagtttgctccacctttcaaccgattggagcttctgcaatcccagtct

SEQ ID NO: 205 - DNA, 363 bp, Glycine max
atcacaatggagtacggaaggttaggaccctctgatcctggtggctcctcgcgcctcaaccctccgagatcttccgggaggaaaaacattgtgtttctgtcactctttgctgtcttattaatagccgcgtccgctgttactgcagttgccgtccgctctcgcaccaaaaataccggaggggacggaactagtctcggcaagttcacacaggccatttcacgcacgtgcagcaagacacgctttaagatgttgtgcatgaaatcattactggacttcccgggatctcaaggagcatccgagaaggacctcgtccacatttccttcaacgtcacgctgcagcacttctccaaggcgctctaatct

SEQ ID NO: 206 - DNA, 531 bp, Glycine max
  misc_feature (427)..(434): n is a, c, g, or t
  misc_feature (488)..(491): n is a, c, g, or t
accgttacccaatcagagaaagaaagataaaattctcaaaatggcagccagttcgatccccatccgagtcgccggaatccaaccgtgcgccacctccggccaccgcaggaccgatcccgatcgccggagagcctcctccaccagctggtggaccccgctgttcggctggtcctccgaaccggactacattgactcaaacaacagagcatcgagtcttcaacggaccaagccggaaccggttacggcggcgacggagtcgaaagcgccgagaccgcgcttcgccggttgcttcacggaggagaaggcgaagcagctccggatgatgaccagcaagtcttttcacgacaccatgtatcactccgcgatcgcttctcgactggcctcagacttcaaggctcgctccgatccgtaacacttgaacagtttnnnnnnnnttcaccgtctgcaccagtgaagcaatatctgcacgatttctcgaagctgtttcnnnnctatctggataaatccactccacattccacgtacagatgg

SEQ ID NO: 207 - DNA, 400 bp, Glycine max
  misc_feature (45)..(45): n is a, c, g, or t
agcgtcttcctcgtcgctgattccgcgggaacaggctctgtccangtcgtgttcttcgccgttcggttcttctctctcgctacgttttccactcacgctagagacggtgctgttcggagacgaaactcccgtttcctcctcggtgtccacggcggaaggtaaccggttcacgtcgattccgcgcaggaacgatcgcgtttcgcctctgcatgtgtcggagtttcgatctggatgtaaaagaaaaaaatcattattttttttaaaaaaaattcatgcatattaaggatttggaatctctggttcggcataaataaagagggtggtgctaaagatactgaaaatgaagggtgagaataaaagacaagggtaaaaataagtttttgttttctgtaaaaaaaaa

SEQ ID NO: 208 - DNA, 817 bp, Glycine max
gtattaataagtatgtagactgtgtttatgactgtcgtggcaaatcattgcaagaatctaagttcttttcaggttggtctatttccagatatcatagagcgcaaagtggcacggcattttgaggaaggagatcttgtaagattctcatgcatttagttacttcctcaagcaatagtcattaatataaattgagacatgttggttatgtctatgtgggaaggtttcggcattagtaactggggaattttataccaagaaggagcattttccaggatttgctcgaccttttgtgttcaattctgaggttttgttgaggttggtgtaaacatttatctgttacttattctagttgttcaagatgggtgagcttaccgttttcatcctctaagagcctttcttttcaataattttctatagagttggacgtaaagtagaagctaaagatgctgccagaggagctttgaaatcaccatggtggacccttggctgcaagtatcaggtatgaaatcatcatcagtctgatgattttctggtttaagtgtaagcttctgtacttattttcctccgtgtccctcttgaatttcttttgtcatattcgtttttgttaggacgtggctaatatagcacaatgggaagatgagcaaattgagtacattaaagagaaagtgactgaagagggaaggcaagaagatcttaaaaaggggaaggcccctgcacaggtgctatatagtgtgaactatttatcgatttcatccatggctagggtgtatgctgatattcatcttaatcttgctttcatcttcaaatcaattgcagg

SEQ ID NO: 209 - DNA, 477 bp, Glycine max
ggtttttctatgggttcttcgataaggataacttcattatggtgaggaataacatttctaaatctattactcattctactaatttactcaaggaagcaaactgattagtcttttgttttgcggcattatcagttgccaaatgtgctaggatttctgtttggcatctctcaaatgatcttgtacatgatatacaagaatgctaagaagaatggagaaatcaattgtacagagcagcaagaaagggatggcacagtgaactccaaacagcacagctgcaatggcaacaaactcgatttctcttcactggtagaaatgaaagagaatcaactcaatcaagtttgatgttatgttgataagtatctaagttctagagttgatggaggactatatataggcttaggatgaatatcgaataactaatgtctcgtatctaattatactgttgtaataacaactattgccacttggtatgcattg

SEQ ID NO: 210 - DNA, 706 bp, Glycine max
cttccttccatctcttcttcaacattccaatccaatccaaaacgctgcgttttattttgtattcaattctatcaatcccaaaattcctcgccggagatagagaatcttaacaattccaccactttccggcgagacatggccgtcgccgtctccgtccccgcccgccagaagccgagctccgacgcgagcctctttacactctgccccttctggagttcgcgcaacgccaatcaaagctcctccaaaacggtgtcttccgtcgccaggtcgctgctccctccccgccgcagactccgcctcgatccttccaattacctctattttccatgtaaaagccattccaattcatatttctaagcttcaatttgttccttattcgttttttcttttcttttcaatccgtttatttttgttaatagtgctgaaatttcgtttgttttgaagatgaaccggggaagcaggtaaggagcgcggttcggttgaaaaacactagcaagtctcacgtggctttcaaggtacatgttgtactgttgttgaagtttgaatattaaactaaaaagttgtttattattcaccgttaggttaaaatgtgttttttctatgtttgaatacaagcgtgtttctaaatttaagatttatgtactcaaggtcgtaattgacttttgccaatgatttttattttcttagtttcaaacgacggcaccaa

SEQ ID NO: 211 - DNA, 406 bp, Glycine max
  misc_feature (399)..(399): n is a, c, g, or t
tggcttcttaaaggataaggaaactgatgacacatacagggatgaccgaagaaggtgaaagcattggccaccacagatgcatgcttttgcttggagtattttttctgctttatttgttgatttcctctcttatatatgcataccgtagattacattggtcaactgaggttctgtgcttgcttatgatcatgtaatgcgcagaattttgtatgttacaaattaaatcccacttgaaactttagtatggaaggaaataccgtgataattagtatcaaattacatcggtatagtagttatgctttttgacttggatggtacaaattagcatgatacttagatggagttttcatctgttaccttttcttgagaggagccctgtgatagcataccctagaaagncgagtta

SEQ ID NO: 212 - DNA, 743 bp, Glycine max
  misc_feature (23)..(25): n is a, c, g, or t
  misc_feature (734)..(737): n is a, c, g, or t
tcttggcctctgggtataccccnnnggttggctgccctgaaatttcgagctaatgacaactaccccttaaatcggtctaatgagccttatcatcctcctcgcccttataaggttagttgtagttgttatatctcatacacctgtatgctggctacattgcaatattgaattattgattgcttccaacaattcttaactctcaattatgattttcatttgatgtggtgaagtcatggttagtattgaaatcgcacataattttattaacttcaatgtctgttaccttattttttttattttgatttggatgctttccaggcacctcactcacgtcgggagactaatgactctcttaatgatgaaacatttggttctttggagtgtacaagtgaagacagggctgaagaggaaagaaaaagaagaggtaattgttctttttcagaagacattttgtcttgctgtatctgttctcattaaatttggctttagaagttctgtttacctttgtaattagggacattgttaagtgcatgtttagtgagttttagactaaataaatggatgacaactttcttgccagcttcttttgaattgatgagaaaggaacaacataaagctttccaagaaaagcataagttgaacccggacaagaataacgacgattttgacataacttcacttgctgacaacgatgagaaaagggtagttaataggagcaacgagtatgtggagcnnnntgtgat

SEQ ID NO: 213 - DNA, 951 bp, Glycine max
  misc_feature (908)..(910): n is a, c, g, or t
ttgattatctttgtcatggtgtggtatgtgtcattttattttatattattaggctttgggattcaattatttgagctgttaaaggttttgtgcaggtggaacagaatataaaaggatgttacaagttaataagcctacagccagttgacatgttcccacacacacctcatattgagtgcgtttgccttctggagcttcagtaatctgtgataaattaaaactttccatttcaaggtcaggcactatttcattttctttgctactttaggaactacttgggagtttgcaccttggatgtctgatgaatttttagtgactgttttgtttgaaatttctaaatatatcaattgattcaatttatttgaactggatttggtaaaaagacaaaacaattatcataaacctatatattgatttgttgtcaaatataaattccatttgtaattactattttttaatgaaatgaatacaaattgcagaattcagtggataactggacttgttcagctggcttaactgagttgtatcgattggcccatggtggctgtgagaaactgctataaaaattaccatttctcatgttctccatttctattcactgttatcaagtctttattagagcagctgcagctaatatattaatgcagtcataggttatagccttatataggccatctctgtaacattacccattcctgaatttgtataatgctttataggccactgatagtatgagttgaagttgtgagtgataaacaatccacagtaattcaaattatgtttctctacaattgattcaaattatgtttcctctatttctctgtttctgacatggctttcaggggattacaagcttaatacaagatgcaagtcaagattgggtcttcaaggtgatagataggaaaacnnntacttttatgctgcaaagtgtgcctgatgctttgcctaccc

SEQ ID NO: 214 - DNA, 522 bp, Glycine max
ggttcactcacttccctatgttgatccaaggcaaccaggtatagagttaacttgaagtgatgctacaatatgatatttcttatttcatggttatatgaaatttatatttgaccaaatctttgttattacagttccagtaagaattgtggacccatcaaaggacttgaattcttatggtctgggaaatgttgactggaaagaaagggttgaaggttggaagcttaagcaggagaaaaatatggtgcaaatgactggtagatacgctgaagggaaaggtggagatgttgaagggactggttctaatggagaagaacttcaaatgtaagccacttatgccatttccattgatgtttaatgactagatcataatttggaaagtattgcagaaatctttgctaatgtaagttagaccatgaaatttttttttttcaatagcattcaaggccattaaagttgattcacattctttttgttacaaagattgcattttagttccctgtcattgtaggatagattagtact

SEQ ID NO: 215 - DNA, 671 bp, Glycine max
gttatggatggttctgagagtcctagagacagttgaggctcattgtggttaccatttcccatggagtctttccaacttccttccattgtatggagggtgagtgtgaatttacttctcgttcacttgacaccagccattttggtttattctactattgtgcctcttgttaaactctttctattctcactttcagagctgatttccatgactatcatcaccgtttattgtacaccaagtctgggaactattcatcaacttttacttacatggaccggtaagcatttgagcgcatagtgattaaagaattattgttaattttcatgatgattatagaatctaaaatagcttaactgacatttatagtgatgcattgatgccttgaaatattgatattttactaattatactgacaatagtagatgacatttttgctgtcgtaataggatatttgggactgatataggctacagaaagttgaaagcattgaagagcataggagttgaagacagtagcgagcaaaagaaacaataagaatacgattttaggaatatccaggaatgattagagagttgatttgcaaaagggcatatttgaaaaatgtctatgatatcaactccttatgtgttcttgtgtttttgtagtagctggtgtttgtcttcaatgtgctgatg

SEQ ID NO: 216 - DNA, 416 bp, Glycine max
gatgatggaaacgtccacatgtatgatgctgagggaaaagctttaattgggaccatgtcaggtcatgctagttgggtactgtgtgtggacgtcagcccagatggggcagccattgctacaggttcaagtgatagatctgtaaggctatgggatcttaacatgagggcatctgtgcagacaatgagcaatcattcagaccaggtatggggagttgcatttagaccacctggagggagtgatgtgcgaggtggtcgacttgctagtgtatcagatgacaagagcatatcactgtatgattattcctgatttagatattgtgtgctgtatttgtactctttgtggaatgttatttactcttttgtctacaaattgattttgaattgaagaaaatgcatggttgtacatgctgtatccgt

SEQ ID NO: 217 - DNA, 209 bp, Glycine max
tgaagggtgagaaccctctcacacaatcctccatgcttcttttaagagccatggatagatttttgccaacaaagctccatgcctataccagatagatagatagattggtttgagtgatcttcaaagggctctatagaaggctagtggggaagttagtttctgaccatattgctttaaatagctgatgattgagaaactcagaagtggag

SEQ ID NO: 218 - DNA, 359 bp, Glycine max
ttgattgggaagccgttttgaacttggatcctaattcctttgtggattctgtcaaaagttggctatacccatctctgaaggtaacaacctcatggaaagactatcatgatgttgcgtcaacttttgcaacaacagggtcggttgttgctgccttgagctcttctgatgattgaactccttggaataatgacaggttagtcaatggccaagttattttcaatttctgtttttcttaatttctggtcttgtactgttgtttttgcaattaattacccaatacaacagaacggttcaattcaatgtctctgctaaagcaaacacaaggttctatctgcttttgtacgcttctgtatgctcac

SEQ ID NO: 219 - DNA, 525 bp, Glycine max
gatgatggagtggatggagttgaagaagaaaatgctgaaggtagttttgaagaagatgaatatgaggactcagctgctgaggctggtgggaaagaccagttgcctgaagcagaaaaaagtgacattgctactgaatttggggatgatgagcaaaaattgtctttcattgatgaagatgagaaagagaagcatgatgaacttcttgcccttccacctcatggttctgaagtctttattggtggacttcctcgggatgtatgtgaagatgatttaagggaattgtgcgagcccatgggtgatattcttgaggtcaaagcattgatgaattgctctaatgatattataaacctgtccttttctgcaggtggggaaaatgggaattattagtaaaaaaaaatatttgttgttgcttttcaggtgcgattaatgaaagacagggacactggagaaaacaagggttatgcctttgtggcttttaaaacaaaagaggtagcgcaaaaggctattgaggagatacacagcaaa

SEQ ID NO: 220 - DNA, 528 bp, Glycine max
acaatctcaatttcaactgcatcaagaggtcacatttaccatggttatagaagactccaagagaatcttgtatcagacctgttggatattggggagatttcttatgctccctcaagactgaaagaattggaattctgttctgaggagtttgaaaattatgttccttgctttaatgtttctgacaatctagctcttggtttttctgatggaaatgagtttgaccggcaatgtcaccatgagctcaggcctaattgtttagttctctctccaccaaattacaaaattcctcttaggtggcctactggaagggatattatctggattgctaatgctaaaataactgcacaggaggttctttcttctggaagctttaccaaaaggtgagtgagagatatacatctctcctagttgctgtcatactttgagctattgtttcatcttaaagttttcatgtatttttatttggttacaggatgatgatgcttgatgaagagcaaatttcctttcgttcagcctctcttatgtttg

SEQ ID NO: 221 - DNA, 324 bp, Glycine max
tgctgattcagactacatataggatctgtttggatacaagcactttgagagctttcttactgaaaatatagttttttcccgtaacttaatagcttgtatccaaacaacctcatagtatagttgtcgtaatatgtggacaagttgtgtcaagtcaatttactaaaaacaacttgagcaaatactagttctatggacaagttctgcatgcgtattttctttcagggctattagttttatgcgaggacagggaaatatgtcaaaatttaattacatatttatagtttaaataagatctaagtccttatagtatatattcataagatt

SEQ ID NO: 222 - DNA, 383 bp, Glycine max
  misc_feature (372)..(376): n is a, c, g, or t
tgattctgaggtttgtattttacatttatattgtggattttcccttattttaaatcagatatcctgctgtctgccactttaatatatacatgcaatcttcttacccttgtctctttgatgtcaatgtctttgtgtttatccctcgataaagatttgagggagacccctgatatgcttcttcatatcaaaacatggtgtagccaatcaatggaacgatttaaatataactaactattcaaaattagttatggttttaattattgttttctctgggaaacattcagatacttcaatgtgattggatcagacccagagggcagattgggtgaggctccaagacctgaacttcgtgaacatggccgaatttctggnnnnngctttga

SEQ ID NO: 223 - DNA, 393 bp, Glycine max
gagagctgttactgtaaattttgaactgtatctagctggcatgcatacttctgcggacatggcggaatcgtctgcatctggcatgatgatgaaggttcttaattgactgtgttgagaattagtgggaatcatactggcatagtggggtgtttttcaggaatcaggtagttgatttagagatgacaacaataacattgtaaatttgaattgtgcgttaaatatctggccatagaaattatgttgtccaggtgcatatttacatcataaaattttgttaattgttaattgctaataatattaatctcatttgttcaaattcgtcattggatatccagtgctagttctcagctagcactgtgtttgggtcctgtgatgcctgtgtatgcatatttg

SEQ ID NO: 224 - DNA, 614 bp, Glycine max
  misc_feature (533)..(535): n is a, c, g, or t
  misc_feature (546)..(546): n is a, c, g, or t
  misc_feature (549)..(551): n is a, c, g, or t
  misc_feature (556)..(556): n is a, c, g, or t
  misc_feature (565)..(565): n is a, c, g, or t
  misc_feature (567)..(568): n is a, c, g, or t
  misc_feature (574)..(575): n is a, c, g, or t
  misc_feature (578)..(580): n is a, c, g, or t
  misc_feature (583)..(584): n is a, c, g, or t
  misc_feature (586)..(587): n is a, c, g, or t
  misc_feature (591)..(593): n is a, c, g, or t
  misc_feature (595)..(606): n is a, c, g, or t
ttggtctctcaatatactcaaattgagttcgcaacttttcaatggcatcaaacagctctataactctctcctcatctttcctggattcatgagcccaataagcaaaggctaaaaggagataatatagtacaatggcagctgatgcaacgctaatcctctacacaaggaaacggaatttataacatcttgtatttccataaatgataaaatgttccacgggaagaaaacaaaatggttttagggtcagccagttagaagagttccaatttactgctggatttagaaattatatttattttgaacttgtatcaaccaactgtccaattcacaaattagtaaagcccccataaagttatctagaaagaaaatacaaaacctggaaattttcccgtgttgagcataaaactgttgtttcatgttatccactacactgaaggtagtaataatctgaaaaaaatatgaaagaaaaccaccaataagtccaaccaaatcatagcactactcaatcactttggttcatggacaaagcatannncatgcaacagntannngaggntcaagcatntnnaagtanncannnaanncnnatgnnngnnnnnnnnnnnncagcgata

SEQ ID NO: 225 - DNA, 533 bp, Glycine max
  misc_feature (523)..(528): n is a, c, g, or t
gcgacgacgacacggtggacgactacgacgagtacgaccccaccccttacggcggcggctacgacatcgccctcacctacggccgccccatcccaccctccgatgagacctgctaccctctaggagcctcttcttctgatgacaacttcgattatgatcgccctcaatacacctctaacgctgaaccctctgcttatggtgatgaagccctagctactgagtatagcagctactctcgccctaagcccaggcctgctcctgcaggcttcaaccccgccgcagggtccgggtacggagggtccggatccgaatacggatccgggtatgggaggaagcaggagtcggaatatggatccgggtatggtggaaggaaggaagaaggtgaatacgggtcaggatatggtggaagaaaggaggagccggaatatggatctgggtatggtagaaggaaggaagaaggtgaatacgggtcaggatatggtggaagaaaggaggaaccggaatatggatccgggtatggtannnnnnaagaa

SEQ ID NO: 226 - DNA, 503 bp, Glycine max
  misc_feature (347)..(348): n is a, c, g, or t
  misc_feature (364)..(381): n is a, c, g, or t
  misc_feature (383)..(385): n is a, c, g, or t
  misc_feature (390)..(396): n is a, c, g, or t
  misc_feature (398)..(403): n is a, c, g, or t
  misc_feature (408)..(408): n is a, c, g, or t
  misc_feature (410)..(412): n is a, c, g, or t
  misc_feature (447)..(448): n is a, c, g, or t
  misc_feature (468)..(475): n is a, c, g, or t
  misc_feature (477)..(477): n is a, c, g, or t
  misc_feature (485)..(486): n is a, c, g, or t
  misc_feature (489)..(491): n is a, c, g, or t
tcctcctttctcccaccatacccagatccatattcagattcttcctttcttccaccatacccagatccatattcagactcctcctttctcccaccatacccggacccatatcctgacccgtattcaccctcttctttcctaccatacccggatccatattccggttcctcctttcttccaccatatcctgacccgtattcaccttcttccttccttctaccatacccagatccatattccggctcctcctttcttccaccatatcctgacccgtattcaccttcttccttccttccaccatacccagatccatattccggttcctcctatcttccaccatatcctgnncagtgttctggttctnnnnnnnnnnnnnnnnnngnnntctgnnnnnnngnnnnnnctctnannntctcgatgcgtctcttgatttcctgggcgcaagcnncgcaatgcatgtgaactttnnnnnnnncngtgataanncgnnnctgcatatatag

SEQ ID NO: 227 - DNA, 617 bp, Glycine max
  misc_feature (422)..(425): n is a, c, g, or t
  misc_feature (427)..(434): n is a, c, g, or t
  misc_feature (448)..(450): n is a, c, g, or t
  misc_feature (457)..(483): n is a, c, g, or t
  misc_feature (492)..(501): n is a, c, g, or t
  misc_feature (506)..(511): n is a, c, g, or t
  misc_feature (515)..(529): n is a, c, g, or t
  misc_feature (534)..(552): n is a, c, g, or t
  misc_feature (565)..(568): n is a, c, g, or t
  misc_feature (570)..(604): n is a, c, g, or t
  misc_feature (607)..(614): n is a, c, g, or t
agcaagctccttcgattcacgatctcttcctctgaaatttgtattcccaaaacctatgctacacttttctatctgaattgctgaattctcttaacaaatttgtaaattttggggttttcatgatgtttttagttaacttcgcagtttgaagaattctattaatgggttttggttaaagatccattttttcttattgttttttgaaattcttactgctgctattgtaatccatgttaatgttatgcatattttgcagaggaattaacatatatatagcaagcatggcagtcacactctacgaccttagctcttcctctgggttgaagaaacttgatgagtaccttctcccacgcagttacatcaccgggtatgtcactgcttttatgcttcgtttgtatgttttttttttttttaaaaacccnnnntnnnnnnnngaaaaaaaattttnnngggtttnnnnnnnnnnnnnnnnnnnnnnnnnnnaaaaaaacnnnnnnnnnnttttnnnnnnaaannnnnnnnnnnnnnnttttnnnnnnnnnnnnnnnnnnnaaaaaaaaaaggnnnntnnnnnnnnnnnnnnnnnnnnnnnnnnnnnnnnnnnaannnnnnnnttt

SEQ ID NO: 228 - DNA, 781 bp, Glycine max
ctctctcttttcttcttctcctcctactcacatcaatcaaccctagcgtaaacatgaatgaacttttatatatatgacaaagcggtagggtgaattcctattagatgtttttataacaaaataaaaataataaacttgcaataaattaaactcatgtatttattactcagaaaacaattattgggatagtttgcccttgagtggagatttataaattttgtctagtttcttttgggtgatgcagagtgactcatatcaagcaaccggatgctacaaccttctttgtgcgggttttgtgcaaacaaatggcaggatagccattggagctgccatttcccccatctcatcttatgaatccaaccaatatgacatcaccatcctaatttggaaggttaatatttaaattcttccacatgcaaattaatttaaagaacttatgatttaattttgtccaaataattatctaatccaatatatcaattatgcatactcacttccttttgtaatattaattaattaggacccgaaagtagggaattggtggatgagttttggtgatggcacattggtagggtactggccagaagggttattcacacacttggccacacacgccaccatggtggagtggggtggcgaagtggttaacacacgtgccaatggccaacacacctcaacccaaatgggctcgggccactttgctaatgatggttttggaaaatcaagctattttcgtaatcttgagattgtagacaccgacaatagtcttagctcggtgcac

SEQ ID NO: 229 - DNA, 443 bp, Glycine max
tgttgctcctgcctacgggtgcaggacccatgtggttataccagatgatgctgccattgagaaggtattttataatgattgtaatgtaatcatgtaaattctgttatgaaatctagccataaacctctaagattttgtgtacaattgatgattggcttgcgtgaatcaaccttcagtctcaaatacttgaagcccttggggcaactgttgaaagagtgagaccggtgtccatcacccacaaagaccattttgtcaatattgcaagaagacgggcatctgaagcaaatgagtttgcattgaagcgtagaaattcacaacaattgaatggcaaggaggacaccgagaaaataaatggttatgaatctaatggatgcaattacagctctctgtttcctgaagattgtcaaggtggcttttttgctgatcagtttgagaacctagcg

SEQ ID NO: 230 - DNA, 315 bp, Glycine max
gtgccaccagtgaggttagtggtgataaactatctctcttaattaactagtataaaatggaacacaatgatgcttattgctattatctgacaacatcaaacattgcagggagattttcatgctgctatgaattttgcagcagtaatggaggcccctgttgtttttatctgtcgtaataatggatgggcaatcagtacacctgtggaagaccaatttcgaagtactctttcatttcattgttttttgtcacactcttattcttttagaaaaaatattttactccctccataccctttttgatatctgattaagctt

SEQ ID NO: 231 - DNA, 351 bp, Glycine max
gagtgaatggcacaaacacaatatcaagcgtaagacaaggcaactcccaccacttactgaggaagagtgcatggcagacatggaattgggtgattcaaaatctgatttgaaggattattcattttaagatgatgataagtgagttggtgtaatcactttattgaagtcttgtgtgtatacttgggtcagttttgtcagcataatctgtgttatggtataaactattcacatggaaatccttaagtatggtgcaatacaaattgcaaagactaatgcatttcaattttctttgtctgagtattttaatgtaccaagtaagtgcaactaaagatggttgtatgcaggaggttt

SEQ ID NO: 232 - DNA, 485 bp, Glycine max
cataagaacaggtcctctttgactcaacttgtatataattatgtacattggaaatggttacttggtattttcttttggccttttgctgacatttttgaaaaaaattcaataggatgaaaggaaaaaaggaaaagctgctgaaggaggcagtgaaggagttggagcagggcatcagtttggtcaaagctccttctgtgcttcaacaggatccatctctcacattaccaaagatcaaagtcaaggtttcccaacagcaatcagaggagaatcatgccatggaagagtaattctaacaatgctgcacttaatttttgccgttttaatatttgttgctaaattagttgcctgtaaggtccagtttaccagtttccttgtgatcattaatgtgaatgatgtgttcgtcaaacattcgatgtatttgtctcttaaaactatggttctctgagatagtcaactattataaaggaaatcggaaagttgttgct

SEQ ID NO: 233 - DNA, 764 bp, Glycine max
  misc_feature (516)..(516): n is a, c, g, or t
  misc_feature (527)..(533): n is a, c, g, or t
  misc_feature (539)..(541): n is a, c, g, or t
  misc_feature (599)..(616): n is a, c, g, or t
  misc_feature (619)..(627): n is a, c, g, or t
  misc_feature (631)..(631): n is a, c, g, or t
  misc_feature (636)..(656): n is a, c, g, or t
  misc_feature (660)..(662): n is a, c, g, or t
  misc_feature (664)..(668): n is a, c, g, or t
  misc_feature (673)..(679): n is a, c, g, or t
  misc_feature (681)..(681): n is a, c, g, or t
  misc_feature (686)..(696): n is a, c, g, or t
  misc_feature (698)..(698): n is a, c, g, or t
  misc_feature (702)..(705): n is a, c, g, or t
  misc_feature (709)..(728): n is a, c, g, or t
  misc_feature (732)..(740): n is a, c, g, or t
  misc_feature (743)..(746): n is a, c, g, or t
  misc_feature (754)..(755): n is a, c, g, or t
tgaaatcggaagaaggattagggtttgtggagatgcaagggcaaggcgttgatgaagtgagcatagaagagttggcgtcgaatctttccctctacaaagatcaactgaaccaggtaaccaagctcgctcacaactattcactcattctttcttgtttgtttaataatgtttttttgaatccatcaggttagagaactcttaaacgatgaccctgcaaattctgaatatgttgacatggagagggaactttccgaggtaagctcaattcaaccccagttttgatgttttgtttccgccttgttctctatcattcattcatcatcgagtaagcagatagatccctcccattccatcggaggatgtcattctatatattactactaatcaaactagtttcttcgaaaaggtgagggtactactactagtattactgcggcaatttgtaatatcattcaaattgctcaacctcaggaggagcattaaaaagtgagtgttaggtccaaatgcacatcaacnctggattggcnnnnnnntttccnnncttccgatacagaccctcagactatgggtaaggttgtaatgtgcttccaccctgaccnnnnnnnnnnnnnnnnnnttnnnnnnnnncagnaattnnnnnnnnnnnnnnnnnnnnntttnnntnnnnnattannnnnnntnttatnnnnnnnnnnncnaaannnnttcnnnnnnnnnnnnnnnnnnnntaannnnnnnnntcnnnntaaatttnntttttttcc

SEQ ID NO: 234 - DNA, 396 bp, Glycine max
atggcaggacaccttgatgtttggaagctgctggatgatgcacataacttggtggtcacccttcatgacaaaatgaaaatagagacatcattccgatgacctgtagttgatacttttacaaactattagtttataatattggccaaaagatctttgctttcaagctgccagatttctcctctgcatcaaaaaattctgcaaatgtcgagtatatattgcaatgaagcctctgcagctgcatgctgaaaattgccactgcttatttacgagactctgatttcgacaattttggctcatgtgggtattgaagatggctagatttagatggcatggctgcttgctgaattttgccactgcttaatgcttatttacgaggcttagtttcgactatgttgc

SEQ ID NO: 235 - DNA, 402 bp, Glycine max
agtggatttatggcctctttgttgatcaagcagttgcttgaaaagggttatgctgtcaataccacagttagagacccaggctagtctctctccctttgtgaaatatgtcgctgtaaaactgtttatttgttttgtttaccattcagaaaaattaaagagaattaaagaaatagaaaaggtatttaaattttctttcaatttttaaattttagcaggtacatctagtgtgactaaagagaaaggcacattattcaaacgagacttttttttagataactggaaataaggtttgcctgaacacacgtgattttttctctttacagaaagagacatgagtgataaaaagaggggaaaaatggttttaaaaaaatcaaaactatacttgacattagtaaaaaaaaa

SEQ ID NO: 236 - DNA, 629 bp, Glycine max
  misc_feature (607)..(618): n is a, c, g, or t
gttagcggtggcggtggggattcggagaagtcgcatgtcagtgatgtcaccgaggttcgcgacgttgacatggcgcaggcaaacggcgcttgttgcccttccgttttgaaacggaagcgcggtcgcccggccaagggaaaccgcgttccgaaagggattataccgccgtcgaggcagaaacaggaagaagaggatgtttgcttcatatgcttcgacggtggaagcctcgttctctgtgatcgccggtgagtcgtcgtcatcatcaccgttctgttcttcgcttcgtgtctgtgattgattcatcgattattttgcgataattgatattcagtttgggttttttactacaagtgagggtttctttattaagttgtaagccttggagggtttatcttatctttctaacactccctttatctctctccttttttaggggatgccctaaagcgtatcatccctcgtgtattaagcgagacgaggccttttttcgctcaaaggccaaatggaattgcggtatgttgctttttaaactgtcttcattcatttttccggtataacctattaacatgcaattggatcggatttcgcttgctctacgtattttgtnnnnnnnnnnnncacatgcatat

SEQ ID NO: 237 - DNA, 394 bp, Glycine max
gcgtgttccagatgttcgaccgcaacggcgacgggagaataacgaagaaggagctgaacgactcgctggagaacctgggcatcttcatctctgacaaggacctgagccaaatgatccagaggatcgacgtcaacggcgacggttgcgtggacatggacgagtttggggagctgtatcagaccataatggacgagcgcgacaatgaggaggacatgagggaggccttcaacgtcttcgaccagaacgccgacggcttcatcaccgtcgacgagttgaggaccgtcttgtcctccctcggcttgaagcaaggaagaaccgtccaagactgcaaggccatgatctccaaggtcgatgttgatggagatggcatggtcgattacaaggagttcaagca

SEQ ID NO: 238 - DNA, 505 bp, Glycine max
tctttagcctctacccagagatttagaaataggaggatccctgtgctgagtgactggaaatagtgaaaagtgacaaggaaatcgcaaaaccaaatgctctgtctctctagtctagacaatatcaaacgctatcaaaaaaaggaggagaaagtaaagtaatgaaatattagagcaaacagggattattgacattagttgtaatagcaattagcaaataactcagtgctcgtgtcaagtttgtttgttacctagtgcttaacattaaccagcctcaaaccactagatacatcttcacaatgcttcatatgatgaaaaatggaagtaaaatcaactgtgctattggccctacagtcatacttgggaggataatggaaacaaggctccatggacttagctcgacgacaaggtggatctgggatggtttccccatacgccctctgcaaaatccatggcttcaaacctccaagactatgagcaacatacccaaaagtagacttcgggctgt

SEQ ID NO: 239 - DNA, 578 bp, Glycine max
tcttctagcccatcagcaggcgggatatgcactggtcttggtattgctccaagggtagttggtgatttaataggagtggtacgtggatatttttctattttttttttattgtttattggagttgttggtaatcttttttgaattttgtctgaactgtgttacccgaaaagaagtctgtgtttcttatcagtaattgttccttactgctaaacttttagctcaggaacttcaagctgtttctgtgcttttgtattaaaaaaaatataatgtcaacgaattaagcataattaacacaggaagaatggtttattaattttattttggttgtgcaggtgaaggcgtacacaacaagagttggttctggtccttttccaactgaaattttgggttcaggaggtgatctcctcagatttgctgggcaggagtttggcacaactactggccgtcctcgacggtgtggctggctcgatatagttgctctgaaatactcatgtcagatcaatggtttctcatcgttgaatcttaccaagctggatgttttatcagatcttgaagaaatacagttgggtgtctcttac

SEQ ID NO: 240 - DNA, 211 bp, Glycine max
ctatttcacacagggaaaatacattggtgaccagtaagtgcctttttttctgtgatcctttaggttgtttgctcaattaatggcactttactgtatggatttttgtagctgaatgttttgcttttttacagatcaatgactatgtaatatgaatactcacttgacacttcttttttttgtttctttgtggttgaatatctctctttttttt

SEQ ID NO: 241 - DNA, 120 bp, Glycine max
cacttttcaggttacatcactgtcaatgaaaaccatggaagggcccttttctactggttctttgaagctcaatctgaaccatccaagaagcctctccttctctggctcaatggaggtctc

SEQ ID NO: 242 - DNA, 373 bp, Glycine max
aaatcatggcatgtacttggtttgggttataatccaagtttggatcgatcagagattgagaatgcagcagttgtacactacaatggtaatatgaagccatggttagaaattgccatgacaaagtatcggtcttactggaccaagtatgtcaagtacaatcatccctatcttcaaaactgtaagctaaatgaatagtaccgataatttggtcccaagtacagagaagaattctctgatattttctatcacctttctggcttttggttatttcaaccacagcgtcttttgctagaatgatgatcattgtcttaaagcttagaagggatagggtaagggcgtgttctatatttgtctccaacatcatctctttcca

SEQ ID NO: 243 - DNA, 492 bp, Glycine max
gaaactcttccatgacttgcaaccggatttcatcgtcaccgacatgttccacccttggagtgtcgatgctgctgctaaactcggcattccgaggatcatgttccacggcgcaagttatctcgctcgctccgctgcgcactccgttgaacagtacgcaccccacttggaagcaaaattcgacaccgacaagttcgtgttacctgggttacccgataacttggagatgacgcgcttgcagttgccggattggcttaggtctccgaatcagtacactgaactgatgaggacgattaagcagtcagagaaaaagagttacggttcactttttaatagtttttatgacctcgagagtgcttactacgagcattacaagagcatcatgggaactattagagagtgaaccgtaactctttttctctgactgcttaatcgtcctcatcagttcagtgtactgattcggagacctaagccaatccggcaactgcaagcgcg

SEQ ID NO: 244 - DNA, 361 bp, Glycine max
cttccgcgtcaactactacgctgtcgtttcactcatcctcgcagtctctctcctaaccaatcctttctctctcatcctcctcgttggcctcctcgcctcttggaccttcctctacctcttccgtccctcggatcaacctctcgtcattctcggccgaacattctctgacttcgaaaccctagccctcctctccgccttcaccgtcttcgtcgttttcctcaccagcgtcggatctgtcctcgtttcggctctgatgctcggtgtcgccgtcgtttgcctccacggcgcgttccgcgtgccggaggatctgttcctcgacgatcaggagaattctcaggctaccggattcctctccttccta

SEQ ID NO: 245 - DNA, 306 bp, Glycine max
cgcagtgcgacagatgcagtagtccaaaaaactcgttcgactagttaacagtagcatgtctctttttccttttttggaccgcagtaaactatatatagattattggacctatggtggggttgaaaatcttcaccagttggtgactgttcagaagaattatgaaccgttaattatagtatgcccgagccaaattataaacgactgggcattaaattttgcagcagagaggctgtttctctcgagtttcattaggattaaaattaaaataagaatttgtccgatattcaactgggaaagctggtaaag

SEQ ID NO: 246 - DNA, 889 bp, Glycine max
tgtgggttctcaatggcaacaataatcctagcagcgagctggagcttctcccatgtcttgccaaggttaattatgtaaatacctgaaaacataaaccacaaaaattcaacaaaaactccaaaatgttctatttcattaacaagaggaaaccttcctggtagcggtgcaaaaaagcaaacgcccaaagagtcaaagactaccattatagaaattctgattagtaattaaattaaccctttgaatcacttcttaataacacctaacaactttatcatggtcatgaaaagtacacatccaattacaaaaaaaccaaagaaacaactgatcataaacggaaaaaaaaacatatttaataattgaatattgaaaatcccaacaattatcaaaaagtagagatatcatatggtctttccaaaaactttcaaaatttaaaccactcataaaacacacatagatattactataagctcacggccactatggcagggcttctaaggtacccagaattctacatttgagtaattatatatatttacacgaattaaattagaaaaaagtgatggtgtatcagagataaacttagttacattacacacacatatcattccattgtaaaaaccactaagaacaatgcaaaggaaatcactatttcaacataaaataaataaaaaggagaaattgagaatggagcagtgaccatcggttctgcgcttgaagacgtagcgttccatctgaaagtcgcagtttttggtgccgaggtgaacgtcggcggcgagcatcatctggatgtccgtctccctttgcgacaactggtgcgatggagcggcggaggagtcggcggcggccatggctccgggaggtaggagaggctgtggaggtgttggttgtg

SEQ ID NO: 247 - DNA, 371 bp, Glycine max
gatactgaaacctatcgttcttcacatcataaccatgcgttccagcaacggtgcatcaagcagcagagcctccaatgctaacactgggcgccaccctgtgtaccgtggagtgaggcgtaggagtagtggcaaatgggtttctgaaatccgtgaacccaaaaaacctaacaggatttggttagggacatttgccacccctgaaatggctgctattgcctatgacgtggcagcgcttgctcttaagggtaaggatgctgaactcaacttccctaactcggcttcctccctccccgtccccacatcatctgctgctcgcgacattcagatggctgcggctagcgccgcagccgctgtcggagctgcgaatgatg

SEQ ID NO: 248 - DNA, 393 bp, Glycine max
tccatgtcattctattgatagtgaggttcggggcgaattgcttgctaattttcagctctttgttgcggttcttgtggtccttgtgggaactgtggcatcatatggctttgctgcttcaagatatgggagttctgaagtcaggaacttgcatgcaattcagactgaattagatcaagactaaagttgcgttgctattttttctggtggtagttgaaatgtgttggcagcatagagtttcttatagaacatgtttgttgtatattgaagtgcaaaggatcatgcatgcatgatcactgaaaattgaaaattaacaccccctcctccctcaaaaggaattatacatttttgacttttaggaatcggatgtcaaaggagcaacagaggagaatcata

SEQ ID NO: 249 - DNA, 339 bp, Glycine max
tgtttgagttggccaaggctgttttggctgcggctcatcttggctagctagattacaatattaattgttcattaaatgctttgaattggtggtttggtattttgaaaaaccattcaattcatttaaattatactcctacatatatagagcttcatgtttagaattttactccatctgatctgctgttaggtttgaggatgggtatagataagtttatccaatagtaatgcagttgtttcgtcatttgtgacctatacaactcgtgtaattaaatgctatgatttgaccctctttacattgagttgcttttacttgaagaataatgttgtcatcggattc

SEQ ID NO: 250 - DNA, 666 bp, Glycine max
aacggctgagaggcaacctgatttagtaagcaagggaatacctcttccccttgctatgcatgcaaacatgtctgttcctgtcagaagtgatggcgtacttgcacatcctcttcagggaactgtttctaatgcacaatcaactgaatgcccaacaactagtgaaccacagaatcaacaggatgaactctcggttgaaggagggacaattagcatctcaagtgcatactcccaagggtgggtaattgcttaaagtttattgttgttgttattttttatttctgaaagattgtatggctttgtttgatatggatgtttgataattgatacactctttttatttatttatttagttttttaaagaactttcttcttgttatggttttataaatctaatgatgcctgttttttcttttaaatttgtccgttttaaaaaatctaatattagattttcacaaagatttcaataatgttgtgatgtttgacaattgtaaggcaacatgtatgttgatttatgttccctgtttgttacataacttacatttcattcattctcttgtatacgttcatatggagaagagaactcaagttggtgctttcttccttgttgttgaggggagtgagagattaccaaattgatgggtatttacttttttttttgaaaaaaaa

SEQ ID NO: 251 - DNA, 813 bp, Glycine max
  misc_feature (800)..(805): n is a, c, g, or t
ggcatactgaattgcggatcatcaatgtttatttcaatagggcttctttcataatgattagtaattagtagttggtatccccttcaggaatttattgaagcaactagggagcctggtgttacatttttggcggccaagtttgatggtatactgggacttggatttcaagagatatcagttggaaatgctgctccagtgtggtatgttactatttaaatttcgattcctcattttgttagaagtttattgaatttattgaattttgttagtgcttactacatcagaccctactggatctaactcttcctatagtgagagtcttatagaaccaggctacccttgttattgtttttaaaattttattgaatccccatgtgtttatctgatcttacctgtcacaggtacaacatggttgaccaaggtcttcttaaggaaccagtattttcattttggttcaaccgcaatccagaggaagaggaagggggtgagattgttttcggtggtgttgatcctgctcactataagggaaagcacacttatgtgcctgtgaccagaaaaggatattggcaggttataatttttttaatacttaataatgctttctttttttacctttttctatatgttaatttttatttttgttttcagtttgatatgggagatgtacttattggcggtaaacccactggtatgtagagaatgtgttagcagaaattgataatttgttcttcctatgatgcatcattggcatttttgtaaatgggtcagagttttaatttatttggactgacctgatctannnnnnatcaggat

SEQ ID NO: 252 - DNA, 748 bp, Glycine max
caaaatcttgactgcaagaaaacaataaagactcataaattcataatcatcccccagcaagaaaaaaagaaaatcgcaaaggcagagcaagaacacaacacaagacatcgaagcagaagaagacatggggttgcagtggctgattctcacctacgtggtcgcagccgaagctgcggtggcaattctgctaacccttcccacgcccaaactcctgaggaaccgtttcgcctctctcgtttccctcattcttcaacccgcgcttttcattgtaccctttgcagggttccacctcttaggtacgattttctctcttttcctcaaatgggtttctttaatttcatcttccaacaactgggtttgcctcaaaataatttcttttttacttttggattggtgggtaggtggtcgtcaattgttgtaactgctctttatttcggggtttatggatgatcacccatctgggtgtctcttgatagtgaaaattttgaatctttctcactttctctttgagatggattgttctgaaagttagattgggagcttcgaaaaggcttataagagggttttttttttaaaaaaattttggttgtgtcttgtgtgctattagttctgttcatgtggagatcgattgagtaattgtgtgtaatctactgttggttttcctgaattttgatctatggttgtttgtagatttatactggaaaaatgagcatcgcttgatgtgtacctctgaagtttgtactgctgc

SEQ ID NO: 253 - DNA, 747 bp, Glycine max
gaagcctctgattcgaaatttctttgagaatacggcaactgtgcaggtaattaatccatgccgatatctctgaaaagtttaaatagtaatatcctcataagtgtggtttggtggccaaagttttaacaacatgaagttctaattggtgttttgcattgctcttaacagcttgatcaccgtatacttgcaactgcaactctgatttctgtgagcattttatggtggtcaacaagaaagctggagatacatcctgcagtacgatctgtgattggaggtgctgttggcatggcaactcttcaggtcataatttcatttccacttttatatactttacagtaataattatcattttgtattgttgtttctagctagttctctgcctttcgatatattgcctcctttgtcgagctgtgaatactcagacctgttacttgacgtgtttttgtctgattcttcaactaaatgaagatgatgataatacatagataaaatagaaataagaagaaagactttatggtatttgtttttgttagtagtctagtatatgatttcccagaggctgttgtcatcaagtataatgtaattaattttgcatggtttcaggtcaccttaggaatttcaacgcttctttcatatgtacctgtttcactgggcactgcacatcaggctggagccttgacacttctgacatttatgttacttcttaatcacacggttcgaagaccgtctttgtcccttctcaaatct

SEQ ID NO: 254 - DNA, 708 bp, Glycine max
  misc_feature (52)..(54): n is a, c, g, or t
ggtaatcctcgtatcatttgttgtctttcactctgttattatcttgtatggnnncttgataaattgcttgctgacctttcaggtttctaaccttctgtatgttgaccaaccaactggaactggctttagttacagtactgataagcgtgacattcgtcatgatgaagaaggtgtgagcaatgacctctatgactttctacaggtacttgtgctgtgtttgctctaaatatttgttatagagtattagctcagtcatcagtgttttcttaattagttacctggcttatatctattttctaagttgcttttctaagaaaaccaaaactcagaaatgcttagttactgttgattttgattagaacacctggctgagcttcatcagtaatgtcttggcttagcaagttttctctttaccctacaggccttctttgctgaacatcctgagtatgtaaagaatgacttttttattacgggtgaatcatatgctggacattatattccagcttttgcagctcgtgtccataggggaaacaaagctaaagaaggaattcatataaacctaaaggtctgttacattgcatagtgagccatttttacttaagttttacatatgcattgaaaggtgagaagacttgcttgattcatttgaagtgattgaacagggatttgccattggtaatgggcttactgatcctgggatccagtata

SEQ ID NO: 255 - DNA, 932 bp, Glycine max
  misc_feature (642)..(929): n is a, c, g, or t
gtagtgtagcaggaagaagcagcaatggcgccgaagataacacgtaaggttagcagaaaccctgaattgataaggggaatcggaaagtactcgaggtcgcagatgtaccacaagaggggcatttgggctatcaaggccaaaaacggtggcgttttacctcgccacgaccctaaacccaagcctgaagctcctgctgaaaaaccacccaaattttaccctgctgatgatatcaagaagccccttgtcaacaagcacaaaccgaaaccagctaagctcaggtgcattttcacttcaatcccatcctcactttaatttgtttttatttttgtgttttaatttattttgacttattttatgatgatgctagtgaattgatttgggatctggtgagtgaaatgtatgttattgctaattgataaaatgaatttgaattttttttaataaaatttctttggattaatggcatttttttattatttatatgtggagcctatgtcgtttgattttgtgtctggtgtgtgttcagggctagcattactcccgggacagtgttgattcttcttgccggtagatttaagggaaagagggtagtctttttgaagcagcttccttctgggttgcttcttgtgactggtcctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccc

SEQ ID NO: 256 - DNA, 566 bp, Glycine max
  misc_feature (62)..(62): n is a, c, g, or t
  misc_feature (510)..(517): n is a, c, g, or t
cttattgctctgtttcagcagcagcagccgcaccacctagtctctcgctcaatattttcttncccatatacctgcatcaaattgaaaatgccaacaatcaacacgtgttaaaatcaaatgggacaaatgaatggtgaaattagtcttaaaattgcaatttgctgtcactacgtagtctttagatttgatgaaataaaaaaacatgtccttgaaactgtaattcatttgatataagttcctaaattaaagtcacatattacatattatatgaaaatattaggagtatatatacatacatacctgccaagcatcataacagtggcctgaggattagttccaggggagtagttaaaggtggagccatcaataacacgcagagcgtccacaccaagaaccttgtagtccctatcaacaaccttagcaacttggcagcctccatggtagtgccaaatggtcatgacagtgtctttgcagtactgttccaaagatagtgaagaattggtgtgcttnnnnnnnnaagttaacgggggcacttgcggtcatgttgagcagcacaggaacaggca

SEQ ID NO: 257 - DNA, 267 bp, Glycine max
tcagtatcagttgaacattatgttcactcttttcagttgcatactgccttgagagctttgtagacaatatcaatataattcctttctagatccagttatctgttcattcttttagatgctagcagcgaaattgagggataactactgattacggagttcagccattggtgctcaattgctattttcgggggtgatatgattgtagttttactctgctattggatatacacaacttctgttgatgaccaaatattgaagagaaaaaaa

SEQ ID NO: 258 - DNA, 976 bp, Glycine max
  misc_feature (702)..(702): n is a, c, g, or t
  misc_feature (704)..(727): n is a, c, g, or t
  misc_feature (731)..(743): n is a, c, g, or t
  misc_feature (748)..(763): n is a, c, g, or t
  misc_feature (765)..(774): n is a, c, g, or t
  misc_feature (776)..(797): n is a, c, g, or t
  misc_feature (799)..(814): n is a, c, g, or t
  misc_feature (817)..(845): n is a, c, g, or t
  misc_feature (850)..(852): n is a, c, g, or t
  misc_feature (855)..(886): n is a, c, g, or t
  misc_feature (889)..(902): n is a, c, g, or t
  misc_feature (904)..(940): n is a, c, g, or t
  misc_feature (948)..(973): n is a, c, g, or t
cgccgtacatatcttcaattatgtctgatagaggtgataagccattttcaattgttgcccctaatgtgtcacaaaggatgttgggtcctgcaactggcagcaacccatttggacctgatatttatacgggggcagttttgtcatcttctcccgcagtgccatatcaatctgcaccatttcagtatcctgtcttccctttcaattccagctttcctcttccatcagcatcattttctggtggatcaactccttatgtagatacaacttcaggagggaggctttgcttccctgtagtaaattcacaacttataggttctgttggtaatgtttcagcccattaccccaggccttacgttgttagtttcccagatggtagcaaagcctacctcctgaagttgtatctacataaggagttgatccaccagaaaatgatgctgatggaagaggaaagctggaattgaaagggaagacaggatactgaaatggtgcagattgatatggcactgcgggagaagaagacaaaactgcccccgtataaatatcaggtccaaatgggttgctgccagttgcaggacccaacatcctttgtggcacattaggggcaacaattgaaaagggcttatcacctctatcagacataattgaagatattgttacggctgaataggtgttcgcagtggaaggaaaccatgaagagaagtngnnnnnnnnnnnnnnnnnnnnnnnncccnnnnnnnnnnnnnccccnnnnnnnnnnnnnnnncnnnnnnnnnncnnnnnnnnnnnnnnnnnnnnnncnnnnnnnnnnnnnnnnccnnnnnnnnnnnnnnnnnnnnnnnnnnnnnccccnnnccnnnnnnnnnnnnnnnnnnnnnnnnnnnnnnnnccnnnnnnnnnnnnnncnnnnnnnnnnnnnnnnnnnnnnnnnnnnnnnnnnnnncccccccnnnnnnnnnnnnnnnnnnnnnnnnnnccc

SEQ ID NO: 259 - DNA, 397 bp, Glycine max
cctcgctctcggtgcccaaatcctcgacgagaactactcccttggaaaatcactcaccaccgacaacatcgttagtttagcatccaagggtgctcccaatgacgccatcaacgttgttctaacattctcggacgtaaccgttgaggggttctgttccagtaggtgcgggactcacggctcctcggtgggtcatggcaagttggcttacgtgtgggtggggaactcggagacgcagtgcccgggccaatgcgcatggcccttccaccagcccatttacggcccacagagcccaccattggtagcgcccaacaacgacgtgggcctggatggaatggtcatcaacgtggccaccctattggccgggaccgttacaaacccttgggggaatggctacttc

SEQ ID NO: 260 - DNA, 423 bp, Glycine max
atttatttggctaactctctcaacagtttgagattggaagggcagaaaactgctgctattgagattctgcagcagtttgattggcaggttcctgattgggtcattgtgcctggtggcaaccttggcaacatttatgccttttacaaaggcttcaagatgtgtcaagagcttggtcttgtggataagattccaaggcttgtttgtgcccaggctgccaatgctgatcctttgtatttgtactttaaatccggctggaaggagtttaagcctgtgaagtcaagcactacctttgcctctgccattcaaattggtgatcctgtttccatcgacagggcggttcacgccctaaagagttgcgatgggatcgtggaggaggccaccgaggaggagttgatggatgctacggcgcaggcagattccact

SEQ ID NO: 261 - DNA, 577 bp, Glycine max
  misc_feature (553)..(555): n is a, c, g, or t
cattcaaatgtataattgattcccactcttcaaagccaacttctctattctcattctcaccaaaaaaattgaacaccaccccccacctcaacctcatattacaagtacaagtagctgattctggcaagtggaggaacatggtttcatttttcccaggttttctaactaaaggtagcgatgttcagaagctcaaggtggagctctatgaagcaattgcaccccttgaccgaggtgccgaggctactcctgaggaccaacaacgtgtggaccaggttaaagtgaaaactacagtaacaattaacatgtcaaatattccgtgcataatttaattgacttaatttgtttcactgtctttcttttcttggtttccttgtttgtgaattgtgattataagtagtgggccatatctatccagattgctcgtaaacttgaggctgtgaatcctgttaaggagcctctcaagtctggtttgctcaatgggaaatgggagcttttctatacaacatctcaatcaattctgcaaacacagagaccaagaaaagaaagacagtgnnncaaattaagtcaattaaattat

SEQ ID NO: 262 - DNA, 734 bp, Glycine max
  misc_feature (640)..(641): n is a, c, g, or t
  misc_feature (653)..(653): n is a, c, g, or t
  misc_feature (667)..(670): n is a, c, g, or t
  misc_feature (705)..(707): n is a, c, g, or t
  misc_feature (711)..(713): n is a, c, g, or t
  misc_feature (718)..(723): n is a, c, g, or t
tctgttctggattgtggcgtgagagacgtgattctgatgggaaatcacatattgttctggagtcatatccaccatgtgatagcatcgaggttttgaagcaagctcttttaaataacacagtgagttaccagtgttaactttctcagcatgcaaattaatggaacttgtttaaatttgagtatcactaacattaacatgaaattgaatgtgttatagttttaaattctatactaacaatgattaatggataatttgaaatggaagaaatcgtaatataaagatgctttgtctttttcatatttagagctgaacttggaacttgaacatagtctctactctctttaagcaaatcttactgtgtttttttttttggggggggggggaggggaggggagaattttttgttttcccatgccttttaaggggggtaaattgggggggaaaaaaaggcaaatatttcttttcaaaatccaccccttttggatgttttttgggccgcttaattaaatgggaaaaaaatctatttaaatcccaggttaatttaaaggggggggatttccccctgcccttcaacttggaaattttgaaaggggaaaaaaaaaaatgggaaatttttttttctgccaaatttcccccccannttaaattttacnaattttatgggacnnnncttgaccccccccaaagggttgggaaaggcccctnnnaatnnnttggnnnnnncagggttcccc

SEQ ID NO: 263 - DNA, 740 bp, Glycine max
aacctccttattggagcaaactttgcttcagctgcatctggttatgatgaaaatgctgctactttgaatgtaagtttggaatgaataattaacatatggttttactttacaagaattctgattttaacaatttcttttattccttttttggcagcacgcgattccgttgtcccaacagttgagttatttcaaggaataccaaggcaagctggccaaggtagctggcagtaaaaaagcagcctcaatcatcaaggatgcgttgtatgtgctcagtgctggaagcagtgactttgtgcaaaattattatgtcaatccttggatcaacaaagtctacactcctgatcagtattcgtcctacttaattggttcattctcaagttttgttaaggtattctattaaactattttgattatttatatatatatattgttggagaactataaagacaagtaataagtctataagtctgtttggatataaggttagaagtgtttttgagagtctttaccaaaacaaattctatatttctagtagagaaactctcaaaaacacttgagacccatataagcgtggaggagttgagtccaatagatttgaatcttttgagcgatatacctcctatgtttgatacagatctagcccaatgcacattcaaaatagttcaaatgttgagaaattaatggttccgctgcttttttgtttggacgcaggacttgtatggattgggaggcaggagact

SEQ ID NO: 264 - DNA, 435 bp, Glycine max
  misc_feature (304)..(308): n is a, c, g, or t
  misc_feature (314)..(349): n is a, c, g, or t
  misc_feature (358)..(368): n is a, c, g, or t
  misc_feature (370)..(383): n is a, c, g, or t
  misc_feature (389)..(398): n is a, c, g, or t
  misc_feature (405)..(420): n is a, c, g, or t
  misc_feature (425)..(425): n is a, c, g, or t
agtgtgatccaacggagcaaatgtagtattgctcccctgtttcgttcagggtcacggtcgctggaccggaggtcagggtgaaaacggcgctcccgccgttgcacgcgtcgaaagccgatttcgttaccttggccacgttgtgttggccggtggcgaagttgaacactgcaaaaaataaaaagattcaaaacttttaaatctataggcaacaaacacatgtagtaaaaccaacactagatgggttaagaaataacggaagagaaaaaagttcgaagtttgatttcttctatattttttttttttnnnnntttttnnnnnnnnnnnnnnnnnnnnnnnnnnnnnnnnnnnnaaaaaattnnnnnnnnnnnannnnnnnnnnnnnnaaaaannnnnnnnnnaaaaaannnnnnnnnnnnnnnnttttntagggggccc

SEQ ID NO: 265 - DNA, 386 bp, Glycine max
agacataaagttaaacttcccatttggatgtggaatgaaccatcatatcctcacaaacaaagactaccagagttggtttgtctcaaggttcaaattcacaaccttcaccaatgagatgaagtggtatagtacggagaaaaagcaaggcgaggaaaactacactatcgcagatgccatgctgaaatttaccaaagagaatggcatttctgtgagaggccataacattttctgggacaatccaaaacttcagccggaatgggttaagaatctatcacctgagaaattaggagaagcagcagctgaaagaatgaaatctgtggtttcaagatacaaaggagaactgattgcatgggatgtgatgaatgagaatctccacttccaaatgg

SEQ ID NO: 266 - DNA, 844 bp, Glycine max
tatggcgcaccctagaacgtggtggacaggtattcctctatttctattttacatcaaagtgtgaaccagcaatgccatagttgcctgcataatagcagtatgggatagtaaaattataaacattttaactgttgtttttgttatcattaccaaatcattttgaggtcatacatgatggatattttgtagttcaagattttaggccaagtggttacctgacaactgatgtggtattaaatattctttgataaagttgattgatctcaatcctcatcacccttgtgctaataggtggccatcttttagcctccacttaacagtttcaggttttcagtcgagtcatttggcaaaaataaatgtactggatgtatgatatcttaaacttggaacccacctggaccctcctatacccttttcaaatgaaacttttatgcttcaaataggtgctgataattttcattattagccaagggtaaatgtgaaagtcaggcattttaatttgttagtagattttcttgttcaatttagaaattgtttacaaatgtttcatttaagtagacaagtcttgactgtaaaaagatatgcaggttgtactacttggttcagctccagatcctcgtatccaaaatgattttgtgaatttggccaatgaattgcattccgctcatcatgatcgtgctagactttgccttgcatatgatgagcctctatcacacttggtaacttatgaaactgaaaaacctttggtaacattttacccatccaggtacaacataatgggcctctactgactcattttaatttcttttgttctagatatatgctggtgctgatttcattctag

SEQ ID NO: 267 - DNA, 544 bp, Glycine max
  misc_feature (487)..(489): n is a, c, g, or t
  misc_feature (499)..(503): n is a, c, g, or t
  misc_feature (511)..(514): n is a, c, g, or t
  misc_feature (525)..(525): n is a, c, g, or t
  misc_feature (536)..(536): n is a, c, g, or t
attagatcacagagacatggaggttgctatggaactggaagatgatcttttttttgctgatttgagcaaggaaattgctctactaattatggatgaagatgaagatcctcttgcttcttgtcctcctgactctcttcaggtactttactactttaatctcttcaaagttcaaacacatgcacacacatactttttttttccttcttcttcttcttcttcttcttcttccaattatggcactttgagaagaaatttttgtctattgcaataatactaacaaggttaaactaattttcaggctttttctggggcaattcatcctcctccacagtttgctttcatctatgagcatgctttgagaagagaaagcaaagggacaggtgtgtttatccctcaagcaacacagccaagaaggaagcagaggaaaggaagggctaataataattcatatgcaaaacatcaaaagcagtctcaaaataccaaaatnnnttctcaaagnnnnntaattggnnnnggaggaggagnaggaggagganggaaaaaa

SEQ ID NO: 268 - DNA, 278 bp, Glycine max
  misc_feature (262)..(264): n is a, c, g, or t
tgagacttgggcccgtggcccagcccaagaggatcaagtttacccctcttctcaaaaatcctagaagatcttcactttactatgtgaatttggtggctattagagttggccggagaattgtggatattccaccggaggctctagcgttcaaccctaacaccggcgcaggcaccgtttttgattcgggtaatgtataattaacacaaattttacttcagaaaaaaaaaatgctttttgagtttattttctattaggacataannnggggcattaccatt

SEQ ID NO: 269 - DNA, 523 bp, Glycine max
gcattcgagcaggtaattcattattactagttaatttgtttcactaacatctactagtacttttttatattatttcttactattaaattatcaaggcatgcatatacatatatgatgaaatgtgacatatatacaggttttgatggaatcgagattcatggagcacatgggtatctcattgatcaattcttaaaggatgcaatcaatgatagaacagatgaatacggtggaccactagaaaaccggtgcaggttcttaatggaggtagttgaagctgttgtctctgccattggagcggaaagagttgctatcagaatttcaccagcaattgatttcaatgacgcctttgactctgacccacttgggctaggcttagcagtgattgaaagactcaacaatttgcagaaacaagtgggcacaaaactcgcttatcttcatgttactcagcctcgattcacacttttggcgcaaaccgagtcagtgagtgaaaaggaggaagctcatttcatgcagaaatggagag

SEQ ID NO: 270 - DNA, 398 bp, Glycine max
agatcgctcaggtggttttggagattttggctcaggtgagcctagtggctttggtggttctcgtggtagtaatcagaacaatagaagacctttttaacttaattaacatatatataaaaaaatgcaccatccttatttatggtggcttagttcttgtagagtttgcttctgtcatttcctctaaaacttataggtttcttggctaatccttgtattactaaggattttagaagacaaaagttctacggccattggatttttcttttcttttctgggacttttggcccagtctcagctgtgtattgttctttttgaaacttttataaaaaaagaaaaaagggagggctgtattctgcggcttccatcatctgccatggcacattacttgtctctatggg

SEQ ID NO: 271 - DNA, 536 bp, Glycine max
  misc_feature (520)..(520): n is a, c, g, or t
gaacattcacaaacattgccgatgttgtttgctcaatattctcgatttgtatatttggtatgttccataacatatttacattgttgtttgctcactcagtattcgtgatttgtatatttggtatgtcctgtagcatcacatgcaatctgttctttatttaaagctttcaatgggttagacatgcattttttttttaattcttaacatgtttgcattttgttaaaccatactgatagttgtgctttttatgcatctcatacatgcccattatttaacagtttttctagttttacacctctggtaatatagctcaattgtgtggagatggtcttgtcttgttcctcaaatcattctgtcttgtttggtcattaggcttctgggaatgcagagaaggcaaggcagattctagttgaggggcttgagaatgttttgttgtcaaagccactacttgaggtctgtcttcactattactttccttgtcccgctaaattcactcatattatgtagttggtgattcttntctttgtatttctaag

SEQ ID NO: 272 - DNA, 738 bp, Glycine max
ctcgacgtcgtcgaacttgtcgtacgttaattttcccttcttacttgctattgggttcatgcatggccagttctagatatgcatgtcttttttaaccacataaagtgaacaatatttttttgttacaggtacgggaactggaaacagatcccctgttcaactctggtcgcggagcagctctgacagaaaagggaacagcggaattggaagcaagcatcatggatggttacaagagacgatgcggcgccgtttcgggcgtcaccaccgtcaaaaatcctatctcactcgctcgtcttgtcatggaaaagtcaccccactcctacctcgcctttaacggcgctgaagatttcgccagacaacaggtcaaatcattaattatttctttttcgtccaccttttccgtccctgccaaactggcgccacctcatgccaaatacaatctcgtttatcacattttatttctccgcaaataatatataataatacaaatattggtgactggctgaatttgtgttattagggagtggagattgtggagaacgaatacttcatcactcctgaaaatgttggtatgctgaaactggcaaaggaagcaaacacaatcctggtaattagctagctagcacacatttaataaagagaaaatactatactataatctttattttattatatagaattattggcgatgaaaacgtgggtgatagtgtttgtgttattatgatgctgtttgattat

SEQ ID NO: 273 - DNA, 385 bp, Glycine max
gtattttgaaactcttaaaattggaagggtctgattggttgtttaaacagaatgatggggctgatgaagatctgattgaccgtgttgctgcaagggagaaatttgtttatgaaattgaaaccacagagatgaaccgcaatcatatgggagaaactcgatatctttcttctgatgggaaggcttgttcttcaatgaagaataatgaggcaaattggtctagtttttctgtaacctcaatccctaactgtggggaaggatgtgtttggagagcagatataataataagctttggagtgtggtgtatcaaacgtgttctggacctctccctaatggagagccgaccagagctgtgggggaagtacacttatgtactcaatcgcctcca

SEQ ID NO: 274 - DNA, 962 bp, Glycine max
  misc_feature (569)..(569): n is a, c, g, or t
  misc_feature (883)..(885): n is a, c, g, or t
  misc_feature (895)..(900): n is a, c, g, or t
  misc_feature (904)..(905): n is a, c, g, or t
atgagcaaagactccgccaattctcacatcaccaacccttcttctcccttcctctctgtctcctctgtcacctccgcttcccaattccccaccaaaaatgccaaaagagtcgtgcttttctactgccccgagaccaaggttctcgccgagaaaatcgccgcgcaaactgattccattgaacttcgtaacatctcttgggggttcgttgcttttccttcacattgcactcctcgccatggattcgtttttttgttcctctattctgctgttttggtttcgattttgaccaatgtggtggtttgtgtgtgtttttcgtctgccccatttgggtgaattgctgttttgtgttggaattcatgtcttggtggttgcaattttggaacttggaaatgcccattacggttatacttgtctctgtttttcatcaacttcgagtgcccccattttgctaaattgctctgttgtgttggagttgatgtaaccgtggatgcaatttttggaacttggaaatggccattacggttagaataattctaagacaaatgatttaaatatatcagtttatcttnaaaaaagggaaaaatggaatgaattgattgcaaattattataagattttccgatttcgaattcccttagggctaagcactatccttgcacattgattaaaaaactaaaagaataaatatttttagtgtggtgtgcaaaaatgcgttgttcattattttttttatgttctcatgtgatttccataataaatattttttttcttttagtttcttaaacaatctctcaaaggatactggtttacaacatcctaattctaaatcacactacatcctcctacttactttgtataagtattaaatgcgtattatatttcnnnagacactaannnnnnaagnnttttcatttactttgtggtaggagcatttcttggaggatgtagcattactttatgct

SEQ ID NO: 275 - DNA, 907 bp, Glycine max
cttttctctgcgattcctattcccatacacaaaccaaatgggtattaaggtgttcattttttcatcaacctatccctatttttccctttcggtttattattcttgatattaattaggttaatgccgattattttctagggtttaacaaagcttttggcggacaatgccccgaagtccatgaaggagaacaaattcgagagctacttcggtcgcaagatcgccattgacgctagcatgagcatttaccagttccttgtcagtactaatcttcccaacacagcgtagtttcaatttcaaccacgatactaatacagtttaattatgttaataacttaatgtcacgtgtttttgtcttggattttggtgcagattgttgtgggaagaagcggaactgaaatgctcactaatgaggctggtgaagttaccaggtatatgcagtaatctcttcatagctgcaattagataagcttaattgtgatttgttgttttgtttcagtttttttttcttactataataaaatgtggttcgttttgtgtgatgatggtgttggttttgtatcctgtagtcatttgcaagggatgttttcgcggacaatcagacttctagaagctgggataaaaccagtgtatatatctatatattttaaatttgttaaacatttcttttgttggaacctttcgtggatgatttttttgttctgttaattttgtttgctgatttcttctaatgctggtgtgcagatatgtttttgatgggaagccaccagatttgaagaaacaagagctggccaaacggtattttatgtggattttttgttattttagagagttctattttatttttttggagtgagggtgttatattattatagaattgttacttatcaaaagtttgtcagcaatggtt

SEQ ID NO: 276 - DNA, 322 bp, Glycine max
ggtggagaaagttgtggtgtctgatcgtgttgtggattctccttgctgtctggtgacaggtgaatatgggtggacagccaacatggaaaggattatgaaagcacaggcattgagggacagcagcatggctggatacatgtcgagcaagaagacgatggagattaaccctgagaaccccatcatggaggagctgaggaagcgagcagatgctgataagaatgacaagtctgtgaaggatctcgtgctcttgctctttgagactgctcttctaacttctgggttcagccttgatgatcccaacactttcggtaacaggattcac

SEQ ID NO: 277 - DNA, 536 bp, Glycine max
  misc_feature (423)..(447): n is a, c, g, or t
  misc_feature (455)..(494): n is a, c, g, or t
  misc_feature (496)..(532): n is a, c, g, or t
gattgctactctcttgtatatatgaaataaaatgtaaatagttattgttcttgcaattgttgaaacgattgttcttgactaccaaaagatttgtaaattgtaaagagatatgaaatagctctagttcttgaattgcatggtgaagcaaagattgaaatgcttgcatagcatgtttgtttctttggacttcttccctatcatctatttgaaaatgttattctggtgctttaaagctccgagaggagatggagaaagcagagaaggaccggagggagaagaaggagaagaaaagggaaaagaaagagaggaaaagagagaagaaggagaagaaagagagaaggaaagcggagaaagaaaggaaacttaaagaaggagcaagtgccacaaaatagtaaaataacctgagtcatttctaccaatgannnnnnnnnnnnnnnnnnnnnnnnngattcatnnnnnnnnnnnnnnnnnnnnnnnnnnnnnnnnnnnnnnnntnnnnnnnnnnnnnnnnnnnnnnnnnnnnnnnnnnnnnttta

SEQ ID NO: 278 - DNA, 367 bp, Glycine max
gatggatttggatgatttcttgacctacataagatcatggtcagcatatcagacggctaaggagaaaggagtggagcttctcacggaggatgttgttgaaaaattcaagcttgcttggggtgaagatgctaaaaaagttgccaagtttccaatttatttgagaattggaagaacaggggattcctaaagatatatgcaaatggttgcttttactgtgtgggagatgtgacgagtaccaacttttatgagtttatccattgattgaataatgtaattttattgaattgcgttcatgttaagaagtcaaaagcttttaaattcgaagggtacaattcctacttatctggaaagagttgagccttagttt

SEQ ID NO: 279 - DNA, 581 bp, Glycine max
  misc_feature (536)..(536): n is a, c, g, or t
  misc_feature (557)..(557): n is a, c, g, or t
  misc_feature (576)..(576): n is a, c, g, or t
ttgttgattgaggtatcttagtactatcgagatttttggcgtgttggagttgaacctgcaaaagtgttttgttccttattgtactttttaattggacaggacaaagaaaatgtgaatacgttagagcttcagtcaactagtgtaaggtctctgttgctttactcactttacatcctattcgatttttttcaaattctaaatttgaatattttatgtcaggcataattgtttagattctaaacctgtttctctttatagtggattgccgctgtgcctataataaaacttggttctattttggtgaaactttgcaaatttcgatctgatatttactgtcagcaatgttattgctatttatttgttaaggtttgcaggcatgtctatgttatttattgttttgaataatgcactagtgcacaaaatagggaggttatccttgtacttgattatctttatgaaagatgtcattgaccatgtgtgcacaacttgcagaaagtgtatgcatttatggacatctttgtcagattatctcttcnaaagaaacatgatttttcaanttattgacacttctaatcnaggtg

SEQ ID NO: 280 - DNA, 483 bp, Glycine max
gtgtcggtaccggtgctcccgtttacttggccgcagttctcgagtacctagctgctgaggtaacatatcactaatttgcatcacttaatcttgattgactatgattaattatgtgttgtgaaattgaattgtcttgattggattgtgaaggtgcttgagttggctgggaatgctgcacgtgacaacaagaagaacaggattattccgagacatgtgctattggctgtgaggaacgatgaggagttggggaaattgcttgctggtgtcaccattgctcatggtggtgttcttccgaacattaaccctgttttgttgcctaagaagactgagagggcttccaaggagcctaagtctccatccaaggctactaaatctcctaaaaagtcttaactgacttagtttattgtttctctatttagtgtgcacaaaatgtaaatctgtgtttaggttccttcttgtatcaccattatttgtagttctcaa

SEQ ID NO: 281 - DNA, 477 bp, Glycine max
tgttctagctgatgctggagatcaggtgcttgaagccttgcaatgaagaaaaagtctcccctggaattggagggtaattccttcctttattatttccctagttattgtcatgctttcctcattcaattatatatcgatttactggtaatgcaaatgttctctgttattgtcagctgtctggatcataatcaaggcaaccgttgaagtctatcatcacataactgaacacctgtttctcatgtgtatgttatcattaatatttatgtttcgtctgtcaaaatcttgacagtatatgtatctcagcatatgaacttattcagcttggtgagtgacttatgttaataatgactttgtcagacttgtctagtagtaagtaaatgccaataatgttaaagactacgccagatttgtgcagtagtaatgccactcatgtcaaatagtcaagtcttcaccagactggtttggaccaagcttaaa

SEQ ID NO: 282 - DNA, 390 bp, Glycine max
cttgattctcatgggcctaattgccactgcaagtttggttgatccctggcatggggattccactcttcaaacattgtttaatagtcttatagaaagtaatttaaattcattatgattctttggcttaaaatcatttgctcatttgttcgtatagctaaccaggtatttgttgtacattacaacggctagtttgatcatatttgttgcctgtacccttttatttgctacacaaatgtagtggatagtattgtgggactatcaactaaatggtagaaagtagttcatattgagagaatgttttctttaaatagaacatagcataaaccaatcacttgagtcccttaatataaaatatgggtaaagctctttagtagttgcactgcagtgatg

SEQ ID NO: 283 - DNA, 364 bp, Glycine max
aggacaatcgtcttgcttcttctaacttcagttttgatttcattcttgtggctcaacatgaagaaattattgatcctatgtggccaacaagaagacatcgccaccgaagctcaatctttcatactattttctattcccgatcttgtagcacaatcattgctacaccctttgagaatctacttaagaagtcaatctataaccctacctctcacatacaccgcatctctgtctattctccttcacgtacccatcaactactttctcgtctctgtgcttaagcttggaatcaaaggcattgccttaggcgctgtttggacgaattttaacctcgttgtttcgttgattctctacatatgggtctccg

SEQ ID NO: 284 - DNA, 383 bp, Glycine max
cccgaggagtacacgtcaacgacgatggggaaatcgaagcgcacgaaattgataaagataattggagggagcgttgggggagttgtttttgcattaggatgcgtggttttggtgtgggtgatttgcaggaagtggaaaagaaggaggaggaggaggaggaggaggaagggtggtgctgaagtggcagaaggggaagtgggtgcggcgggaagtgggggaggaggtgataatagtaaagaagaagaaggtggggggtttgcgtgggaaagtgagggtatagggaagctggtgttctgcggaggaggggatggggacatgagttatagtttggaggatttgctcaaggcttcggcggagacactggggaggggtataatgggaag

SEQ ID NO: 285 - DNA, 330 bp, Glycine max
aagtagttcccgcagtgacctaggccaaacccgcgccatcaccctcagtttcaacccctgctccctctactcaaaacgtacggttatgatgatgatttcagttttcatcaccattttggtgtcactgaaatattaatgtaaaaggtgtattgagtggtcctgacagtgttgaatgattgattgcagagacagagggatagcaattttgacgcggagaggcttgcttccgcgagaaggaggcttcaagagaactacaaagaggctgaaattggtggaattttcatttccataattttcattttttgatgatacttctctctctctctctct

SEQ ID NO: 286 - DNA, 827 bp, Glycine max
tgtagaattgaatttatgtgttgcttatggttattttatagttgtcactttcatttaacgagaggcataaaatgtttgccataacatctactaagtgtgtgtgtttgtgggtgcagttacaagctgtggatcagtgttgtctacgttactccaattaccattcacaatttaaaagtttgttacaatgatgattaaaatatgatggatagtgttgtagcataagtaaaccaaaacaaatataagtagattttagagctatgtcctgcaacaaaagttgattaatctttcaagaatattaacggagctttaagaaatggagaattaatggatatataaatccgtgaatcttagactgaaaacaccgatagcaatataaagcctagattgcttcggagaaacaattctagtttatgtcttctatggtgcttattattttcttttcaattttcccattgctctgtatctaacacagcttcatgacttgtcttgtcaggacaccaatttctgttttcatgagagacacaggctcggttgatttggtaaacatagcaaaatatggtgaagaatacaggaacgataaggagatttccatcaatgtgctatttcatgggtatggtcactacgacatactagagaccttatgatatgaccataattacacctgaaaattgaaaataaacacttagtacagcacaaaacttacttgccttgatggtgcagtttaagacttctcaagtaaagagcttttttgaggggtcattttaggagtgtttcagtgaatttagtaactttttgcaactgtagttcagctgcagggaacttccatt

SEQ ID NO: 287 - DNA, 434 bp, Glycine max
taacaacacaagctaggccacaaccgaggcagtcttttattttatatagtataattcattctgtcatatatatctgtgtgtgtaacaatggtggtctttatttgcaaggaagaatatggtgttcccttgagcaatggctgggctgcaacacatgaatttggccacaagttttgcatctcaaatgaaggtgatgatgacgatgatgataatggcgtcatcgatgtggccccagctgcatagaagaatttggcagaaaaacatgcatagatgaggaggagggatatagtagctagcttagtagtcactgtaagcttcattctgtcgtcttgcttagttacatttgtgtttactcttggaatatataggttatagtgttatgcttgtgtgacataatagaatttatattagtaattatggcttagttcctctctctc

SEQ ID NO: 288 - DNA, 216 bp, Glycine max
gtcttgttttgttagtgtactagatttattgtctatttaagcaagtcaaaagtgtcgtgtttcagtaacggttctcgttgcgctgcgctattttcatgaaccatctgtttgcttgctttgtgtgttactttatcatattcattcctttgtataaactcgaatgaactctatacgtggatgcgcaaatctgcttcctatctttgtattcccatcgct

SEQ ID NO: 289 - DNA, 1419 bp, Glycine max
atccaatcaacgaaaaatgctggctgttttcgacaaatcggtggcaaagagcccagagggtcttcagagccctcactcaaattccgtctcagccctaaaagacggttttctcgcagagcacttctcttccgttcaccctggttccgtcaccgttaaccttggctcttccggtctcttggcctattctcttcacaaacagaaccccctcctcccaaggtccttcactttctttttcctttttcttcaatatctcttattttctcatcatttttggatccaaaaaaaaagactcatttttttcttgatttgggtttttctttttgtccttatggggtgctcgtttgagttgaagggagattaaagttgaaatcttttctataaacccagttgacttccttgctgtgttggtaaatttaatctgtgtatattcgttcatgtttgtaagtttaaacctcacacttattaggataagggtgtgtcgttgaatcttttgtgttgcttggcatcttattgtagcattaggttattattggttaatggaaaatcttggattcttgtggctttatgatgttttttaaagttgttttctttatgctgaccttaatttggccgaacatcaggtttggccgcctagttttatgatgatagtagatatgatttccttattttattagcatgcacgtgattccgagtatgattttttttcggttctggcattatctatcttgtttctattgatggccttaaaactgaatacaagacaaaagaaaaaaagtagtaacccatgctataccatatataaaaatcctttagattctccttgatggttatttgggtatgatatattacttttttttttcttttattctttcgcagatcttaagatatattttgttagtatattaactgtggattctcacccatccttttgctctcccttcccaccagtagaaggcactctaagatagtttggattgctatttataatctttctaccttgggcttaaccattttctgttgcttcttgttattgttattttagtaattcaaatgggataaaaagttcatatatcacaaggttactgttctgcttaggccttagagcaatacttacctaatctttcctctccaatgttaagatgaaatttctgctctgctttcgctttgaacagtggaatgaccttatgctgaattcttataatctgattttatgaaggaaattagatgctataaaagcctataaagttgttaaagattactcttttcttgaaaatcaattaatatgttggttgtcttatgttggcaggctgtttgcagtcgtggatgacattttctgtttgtttcaaggtcatcttgagaatgttgctaaccttaagcaacaatatggattgaacaaaacagcaactgaggtgatcatat

SEQ ID NO: 290 - DNA, 674 bp, Glycine max
ttcctcggacacagaaaaaagtttctcgatccaatatccatcagcttctcctccctatccaaacctgcacacacaacaataacatctcaattttccctccaacaaaaaaaattaaattaaattaaatttaagtttagagggttacaatttgcataatgagagtttacatcaaagaattaaactgaaattccaattttaataagaaaacaacgcaacagaaactctatctatatatttcataacctcttttatgatcagtccacttgatgtatttatcatgtgttctgtggtacttctagtacctctttctaatttttctttttgccgatttaaaaaaaaaaatctctttttttctttttcttttattaaaagaagcttgcttactttgtaggctgaactgagaataatggaggtcgaagtgcgaagggtcgttcgacggtaaaattggccggcgaccttccttcacgtattgcctcaccgtcaccgccactaaatctccgaccgtcgattccggcgtcatcacaacctgcaccggtcccaagcttcccatgggagtaaccttcaacaacaactttggcggctgttttggcacaacatccgtcgccggcgtcgctaaagccgcgcggtgcctctccgacaaaagatccggcaccgtcttcggccgccggatcgtc

SEQ ID NO: 291 - DNA, 631 bp, Glycine max
  misc_feature (308)..(314): n is a, c, g, or t
  misc_feature (326)..(346): n is a, c, g, or t
  misc_feature (362)..(362): n is a, c, g, or t
  misc_feature (370)..(375): n is a, c, g, or t
  misc_feature (377)..(377): n is a, c, g, or t
  misc_feature (380)..(387): n is a, c, g, or t
  misc_feature (410)..(416): n is a, c, g, or t
  misc_feature (418)..(437): n is a, c, g, or t
  misc_feature (444)..(454): n is a, c, g, or t
  misc_feature (488)..(520): n is a, c, g, or t
  misc_feature (524)..(529): n is a, c, g, or t
  misc_feature (540)..(549): n is a, c, g, or t
  misc_feature (554)..(560): n is a, c, g, or t
  misc_feature (568)..(581): n is a, c, g, or t
  misc_feature (590)..(624): n is a, c, g, or t
ttttttcttcttgaactccacgcttataacggcaacagccttccctacacgcaaagccctggcctcgatctcaatctcctcctaacataaacaatggaaaattaatattgcagtgatatctagcattaatcacaacattcattatcagaaaccactaaaagaactccttacattagtacagaacatacacacatcaatgagtttaaagaacatgtcatgtcaaaaaataaaattctccaacacaaaccaccatctgataccatcaaacacagaaaagacagaaataaagtgttttttttttttttttnnnnnnntttgaaaaaaannnnnnnnnnnnnnnnnnnnnaaaaaaaatttccccnaaaatttnnnnnncncannnnnnnnaaaaaaaaaaaaaaaccccccgnnnnnnntnnnnnnnnnnnnnnnnnnnnaaaaaannnnnnnnnnnaaccccccccccaaaaaaaaaaaaattttttttnnnnnnnnnnnnnnnnnnnnnnnnnnnnnnnnnaaannnnnnttccccccaannnnnnnnnnttttnnnnnnncccccccnnnnnnnnnnnnnnaaaaaaaannnnnnnnnnnnnnnnnnnnnnnnnnnnnnnnnnnaaaaaaa

SEQ ID NO: 292 - DNA, 757 bp, Glycine max
  misc_feature (749)..(750): n is a, c, g, or t
ccctgagttccgccattacacagacatcaaggagcttcctccacatcggcttgctgaaatcagaagattctttgaggactgtatcctgttatttgcacttatacataaaccacatgcatctctgtacgagttattgacaattaatgattagtttcttttacaataaagcctatagaacgtttgggccaatataaaaacttttacttttactttcacattttctatctcgtaacatgtagggctaatgtctaatggattaccaaataccaaatacactccaagtccctcgtaggttttggtgaccatttaaataactttcttctatcaatgctatcaatgccacatcccctggtttcagtggtttgctgcatgtttccttagcttgtcacactagacaagaagaatgagaacaaaatagttgatgttgaagactttctaccagctgaagctgccattgatgccatcaagtactccatgtaagctattttcctttaccgtgactcaaattgtgtctatttttggattcttggcactaatttgaatgattaatttatttttcttacatggatgtttccttttgcagggacttgtatgctgcttacatagttgagagcttaaggcactaacttctttagaaactgaatagccaattccaattatgtaaaatgtgaatgaaactccataaacattctgatttccgtgccgttctgttatggcactactgctgcctcggttcttgacacaacagnncaaaaac

SEQ ID NO: 293 - DNA, 1027 bp, Glycine max
  misc_feature (964)..(965): n is a, c, g, or t
  misc_feature (1022)..(1023): n is a, c, g, or t
tcatgatgagttaacaactgaaaggtcatcttattatcttaagatattactatattacattttattttaggactactttttattcatctatgcttactttttagcagacaagtcgattcatctgcccgatgggttgatccgttgcttaatacgtacagtgattatgaagacagcatttatggtaaagaggttcaagtttttcaatccatctttagttttgtttagcttttgcttcttttgccaactttgacatggttttaagctctaacatacatacaaaacatcatttcaaacacacacacaaacttttcttcacaaatattttattcatgttacagggctcacatggagttctcgtgaaccatggatctttgcatcattatcctatgatggcagggtaagactacaagtaaatctttaggctaattctcaatggtagatgataaattctcttaatgaaaaaaaaaatatacataaaacataaacttcttcgggtgtcaaattttcccagtttctttatcttactgttacacactccgttttggtaatgaactttcctgctaatgtgggtgctaatagcatgcatgtggtcataagaccatacaacttagataaatacttatatttataaacagaaggataattgcttgttttattatttgccccgtgattaggccttgggttgggtataatgacaatctaaatcagtgactttctcaaagcatagataagaattcgatggttatttcgtgcaatttacttgtctacatttatcaataatcatcacattaatttgacatttcattttcaaaacaggttgttgtagaatcagttaagcctttcatctccaaaaaataaagttcagcaccaattgccatgttgccatcatttgtcatgtcatcttcttgtgtatgtcagtaatttcctgcctctcgggtcttgagataaatagatctgaaagaanntaatatttattccatcatgtcaccgttgctgggtttgacgaggctgaacaggttaanntaca

SEQ ID NO: 294 - DNA, 737 bp, Glycine max
ctgctgcattggaccctgggctcatctttgatgcaggtttggtttcttcttctacaacaatgagtcatgaacaaccatataaggaaacttaacactacaccttattccaaaaccttaagactcaggttatgggtcttctcctcccttatatggtgctcaactttttcacttctactcgatgtgagacttcacctcacacttgttggttaccagaagttcaatagaaagaatctttgtaacatgagtagaaatgtaattatagctgttaaatatgtctaaccaaagctggagaccttctatcttcctctttctgcatttgtttgctatttactcaaacagtatatgacaatccatcatggatcacagtgtaaaaaacctttattcagcatattttaataaatttgcatcatcaattttgcagggtacgaggattatataggcttcttgtgcacaacacctagcattgatgttcatgagataaggaactacactcacaccccatgtaacacctccatgggcaaaccatcaaatttaaacaccccatcaatcacaatttcccatcttgtgagaactcaagttgtcacgcgcacggtcacaaatgttgccgaggaagaaacctatgtgatcacagccagaatggaaccggctgttgccattgaagtcaaccctccagcaatgactatcaaagcaggcgcatcgcgccagtttttggtgtcacttacagtgcgctcggtgac

SEQ ID NO: 295 - DNA, 360 bp, Glycine max
tccttctatccttgtagttggaagatgtggaccaagtttggctgcaccatctgttctttcttttattgatgcatacacagggaaggaactcaattctttgagtcttgctcatactgttgctcaagttattccactgccttatactgattcaactgaacagcgtctgcatctaattatagacacaaaccaacacgcatacctatacccaagaactcctgaagctattggcattctgcaacgtgaattttcaaatgtgtactggtactcagttgatgctgataatggtgttatcagaggtcatgccttgaagagcaattgcattcacaaagtagtggatgaatactgctttgacttcaggga

SEQ ID NO: 296 - DNA, 543 bp, Glycine max
  misc_feature (510)..(513): n is a, c, g, or t
agctgctctgaccatttctccaaactcagaaaggcgcgcggttttgtggtcattagggttttgcaatagttcttgtgcaggagctccataacaatctatatgttctgaaagccctctaaacattgccgtctcatatcccaagggtgagagaatagcatgatgaaaacaaactgaaccactgaagctcttagcatatctgacgcttgagaataaggctttccatgtctcttcaagaggagcctgaattttttggaagaaactaataaattaacatccaatttccatatttgtcaacaaggtaagcaaaactaaccaataaataaaacataattacatgtttgttcatataattaatgaagaaggatgaacacagttatatttaagcaacgcaatttaacttgcaaacttaaaaatgcaaaaaatatcaaacactggagtcaaacaaaaactcaataataatcatgtattgatacttaacaagagggcttctatttgacttgcaagtttagnnnnttatactttggattggttgtgtacaactac

SEQ ID NO: 297 - DNA, 821 bp, Glycine max
  misc_feature (631)..(632): n is a, c, g, or t
agagctttaagggtaatgttctgaacaatatttgaataccacttggcacttgggcaatcatccgtgaaatgttaatccgtgtaataaccattctaattcatgagttagtaattttttcttgatggttgatatttcatgtgaacaggtgattgctgagcatttgacagtagaagaagctgctgggctaaaagagggattccagcttatggatacaaacaacagaggcaagattaacattgatgaattacgagtagggttgcataaacttggtcatcaagttcccgaatcagatgtccaagctcttatggaagctgtgagtattgctatcaccttttatctcaaatctttattccaaagctgatacttaaaaaataagtacctttatataagattgaggtcttttattttttttcagcgtattttctttttgatatgtgaaaataaatgtaaacttggatcttacttagtataactgtattagttaatttgcaaacaccaataggttactggttctttaactaggtatgcttaactaaaaaacgccacaagcaggcattcttaattcatttctttccccagtgccatttctgttcttccttaaaagaagcttcacaatttaaagtgctacatnnttgtataatttctgttaaatcattgtataacacacatgcccttagaaggttgtcttgttcactcctaacctttgggagctgctttcacagggtgatgtagatggggatgggcacctagattatggagagtttgtagccatttctgttcatctgagaaagatgggaaatgatgagcatcttcgcaaagcc

SEQ ID NO: 298 - DNA, 504 bp, Glycine max
ctgcagttctcgaatacctagctgccgaggtaacgtgacataacactacatcaattaaattaatttgcttctcttaatgttgattgattacggttaatttttgtgttgcgaaattgaaatgtggatatgtattgtgaaggtgcttgagttggctgggaatgccgcacgtgacaacaagaagaacaggattattccaagacacgtgcttttggcagtgaggaacgatgaagagttggggaaattgcttgctggagtgacaattgcacatggtggcgtgcttccaaacatcaaccctgttttgttgcctaagaagactgagagggcttccaaggaacctaaatctccatccaaggctaccaaatctcctaagaaagcttagattacttttttattttccatatttaatttagtgttgtatatcggtgtttaggtgcttttggtgtaacaggatattttatgtgtttcgaaaacactgtaattcttgtcccaatttgttgcttgtag

SEQ ID NO: 299 - DNA, 703 bp, Glycine max
  misc_feature (408)..(409): n is a, c, g, or t
  misc_feature (598)..(598): n is a, c, g, or t
  misc_feature (667)..(667): n is a, c, g, or t
  misc_feature (688)..(692): n is a, c, g, or t
  misc_feature (694)..(695): n is a, c, g, or t
tttgaacaagagtgaacttcatcctagtcctaccaacttgattattgttctcattaatgggaaagttagaggattgctgtctggaggcattattttggtctcatcggttaatgaaatatatatatacacacacacttgcataccctgtttgtgattttatgtaaatcacacgaaagccttctgctttttcttttgagtgccatgtttctttatgtaacattccaaaagtgtaggactagagagaaagcaatactgtgaaattcgttctgtatatgtctaattcaaaggagatttatccctcccccctcttcattgttattaaattttttttatttatttctgtacacattccaaactgtctgctggattggttttgtaaaattacattcagagttggcttgcagaagnncagtaagaaatgtgtacagaaataaataaaaaaaatttaataacaatgaagaggggggagggataaatctcctttgaattagacatatacagaacgaatttcacagtattgctttctctctagtcctacacttttggaatgttacataaagaaacatggcactcaaaagaaaaagcagaaggctttcgngtgatttacataaaatcacaaacagggtatgcaagtgtgtgtgtatatatatatttcattaaccgatgngaccaaaaaaatgcctccggnnnnnanncctctact

SEQ ID NO: 300 - DNA, 356 bp, Glycine max
ttatatcttttgcgcgcattctcattcaccaatggcgttcaccgtcgccattggcagtggcgtggctataatcccctgcggcaataccaccaccgcaattccttacacccgtggtggtggtcaccgaacgagaagaaagctccatctccatgtggcgcgcgcgaagaagcccctgaacggcgacgacgtttccatttacactgagctcctcaaaaccgaagtttccgttttcgaaaataagcccctcggcgacaacgatgccgctttgaagttcgtagagaagatagaccgtcaatttcaataccccgatttctgggaaggatcccagtgggactggttaggcatcttcgtcaagt

SEQ ID NO: 301 - DNA, 469 bp, Glycine max
gatgcttgcctccacctcggcatcaaaaggcttgtctactgtagcacaaacaatgttgtctttggcggtcaacagatcatcaacgggaatgagacattgccctatttcccaattgatcaccatgtcgatccatatggccgcagtaaatcaattgctgaacagttggttcttaagaacaatgcccgtactctcaagtaagtctcacactcactattgttatgtgatttgattttagaactagtctgtagtaactgtcttcaatttaatgataccctccacatcaaggaacgactccgggaatcgtctttacacttgtgctgttcgtccagctgcaatctatggaccgggtgaagacaggcaccttccaaggatcgtaaccttggcaaagttgggtctccttttgttcagaattggcgaccaaactgtaaagtcagattggctttttgtggataaccttgtccttgcactt

SEQ ID NO: 302 - DNA, 405 bp, Glycine max
  misc_feature (400)..(400): n is a, c, g, or t
tttctcttcgagtatagaggacatcatgaatattgttgaggaggccaaggctccacctccagcatccaggtcaattggaggatttggctggggaggggaggaagaagaagaggatgaaacaaaagaagcagtggctgagactgaagaagatgagtacgaaaagagagtcaaggaagcacaagcaagtggggaatttcatgtcagttaaaaagtgtttatttttagatagagagcaattgattcttggtttcctttgcacttagctaagttcaactaaggtgagtgtgttttgcttgtatgtataaaattaagttttccgcatgggacatatagtttaataaatggctgtacatttttttaaggttgtgcatggtaaggttgtgcatggttgttaaaaaanatgtg

SEQ ID NO: 303 - DNA, 758 bp, Glycine max
ctgcggatctaggttgccctccaagatcccataactttattgtaacatttccttttgttaccttcctcatattgaatcccacctggaatcagataacacagattgatcagaaatcagaatactatggtgcttgataagcagaaaactttgcatagtaactcatggagaaagctataactgaaagaatttggcaaataaaacttactgtaggaatcatgtcctcgctatacccgccagtctagaaacaagatcagggaaacatctttcagtgaatcagtccaataaaaaacaagtcactaagataaagccaatgtcattatcatacttacagcaataacatttacaagtgaagtcttcccagcattctgaagtccaatcagagataattccatttcctgcttgaaaaagaggctgcaatcaaattaacaatgtagtaagctattttgaagatagtaatccacttagcccagaccaaacatccacataaaaagtccacacaaaacaacctaacacttaaaaaagttgtgccgtaaaacgagaagcaggttctgaacctttatagaatatcgttcaaaaaattcagttaacacttattcagaacttcacatcacaggctacatatgcagagaagcagctcctgtcactaatccaatgtttgagaaaactttaactttgcaattaaaaagaattcattttttcaatcattacacaacaattttgtgaatgaattgaatccttaaactaacatcatcccaaac

SEQ ID NO: 304 - DNA, 306 bp, Glycine max
  misc_feature (286)..(300): n is a, c, g, or t
cctgcctcctcaccgcctcccgcccacgctctcccttcccacgcgcctcccctcgccttcctccgcagccgccacgtctcccccctccctctccctaaacgacgtattctcctgcgtttcaaaactcggttacgcgcaactcaccgatcactcagtcccctccgaactcgccaactcggccgagtcggaagcgcttgccctctttgacctttccaaagaacagaagaactctctctttcccaaaaactggcctctcggatacggcggcgacgacgaagacgaagannnnnnnnnnnnnnngttccg

SEQ ID NO: 305 - DNA, 1016 bp, Glycine max
  misc_feature (832)..(832): n is a, c, g, or t
  misc_feature (834)..(834): n is a, c, g, or t
  misc_feature (925)..(926): n is a, c, g, or t
ggctgcatttcatgcagtgatgtgatcaaggacttgaggccatgtgtgagctacttggtgagtggcagtggacagccaccagctgcttgttgctcaggagctaaagctcttgcctctgctgcaacaacctcagaggacaagaaggctgcttgcaactgcatcaaatccacttccaagagtatcaacattaactcacaactggctcaggctcttccggggaactgtggaataacccttcctgtggctatctctcccaatgctgattgttccaagtaacattcatatgcccttatcatcagaaaaacactttctgatacactctttttaactagaaatgataacatagtccagaaatatcgtgttccaactaatttttacatgacacgttataagtgttaattttatatatatataaaattagagcgattgccaacagaaaaacataagcatctcaactatgttggcttccttatggggtttaggccaaagcccatttgggaagctaacaaaacctataattaggaaaaacatttctattaaaaagaaggacataataagtgttaataattcttttccatagattaaaaaacttgaatatatgtgcaagtaaaaattagtcgaaactataaacacatggctgttcaggattatttaatatttttttctttctaacccaatcaatattaatgaaatatattagaatttataaaattatacataaaactcattaaataaggagtgaaatttatattttaatatgatttttattgaattttaactaataataaaaaagtgtgatgaaaagagttttgttaacatttcttggccttananattatgttctttacatattttgcttattttatttgtaattttttatagttgtaactaaccttttaaattaattattcgttttttagtttannccattattttgctacactttttgcagggttggttgaaacttggaattggagggtgttgcagagcatgctgaacatttttctgctacatat

SEQ ID NO: 306 - DNA, 402 bp, Glycine max
gcctcatgatagtgaaaagagaaggcttcgaagtggcttcaattgcttgtcctcaatctcaatgcgtcaaaaacacctttccacatcttcactgtttctacagtcacccataagaggctgcttgtcgtcgtcatggccctcctcggaattgagaaaatccattaaccgttccttgaaagaaagataaccgagctttgagaaggtaggaaatgaatgattgtaagaatcttgtttatgtaagtaggatttggtttcatcacataacctcattttcttttatttttctttccttgtcttttgcagttaaacctgccctgtttttttatttttttattgtggtgactaagaatgatcctttccaagctgtagaagaaactttataaatgagcatcaccaccatct

SEQ ID NO: 307 - DNA, 679 bp, Glycine max
acgtctagaattgatttcattgagtgtagcagcaaccaattccatttccagtttctgattcgtcaaacggacaaaggaagtgaaagggtttagggtgtgacctgagatcaacatgttgcggaggcttctctcttctcacctcaaaaccctagccgccaccgcttcttcttccactccccgatctgcttccgccgccgccagattcgccgctctctctcgctcctcccgctacttctcaacccagtccggtactctctctctctccttttttctcattcgctgtttcctaaatccgccagattaactcatcttatttcttcatcttcttacagaggatgctactgccatcaaaaagaaggttgaggatgtaatgccaatcgctactggtcacgagcgcgaggagcttcaggctgagctcgaggtctctctctctttctcgattcaatcaaatgaatagtgtgtctccttactcttttctgtgtcctatttttagagtaaaaactggcggttttgttaataattagcttgtttacacaaaagaaaataaaataacttacgattaaagtattgaagaaagagctattaatcaaactgctgttttctgtatgcaatgtaagtaaaaccaagcatttcaagggagactctcattgttttcttttttgtgttaactactatctgt

SEQ ID NO: 308 - DNA, 437 bp, Glycine max
cattcgtcaatgacaagtctttccagaatgcattgaattcctcatttgaatatttcatcaacttgaatcctcgttctccagagttcatttcactatttgtagatgataaactccggaaaggtctaaaaggggttagtgaggatgatgtagaagttacccttgacaaggtgatgatgctattccgatacctgcaagaaaaagatgtttttgagaagtactacaaacagcatttggcaaaacggcttttgtctggaaaaactgtttctgatgatgctgagagaagtctcatagtcaagctcaagacagaatgtggttaccaatttacatctaaattagagggaatgtttacagacatgaaaacctctcaggacacaatgcagggcttttatggctgccaccctgaactaagtgacggtcctacgcttactgtccaagtt

SEQ ID NO: 309 - DNA, 728 bp, Glycine max
gcagctgtggtggacgtcggctctaagcttctcaaagcggactttgcaattcctgaccagactcccgccatggtttcctttcattctccctctattattactcttataactttaatctcataatttaattcaatttttcattctaattctcaactcaattatgcttgctactactctgccatgatactcttcttatcttactcttaaatacctttcattacagagataatttccacactcctttaatgcataattctaacccacttagctattctcaagtaaatgtttaaacttcacaaccgcacaatcatgccacctttttagtacctaactatctcagtcagaatccctaattttccctcttttcatatcactcagataattcccactcagatgaagcaattgctcgatgatggatcagtcactgatagttcactggctgacaatgtcaccgttgatcccgtcgtgcgaggatttattagagattgggatgccattgaagatttgttgcaccatgttttgtatactggcctcggatgggaaattggcaatgaaggacaaatactatttactgatccactttgtacccctaaggtttctcaaacttgtctgatttcccttttttgtttaatggaattgccagtaatagcttaatattcgttttccacttttccaggcgaacaaagaacagttggtgcaactaatgttgaaacattcaacatctcagg

SEQ ID NO: 310 - DNA, 438 bp, Glycine max
agacatggaaatgtctgctctccagtttatgattaaagaataccctggaaacgaggaagagaagatgagggcggcgattgggaagtttgggctgtcaggtaaagcgcaggtgatgccaatgaagaacttgtcagatggacagaggagccgagtgatatttgcttggttagcttggagacagcctcagatgcttcttttggatgagccaactaatcatttggatattgagacaattgactcgttggccgaggcattgaatgaatgggacggtggcttggtgcttgtcagccatgattttaggctcataaatcaggtggcgcatgagatatgggtatgtgctaatcaatctgtgaccagatgggagggtgacattatggaattcaaggcgcatctaaagtcgaaggcgggtttatctgactgaaacaatacgagtgtgga

SEQ ID NO: 311 - DNA, 220 bp, Glycine max
tcagaggcggagaagtacaaggccgaggatgaggagcacaagaagaaggtcgacgcaaagaatgctttggagaactatgcctacaacatgaggaacaccattaaggatgagaagattgcatcaaagctttctgatgacgacaagaagaaaatcgaagatgccatcgagagtgctattcagtggttggatggaaaccagctagcggaggctgacgagttcg

SEQ ID NO: 312 - DNA, 658 bp, Glycine max
  misc_feature (448)..(448): n is a, c, g, or t
  misc_feature (465)..(467): n is a, c, g, or t
  misc_feature (470)..(481): n is a, c, g, or t
  misc_feature (506)..(513): n is a, c, g, or t
  misc_feature (525)..(526): n is a, c, g, or t
  misc_feature (528)..(532): n is a, c, g, or t
  misc_feature (536)..(539): n is a, c, g, or t
  misc_feature (542)..(545): n is a, c, g, or t
  misc_feature (547)..(551): n is a, c, g, or t
  misc_feature (555)..(559): n is a, c, g, or t
  misc_feature (576)..(577): n is a, c, g, or t
  misc_feature (580)..(580): n is a, c, g, or t
  misc_feature (582)..(584): n is a, c, g, or t
  misc_feature (586)..(588): n is a, c, g, or t
  misc_feature (590)..(597): n is a, c, g, or t
  misc_feature (599)..(601): n is a, c, g, or t
  misc_feature (603)..(608): n is a, c, g, or t
  misc_feature (613)..(614): n is a, c, g, or t
  misc_feature (623)..(624): n is a, c, g, or t
  misc_feature (628)..(629): n is a, c, g, or t
  misc_feature (631)..(631): n is a, c, g, or t
  misc_feature (633)..(635): n is a, c, g, or t
  misc_feature (637)..(643): n is a, c, g, or t
  misc_feature (645)..(647): n is a, c, g, or t
  misc_feature (649)..(651): n is a, c, g, or t
cctgcactcttgaggagatatataaagggactacaaagaagatgaagatctctagagaaattgcagatgccagtgggtgagtagaagttatttgccttgctatttcttcttctatgtttgaggatcttctagctttcttagtttttgttgttgtgtatgtgatacgatatctaggaagttaattttgtgtatgactgaaaatggttgaactttcaatttggtgccaagaaaaagtatatatgcttccactaaggagaaactaattgatcccaattttcatgactgcaatctgctattttcacttatgttgattgcttggcctgaaaagttacccttgagaactaacgcttgctcattggctgtcctttgtgaatgctcttttagcaattgagtgatttgctttgttttttggtgcatctatttcatcttttgtgggcaatgttccagncttgattgatggcgttnnnttnnnnnnnnnnnntaatgcccaaactgattttttgttnnnnnnnnttgcttttattnntnnnnnaacnnnnttnnnngnnnnnctcnnnnnattatacccaaggccgnntgncnnntnnntnnnnnnnntnnncnnnnnntaaanntttacttanngttnncnannntnnnnnnnannncnnnattaatt

SEQ ID NO: 313 - DNA, 561 bp, Glycine max
  misc_feature (538)..(545): n is a, c, g, or t
atacatagggacttcaagtcgagcaatatcttgctggaaaatgattttacaccaaaagtatcggattttggattggcccgaacagcagctgatgaggggaacagacacatatcaacacgagtgatgggaactttcgggtaatagttctttcttactttcctgtgtctattttggaaagttttatctacaagtcatctcttcacattgttaccctttaagtttttctaatcactccaacataataaatttgtagaggttgatcagttaagttaaactagaaactctatcagtttagtcaaataaagtgatttcttaaccatttgtaaagacatttgcttctgtagtcatttctattaagaatttacaacttgtatactgtctgaaataattttgattgagattatttttgaagagtggaggtatagcaataagtatatgccagtgctgtttctggtaatttattgtgaaactagaatcccacctatatgctgcttctagattatttaataagcaaagtgactaatattaagtagtgccnnnnnnnntgtcatctcaaattaa

SEQ ID NO: 314 - DNA, 1484 bp, Glycine max
  misc_feature (1428)..(1436): n is a, c, g, or t
  misc_feature (1464)..(1465): n is a, c, g, or t
tttgcatttgacatttctcatctaagcttttagatttctgattcttgtttttctccatcttaggttttattgacagttatatttactagatacctggatggagtggcttgtccaatgcaagggtaactctttttggggatgtctatccacttccagaagatcaacaggttgttttgctgattaatttgtttttgtggatcagcaaatgtgcacttgtttgtacctttaattgttcatatagggatacttctgaattagaggtttatttgtgcatggcatgatatctatttgactatttgtactaacaggaatgggctcataagcagtatattgcaaaacatcaacagggtccttctcaacagtggggcaacttctactattttaggatgcagaatataaggttggctcctttccagctatttatatgtagtcaagattgaagactacctaaaatcacatgatcacttagagtcatgtgacttgttaaaaaatcacatgacttgagtttcaacattgatcattcattataagatttaatagtttaatatttgttcctttcattttcacatagaaatgaccctctcctttgatatattgcatacactcttgaacacacacaaacagacgctgccaagttgattgtaatgaacaaataatcttttgagcaaactctattgcacatttttggggcattttacctgggcccagtttatataggtcaatattagtcgaagcacccaatatcctagactttggcaagacaaatagttttccttttttgttgttgaattacgaaacaatcatattttgggtatttggtaaagcatcaagaacatggccatgtctttttgtatccttttgaattttccataaaaaattccttgacaaaaatgtagtgcttgtgaacaatagaatccatgaagaattgggaaattaaaattcatcatattgtttggttctatcattatcaatctgcatagctaatttaatcagttcattattggcagtgacatatatttcattggaggctttggtactgttgcttgggtggatgtaaaggaatatgaaacccttcaacctgataagattgcagttgatggtggtgaacagtatttaaaggtgaattttctgatttcttactctgggagttaaaggaaataatatcttacttgcgcgggcaaaagtaaacaacattattttaaaaacaattttatatgctcgtaaactctcttctcccactttgaagaagaaatttatgggattggtttggatggggcatcctaatttttttggcctagaagttgaagacggatgtataacatgtggcacattcaaggtcttaattggggttgttggttttgtggggttcctagagttatatatcacgtaattgctttgtttttatgtttgaaacaataggaactcaannnnnnnnntcaaaacccctaaagaaacttctatctnntgagactgaggtagatgac

SEQ ID NO: 315 - DNA, 598 bp, Glycine max
aacatcaaaatgatatcgcaaattgctagctcaacggcgactgcacggtagcaaaacccatgaaagttgatacattctctaagcaaccagagtgctagcagttgttgattcgctgcaaaattcacaagtcattaatagcacgaaagggacagtgcacatggataaaaaaaaagttacaaggttggcattcaaattacaaatgcacaaagacttcagcaagcatcatacacatgtgcactcgaaacaaaaaatacataactaccagtgaaaatcaatagaatttcatttagaagatcatcttatgtaacatatccaaataataccacgtatgcattacctattgaataacaacacctctaggaaagtatgtctatcaacatgacaatcttatatattttgaccattttacaacacattcagcaggtaaaaaatagatctaaaacaaatacttactaatgtggtccatctcaaataaatacttaaaacatgcttccgaaacagaatcaaagtatacagaatttaaataacttaataatcctatggaaaaatttattaataatactgtgttgggataggcaggggaaaaatgaaccaaacc

SEQ ID NO: 316 - DNA, 376 bp, Glycine max
ctccctccaattccccaacttctcccaccgcgccaccaccacgcgccgcgcccgcgtcgtcgtcgtctccgccgtcgaggcaccggagaaaatcaccaagctcggcgacgaaatcgcgggactcacgctcgaggaagccaagaacctcgtcgacttcctccaggacaagctcggcgtctccgcggcagcgttcgcccccgtagccgtcgccgcgggtgccgtcggcgccgtggcggacgctccggcggcggtggaggagaagacggagttcgacgtgttgatcgaggaggtgccgagcaacgcgagaatcgcggtgattaaggcggtgagggcgctgactaacctggcgctgaaagaggcgaaggagttgatagaa

SEQ ID NO: 317 - DNA, 364 bp, Glycine max
ggcgcaagagaagaacgttggcacgaggaggggtaaaactttctgcactttcactattgctttagacattttttattggatttcggaaagtggaatccaatggaaagtgcagaagcaagatgtttcgcttgagcccaccattttcttccaaatattttcacgccatgttcaacttaccaaactaactagtaatgaacttccaacatttcctcggtctttgactctcctttctgtgtaccaaacaaagcaataatgatggctctagcctcaaaattttcatgcacacgagtatttaaatgcaactgtttaagacttcaacttgatatcattaagttagaacaatctcctcccagctgttctgctc

SEQ ID NO: 318 - DNA, 1559 bp, Glycine max
  misc_feature (828)..(828): n is a, c, g, or t
atctgattaatacactctgattttttcacataggtgtggttgtgggttagtgcatccgtaaagcttgattttttgttttgatatatctatatcttttgaattgcttacataccattctgtgttggcatcttcagtacacttttcgtcacatgttgccaaatttcaacgagtgctggtgggacagtattattcttgacatcttgatctgcaattggtttggtaagagttttgacccaattttatttgacttttggcaagttgcaaggattgcatgtgatttattagttaaagcatgagcttatttatcgtatcaccatgaccacagattgcatctatagtcattcatttaatctgtaatagcttgtcagcagcatacatactgattttgaaaacatggccagccccttaaatgttgaaagcttgcttgtaggattcttccatctgtgaattttgttgtttcaagtttgaaggtatatgaaaatgtacaatctcggataagaattgctaaattattgtgcacatgaatggtttgactacgttaaagatcaattgtgtttgcgagatttatttttgtaacttagtttttgatgatattcaagcctttaatataaaagtatacttatttattttactacaagttcagtttggttacatctaaattatttttttcatcttagaaaatttttgggtacatcatgtgaactttagtggttcttttagtatcataattcatgattctgctggtatataataaagttttgcattgaatttcttaaaaatcattattagtttgaattatctgatccccctctagaatgctacaagagnctacttgtttgatcattttattaaaaaaaatgtagtgtttttttgtgtttgcactattgctgaaattaatgcccttttggatttgaaattgttacagccaattgtaacatcttttaatttggttaatatgcaggaatatgggcaggaatgcatactgttagatattttgacgggaaaacatacaaatgggttggtctaagccagcagcctaacataataggaaaagtatgtttttaagattttgattgtttttgtcatcagttattccattatgcttgaatccttgattcctattgaagttgatagctctctaacttgaaatctacttttttctttgcctagttgagcagtagtcaattgccaatacttgtgttgacagatgttttcactaaaattgtgttttcttaatgttgtaataataactagtattgtcactaaaaatgattttgactatctgactatgttagttgattcttagtgttagtaattaatttattgattgctaagtggactgaatgtgacttgagtgctctttgctatggttcttcgttatcaggtgaaacgaacattaggccaattcacaccagcacagtgggacaaagacgagtggcatccactgcttggtccttggcgtttcattcaagtgcttagtctttgcattgtatttttgacagtagagctcaacacattctttttgaagttttgtctctggatacctcctcgaaattcag

SEQ ID NO: 319 - DNA, 383 bp, Glycine max
tctctattctgtactgtgatttcgaatgcattttcaatttggattttaataaaaactttatgttttggattccttaatcagtgccctagggttacttattagcaagacccttgtgctatcagtttaccattataggttctcttatagattttagattagttgtaggaatctcaacatttgctgctcatattatgccatatggttcttggtggtgccggtttatccacaattgcttgtcgctaggattttcatggccattgccgttgaagactcgaagtcctaaccaagcttctggagcctttcttttgatagagtcctttgtcttttttcaattgttaatttcatgaaactatgtagatatgggactgaaatggtatttctgc

SEQ ID NO: 320 - DNA, 503 bp, Glycine max
  misc_feature (425)..(428): n is a, c, g, or t
  misc_feature (442)..(451): n is a, c, g, or t
  misc_feature (458)..(462): n is a, c, g, or t
  misc_feature (473)..(474): n is a, c, g, or t
ggcttgacccgattcttgcgtacactgcgggtgcggagattgagcagcttcagtggtcgtcttcgcagcctgattgggtcgctattgctttctccaccaagcttcagattcttagggtttgaaattttattaatgattactcatcacttctgcttctgttccctgtatgtgcatgcgaaaattggggatacttcagatttgaagacacagttgtattgttgtgtcttttattgttgaaaccaatgttaaccttggtaatttctggctttgggacgaaagtagttttgattagggtttagggcgtaaaactagccttagtttgtttctgctaagttagtctgcaagtattttaaagaaattttccgtcacatcaatattggcttcaacaataaaagacacaacaatacaactgtgtgtgtcttcannnntgaagtatccccannnnnnnnnntgcacannnnnggaacagaagnngaagtgatgagtaatcattaataaaattt

SEQ ID NO: 321 - DNA, 396 bp, Glycine max
tacaaagctgattataattaccaacccttctttggtagatacaaaaacttcaaaatacaaggttgtaccactgaagcttcaacctcatgccagccaccatctccctcaccaccaggctatggcagcctaagccctcagcaactttctgcaatgcaatgggtccaaaacaactacttggtctatgactattgccatgatcctggaagagaccatacacttactccagaatgctaaggttttaagctatatttggattgaaattgggaaagtatatttttataaaattctatacacaattgcaaatacagaatgaaaaaggaataatttgttgctttgcaaataaaattacttttgagctttcccaattgaaatccaagcatgcacttaattagtttg

SEQ ID NO: 322 - DNA, 433 bp, Glycine max
cattgtacctgcatctcgcattcctgacagtaatgggccagcctctcaaccaaatggacctcaagtggttgggttgaccaatcaagccacgggactagctccttctctcttagctccaccttcttcaccagcatccttcacacattctgcccttccttccactgcacaatcacctagttgtttcttatccttgtctgctaactcacctggtggtccttcatctacaatgtttgccactggaccatatgctcatgaaacacagctggtgtctcctccagtcttttcaaatttcactactgaaccatctactgctcctctcactcctcctcctgagttggctcatttaacaactccctcttcccctgatgtaccttttgctcattttctttcatcttcagtggatctcaaaaacaatggcaagggtaactacatc

SEQ ID NO: 323 - DNA, 515 bp, Glycine max
  misc_feature (474)..(474): n is a, c, g, or t
  misc_feature (501)..(502): n is a, c, g, or t
  misc_feature (504)..(506): n is a, c, g, or t
ctaatctaacaaacgcaatttaaaaaccgcaacaaactttctctcttgcgttcacacttattctctggcttcttcttccattttcgcttctcgtagcgttttcggaacagttatggcttccattgccggatccaactgcgtcgctctccgaaccgccaacttcggcgcctccggtaaccggaaaatcggccagatccgccaatggtctccgattctcacgaatctccgtcccgtttccggtcttcgtcaccgatcgaatactccgtttagctcctccggtaccgatttcctttttttttcaatttatttttgctctacgttttaattttcaatcgtgtgtgttaagcttttggtgattattttgtacgtgtaagtgtaggtgtgagagcacaggttgctactctggaggaagcaggaaccggagcaactcagaaagtggaagcgccggttgcagtggtgaccggagcttccacnggcattggcaaagcgattgcactgtcnntnnntaaaaaaaa

SEQ ID NO: 324 - DNA, 465 bp, Glycine max
gatgatctctccgtcaacacccttacctaagaggagccgcagagatgtacgaggatggggtgttcgtgaccgttgatttgggcttcttggtcgacgcccacatctgcgtctacgaggatgtctcatcctacggtcgttatttgtgtttcaatcacattatcaacacccacgacgacgccgttcagctcgcccgcaagttgacgcctggtgcctcttcctccttgcagcaaaggttggtcagagggcgtttttggtcattttgacttgtgttcttcgttgaatgttgactcttgacatattcaactcattttctttttttggctttctgcagtgatgactacgggaagagttttatcgaacagagaattaacaacaagaagttgaacaaattgatggtggacttcgaggcttgatttcgatggtgatctttttgaacggtgattagagcaatcaatcaccttcacc

SEQ ID NO: 325 - DNA, 1395 bp, Glycine max
tgcaccccaagagtaacaagaaaaacggattccatgctaagaaaagcaccagattcaacaacctcaacagtgccattaaaaaaggtgctttgatatggatgttcatctatctcgtatataatagtgcccacaaggtcaaaagttcctgcctgcaaaacagaaaaattattaggcataatgagtataatagtccctagtgatgctttcccttgtgatgcgttactcactgagaaactaaaagcgttggcctttagagccatggagatacctgcaagaacttactgactgcaaataaatatgggaaagtagcttgtgctgaggctggtacagaaccattgttaaaaccctgcaattaaaacaaaagcttgcatttaaaatatttatgagcaataccatttgctgaatcagagaataagctgaataatgtgatactgacgtattaaccaaaagttcccaaagtaatttgttcaaggtaattcaatgttcccaaatgaacttgcagaactacttagacggttggcattatctagcctgacaaaatcattggctctcatattttatggggaacatggactctggatgaaataaaaaggaaatgaaaaatatcacaaaacatctattcacccttttagcatacaggagtggcggcgacaactctatgatatgcatacacaaatatgctgaaaaaccattgtcaatacaagggccaaatatagcattccttgtcatatgaatatttatagttctagtattttaaaacctggtctttgaaggggagagtatgaagtggaaaactattaagagtttcttcaaactcttggacccaaacaacatatactttacattttattacccaaactattttcaggaatatttgaaactctctttttagaataaataattagcttattcccagtattgattctaattctatagaatcttcattaatttttatcaagcataactaatccttcaaaataatatgggcagtataattcttaatcacaaataaatagccacgtttaatttcgaaattcagcaacttattacctgtgcagtaagattttgaaccagcatacggtgatcaaaaggaaggtgaacactagccttgatcgcaataacattcaagcttgaatcccctgttttcattccacacaacgaatggaattagccaatctgctaatgcatgaatacctctattttctttttttgtttccactctctccgtatatcaataagaaaattatgtagaagaataatgaaaaatgaagatatgttccagtgtcatacgaaaaatgaaaggcataactactgaatagtgacaaacataacagttaacaaagtcaaaagcatcaaactgcaagctaaaatacaacaatgagtatcaaattgatg

SEQ ID NO: 326 - DNA, 453 bp, Glycine max
gaggggaagaccttcgtggtcaccggtggactgggattcgtgggatctggtctctgcttggagctcatacgtagaggtgccgtagaggtgcgagcctttgacctccgcctctcttctccttggtcgcgtcctctcaaggacaagggagtcctctgcatccaaggttagccagcagcgtcaatttcatttcttgttatttttttagctgttgactgaacaacttcataaacaaactcaaaaggggatgttgcccgcaaagaagacgtggaaagggcccttcgcggtgccgactgtgtattccaccttgcggccttcggaatgtcaggcaaagagatgctccaatttggtcgcgtcgatgaagtcaacattaatggtacttgccatgttatcgacgcttgcctctacctcggcatcaaaaggcttgtctactgtagcacatgcaatgttgtcttt

SEQ ID NO: 327 - DNA, 409 bp, Glycine max
ttgaattgaagaagctaccagcaacgcgagcaaaatctccaaaactgggccggcgaaagagcaacaatggtgcagttaatttatctgaaggggacaaggagaaaggagctggaatcaggagaaagcatcacacacttaagacagacaactatggtgataagagtgatgtaaatggcttatctgacctcaaaaacaagaccaagcatattgaagaaattgatgcgaccgaggtaactggacaagcagacttggagattggcagccagtgcagttttcagtgagattagattctcatttttctaatttatatgtatccggggactgtggacttgtttcttgcaacaagcatcttcactttgtttttccttttaacttatgagcacttgctgctgtgtgcattgtgtaagta

SEQ ID NO: 328 - DNA, 298 bp, Glycine max
gatggaaccatctattcgtttcactctattatgttccatcgcattccacaatccataccattagatagaaaatgaactgatactgtgccacgtttacaacctttggttttggaggcatatttttatacctcgagcactgattttcttggtgcttgcttacgtatataattttgtatagttttaatgtacaaaaatggaccaatactagtagaagaacaatgttctaatgaatatgatgattagtatcttctccagaatgagttactcgtgcattaggtggatggtgtcatgatatttg

SEQ ID NO: 329 - DNA, 774 bp, Glycine max
tggcgaggaacagatgttgccattaaaagaataaagaaaatctgcttcactggtcgatcatctgagcaagagagactggtaagttataatttaatttctcttggatggcacactatctctttttattataaattatttcctacctttttattctttcttattttccttccaactaaatttacttgaaagtgcttcaatcaattattgatagactttgaggcatgtgagacgatatttgtttcatttctcagactgtagaattctggcgggaagcagaaattctttccaagcttcatcatccaaatgtggtggcattttatggtgtagtgcaggatggaccaggaggaacgatggctactgttgcagagtacatggtggatggttctcttaggcatgtattacttcgcaaggataggtaatgcaactagaaaaagttttttgcatttttattatttagttttattaatcaattacctaaaatattggcatgttttgttcataccattgtatttaaaaactaaccagtaaagggctggtttactgctgcctcttatttgaagtgaaattcatgtttttataaccataacaactcctgtctcgtatgaaatacatgatgatatatacacttgtgtgtgtttggtgatgatgaatttcttttttttactgaaggatctggattccattgcaggtatcttgatcgtcgcaagagactgataattgcaatggatgcagcttttggaatggaatatttgcactcaaaaaatattgtacact

SEQ ID NO: 330 - DNA, 257 bp, Glycine max
ttactccaatattactaaaaaaaacacgacatacaaatgaccaatattactccatatccactttgttcatctctagcattaaaagacctgaaaatactaatccgaataactaactagatgcacgaacgagaggtagaaaaaaaatgttaatcaagcagcaactccttcctcatggagtagcatctgatcaaagtgccacacacctgaaagttggggccataaaagaaaacaaagggtttagattccttttttttttt

SEQ ID NO: 331 - DNA, 385 bp, Glycine max
  misc_feature (362)..(369): n is a, c, g, or t
  misc_feature (376)..(379): n is a, c, g, or t
ccgtaaaggaaccgtccacccctctccctcgccgtctccgccaaccatctccgaccacctctccttcctccccgccgccatcctcaccctcactctttccctctcttcggaggacagagaagtccttgcatacctcatctcatgctcatccaacaacaacttttccggcaaccctcgccggaaacctaaggttgtcgcggacggcgatcaccctcctctcttcaactgcagttgcttccggtgctacatgagctactgggtccgctggaactcctctcccaaccaccaactcatacacgaaatcatcgacgccttcgaagactctctcacccacaccgcaaagccttctagaaaggacaagnnnnnnnngagggannnnaagagg

SEQ ID NO: 332 - DNA, 582 bp, Glycine max
  misc_feature (212)..(224): n is a, c, g, or t
  misc_feature (237)..(252): n is a, c, g, or t
  misc_feature (258)..(262): n is a, c, g, or t
  misc_feature (271)..(277): n is a, c, g, or t
  misc_feature (283)..(288): n is a, c, g, or t
  misc_feature (291)..(291): n is a, c, g, or t
  misc_feature (293)..(293): n is a, c, g, or t
  misc_feature (295)..(318): n is a, c, g, or t
  misc_feature (326)..(328): n is a, c, g, or t
  misc_feature (335)..(339): n is a, c, g, or t
  misc_feature (346)..(359): n is a, c, g, or t
  misc_feature (366)..(367): n is a, c, g, or t
  misc_feature (374)..(381): n is a, c, g, or t
  misc_feature (385)..(407): n is a, c, g, or t
  misc_feature (412)..(412): n is a, c, g, or t
  misc_feature (419)..(440): n is a, c, g, or t
  misc_feature (445)..(455): n is a, c, g, or t
  misc_feature (457)..(457): n is a, c, g, or t
  misc_feature (459)..(463): n is a, c, g, or t
  misc_feature (481)..(489): n is a, c, g, or t
  misc_feature (497)..(505): n is a, c, g, or t
  misc_feature (507)..(529): n is a, c, g, or t
  misc_feature (534)..(543): n is a, c, g, or t
  misc_feature (552)..(554): n is a, c, g, or t
  misc_feature (558)..(577): n is a, c, g, or t
ctgcgttgccaataatagtttgtgttactctgctaagaaggctcctccaccgcagaggattgttggtggccgtagagtgattgttgctgcgagccctcccaccgaagacgctgtagttgccactgaccctctcacgaagcaggatctcgtcgattatcttgcctccggttgcaagcccaaggataaatggaggttccgtttttttttttttnnnnnnnnnnnnnttttttttttttnnnnnnnnnnnnnnnntttttnnnnnggttttttnnnnnnngttttnnnnnnttnanannnnnnnnnnnnnnnnnnnnnnnntttttttnnnggggggnnnnnaaaaaannnnnnnnnnnnnnaaaattnngtttttnnnnnnnnaatnnnnnnnnnnnnnnnnnnnnnnnaaaanaaaaaannnnnnnnnnnnnnnnnnnnnnggttnnnnnnnnnnnanannnnngaaggggaaaaatttttnnnnnnnnnaagggaannnnnnnnntnnnnnnnnnnnnnnnnnnnnnnnttttnnnnnnnnnnatttttttnnnaaannnnnnnnnnnnnnnnnnnncgggg

SEQ ID NO: 333 - DNA, 448 bp, Glycine max
tcctcaaaccaacaacaacaggcaacagctgtgaatgaatcactcatcactctgtctcactcttattatgtgtcactctctcccacacttttccatttcactctcacctttcccatgatctcaagtctccaccaccccaacactgaattctgcaatttccctcaaccatttccaattccctcttctgggcaccgttaaatttcccatcttgccaccgatatctcatctgggtcattccatggcgcacgcgaagaccgattccgacgtcacgagcatggacacgtcatcgtcgccaaaacgcgccgtttactacgtgcagagcccctcgcgcgactctcacgacggcgacaagtcgtcgacggcgacgcacgcgacgccggcgtgcaacagccccgtggactcgccctcgcaccattcctacgggcaccactctagggcttcttcttcg

SEQ ID NO: 334 - DNA, 603 bp, Glycine max
  misc_feature (504)..(506): n is a, c, g, or t
tcctgtcaactgtaaagtagaaaagagctcacctgtcgggccttctccaattcttgtatgaatctgtccttgtaaactctgaatgcctgattttgatgctagcatgatgactatgatatactagtcatagcttaacaattagaaatttatatttaagtattacaactaatgtttcatttctattaatatttgcgcaagcatgttggatcaacttgttatttttctaatttcttctactggtatcttaattccactatgccatacccttgcataccgtggaggacttaacatcttttggatatctttattatttgatgtctgtatttctttgtgaaattatttggtttaattaatttttttgaagtcactttattagtcatgaattatgtactgcatcttaatacttgttcacaactcattgattggttttgccattttcaacgaagaatggagtcgataccacaggtcaaaatgcggagaaacctagaactgtagaatgatggnnntagatagagctaaaccatggcagctgtctgaaattgtggatgctgtccaatgtcggttagttaccatgcctgacagtacagattcttccagcaaggt

SEQ ID NO: 335 - DNA, 1005 bp, Glycine max
  misc_feature (748)..(750): n is a, c, g, or t
  misc_feature (986)..(987): n is a, c, g, or t
  misc_feature (997)..(997): n is a, c, g, or t
agacgaagtatgttaattcttgactctccagttgatatacttcacattcagatatttgtttgtgtcacaaaataaaattctcttaattatcacagtgagagctaactttgagttcataagcaaactcggtgttgacttttggtgtttccacgacagggatatagcccctgatggaaaaactcttgaggtgagtcaatatttaagtttcttcacttaattgcaattcttagacaggatcaaagtgcgagatgcagtggcatatgcttaccttttttttatatctggaatattcagttatgatcatagtcggtggaatgtactttcttgattaatactctgctgctacatttttaaatctgctttctgagctataggattgcacttgttgtctttatcacaggaatctaatgcaaacttggatgaagtggttgcccttgctcaagagctccagactaaggtaattttacatgaacgtttgatgtacagtcttctttttcttttcccctttgtctagttcatgaagtatttttgtgatttaaattccagtgttcctgtttatacaatattctgcctgaacactgttctaaatttatgtattttatgtcttgaggtaaacaaccataatacatgtaataattttgttatgttaccatataggctaaaaaaagagtgttatggggaacagctcagttgttcatgcatcctcgttacatgcatggtgctgctactaggtaacatatatacaatnnncgcccaaattgtctatatgatgattatgcatgttgggttcatggctcacaaaatgaactgttttacagctctgaattaaaggtctatgcatatgctgctgctcaagtgaagaaagccatagaggtactgttgtgtatgcatgtagtagtaagaaggttcattgtatttttaaaaccattgttcttttgctgatttgcataaagggcaggtgacacattatttggggggagaaaatnnatgttttcgnggggtggt

SEQ ID NO: 336 - DNA, 320 bp, Glycine max
ggtccaattccgggcgttaaatatgatgagaggagacaacgaaagatatggtttaacagcatggtggctgcttacactggttgggaagatgaacgcaacgatcctgttaaggctgtgacctttggggatggtctaccattaccctttcacattgtctatgattgtctccacattctggaggacgaatctgttgccattccttggcaaaaaggagacattctcttaattgataattgggctgtcctccattcccgaagatcttttgatccacctcgcagggtcctagcttcccttgtcaagtgagccttgtaccaatttca

SEQ ID NO: 337 - DNA, 462 bp, Glycine max
  misc_feature (426)..(430): n is a, c, g, or t
tgtcaacgcgcagcaacaagaatcaaaatccaagggcgagctttaaaccatttcagttaagctttctaaccccccaacctactcctttgtagttacaatttcattttagcgttttttttctactcaaaattagaattagaattacaacctcggtaaaatagaattactgggtatgtgtgtgctacttgcaactttgagaactcttgtgatttttcttcccataaggtatttgtgaaaatgctgtaatgaggaaaattgttggatagggttttgtttgtatttctgttgttgcttgttaaatattgtatgagtagagtatgactctgtgttttcacttacatggatggcttaggaatggtggaactttgttggaagagtggtttttaataattgatttaggtaacataggtttggggtgggttatgnnnnnggtctagccaaggggaaaggaagaaatccgga

SEQ ID NO: 338 - DNA, 555 bp, Glycine max
  misc_feature (33)..(34): n is a, c, g, or t
  misc_feature (412)..(413): n is a, c, g, or t
  misc_feature (442)..(446): n is a, c, g, or t
  misc_feature (448)..(448): n is a, c, g, or t
  misc_feature (455)..(456): n is a, c, g, or t
  misc_feature (459)..(462): n is a, c, g, or t
  misc_feature (476)..(481): n is a, c, g, or t
  misc_feature (483)..(485): n is a, c, g, or t
  misc_feature (487)..(487): n is a, c, g, or t
  misc_feature (497)..(505): n is a, c, g, or t
  misc_feature (510)..(510): n is a, c, g, or t
  misc_feature (520)..(527): n is a, c, g, or t
  misc_feature (530)..(533): n is a, c, g, or t
  misc_feature (535)..(545): n is a, c, g, or t
  misc_feature (548)..(549): n is a, c, g, or t
  misc_feature (552)..(552): n is a, c, g, or t
tttctccagtctagtttcatgttttcattcctnngtgcctaaaaaaggatggaaaaaggaaagaaaagttacatgcgtgtttcaatctctcatccgtatatggatttaatttgtgatttcataatttacaccaagcatttggcatatttaccaagtagggcactattaaggcttccattttccacatactcatagactaatgtacggctaggtccttgaatgcagaatccaatcaattcaacaaggtttgaatgttcaacatttgacaaagttttaatttcagtcaaaaattcgcgaactccctgctttgaccaaactgagagagtcttcactgctatatgccttccatctcttaatgttccctagcaaaattgtcacatgagtatttagaatggctcaacgtcaataagannataaaatgataaaatatgatgcaatttcnnnnnancttgatnnctnnnngcatatacagtgtnnnnnngnnntntttatgttgnnnnnnnnncacantgtagcattnnnnnnnnacnnnncnnnnnnnnnnnttnnctngcc

SEQ ID NO: 339 - DNA, 577 bp, Glycine max
  misc_feature (58)..(59): n is a, c, g, or t
  misc_feature (62)..(64): n is a, c, g, or t
  misc_feature (513)..(515): n is a, c, g, or t
tttaacgctgaatgtggagatggtcaggttagtatgataaaagttagagccatccaannttnnntgtgtaaaattctaatataatctatcctctgatcaattgcagcttgatttgaatttggaacgacttagaatggctgttgatgacttacttatcaagcttgctaagaacttcccaaaaccaaaatcacaaacagtgtttcttataaacaattatgatatgacaattactgttctgaaggtaggaatctgtaaaataacttagttttaatgtatagctatatctgcatcaatcaatggaaaggtcaagggtgtgcaatgtggttttcataaccagatgggttgttctctgacttttgacaactaaagttttcccacttgcttgattccaggaagcaggtcctgaaggtgggaaaattcaaatgcactttgaggaactgctgaagagcaatacaacaatctttgtggtaattgcaatcaatttcttgtatatatagtttcaacacaatgatnnntttttgttttgatagtttcaggaagaagtgagtgcatcaatttttctgttgctatatgttct

SEQ ID NO: 340 - DNA, 672 bp, Glycine max
agctatcgatggaaattgttgcaccctttctgaaacttgcgaattcttctccaatgtcgcttcttgcgcccactcccgcaaacacaccacaagtccccaatctttctgaagtggctttggtgtctccaccttctagtgtggttgaagaacaattgatctctcgggttagtaatcttggttataatcgtatttttggtcttgttttcttgttgcccatttttgctttcaagaaaattaatattgttttttatcatgaaattaatattttatgtttggtatgaggaaagagagtagatagatagatagataagaaaaggattgatttttattttttgtttaggatatgtttaggatattttttgtttttaaaaataaaacaaactcaattttttctttagttttattttctttatgctaaatagagtgtaaatcttgattactaaaggaaaaagcatcaaattaaatgttttctatattcatatgggtggtaaaggaaaaagcatcaaattaaacgttttctatatttcaaagatattaaaggtgttaatttcatatgggtaggtattgtttgaatgctaagagtaaagggctttttgctgcttctttttttatggcaggtggtgaatgaaatatttgaagggaagaagaacgagaatgctgaatgtgagaaga

SEQ ID NO: 341 - DNA, 366 bp, Glycine max
cataaaacctgcaaccctcaacttcctgacaccactcgcagtccctgagattcggcggcggctagcgtcggtggcggcggcggcggacgaggaccctccgcaatcgccgtcgtcgttcactttctcgtcggagggggagaaggtgtacgtgaagccgccggcggggaagtggaagccgtcgccgtcgtcgacggtgacgatgccgatgtcgttcatgacggggtccatcgtggggaagcgcttctacaaggaggtgaagactcgcgaagccgatgacgggaacggctggacggttatgctcgattaccgaaccctaaagactccttccaagagacccctcaagcttccctctcttcctcttgctaa

SEQ ID NO: 342 - DNA, 390 bp, Glycine max
tgcttgcttggcataattatggggtatctcatgaagaagacctaagcatttctgcgattcaatctttcaccatagttttcgatcttagtttctttgttcctaccattcaagcaatcatgaggaaagttaaaatagatcaattcagcagatgttggtttttcttttttatttttgccgtttcttttcttttctttgggtggataacattttggaggtagaaaacattaggggaagttgtgggtctgtggttaagcatattgtgaactgactcatgctttcgttaactgcattctttttgtaacttaaagaggggaagcttcttgttttcttctttttgtggttcgtctagtgactacatggtaatgtcaagttgtcaaggacgaccacgaa

SEQ ID NO: 343 - DNA, 394 bp, Glycine max
tatgggtcaagccgcatccatgggttctctccttttggctgcaggtgccaagggggagaggcggtctcttccaaatgcaacaatcatgattcaccagccttctggcggttatagtggccaggcaaaggatattgcaattcacaccaagcacatagttcgggtttgggattctttgaatgagttgtatgccaagcatacgggccagtcggttgaggttattcagacaaatatggacagggataactttatgactccaaaggaggccaaagagtttgggctcattgatgaggtcattgatcagagacctatggctttggtttctgacgctgttggtaacgaaggaaaagataaaggttccaattagaaccagatggagggtaagatttctttgagg

SEQ ID NO: 344 - DNA, 371 bp, Glycine max
  misc_feature (18)..(18): n is a, c, g, or t
gctcacagcgcagtccanacgacgcttggatctgtcgtcttgccggaggagcttcgctgtgtcatggaccacctcgaaatcgaccgcgacggcctcatcaacctcttgccaccgtgagtgtttgtgaagttctagatctcatgggttgcttggcgttgttgtttgggtggaggtgcgcacaacaatgcggtgttctcatccaaggcatttttctgttactggagaagcaacaatgtttgaaagggataacttttaatataccataatgaaataaaattaaaatttaatggccaaaaaatgatattaaccaaaagaaagaaagagccataaaatactttgattaaataaaaccgtgaagagctagtattgga

SEQ ID NO: 345 - DNA, 392 bp, Glycine max
ctgtgaaggttttgacaatgtctaaggcaggtattgcagacttggttccaagttggttttggaattggactttgcaaattgaattcctggatctgtcaaacaatctgttaagtggagacctatctaacatctttctaaattccagcgtcataaatttgagttctaatttgttcaagggtagattgccaagtgtgtctgcaaatgttgaagtgctgaatgttgccaataactcaatttccggaacaatttctccctttttatgtggaaagccaaatgctactaataagttaagtgtgcttgatttttcaaataatgtcttgtctggtgatcttggtcactgttgggtgcattggcaagctttggtgcatgtgaacttgggcagtaacaatttg

SEQ ID NO: 346 - DNA, 374 bp, Glycine max
gcgcgacctctccccactcgcgaacgagacgcgcgtggttctggaaaccatgatgaagaacatgtactcgctgagccgcgtcgtggcggcgctgggcctgctccagctcactctgggcgcgtggataacctacctcaccaaatccgaacccatcgctgaggtttcgctgcagagtttgttggcgttcgcgtttccgttctcgcttgcgttcatgctgcggcgcgcgctgaagccgatgcattttttcaagaagatggaggagctagggaggttgcagatcctcacgcttgcactccaggtcgcgaagcagttgaacgtgctctttgttagggttcgtgcggtttcggtgcttagtgttgttggtgttgttgttg

SEQ ID NO: 347 - DNA, 381 bp, Glycine max
gcaccgtgtcgctcttgtgggtggaaaccataccgcagccaggttttgcagtcgctgaaattctcccctccctagatcgctggctttgtttgttttcttttctctcttccaactttactcaattaccattaattctcgatctcggtgtttctcaaaaggatctcatcttatcgatggaatttagcacgatgaagaagaagaagaagaagcatttgcacgatggaagaacaattgctctcaaccccgaaactgaaactttcctcgttatcaggattcccgatgcgcttgttttgcgcattgtgtctcgctcgttgatcgtggccatggttctcgcagccttgcctttcttgggaactgttctcgaaggattctatttctcgt

SEQ ID NO: 348 - DNA, 332 bp, Glycine max
agcaatgtccaagccagtagaaaacttctggcacccacaatgcccaatatgggaaattatcctcctcgcgtgatatatcctccattccccccagtaacagactggccagagtataggttgccatcacccttaattcgcacacttccacccttctcaccacctcccaaccctaccaatccttgagtagtagcattatttgctacactccacagtagattaatgtagcgtaatcaatgttgctatatatgtgcagtcaaataaaggttcatcacgaacaagctttcaattcccatcatgtttatttactttgtttgctatgctttgattgagtg

SEQ ID NO: 349 - DNA, 332 bp, Glycine max
  misc_feature (16)..(16): n is a, c, g, or t
tgcatcctacagaaanttcaacgccaatgcttgtgtttggaactctggaaaatcctcatgcaaatcaaattcttcaccttcctctgcatctcccactaatgcatggttatcacaagagcttgattccactgctcagcagaggttgcgttgggtgcagaagaactacttgatttacaattactgcaccgacaacaagagatttcctcaaggccttccactcgaatgcaaacactcctagagcctataggactcacatctcgcactacccataacaagtgttgcaatataatcttatgaaccattcttttaatttttgtattcctttttttttg

SEQ ID NO: 350 - DNA, 489 bp, Glycine max
ttgtcgagcttcccaaagggggggttataaccatgcatgttgtggtgcagccatctttgctcaaaacaaaaacaggtagatttcattctggaatgtaccttataattattttctgtcatcttatatgtgtctcaaagggcagctctttgtaggtgttaggtactaggtaatgatagaaagttaactaactaggatcaaggatcaagtattatgactgaatgctaaaaattttcttttgctggtctgaacagagaaaaaagttgatgaggcgcccagaaaacataaatgtgcatgttcgatattgtgagaatccatcatcatcatcatcatcatcatgaagagttaagctgctgatcttgccttgctgggatatccgaaggtcatggatatgcctagctgggaagacaataatttgtaaaacagtcccaaccccatcatagttgagtgttgttggagggccttcctgtgtagcaatgcttgtcattgatg

SEQ ID NO: 351 - DNA, 778 bp, Glycine max
atattgatgaaggtaacataacaatgtttgattaatttttaagaatatggttgttgaattaagatacctatgatataatgataaaatacaagaaaaatctgcttacattgcttgattttgactgaatatgtttgtgaacagtactctcaggcattcaaaatgtaagaatctatacctacaaagaactaaaagttgcctctgacaatttcagtccggccaataaaattgggcagggtggatttggttcagtttataaggtaactaaataacttttaagtatttctttctggcatcattgtatcaattggcttgatcattatctttttcttcctttccttatcagtgaaaccttaacaatattatggtggatgatcagggactgctaaaagatgggaaagtagctgccataaaagtactttcagcagaatcaagtcaaggggtaaaggaatttatgacagagattaatgtaatctcagaaatagagcatgaaaatttggttaagctatatggttgttgtgtggaagggaatcagcgaatcttggtctacaattatgttgagaacaatagccttgcacaaacccttctaggtaaatgcattataattttgtgagttaatttttctgggaaaatttgagaagacatctattgtatcatttagaaaatatggagttgttatattaatttaatttccttaccgttattctttttgaataagttattttctcttcacttgcaggttcaggtcacagtaatatcgtttttgattggaaaacacgat

SEQ ID NO: 352 - DNA, 383 bp, Glycine max
atttctgaatgatgatcaaatcaaagaagtggccagtggcttagaactcagtggcttacctttcattttggttctgaatttcccatccaatctctctgccaaagctgagttagagagagcattaccaaaagggtttttggaaagagtgaagaataggggagtggtgcacactggttggtttcagcagcagcttgtactgaaacactctagcgtgggatgccatttaggccatggtggcttcaattctgtgattgaagctctggccagtgattgtgaactggtgctgttgcctttcaaggctgaccagtttttcaatgctaagctcatagccaaggctttggaggcagggatagaggtgaataggagtgaagatgggaccccca

SEQ ID NO: 353 - DNA, 360 bp, Glycine max
gtatctcaatcaatcaacaaaagctcactttcataaagacacgcacacatattcttgttacacaaaatggaccaacaagagggtaacacgtggacaatgccaccgttctgggcggttgagcagcgaaaccgccgccgtcttcgccgctcttactctctgttgctcacctccacctccctcctcgtactcttcctcgtactcgtgctggtgttctcgctcatcgtggttccgacgttgcactcgttcgcttccaacatcttcaaacctcgtacagttaagaacagctgggactccctcaacctcgtactcgttctcttcgccattttttgcggcttcctcagcagaaacaacaacacctcc

SEQ ID NO: 354 - DNA, 438 bp, Glycine max
aaagagaagagtagtgggagccgaggaaggttggagaaaagcaagtggggtcccgcatcaaccaaaaggttatcatctatctcatttccacaacacctacgcgccaacatatttcaacttcattcccttattttcactcttttctcactcactgtccaatccaatgtgtgactatcaaactccccttttcccatgaaaccctcttccaccaccgtcacatacccctaccaccatggccacactccacaacaaccaaccaattccccgtccagcgccgccgtttccatccaatccgcctaccgcgcccaccgcatccgcgtcctctaccggaaaatcgccgccgtcgatgccgaagccgatcggctgcagcgcctgatccagcggcaggacacggtggacgccgtgcgcgccaaccacctcgagaaactgcgaatgaac

SEQ ID NO: 355 - DNA, 717 bp, Glycine max
  misc_feature (689)..(691): n is a, c, g, or t
  misc_feature (698)..(705): n is a, c, g, or t
gccttgctccgctctctccgccgccgcgaccttccctcgtcttctctctccgcctttcgttcggtaccgtcatcgccctctctttcgcatctccattttcactcgattaacctcacttcttattttctgagatgtttgctgagttatgtgacgaatatagcgaatcgctttgtgtcttgtgtttagaaactgtaactttttatttaaatgattgatttttaagatctgagacgaggctctatgtcccgtgattgtgcgactttgctgcgaaggtgaaatcttatgtgaaataagaaataaaattttaacccgtcaataatattactagatcttagaatttaacagttttagaaaggttctgagaaccgcactttatataagattgagagatacttgttaactttgaatgttactgattattgggtcatgtattggcttgaagttttgctagattatctgcgttttctgtgcttctgacttcattgtaacttgtatacaagtacgaatgctgtttttgatgtacgtaatctatttttttttagaactgctcatctattcgggacctagtaagtatatgaacaattgttgatatcatggcatcatttgtggaataatgattgttgaacttggttgatcatgtcagcattgttctgaaggtaatcttaattttctttcacattgttgtgcannngacgagnnnnnnnnagacatcatatg

SEQ ID NO: 356 - DNA, 370 bp, Glycine max
  misc_feature (309)..(309): n is a, c, g, or t
  misc_feature (316)..(321): n is a, c, g, or t
  misc_feature (331)..(333): n is a, c, g, or t
  misc_feature (337)..(340): n is a, c, g, or t
  misc_feature (342)..(342): n is a, c, g, or t
  misc_feature (350)..(352): n is a, c, g, or t
  misc_feature (355)..(358): n is a, c, g, or t
  misc_feature (360)..(360): n is a, c, g, or t
  misc_feature (362)..(364): n is a, c, g, or t
  misc_feature (366)..(366): n is a, c, g, or t
cagttaattactagtttttgaatacctcagacatgtaccagaagcccgcaggaacaagaccattgtgaattaaattggactctgatttgttcatagatattctatggtggtttcttttaagtttttttttttttaaaaaaaatttgttatttatgtttcacaatttgatgttaacaaaggaaaaaaaaagggggtggggaccttttgcgaacccaaacttaattggggtaattttaattttttttgcaaggggttaaaggcccaagaaggctaaatttaggtgaatggacgggtggggaattaaaaaanaaaaaannnnnngggggcaagnnnatgnnnncngggtttgnnnaannnntncnnnangggg

SEQ ID NO: 357 - DNA, 714 bp, Glycine max
  misc_feature (673)..(675): n is a, c, g, or t
  misc_feature (687)..(687): n is a, c, g, or t
  misc_feature (690)..(693): n is a, c, g, or t
  misc_feature (695)..(702): n is a, c, g, or t
atttgctcttgattcggctatcgaagagcttgttcacctcggcatgcaaaggtattgaatcgctacaagtttcattcgtagtttttatttacttttgaatcgttaggagtttcattcattgatttcatataaagtttaattttatttgtttgaattgaaaggaagaaatgcaagaataagttcttctccgttttaattgtttcatttcataacattttgaattaatcgattcgttttctcttttttagggtttgataaaagttgagaaaataggcgtggaactttactttgttagttacactagaagattcacagctacaattataaagaagacgaaagaaattaaagaatgaaagttgtattgttttgatgtgtttctgagctggatttctttttctttgctaaagagatttatgagattttaacttatttgatgtgagaagtgttgagatggggcatgaaagttccatgactgctgttgttgcgattggttttggttgttttctttactatgtgttgtttttgtgattgaagagaaatggcggcggagtctatttacaaagagagatgtgtttcggtgaatgatggtccaagttgggccaaatacatgttgatctctggttctcctgatgatgaatatgatatcatcactttgcaatatactgaggagggnnnattatctgtagntgnnnntnnnnnnnntcgtgctgcagc

SEQ ID NO: 358 - DNA, 332 bp, Glycine max
tatggaaaattgaaggaagccggaaagccaagaaaaatttgccctcagagcacaagtttttgcagaatgcatccaaaggaagtgatggtgataagggcactggacaagaaggggaaacacccgttgctgtataagttaggggagaatgattgtactgcttctatactcaatagatctgtttattttaatttgttaatcacctcatcctgaagataaaaagggtttttctcacttagacacagaagatcatattctacgtagcatccatactgtatattaattatcttaaatttctttatatgcttcaagtgttagatgcaaacttaatgaat

SEQ ID NO: 359 - DNA, 388 bp, Glycine max
  misc_feature (261)..(264): n is a, c, g, or t
  misc_feature (270)..(279): n is a, c, g, or t
  misc_feature (283)..(289): n is a, c, g, or t
  misc_feature (302)..(302): n is a, c, g, or t
  misc_feature (304)..(305): n is a, c, g, or t
  misc_feature (313)..(324): n is a, c, g, or t
  misc_feature (331)..(334): n is a, c, g, or t
  misc_feature (344)..(353): n is a, c, g, or t
  misc_feature (355)..(369): n is a, c, g, or t
  misc_feature (377)..(383): n is a, c, g, or t
ggtgatacttttaccccatcatatgcgcaggatttcaaaccagcatacatggagggatttgaacaggctgagctggggaaccatcctgccaaagaacaggcagggtcacaacaaaggtatccaccttctggcccaggctttactggagaggtatggtagagacctaaaaatctagaaatattcgagtttctgattctggatcaaattagtcataatagagataaaaacggatgcttctctcttttcttctttttttttttnnnntaaaannnnnnnnnntttnnnnnnngggggaaattggnanngggggggnnnnnnnnnnnnttttttnnnntggggaaaannnnnnnnnntnnnnnnnnnnnnnnngaaaaaannnnnnnttttt

SEQ ID NO: 360 - DNA, 299 bp, Glycine max
agtacatatttgggtttgtggaactggcagtgataaaatgtgcgattgagcttggcatagctgaagccatagagaagcatggaagtcccatgacactatcggagatatcatcaagtttagggtgtgatacttcacatctgaagcgcatcatgaggttcctggtgcaaagaaagatattcaaaggcgacgggtgcagcaggggctattctcaatcagctctgtctcgtcgattgatgagaaacggcgaacacagcatggctagttttctcttgctggagagtagtcctgtaatgctggca

SEQ ID NO: 361 - DNA, 404 bp, Glycine max
gttccttcaaatgggtaataacattcctaagagttaagacaataatttgttttaaagctataacaaaagaatgaacaaataaaagaatctctcgtagtgcctaacaactaaacatagatgaaaacattgagtcgtagttttacacgagcgtggaacaagatgaggttttaggatcaacaagagctggcaacagatacttccttccgttgaccccattcgcgttgtaactggcaccggtggtggggtccaccaagagattccctgcatagccaggatacgcgcccttaccataaaccccagtgcaagccgaaccagcttccaaaggagcttctttgggtccttgaaagtagccatttccaaaagggttagtgacagtcccagcaagaagactagccacgttgata

SEQ ID NO: 362 - DNA, 401 bp, Glycine max
tagtcgtaggatttggatttggagggtgggccagcatggtgaacttcatacgccagattgacacatttggactcttcacaaagtgttaccaatgccctccaccgcttctaccacctatgccgccgcatcagctcaacgccaccgcgccttcgccacttcaccaccctcatcatgcacactaaggattgcactctttaaagttcaaattgagacccatctatgaagccgcaccctaggctctttggtgaaattattaacggtgcaatacatgtcattgttacgttgagaatgataaatttgtaatgtattggccgtgtcataattaaacatataatgtattcttcaattatctttctctttatagccttaaggtagttttgagcactttgtcatggtcaatt

SEQ ID NO: 363 - DNA, 385 bp, Glycine max
accaaggaaactaggggtggagaaggccacaaagaagaatcattctatttaaagtcagcctatcagtcaggttagttgatgcctggtcctcaaaggttcaaaacattcctttgggggtagctgatgggtgtctccttacaaattctcagcgtttaaagggaggcatagctgaggtgtatacccgtcgaaggtttatgaagagcttgagatgtattgcctcaggactgtgataaggttgcggagttttgatactctgctcaaagataatcaaactcagtagtttttcagagttggcctggatttgcgatttagatgtaataggagaacatgggatccatcgctctccaattggctattttattttttgtagccacttggtttctgt

SEQ ID NO: 364 - DNA, 645 bp, Glycine max
  misc_feature (438)..(438): n is a, c, g, or t
  misc_feature (443)..(451): n is a, c, g, or t
  misc_feature (453)..(453): n is a, c, g, or t
  misc_feature (458)..(458): n is a, c, g, or t
taatcaccttgctatgctcattgctgtttttccatcactcaacagcaacaagcaaacaattatgatgtccagttgacatccaaggttgtttcgagaccaaacatgaaatatgagaagacagatcagaaaacatacggaacaatttcttcaaaagtacgccttcccttcaacttctatttttactcgaattttaacgtgaccacacatttgtagtcaatacgtatccattgattcacatgatatattaaattttatggatgacaaggacttgtcatcaatgcaattgttgtactccttagaatgtctttatagcaaataagagattcaatgatataacacacgggtagagtgcctggtacggttaggctggaagtgcacaagcccgtgaaaagtactcttcctagtcttttatacaaggacatgctcaagtagatgcanagcannnnnnnnnanatagnaaatatatacatatttctggccactgtatctaaataaaattattagagagaaggattctgttctagttatctatatgattcgagtactgcttatgcttgttaacacaatctcatcaagcaaaactaaaagagaagtctgcatttacaaaatccagaaaatatcttacttgaatgacttttagaagca

SEQ ID NO: 365 - DNA, 1414 bp, Glycine max
  misc_feature (22)..(22): n is a, c, g, or t
  misc_feature (315)..(315): n is a, c, g, or t
  misc_feature (317)..(319): n is a, c, g, or t
  misc_feature (323)..(323): n is a, c, g, or t
  misc_feature (325)..(326): n is a, c, g, or t
  misc_feature (352)..(354): n is a, c, g, or t
  misc_feature (356)..(363): n is a, c, g, or t
  misc_feature (384)..(387): n is a, c, g, or t
  misc_feature (395)..(396): n is a, c, g, or t
  misc_feature (398)..(398): n is a, c, g, or t
  misc_feature (1403)..(1409): n is a, c, g, or t
agtgcgcacacacacatattcnttttgttcaaatggtttgctatgaagtgtgacacttatctattatttctttactactaaaagaatgaaaagggtattgtgaatttaactgttttgaacaaaatattagagaagaaggaaacattgtaatggttattagctcttaaattattgtaggtcagtgtaatatatatctatatatgtagaaaacttgcttacacaaattgttctttttcttcaaatgttttgtgaaactgaaacctgtctatagtgtttgaatttgatcacttggaaaaaaaaaaaaaaatgatctgngnnnaatnanntgatttgaacaaaaattacagtttannngnnnnnnnnttttaaaatattgcaagtcannnnaatatctnncnatatatctgtttatgtattaaacttgcttacataatgattctttttgttttattatgaagagtgaaacctgtctccaatgtttgaaacttattattaaaaaaagaaagaaaaatatctgttgtgaattgcctgttctgaaccaaaaaatacattatgaaaaaacaaaattgtaatggttagtattagctcttaatttttgtgagtcagtgtaataatatgtatctatatatatctatacgtattaaacatgcttacataatgattctctctgttcatattatgaagactgaagtctgtttctaatgttttaacttgaccactttaaaaaacaggctctattgtgaattacctgttataaaccaaaaaattacattagaaaagacattgtaacggttgtaagctcttaaatagaacttgttcaagatagtttccaacatatgaaagaacacctcgtttaaatggcataatggcatgagtgcatcacataactaaatggcaaaacttagatgtagtttcatagttattttttgtgctattttctagtcaaaattagtgttttacctccgtaatccgcgtaataaaggtttgtattaaaggtcaacatacattaccaaagtgtaagtccaactctgatcggaaaacaacatcaaaaacacctaagaaactgtgtgcagtttttgtcctaaatgaaaaattgtttttcttttcatctggttaagtagtagtgtttagttacaataataactgaaccaagtgcacaatgcagaactcaactgtgttcccacttggggaacaacctaggagcagtcccgccacagccacgcctcccataaaacttctgacaaggatggagcagctgaagctgctgagcaaagcagagaaagcagggttgctatctgcagcagagaagtttgggttctccctctcaacaatagagaggcttggactcctctcaaaagcagaagagttgggtgtgctatctgctgccactgatcctggaactnnnnnnnacact

SEQ ID NO: 366 - DNA, 455 bp, Glycine max
  misc_feature (308)..(322): n is a, c, g, or t
  misc_feature (324)..(343): n is a, c, g, or t
  misc_feature (345)..(378): n is a, c, g, or t
  misc_feature (382)..(397): n is a, c, g, or t
  misc_feature (408)..(415): n is a, c, g, or t
  misc_feature (418)..(420): n is a, c, g, or t
  misc_feature (422)..(443): n is a, c, g, or t
tgtttttgtgctcggcaggagtggcagtttaaggattggcctttcaaggaccatgttgaaattttcaacaaaagtcagtccttcactcctcctttcacatactataccaattcaatccatgctgctcctttattctagtaagtaacccttttgtgattcattcatttttgcagttattggatttttcatgcgttttgaagatgatagtttggagtcatgcaagactgtcaagcagtggaatgtcaagattatctcggtgggttctacttctattatactactactaccacctttcctttttttttttnnnnnnnnnnnnnnncnnnnnnnnnnnnnnnnnnnnannnnnnnnnnnnnnnnnnnnnnnnnnnnnnnnnngggnnnnnnnnnnnnnnnnaaaaaaaaggnnnnnnnnaannngnnnnnnnnnnnnnnnnnnnnnnaaaaaaaaaaaa

SEQ ID NO: 367 - DNA, 685 bp, Glycine max
  misc_feature (605)..(609): n is a, c, g, or t
  misc_feature (612)..(625): n is a, c, g, or t
  misc_feature (631)..(642): n is a, c, g, or t
  misc_feature (650)..(666): n is a, c, g, or t
  misc_feature (670)..(675): n is a, c, g, or t
  misc_feature (677)..(677): n is a, c, g, or t
tgccgtaactcctcttacgctggttgcaccaaatgcctcggtgccctacaaaaggtaactccaatcatatcattattctgagcttctatcaatcaaccctaaaagttattacttttttttcaccgtgacgtgacattgctgtgaaatataaaatattcaccagttttgtaattaattcctaattttttttgtcttaaccggttcacaaggaaggagacctcactaatccagtctcggtcggaaattatttcttttaaagtttgaactcaattaaacttgagtattacttgcaatgattcaaccttaattcttcatgacttgttaaaagaaattgttaacatgtttttttttcgttgattttctttaaaaggctgttactttgattatatacattattatatcactggttaatatgaaatagctagcatgtcttttcatgttgaagattgaacattttttagttattcctaagaattgtgaatagttcaatattaaacccaacaaaaattacttaacaatattatcttaaaatttgagtttaggaataactccatttcaaacagcactttccttacttatatacactattttttttttttaaattnnnnnaannnnnnnnnnnnnnggggannnnnnnnnnnnaaggggannnnnnnnnnnnnnnnnaaannnnnngnaaaaaaaa

SEQ ID NO: 368 - DNA, 822 bp, Glycine max
tgcttaggcctaataggttggagcccctttctctcagtaaatctgcttgaaatctgtctatatcatctgttctatgctgaattacttctcaggataaatattgagtttgtttgcttttcactttttccagctatgtaattgttgttgagcatgatcttagtgtcttggactacttatcggactttatttgctgtctatatggtaaacctggtgcatatggagtggtgacacttcctttctcagtcagagaaggaattaacattttcttggctggctttgttccaacagaaaatcttaggttccgtgatgactcactcaccttcaaggtatatattatttatgcatcccccttcctctcattttctgatcataaacccaatttgggtgatgaaaatgaaaatattcaacactgaaacttagtggtgtttgttttgacatgccaaaaatataattgagtgaagagctgaaaaatatttatcatatgggaggtcactgaatatccagcaacaatttcatgtagtgttactgttgcattctttatattattagatgctcatactttcagcaccttaaaacaaaagtattttcaaacatcataaatcagtgcttaattattcattactctaaatttctctactgaattttaaaatccaaacaaaattttcaattttatcatacacaccctggtctcatgttgtgtctaggttgctgagactccacaggaaactgctgaggaagctcagacatatgctcgatacaaatacccaaccatgagcaaaactcaaggcaattttagacttcgtgtagctgaaggagaattta

SEQ ID NO: 369 - DNA, 469 bp, Glycine max
caccatcatcaacaattcacccaaatccaagcctcctttcaagccagcaaaggatgataccaagcccgttcttcaagatcctgtaaaaactctttctctctctagtttcttttttgtgcttctttctttgtaaattattaaccttttttcttcttcttaattcttattattctctgtcagatactgagatccgacccaattgagacagaggaagctgtgctgcgattgccaccattcaaaatccccacttcaacttcaacacctgaaatggcatgaatgtatttaatttcactctttttttctctcttcttttttacgttttttcgtcttcaacaatgggtttatgaggtttggtttgaatgttttttttatgagcaaaataatatattttagtagttttaattaaaataaaggtaatatagaaataaaaaataattatttattttgctcgcttccttatccgagaact

SEQ ID NO: 370 - DNA, 368 bp, Glycine max
catgcgggtgtgattaattagaagagcactaactggtccccgagtatgctaaaaattagcatcctttctagctatcataatgcaacatacactgtatgaatagtattgcaaacgggtatcactgtcaacttacaacatggcttaaagtataatggtttacaaaaacaatcttgggagaaggaaaggaaaaaaaccctattgcaatcatcttgtagttgtagcaaatctatcccacaatggtttacaaaaccaatatattgtttggttcgggcagaaatgtataaagcataatgctttccgtcaccaattctgtcagcgtgtttgggagagctattcaaattctcaaacacgtttgtttgagacatgct

SEQ ID NO: 371 - DNA, 607 bp, Glycine max
  misc_feature (540)..(543): n is a, c, g, or t
  misc_feature (545)..(545): n is a, c, g, or t
gatgaccccaatgtggcactcttcttcttggaaaaggacttgcaccacggaacaaaattgaaccttcacttcactatctactacacctcaaatgttgatgccacgttcttgcctcgatcagtttctgattccatacccttttcgtcaaacaaggtgatgatggaaaaaaaagtaatagaacaatgtacatagatactagattatagcatgttagtatagggataatgtataaaaggctatcaaacactaacctaaattcgcactcatctccatgaaagtgatttggtgggaaaaatcgtcaattcctcattggtaggaagctctttacggactatctactaatgattgactcaatccatcacataatcaattttatcataattccatacaaatatccgtaatctagttatattagttgttatatttttaactgtcaattgatgattaaaaaaaaagataattgattgatactgattcacaacaattattttaacaggtgaatgatgtattaaacaagttttcaatcaaggacgggtcagnnnngnctaaaactgtgaagaacactattaatgagtgtgaaggacctagcataaggagagaaaagcgt

SEQ ID NO: 372 - DNA, 597 bp, Glycine max
  misc_feature (232)..(232): n is a, c, g, or t
  misc_feature (239)..(239): n is a, c, g, or t
  misc_feature (250)..(250): n is a, c, g, or t
  misc_feature (260)..(260): n is a, c, g, or t
  misc_feature (264)..(265): n is a, c, g, or t
  misc_feature (267)..(267): n is a, c, g, or t
  misc_feature (277)..(277): n is a, c, g, or t
  misc_feature (280)..(280): n is a, c, g, or t
  misc_feature (287)..(288): n is a, c, g, or t
  misc_feature (291)..(291): n is a, c, g, or t
  misc_feature (293)..(293): n is a, c, g, or t
  misc_feature (296)..(296): n is a, c, g, or t
  misc_feature (298)..(299): n is a, c, g, or t
  misc_feature (301)..(302): n is a, c, g, or t
  misc_feature (304)..(306): n is a, c, g, or t
  misc_feature (309)..(309): n is a, c, g, or t
  misc_feature (311)..(311): n is a, c, g, or t
  misc_feature (313)..(316): n is a, c, g, or t
  misc_feature (318)..(320): n is a, c, g, or t
  misc_feature (323)..(323): n is a, c, g, or t
  misc_feature (325)..(325): n is a, c, g, or t
  misc_feature (327)..(332): n is a, c, g, or t
  misc_feature (334)..(335): n is a, c, g, or t
  misc_feature (337)..(339): n is a, c, g, or t
  misc_feature (341)..(341): n is a, c, g, or t
  misc_feature (343)..(353): n is a, c, g, or t
  misc_feature (360)..(364): n is a, c, g, or t
  misc_feature (367)..(370): n is a, c, g, or t
  misc_feature (372)..(385): n is a, c, g, or t
  misc_feature (390)..(401): n is a, c, g, or t
  misc_feature (403)..(415): n is a, c, g, or t
  misc_feature (417)..(419): n is a, c, g, or t
  misc_feature (421)..(433): n is a, c, g, or t
  misc_feature (439)..(441): n is a, c, g, or t
  misc_feature (443)..(461): n is a, c, g, or t
  misc_feature (463)..(471): n is a, c, g, or t
  misc_feature (475)..(475): n is a, c, g, or t
  misc_feature (477)..(481): n is a, c, g, or t
  misc_feature (488)..(494): n is a, c, g, or t
  misc_feature (497)..(518): n is a, c, g, or t
  misc_feature (522)..(532): n is a, c, g, or t
  misc_feature (535)..(547): n is a, c, g, or t
  misc_feature (550)..(554): n is a, c, g, or t
  misc_feature (559)..(560): n is a, c, g, or t
  misc_feature (564)..(569): n is a, c, g, or t
  misc_feature (573)..(582): n is a, c, g, or t
  misc_feature (585)..(593): n is a, c, g, or t
gggtagatttgaactctatattgcctctagtcgtcagttttgtactgtttcccccactatacatttggaaaggttaggaactagagttgtttgttatttctgcacagccaactgttagccacccttgcttggattaaagactgatggactatttaccaggtcataggaaaactctatccaaaaattaccagctgaatagctggcttctgtacaaggaaaaaaaaaactggcnccaaccntacgaatatcnccagattgtncgtnnanggaaatgacnatngcaattnngcnangtnanntnncnnnatncncnnnngnnncancncnnnnnntnnannncncnnnnnnnnnnntcccccnnnnntcnnnncnnnnnnnnnnnnnnctctnnnnnnnnnnnntnnnnnnnnnnnnncnnntnnnnnnnnnnnnncctccnnnannnnnnnnnnnnnnnnnnnannnnnnnnnttcnannnnncctcctnnnnnnnccnnnnnnnnnnnnnnnnnnnnnncttnnnnnnnnnnnacnnnnnnnnnnnnnccnnnnnccccnnaacnnnnnnctannnnnnnnnnctnnnnnnnnncccc

SEQ ID NO: 373 - DNA, 399 bp, Glycine max
cactttcaaccaattgacaataatagagcaaacatcacaagaaaatggcaagtttcactagtttttattatgagacatatttgaaatgatcatggaaggaagggatggagattcagatgggtgttctttgtcatcaggttcttggatctaaaagggtggcttagtccatctttgactttcaaaataagagaaacctctgatagttgccaagccacattgaggacaatcatcaccgaaagaagacaatgagtcacaaagttctgcctcttcaccttcttcagctctttgattatctcatcattcttacttcccttaccttcccttccattctccttttcactttctgtttcctgagttaaagaagccacaggctcagaagaactagaagcctcgaattgc

SEQ ID NO: 374 - DNA, 664 bp, Glycine max
  misc_feature (644)..(645): n is a, c, g, or t
gccctgtatgagaaggtatgaatgtgattatgactatgaggcattgttttgtttgtgatgactataacatgaggctctatttgatgatgtgttctttctgtttgtttattaggtgaaaccaaagggtgtgacaatgacggctattttggctaaggctgctgcaatggcacttgttcagcacccggttgtcaatgccacctgcaaagacggcaagaatttcgtgtataacggtaacatcaatgttgctgttgctgtggcaattaatggtggtttgatcacccctgttcttcaggatgcggataaggtcagtggcttgactatcctgaagcaatattatggtgattcatgtctaattttctgtgccatactccaactatttgatctatctttatctgagtccaatggtatcttgcgagcaatccatgtagctgacctctcctgattgttgtttttgtctaatttgttatttgattgggtacttgtttcttgttgtgacagttggacttgtatctattgtcccaaaaatggaaggagctagtggaaaaagctcgtgcaaagcagttgcaacctcatgagtataattcaggtgtctttatgaattgtgattgttgtttgttattagcaaaaaaaaatttcgttgaacnngggtgttttaattttgacc

SEQ ID NO: 375 - DNA, 443 bp, Glycine max
  misc_feature (415)..(424): n is a, c, g, or t
  misc_feature (432)..(440): n is a, c, g, or t
cttaccctcgtaactcgtaacggcttcataccggacctttccttttctgtttttctctctagttcaaagttagaatcttttgttcactcactgagccatggatggcgccgagttcgacgccgcgtttgggttcccatctgagtttccctacgagtttgactcggtcgggactgaaccggttgattccggttcgaccgggactgagagtagcgacgatgaggacttcttcgccggcttgactcgccggctgagtcacacctcgctcaatgaaacaaggaaggaacaacacttcactgttcccatcggcaacagtggccaagctgaggtaatgataaccaatacccaccgttttcttcctttctttcacttttcttttcggggaagctaactttgtatcggtttttttttttttttnnnnnnnnnnaaaaaagnnnnnnnnnggt

SEQ ID NO: 376 - DNA, 410 bp, Glycine max
  misc_feature (402)..(406): n is a, c, g, or t
actagtaaacttgaagcaagaagtaattggaagtaaatgtctactaggaaaaagctcaaaatccttggatgtgacccaataatctcactctccacacccggaaaagttacccacctatgctgaggttccaaggtttgaaccagaggaccaacaagaagccacggaatcatatattgcctatggttgagtttggttaagtaatgttattgtgagctccttcctggtagctaaaccaaaaataagaaaaaatcaatttcctgtaattgtgcaaccctttaagataaaagaggtaaggatatctgacaattttggctcctgtgatcttacgtatatatatgcttttgtacttgaattatttgttctgtagcttctatccaaggtctagctgtatccatccagcannnnntcca

SEQ ID NO: 377 - DNA, 1012 bp, Glycine max
gaggctgatcctttagattctcaggtggagtcaaattctcaaattcaatagtataaaaaaacattgcaagatgaaacttttggcgcattaattagtatgtatgagtatgcctgattctctttgtggtttgttagttctacaaatctttacacaaagatcttaatttggcaggtgctttctgtggccatgatccatgcagggtctgctcatgacataatccctgattcagctacatttggaggtacttatagagcattcagcaaaaagagcttctatggactgaggaaaagaatagaagaggtaaatgtcttgtctggttacgaccactccatattgttttattgagctgttgaattgaatatgtacccattaagtgggtgtgtttagattcacattgagttaccaaaagcatgttaagttactggttaacatgaatttagatgaaaattcacaatttcacatgattgatttcatgttgagaaattaattttgaagtgaaacaagttttggtggatttttatgtaggatccaaaattttttattgagttttcttactaacttgcttctagaataaaacaacatccaaacataaatcacatcacttgaaattcaattttgttcataattaattttgcaaatgctcccccaaatgcacactaaatcttaaaggggccacctatgcactttactttcttcctgagctttgctgataaaaggaaaaacgtaactttcttcctaagcttgccctgtagatatgagctcacactatagaaagagattgctcaaagtggatttgcatttgtttgtaacttcttttgagcaggttattaaagggcaggctgaagtacataggtgctctggagaggttgagttctttggcaatgaacatcccacaatccctccaaccacaaatgatgtgagaatataccaactagcacggctagtgtctagcaagattgttggagaagataacatagaattagcacccctcttcacagggagtgaagatttg

SEQ ID NO: 378 - DNA, 380 bp, Glycine max
cgtaggtgtacatagggccatgtaattaccaaacaagccacagagcagatgagaaactagtatactggtaggttaatttacttttccatgtgatacacagaaacaatattaagattgggaacatggtgataagttaagttattgttgtaaaacgctccgtggttgattcccccttgtagaattattttttctgctatctttctataggttcttagatgtttcttgtataagcttggcaaaactgtactttatagtttgtcaatgtttataatgtgaaatcaaaatcatattattcatcattgtgactatgacttctggttggatagtcactggtaaattggaaccagcaggagcaagttacatgccaagacaatgaaaat

SEQ ID NO: 379 - DNA, 356 bp, Glycine max
ttctgccattctgggataaaacttaggttgactaagtcaggtgatttttgagttattttttaatgaatattaaaattttatctcgccaatttatatgataatagacgttttattgatgtaaattattgagataaaattttaatttttattaaagaatatcattaaaaacactgagttatgtcttattttttattatgttttttctgttaagaagtatcttgcctctgatccgattgcattgaattactaggatattaagatgtttctccactagctgggtggagatcgtagatctaggtcgttgttgtaaaataacatggtgatgtacctaagaagtaacatgggtatggttctga

SEQ ID NO: 380 - DNA, 358 bp, Glycine max
tacgttgacgaatctgagtccgccgttaacgaacaaatcaagttgctcccatttctctctctctcgctctccctcatcggttttatttcattttcttttttccaccttctgcttattattattttttatgcagtgtggagtataacgtttcgtacgtttaccatgccatgtttgcgtacttcgatagggacaacgttgcgctgagaggacttgccaagtaagtaacggtttcgttatttttagaatctatcgttttattttatactagttaggagtgattattagttattaataatggttatgtgtggttgatgaaggttttttaaggaatcgagtgaagaagaaagagagcatgctg

SEQ ID NO: 381 - DNA, 1266 bp, Glycine max
ttgtagcagctgtgagtttcactcatatgatcatctgtttatattgttgaaaaactccggcatttatttacttaactagttcttcataatgcacattggtcttaacctttgacttctaaactgatgtgaaattttttattaaaagggattggctgacctgaacaaacctccagaaatgatctctggcaacatgacaggaggtttatcatctctgttcctacaaaatgttgaattttttcttggcatatggtctgttgcttattatgtctcttgtttgttgttaatgctgcagcaatgtgtgtctattcagcattgttcatgagatttgcatggatggttcagccacgcaactatctactttttgcttgccatgcctcaaatgagactgttcaactctatcatttttcccgatgggcaaaggcacaggggtaagcagcttgcatgcaagtaaacttaactgctatgattttaaccagttctatttgatgttactctccgtggtgttaatgtttcatatgttataaaggctattttaacttgtatgattatgatatgatacttttataatgaattgctcttttgtctatgaattgttagttttacatgcttccacctttatttataattgactatcacctggggctctcttcggatctgacatttgaaaaggtttcttcaagttacaagccccactgggaaacaaggcctagctatttaattggcaatactttgtataatcacagtataaaactggccatgctctgacatacacttgatttattatgatttatcactatcattgaatcattgttaataatactctctttgacacacacacacacacactattattcatgtgggtctttattaaatagagagcccaaaattttagtgcattcacataaaatttatataacgatagagattatcttaaaaagagtgtgttacttagatttctttctctatgtaattgtttagctaaattgagccccccacaggggctgctcctttccaccatgtcttaattggaacttgtcttttatgcattgtaagacatttattttaactcaatggagctgtgaatgtcagttttctgataaagtttgtgtttcttgcaatttcttttcaaggcttctgtcggaaaagaaggaggaagcttcatcccagtgatttgatgatgctaacacattcttgagtggagcgattttaaagattttgcatttgaacttggtgatgtatgaataattgattactgatgtaagaaac

SEQ ID NO: 382 - DNA, 321 bp, Glycine max
cttttctattcttcaagactacatccatctgcaataataaagcttgccccacaacattatgttagaaacctaaacatctctagtagaggcaatggagatgagaagataaatgattcaaagagaaaaaagtagagcaggttttatcagtaaattagcaaacaaagagaccattacaatgacaatgaaggtgacattatctgcataaaaattatccttcccaaattcagaattccttgtccctaataagattatcaagtaacaaccataaaactgtttcccttcagcccttatcaaagtctgctcatatattctgcaactggg

SEQ ID NO: 383 - DNA, 395 bp, Glycine max
aaaaaataaaagagaagaaatcatctttttgtggacattgtgtttgttttctaagaagaatggaaactgtgtgtttaaaatctgggatggttcccacgatctctattagtgggtcgctggacgcacgcgccaatccttctcaggtgagcacggtggggcgcgccgccgcggataaaccgccgcagaggtcggtgttttcgaggttttccttttggtaccctttggaatctctctggcctcgggggaacaacagcaggtacaaagggctggccctcgacgacgccgttttggcggacaacaacgccgaagcgaaggccgttagagatgacggccagggtgacggaacggaaaggcagaccggaaactgggttttgaagattctgcatgtgaagtcc

SEQ ID NO: 384 - DNA, 341 bp, Glycine max
gcccaagactgcacatcattgaagactgtagtgtttccttcaactgctactgaacaactaaaggaaaacaggaaagaggttctgttctggaattgcttgaagttgaatcaacaatctcttgaggccattgcattgaatgcacagatcaatgtgatgaaatttgcaaaccgacgcctctctgtatcaaatcacgatgatgttgaaaattacaatgattatgataaaaaatatcatttttatcaagttgtttacgtgtatccaggaagtagtgttctagagtggttggagtataagacaagaaataattatataattattgatatgtcttcagctccaccttc

SEQ ID NO: 385 - DNA, 370 bp, Glycine max
cttcgacgaatccaaagctggagttaaaggcctggtcgactccggcatcaccaaactcccaaaaattttcgtccggccgccggaggacctcgccgccgccgacccagtatccgacaaccctgccggtgcccagttcacgatccccgtaattgacctcgacggccttaccggcgagcgctccggcgtggtggctggagtccggcgggcggcggagacaatggggttcttccaggtggtgaatcacggaattccggtgaaggtgctggaggagacgatggcggcggtccatgagttccacgagctgccacaagagttgaaggctgagtattatagcagggagcagatgaagaaggtgaagtatgggagcaac

SEQ ID NO: 386 - DNA, 673 bp, Glycine max
actgggttattcaaacaaatatctatgccaatggaagtgtcagcacagggagagaagagaaattctatttctggttcgacccaacacagcagtaccattattacagcatcttgtggaacagttatcacacagtgtaagtaatataagtcttgtttcaatcttgaaattgaaagaacaaaaagcgaggagtgttaacaacacactctttggcacgtctcttctaatgcagtcttttatgttggctaaaatttatcaaaaactacaaaatattcattaaataagtcgtgacatccacaaaattgtgatttttaataaattttaattagcaagaaagagtccattaaaaaaagtgtgttgctagcatatctgaaagcgaaatggattgactttcttgattaatatttaatagccgtagactaataaataacccaattgtggattttgtaggttcttagtggacaatattcctgtgagagaattcatacacagcaacacatacccttctatttatccatcaaagccaatgtcagtgtatgccacaatatgggatggttcagaatgggctactcatggtggcaaataccctgttaactataagtatgcaccatttgttgtttcatttgcacaaatagaattgagtggctgcatttctgatcccacagcaccagtttct

SEQ ID NO: 387 - DNA, 772 bp, Glycine max
taagatggtggagatgtctgcactaaatcacctcatgtctacacatgttttgcatcaagctcagcaaattgagcatctgtatgatcaggttagataacatatcatattcttcacccttgttctcctttttgattattattttgtgaacattttaaggtcgccatctatcatatctctgttgtaatctaaatattatgcaaatcccacttgataacacagtgatcctaaaaataaataatctgtattttattcacctaaaaatcctaatatccatactctatgtattagtaattcatactatgaaggtatatattttcacaggtttcaacattgtagtgcagtaagtactgtgctaaatgtttaatctgcacaaaaatagttgcatttccaatttccaagaaatataatagttcttctgccgccttttacaggctgttgaagctactaagaatgttgagcttggtaacaaagaactctcacaagccattcagaggaatagcagcagcaggacatttcttttactatttctatttgtgcttactttttcaatcctctttcttgattggtatagttaaatgcttttggttttctgctatcacagtgtatcttatagacactctctgccccttttctcttttttccctattgctgtcaatatttgtttttactttttaccactaggaaggcatctttttctagattcgatgtttattggagacagaattttagtaatcaatttatgaagggaatgacaaaagagacctgcctactg

SEQ ID NO: 388 - DNA, 1261 bp, Glycine max
  misc_feature (564)..(564): n is a, c, g, or t
ctctttcctttgatatgttacattgtgcaagatgtggcattgattgggaccagaaaggtatctttcaactttcaatctattctactttgtgttggaccaagatgcatttatcatattctgtacttatttgacaaaaacatttattttctggactatatagatgatacatcatactttatgtgtcaatggaagaagttagttgtcatcaaataagaatagaattcactccttggttcttcaattgcatctgtgttgtaatttttccctattgaacctagacattcaacactattttgtgaccaatgaaaaataatgccagttgactggcttctatttagttctggccctttcaactacgctaaatacctagctctttctcattccgatgagaaaagtgtgttgctaaccatatatatcacttgaactaaaatgcttttgtcttgaatgtctataagtcattaggtgcattccttatttgtttctgatgtaacaaaaactaatttttccgtgcagagttaagaaaaatatacggtatatacttttggaaaatacccatatttagtnctttgttacatgggttcctgaaagttacacctattaaaataagtagacaccttttaacgtttacttgccatattggtgaagtatcaaacaaactgaggttgacttttgaaactcttccttctgagttctgatgtgtaaaggcattgaatctaaatctaatccttcaacttgcctttattctgttttatttaccctcccctcctctttgatttgtgtagaatttttatcaatattttagcaccatgtgatttattaacattcatattgcatggtatggtatagatggccttctcctgattgaagccgatagactcttaaaaccgggtggatactttgtttggacatcaccactcacaaatgctcgtaacaaagagaatcagaaaaggtggaagtttatacaggattttacattaacactttgctgggagcttctgtcacagcaagatgaaactgtcgtatggaagaaaactagtaaaaaaagttgctatgcatcaaggtaatgctttcatgcatgtacttctggaaaattatttcacttatgtgtgttttaggaaacagatttctagtaaatatattctatacaatgtgtatatatttgtttaccattttgaaattaatgtcgcctgattcttagcatggcctatatttacttccagaaagtctggttctggcccttctttgtgtggtagaggtattg

SEQ ID NO: 389 - DNA, 849 bp, Glycine max
  misc_feature (752)..(758): n is a, c, g, or t
  misc_feature (761)..(761): n is a, c, g, or t
  misc_feature (777)..(777): n is a, c, g, or t
  misc_feature (785)..(791): n is a, c, g, or t
  misc_feature (820)..(820): n is a, c, g, or t
  misc_feature (825)..(845): n is a, c, g, or t
gatttccttgtttcctgatggaaatgtaatgtaagaatgcataaatgatgacaaaagacatgaaataagacaaacaatctaggacaaagggcatgcataaacaatcagattaatttttttatgtaaaatacagaaatcacctacactactatgattggagaaaatttctattatttagtgaattattgtacccttctgcctaatgagaaagttatgaaatattgaagaatacctagtaatattttgattactgtaagcatcccattcccaccaagcagagacataaaactgatacaagaagataaattgatgtctctaattagaactttataacttgtgattacttattgcagagtcccctctcctttttttttcttctttttcataagctctattcaatttaaagaagtcagaaatttccctaaccagattctgtggtcacattgaggaacagaagaaatgaatgcaaacataaaaatccacaaacacaaaaagattggaattggacaaaaccagccttaccattttcaaaaatgatgcaaactactttcccttaacaagcacaacgctaacgagacttacctttacatctattgtcgaaaaattcctcatcactataacgagcacaaaggacctgagaaattgccacattaaatgaccaatttgctgattaatcaaccaatttaagctttgtcacaacaacaatcacataccgctggaaaatcaaaagccttgccatcaagtgtttcagnnnnnnnctnatacatgagcaaccgnacatctcnnnnnnncacataaaaaaatatctgaagccaatcanaatannnnnnnnnnnnnnnnnnnnntcta

SEQ ID NO: 390 - DNA, 412 bp, Glycine max
cctctcgaggatcaaacgttgtacatcgacgtggtccacgccggctcggaggaggacaccaagccgcttatcggctcggctcggctcaagctggtggacattctcgacgacgttggaatcggcgagcgcgtgagccgcacgctctcgctgaagcgtccctcggggaggccgcacgggaaggttgaggttagcgtgacaatcagggagcccagctaccgtgcgcagggtgggtacaacgcgcctccttacggcgtgagggattattcccctgcgccgcaggggtatggtgggtatcctccatatggggccccaccacaacaggcgtattattccgctccaccaagtgggtatccttataatgcgccaccgcagccttataatgcgccgcctcagagtggctacggctataata

SEQ ID NO: 391 - DNA, 303 bp, Glycine max
cttggccgaatttttgcaaaagccataacagagaatgtagtttctttgaaggagattgggcagttaatacatgatggtggagaggagccaggtagtctcttagaagttggacttgcagctgatgttcttggaagcactttggaggtaattcaaagcgagaagggggacgcggttctaaacgagatgcgttcagactctaacttgaggttggaaactttccggcaacctaatgctaaaacatcaaggaagttggaaaaatttatttagatgccagtgatggttattgtattttttttttttttt

SEQ ID NO: 392 - DNA, 354 bp, Glycine max
tctcgttacacacctcaaaacgcagcggcacactcactagaatgcaagccgtttcgctctcacctttgtcgtttagggattcttccgacgagttcgctggaaagttcgaacacgatttcatggccaagctcaaaatcaacgaagagaaagtcgaaaacgaaaacgaagagaagcataacgaagatgagatagaagaagaagaagaagaagaagaagaagaagaagaggaagagtttagcttcgttctcacgaattccgatggatcgccgatctccgccgacgacgcgttcgacaacggccagattcgtccgatttttccgattttcaaccaggatcttctgttctccgacgatt

SEQ ID NO: 393 - DNA, 1222 bp, Glycine max
  misc_feature (45)..(51): n is a, c, g, or t
  misc_feature (1058)..(1058): n is a, c, g, or t
  misc_feature (1179)..(1181): n is a, c, g, or t
  misc_feature (1183)..(1183): n is a, c, g, or t
  misc_feature (1204)..(1205): n is a, c, g, or t
  misc_feature (1213)..(1215): n is a, c, g, or t
aagtgcagctgtgaacccaaggtagttgtctgctcacaaatatcnnnnnnnaaatcatcaatcatagttttattctttgtcttatttttagggcttatgtcttttgtcagaactccattgccttagtacaatagtaactgaagccttaacttgcacttgtaagatagaaatgattaagaaattatagatatagtagcattacacgtgattgtcctctttataaaaagatagaaattcttgatgactcatttcttccttgaggaatatgcgtgtaacataagaattgtaagaaataaaatgttatttatggagattcttctcattgtctccttgtttgcaaatagtacatatacacacccttcaaatttataattgtatgttattttccttataataaccttcaaattatggcaatggtgtctggtttcctttttaaaaaaattattagagagattaaaagctaattctgaaaaaactagaaagattacaagagttcattccctgtatgttacatgtaggtctctataagagtcgacttgcttcatgcttgtcctattcatatgaattgtcagtacctccaaagtgaactttactgaatgtgggtaaagctgaggaatttctattgggtaggaataaacagtcaggaaaatcactttgtagagttacagatttgttttgatttctctttagctttttatagaatcagatgccattgaatagaataaaaggctgaatagttgagattaaaactcatgctgaaggaagccgcttgtagattgaaagtctataaggtgttttgcactagtttatgccaagatctatgcattcagttttctaaagggcatcataggtgaaaatatagaactgcattatagcataaagtttgagacaaagcatagtaggctgttcttgattattctaaactaaatttttttgacaaagggctctgatttgggaggtgaaactgcaaaggaggatttaaatgaaagatatgaaaacctagaaagggagttactactgttgaaggtcgaaagagactctttgctgcagaagttctntgaatcatcagagaaactatcaatggtttccagccaaaaggaaaatgctttgaaagatttaaatactgaagtgaacagaaggaaaaatctagaaggggaagttaagcagattgctgcagannngnctaatcgtcagaaatcactcnnttctttcnnntagtgat

SEQ ID NO: 394 - DNA, 555 bp, Glycine max
  misc_feature (182)..(182): n is a, c, g, or t
  misc_feature (227)..(227): n is a, c, g, or t
taccatttacatttacaagtatgttaaattgaacactactctctgtaatttcttcatggcagtcaaatcactaaaacaaatgaatcttatcgtttgctatcttcttgttctgacagttatcagaagctgcagaatatgcaagaaagaagggagtgatactaaagggagatcttcctattggngttgacagaaacagtgtggatacctgggtgtatccaaatttgttncgaatgaacacttctactggggcacctccagattattttgataaaaatggccagaattggggtttccctacttataattgggaagaaatgtcaaaggacaactatggttggtggagagctcgattgacacaggttttggttttgaattcttgatcttgtccttatatggacaataatccatccaaagttaaatatataggctgaatcctttttatttattttgtattttttttaaatccacaacagatggcaaaatattttacagcttacaggattgatcacatattgggattcttccgaatttgggaacttccggatcatgctgcga

SEQ ID NO: 395 - DNA, 408 bp, Glycine max
agtgtcggtgttgtcagcagcagaagctctttctgagaagcagaagtttgccagtaccacggaaaagcctgttcttgtcaaataaaaattgtagctgatgttattcatgctagtccttcaaatcatattatatcctataacctgctaagatgaagataacaataaggatcatccgtgctctgttccatctgtttgcattatgtttcttaatgaagtctacaaataaatcttgatgcatgtattgtttatgtcctgcccataagttgtagcttttataataatagtaatagtaattataagaggtactccgtactcataatgcaagtgtaaataaaacaatattgtgcaacatttaagtcaggctttctgcttgatactcactggcctgctacaaatgtcttggaattg

SEQ ID NO: 396 - DNA, 387 bp, Glycine max
  misc_feature (25)..(25): n is a, c, g, or t
ttttttgttcctcactgaccaagcnatggcgatgagaaccaaactttctttagctatctttttcttttttcttttagccttattttcaaacctagcctttggcaaatgtaaagaaaccgaggtagaagaagaagaccctgagctcgtaacttgcaaacaccaatgccaacagcaacagcaatacactgagggtgacaagcgggtatgcttgcaaagttgtgacaggtatcatcgtatgaagcaagagcgagagaaacaaatccaagaggaaactcgtgagaagaaagaggaggaaagccgtgaaagggaagaagaacaacaagagcagcatgaggaacaagatgaaaatccctacatttttgaggaagataaggattttgagaccag

SEQ ID NO: 397 - DNA, 1413 bp, Glycine max
  misc_feature (1082)..(1082): n is a, c, g, or t
  misc_feature (1105)..(1106): n is a, c, g, or t
  misc_feature (1143)..(1146): n is a, c, g, or t
  misc_feature (1175)..(1179): n is a, c, g, or t
  misc_feature (1202)..(1202): n is a, c, g, or t
  misc_feature (1403)..(1407): n is a, c, g, or t
aaagcaactacaggtctcaacttctgaacttcttctcacacagttaacgtttctcctttttattcaatcaaatcgaaaatcgatgaaaagtactttgccgatttctccatatcagcaagctgaaattcatgatatcgagttcggtaacggaagcatgcaacaattctattcttcttctcggtccccgcggctccggcaagaatgcggtttgttcctcactcacctcaacctcattttttaagggttttctccattttcttttcattatgtattctcttgttaggttttggagcttgtcattcaagatttgctgcaagagtatccggactcggtctcagtggtattcactgccttctcaaataataatattaataattcatggaattggaagtgtgcttgctctctctattgagttatattttcgttgcagataaggttgaatgggcttttacatagtgatgacatctctgcgttcaaggttggcattcctaaaacctgcttgtactgttactaattgaaacagctatgatgttattaacttactaatgtcgtttgttttttctgattgtataaattgtttactaaagttgattttcctggttgtttatgttgacttaatgctgacaatgactttggtttagttaatcattatttttttaataatcaatggcttcttatatgggtaatttggcaccctagtcagcttcggacacttaacaatgaaggaaaattgggttgactcgaggtctagttgagtgaataactgcttagtcttactacagaaagggacaagtaaatggaagataatcttccggtatgaattagccagggagcttggagattattctccttgagagaatgtggcaatgttctttctgaatttctgttaaaagatgtggagtaaatctttctcatgttaaaaacttgtgaatttacaaaggaattggatggtgatggaccaagctgtgcaatgcagctcagactatttttggatatgcaagagcaatgaggttttgttaggcatattacagaatttcctagttttgttatagagattgtttgaactggtagattttggctanactgacctgaccttgtatgatgnntcatttgttgttgcaattgatgatgaaacaggaaatnnnnaggcagttatgcatggagcatcaattgcnnnnntcaaaagcggtaacatgacctanttattcaaaattcataccatgcatttacaattatggtacagtggattttttttttatcttgatatgaaccttttgcaggcatcatttgatgacaactcccaatttatggtggccatcctaaagttagtaaaagttttcttggttgaaaaaggaaaataatttgaagttctaaagcatttattatctttgttttctagggannnnnatagca

SEQ ID NO: 398 - DNA, 466 bp, Glycine max
  misc_feature (403)..(413): n is a, c, g, or t
  misc_feature (420)..(429): n is a, c, g, or t
  misc_feature (432)..(434): n is a, c, g, or t
  misc_feature (442)..(446): n is a, c, g, or t
ggctcatccgcagcccctgcacctgcccctgctagcgacggtaatacccactcttttctataatcattttctttacttttatatgattgcttcacactttacaattctttattatattcatgaaaattaaaatcataatattgttccaaattccagtatccagttccttgcttccttcttttggaaaaccagaatgtaaataataaaaagtaaaaacatttatattacactaaaaatgtaatttcaagcatcaccaagcctttaaatcaattagtgtgtaattgtttcaacttattcattagttttcagtttgagttctattgtccatgatagtcttattcaaattgagcaggattatccctaattgaagaccactatagtctttgtcaaaaaaaaaaaaaannnnnnnnnnnttttttnnnnnnnnnnttnnnaaaaaaannnnnttttgggaaaccccaaaaaa

SEQ ID NO: 399 - DNA, 530 bp, Glycine max
aggggaacttggtgggagagagcacagaccacaggggcatgtctcaaaatttgttgcaaagtgtatagttgagggtttggtactttggtttcatttagttaaatttgtttgtgtctggaattgccgcttgtttgaaaatgtctctctttgctgcattttccatttgtaaagttgccaaggatgcagctggagttgcaggtattttctctttgataattttggtaaaccaaaaaagaaaatgacccacttttcttcgttgattaattaatcacatttcactgtgttaatttacttattttcaggaaatgtgtttgcttttgggttgtttgtgtctcccatgtaagtttcattaaggatttttgaagattttgttgtttatttgtgttcattgtgtaactctttttctgttttgaattctagacccacatttaggaggattatcagaaatgggtcaacagagatgttctcagggttgccatatatttattcccttctgaactgcttgatctgcatgtggtatggcacacctc

SEQ ID NO: 400 - DNA, 390 bp, Glycine max
caaggtgtggaattcaggaactacacggaggaagagagaatggagaaagttgagaagatccgcgtgatggcaagatcatcccctttggacaaacttttgatggtgcaatgcttgaaaaagaaaggccatgttgttgcagtcacgggagatggcacaaatgatgcacctgctctaaaagaagctgatattggactttctatggggattcaaggaactgaagttgccaaggagagttctgacattgtgatcttagatgacaacttcaattctgtggccactgtcttaaggtgggggagatgtgtttataacaacatccagaaattcatccagtttcaactaaccgtaaatgttgcagcactagtgatcaattttgttgcagcagtttcttcg

SEQ ID NO: 401 - DNA, 585 bp, Glycine max
  misc_feature (57)..(59): n is a, c, g, or t
  misc_feature (519)..(519): n is a, c, g, or t
  misc_feature (521)..(521): n is a, c, g, or t
  misc_feature (530)..(530): n is a, c, g, or t
  misc_feature (532)..(533): n is a, c, g, or t
  misc_feature (535)..(535): n is a, c, g, or t
  misc_feature (538)..(542): n is a, c, g, or t
  misc_feature (548)..(548): n is a, c, g, or t
  misc_feature (571)..(577): n is a, c, g, or t
  misc_feature (579)..(581): n is a, c, g, or t
atgggatgattttgattcacacagcaagcactggcattttgattactcatcatcacnnntcttgtactggtgatgcttgtggtgatgcttcttcctcccatcatcatcatctgagtcatctccctgcaatggtaggaaaatatcataaaatggataccatcttcaataggaagaactttatatagcatgcaaattcacaacacttcatagcattttattctgattgcaaactttattaaatgtatgcacattattagaatgttggaacatgggaagcactgaagctgtgtctgtataatcctctcgtatattgcatgtaacctgatagatccttcttatggttattagaaaaagaaaattcagaaatccagatattgtttgccaatccatgccaaggagtttccagcataatctatactcgtgggtgaacaacacaaccacaaaactcacacatgcagaagcttatacatgcataaatcttgcacccttaaatgtaatgatggcgcatttaacaaaaanantaaaggtcnanntngtnnnnntgcagntattcttttgaaaactattaaannnnnnnannnacac

SEQ ID NO: 402 - DNA, 610 bp, Glycine max
agggtttcgattcggaggtagacgaagatgttcggaagggctccgaagaaaagcgacagcaccaggtactacgaaatcctcggcgtttccaagaacgcttcgccggatgacttaaagaaggcttacaagaaagccgccattaagaaccatcctgacaaaggcggggatcccgagaaggtattttcaatcgttgattttctgatatttgatttgatgaattctgaatgatgatggttgtagtttgaattgttatttgattgtgattcattagtcaatttgattaatttatgatttgttatatagggttagaaaaattgagggaaaaggaaaaaatataggcttagggatcgtctttattggttgatgtgtctgcgttgggattggattatagtgtttgatattttgtggtgttcataatttgtttatcttagtagtttgtacttttgcatagaggtttgtgttattgttcgtgatggatttgtgttgtttttgttggtgtagtttaaagagcttgctcaagcctatgaggttctgagtgaccctgagaagcgcgagatttatgatacatatggagaagatgctcttaaggaaggaatgggtggtggtggcg

SEQ ID NO: 403 - DNA, 380 bp, Glycine max
aagtagtgattcaaaaagttaacaaatttaccatacatgatagtaagtcttattagatgacattgtaaaatccttttacactatttactcaaaaattatatggaacggtttgcaatataatataagtattgcctgtattagtaacttcttactcatttggatactaatatgaaaaatatctatctatttcattgtaaagaaatctttgctgaacaatattaactatatttctgcattagacgcttgattcattaagttattctgttggttgaagttgataaattttaaatcagggtttcgtctgtacgtagcagatgaacttggcaatgtttagtattcaagagaatgcttgtgttgttcttgttcttaattttcctaca

SEQ ID NO: 404 - DNA, 366 bp, Glycine max
catcaatggcctctcttgtatcctcaagtgttcttttacacctctttctcataatttccgcgctccatttgggcgcagcagcaagaattctgagtgaaaaggaccaacaacaacaattgcagttccaataccacaaaggccctcttctcagtggcaaaatctccgtcaatctcatctggtacggtaacttcaagccttcccagcgagccatcatctccgatttcatcacctccctttcatctcacaaatccacagcccaaccatccgtcgccacgtggtggaaaggtacccaaaaatactaccaactcataaagtcatcaccaaaactcaccctcactctcggtacccaaatcctcgacgagaact

SEQ ID NO: 405 - DNA, 821 bp, Glycine max
  misc_feature (629)..(631): n is a, c, g, or t
  misc_feature (656)..(659): n is a, c, g, or t
aggatcaattcatctgataaaaaaaatgaagttgcgaatggcgagaggggaagtttatctaagggtctcagcaatactggttttggtattaacagcatgtttggttgctttagatactcaaaccaaggttgtgttcttatctattgagaagaaggctacatgcagagacttgaacgctctcaagtaagagttccctctcctgtatatatattctccgattgctgtggcatagtgtggcttaatttaatatatattcccgaaattatatagagttgggaattttatgttttttataggatcttggtgtatgttacatctgcgtctgctggttataatctgcttctattgtgcaaacactccatttggtctagaaaaaacttcaaagggtcttatctatgcatggcttggatttgtttcttgttggatcaggtaaattactatttcctaattatctattatgtatatgtttgtattaaaacgctttcctatgtgcatactttgatcaagatatcatcgtagcctgccactggagaagggaatactttactaaagcagattcagaatcttcaaagggtcatgttgtttattcaaggaaaagtctgaagtctgaacctaaatatggatcatannnggaattaaatttggtagagggtcannnntagctagttttaagttgtggtaatatatttgttcaatatataataccatcagaatctaattaaccagatgtattaaaacaaaaaagattctctgtttgaaatttgataattaatcatttgattaatatttggtttatgttaaaatttgtgaacatgtagatc

SEQ ID NO: 406 - DNA, 746 bp, Glycine max
ttcgtctgttcctatttctgggacctctttgtcttccacccaatataccccaggtgaagtcccttttccttcttttaagttttacttatcccctctcccagtggaaactctgtgttgcggtctaattttgtaacggttacttgcttgttactaggtggccttcttttcaagatgagtgatagcaacatgcagtatgtcacatccacctccttcctactgctaacatatgccaaatacttgacccaatcccatatgcttgttaactgtggcggaatcaccgtaaccccaaggagactccggacaatagctaagaaacaggttcgagaaagaagaagaaaaaaaataaactttttatgcagtaataatcgaatcatgtattatatgttcaatatatttgggagatattgattagatgattaaaaaaataataataataataataataagaaaagggtgacggattccaactttttccgttaataaaaaattacaaactaataattattatttgtcccataaaaaaatgggttcaatatattttaatctattaaaatgtgttgcttgatttcctattcttgttaattgaacttgattttttttttaaaataaaaataaaaatgtattttcaggtggattacttgcttggagacaacccattgaagatgtcatacatggtggggtatggtccacggtacccacgaaggatacaccataggggctcatctctaccgtcgattgctgtacac

SEQ ID NO: 407 - DNA, 677 bp, Glycine max
tgattatgtgactacatattattttcttaattattttttatacttgaagaaaatgcagtttctttggaggggtatttggctagtatgcatcctaccatatacttctaaattgttagtaaaaataaaggaaagcattttcttatccattgtatcatttgacgcagtctcactaagtgggtgcctccgccagttaagatgactagtagctacgtaagagacagcataaatgtttcaaggaagagaatggatgtggaatccttggacatgcttcagttccattggtatttaatccctctgtgttgtggttttttatctactgactatcacggttcaagcagcacaattcttcaaattttagggagaattagaatcataaccattaacattatccatgacaaaatcatccattttgcttctttactgaaatagtgaaaaagagtacttaatttccattatctagctaaactacttattaaaataattctgattctctgaagttaaggattcttgttacaattctcccctgtctctaatggatttaggtgggattattcgaatccaggctacctggatgcactaaaacacctaacagatttgaaagaagaaggttagtttcatttctgattaacggttacaaattcacttataagttcacgtttcttgcaaactacttctgt

SEQ ID NO: 408 - DNA, 360 bp, Glycine max
tatggctggtataccccaactcctgaagccagtgtctgaaactatccacgtgctagtttacattgagtaaaatgaagtgccagtgaagactatctgcagattttttccacctctgttcaaacattgtatgtagtcttctttggtgttggttcaaattggtttacagttccagacttcatgtgtactatcatcatgtagagccattgattttaacagcatcttcgtaattagcctttattgtactttttaccatattgttgtataatgcaatgcctccttaaacataatgatacttccactgtggtgaaaatttgattgctattctaatcttgctcatgatagcaggtgtatgtgattgtc

SEQ ID NO: 409 - DNA, 371 bp, Glycine max
ggtggtggtggtgggggcggatttggaggcgcgtctagggctgatgatgtggacaattgggcggttggtaagaagcctgctcctgttagatcttccaatttcggttccagttttcgcgattccggcgtggagcctgatcgttggacgagaggggatccgccgcgtgaggttgagcagcggacggagaggccaaggctggtgttggatccgcctcgaggcgatggtttggtgaatgagtctccggtgaaggcgatggataaggcgaatccgtttggggcggcgaggccgcgggaggaggtgttggctgagaagggtttggattggaaaaagctggattcggagattgagactaagaagacgagccgtaaaaa

SEQ ID NO: 410 - DNA, 373 bp, Glycine max
  misc_feature (289)..(289): n is a, c, g, or t
atgccattgatctatctcctgtaaatggcaagaagaggaaggagttatttcttaatgatgaagactattacttgtctgttaatcctccttctgatcggattccagatatagagatgcaaccaaccgagcatccctggttgaatgactttagtggggtgatgaagaatgtttgtggccctgttactgctgcaaaaactatttatgaggatgaagaaggttacatgattgttataagtcttccgtgtgtggatctttcaagtgttaaagtttcttggaggaatactctcantcatggtatcattaaggtttcttgtgtgagcacatctgggaagccatatatcaagagacatgataggacattcaagcttacaga

SEQ ID NO: 411 - DNA, 423 bp, Glycine max
taagttgtcaaaggagagggtatgcccattccaaaagaaccttccaagaagggaaacttaagaatcaagttcaatatcaagtttccctccaggcttacatccgaacagaaaagtggcatcaagcgattattgacatctccttaagcaacagcagtagctcttcctaccatttagctaacattgtaagatgtcagttattttatgcttggtttatttgttttcaaatggaaattgctgccgctgtgaactggatttcagttagaacagtttattagaggatgatatttgttaattgtttcgtgtcttctttagtatttggtagtgaaaattttcttaacctctttttcacttgtttatgtgaaaagtgcctgtgcaataattgaatttctttgtacttgcccattagtattattcttaccctcg

SEQ ID NO: 412 - DNA, 359 bp, Glycine max
tgatggtgcctccgagagtgttcgtgaaggggctctacatcggtggcgccgatgaaatgcttaaggtcgccgaagagggtctccttggagacttgcttgatggcttgcctagaaagaaggttggggctgtttgtgtgggttgtggggacttgaggttcttgccttgcttcaactgcaatgggagctgtaagactcttgttaaggaacaggggaggacggttgtggttaagtgtacccattgtaacgaaaatggcttagtcttgtgcccgctttgtacttgattactttttcacaatcatgtcatcactctcttcactgttcatattaacctgtattcctcctctcttctcttggtgatc

SEQ ID NO: 413 - DNA, 575 bp, Glycine max
gaggagaggctcttgaaaagggctcaggcagaggctgaaggcaaaactgttgaagctaagaagcctattgttgtgaagtatggtctcaaccatgttacctacctcatcgagcaggttgttttctgtgttattatcacttttgtgattgtagttttgcccctgtatttttttagtgatgttgattttattttttcctagcagaacaaagcacagctcgttgtgattgctcacgatgtggacccaattgaattggttgtctggcttcctgctttgtgcaggaagatggaaattccgtactgtattgtgaagggaaaggcccgcttgggaacggtaatgtttctttgtatattgtgattttcatactgtatgactgaattaaatgactgatttaaaacccacatgctttttaacaggttgtccacaagaaaactgcatccgttttgtgtttgaccactgttaagaatgaagataaattggagttcagcagagttttggaggctatcaaggtggcgttgattaaattaatactgtttcttttatgctgttgtaaaaaaactgattgtattgtgttttgg

SEQ ID NO: 414 - DNA, 358 bp, Glycine max
tatcatcgttattgtatcgtcgcagacacaacaacctaagcagaagaatagcagacaaatcaacaaccactgccttcatcagtttttacaaatcctcacaacatgttcatgtctctcttcagccacttcgagatcgcacaggcccagaagtggaggttttctttgtcccccgtaaaaggtacgaattccaagcccaacgcggaagccacctcttcctccgcagagtccaaaaccgccggaaaagataagaatccatcacaacccggtgggcccaggtttgcgccggagttggatggactacactgcttcgaatccatcgtaccctgttagatgagatggattccttacacctccaatc

SEQ ID NO: 415 - DNA, 819 bp, Glycine max
  misc_feature (44)..(44): n is a, c, g, or t
  misc_feature (46)..(46): n is a, c, g, or t
  misc_feature (669)..(669): n is a, c, g, or t
  misc_feature (691)..(691): n is a, c, g, or t
  misc_feature (703)..(704): n is a, c, g, or t
  misc_feature (732)..(735): n is a, c, g, or t
  misc_feature (738)..(740): n is a, c, g, or t
  misc_feature (751)..(754): n is a, c, g, or t
  misc_feature (764)..(765): n is a, c, g, or t
  misc_feature (776)..(777): n is a, c, g, or t
  misc_feature (790)..(790): n is a, c, g, or t
  misc_feature (799)..(800): n is a, c, g, or t
atgtaattttctcttgagattccctggcaatattatcaaattcntngactattgaatacccaggatgcttatgatgccaaaataagctattatactaggatggaatttatgtttttgcttattgtagtgtatagcatagatatttctcagtataatttttagttgtttttgagtgcatttaacaattttaacttgctcaaatatcttttgtatattgcagtacgtattagcactaagtgttcatccacttcattgtcaaaagtgaaaacaaacacttcctattcttgtaaataaaacaaacttaaaagaaacaagataatacaatcaatcttaaggtgtcctccactccctgttttgctatctcgtaagtgataattaaggaaattttttactttagttgtcttgtactaatcatcattgatgagtagagacatgcatccactattttcacttttcaatgatgttgagatacttgttataaaatccttgttttgtttggtaatgtctttcacctgtaattccatgcaaatttcaacaagttttcaaactgaggaattgcccatttcttgcatgataggtacttgtcttcaggtaatttgaaagatgcgaacatactaatggaagagataaagaagcaaactgaatcggctgaggttgcatttcctaagncagagttgatgcaatttatcgnatatcttttgcnnacgtaagtttgtatgttgctcaaccaannnntgnnncatttctgttnnnntgcttcaatnnaaaggggactnnaagcactatattnggtgaaaannaaaattttatttgtttctg

SEQ ID NO: 416 - DNA, 583 bp, Glycine max
ccaaatgatcgtcggtttcggcggcagtggcctcggccaggttgtcatcgccgtcgccgtctctttcctcgtccgcgtcttctccgctcccggcccggccctctcgccggagaacgaagctgacgacgtgccggagaacgattccgacgacgcagaagctccaacttccggcaaggtcacgccggtcacaatccagtggagaaacatcaattgctccctttctgataaatcttccaagtccgtgagttcctgtttccttcttctcgtgaatgctagctaaaatcctgttaattaagctagagtacaagctttggatatatatcgtaactaatcttttaattatttcgttacatgcactgcacattttggttcaacctttgtaatagttgcttaatttgataggggatttgtagagttttttttttaaaaaagaattggtgatgattggaaggtgatgttaaatgaacaggcgaggtttctgcttaaaaatgtgagtggagaagctaagcctggaagattattagccataatgggaccttcaggttcagggaagacgacgttgcttaatgttcttgcgggtcag

SEQ ID NO: 417 - DNA, 412 bp, Glycine max
cagggaaactcaaagcctcaattttcacagcaggagttgtctttccttttgaagctcattccacagttgatacaaatttgaatagcagaagagaagaaagacatttcttgaggctttttaattaatttcacaatatgtactgtgtggcccttcacaaaatcagtggacccccttggagggggtccataaaaagcttaacctttgtacatatatttcttcttttcactttgtagatataaaggaaagaatgattcatgtgtcaacttactggtttggtggtcgccatccaaatatacttgtcagataatgcttttcattgtttcaaaattgttacactggcatttgtctaccactgcaatgagaaaatacggaaacttggcctcttcctgtttgtgttcttgccgttagattt

SEQ ID NO: 418 - DNA, 688 bp, Glycine max
gagctgtgaaacttgctgatgatatcaatggcatgatttctgaacgtagttcgtttcctgcatctggaccagaaacccagcgacatgcttctgctataagaaggaagatcacgatattagggaccagacttgatagcttgcaatctctgttgtcaaaggtccctgcaaagtgagtgttcagttctttcctatgctgattaagaaaagttcatgctattaccgcagagcatagaggacctggaatactatggcttttagtcatctattcttttcgttttgaaataaatgtcttgaaacctcctaatctggactatctctttcatatgaagttgcatgattcttattttaagtgtttctttgtcaatgatgcacagaactgagaaggagatgaatcgtcgaaaggacatgcttgcaaatttgaggacaaaagttaaccaaatggcttcaacattgaacatgtctaactttgcaaatagggatagtttgctagggccagaaataaaatcagatgcaatgagcagaactgttggcctggacaacagtggactagttggtcttcaacggcaaattatgaaaggtctttaatctgaattgtttgaaattgaaaaatattacctgtagtctgctgtttggatctaaatttggaaatgtgctattcaagcagagcaagacgatggccttgagaaat

SEQ ID NO: 419 - DNA, 449 bp, Glycine max
ttccgcctcgtgatgatgatgatggtggtggtggaggaggtggaggcggaggcaactggtctggtggattcttcttttttggctttcttgcttttcttggcttcttaaaggataaggaaactgaagacacatacagggatgaccgaagaaggtgaagaattgaccaccacaaatgcatgctttgcttggagtattttgctgcattatccttgatatcctctctcatatatgcataccgtagattacattggtccactgaggttctgtgcttgcttaagataatgtaatgcgcagaattttgtatgttacaaattcaatcccacttgaaagtttagtatggaaggaaatactgtgatatttagtatcaaattacatcagcatagtagttatgttttttgacttagatagtacaaattagcttttcatggtccttgagaggagcactttgt

SEQ ID NO: 420 - DNA, 407 bp, Glycine max
ctcctaatgcaggtggtggctatggtcctggtggtggtgtgcctcagaataactacgcagggaacatgggagggccaccatcaaaccagaacatgggagggtttcaacaaaattcaggatggtcgaacaatgctcccagtagagatgtgccaagcagggatatgggaggaccacctggtgggaacccatattctgggtgagatcactgcagatttttctagccaatgtagataacgaagaattgtgcccaagaaagcagagtttatgctatgtttctcaaggaattagaatttattagtcttacgtgttactcctattttctaatgaacctgcatgttgtgcatccgaagttcaatttttttaatgctagatacgatcattttgtttctattgtttgtgaggttgaa

SEQ ID NO: 421 - DNA, 297 bp, Glycine max
cttcctagacattaatacacatgaggccatgaagattgcatgcatttagtaagtgatacatgaaaacacacttctaacacacaactcaaactaatgcccattaattaatttttaaataacgactaaaatcacaaacaaaacagaattctaatacaacaaacacaaaaaaacctaggcatgaaatatgtaagaaataatcactagaagaaacatctacaaatatacattccttatgtttcaatcatcttcaacaagagcaccaatttgaagtgattgtagagtctttcaagcctccaa

SEQ ID NO: 422 - DNA, 399 bp, Glycine max
ttattgtgtcatgtatcatacgatataaaaacatattcaattttttaataacggtgtgcaaccaaatatagggttgtttagaatggttgcaaagacttgaattccttaataagtccttattgtatgaacagccaaaaatggctagtggtttgccaaaaatatttgtactttggtagtaaaaaagagttgaagagtgttttgttttacctttacatggattccaatgtacttaaacaaagaagcaacaattcatttctattgagtaaacgtgtgtttggatggttgtaaacagaaaaacaaacgcaggccaagactttgagtcacaataatacgagccaataatactctaatgatattaacatgttggacgtacatgaggtaggttccaagagtttccat

SEQ ID NO: 423 - DNA, 351 bp, Glycine max
cagtgtccatcaagatatgccccacaatggaggcaaagggcaatactagggcacaccgtgggaaaccctagcggggcaagtgagaatacaactttgaaggtgtaagtcactcgaggagtaataatacttagtatgaagatcttaaacgtttgaataaccgttgtcgttgttatgttgtcttttctatatcgtatattaccgagcataggtgtgcatgctttgagaataagagccttgctaggctagaatatgaatatcttcagcaattttattatagatgacttgtgtattgtaagtgttacgactttgtacttttgtgataccacatgtttatgttctccgttcatggat

SEQ ID NO: 424 - DNA, 381 bp, Glycine max
tattggtggtctactgggtaagctctgcgaagagcgcgggatccaatatgagtacggcaccggcagattggagaaccgctcgtcgttggaggcggacatagcggctgtgaagcccagccacgtgttcaacgccgcgggtgtcacgggtagacccaatgtggactggtgcgaatctcacaaagttgaaaccatccgaaccaacgtcgtcggcactctcaccctcgccgacgtctgccatcataaaggcctcatcctcatcaactacgccaccggctgcatcttcgagtacgattcttcccacactctcggatccggcatcgccttcaaggaacacgacactcccaatttcaccggatccttctactccaagaccaaagccat

SEQ ID NO: 425 - DNA, 358 bp, Glycine max
caaaattggcatggcatggcatgaggcgcacaaatgtgttacaatatcattgttccatttttaaaagtagggaaattgttactgaatttggcttggccacacaatggataggtgtttgtacaagaaaaaagcagctacaatatcattatcactctaaatgcaaatcacaaggcttgaaaagtatactccaattgccacattgaactaaagacacctaaaacttacatccacacacttccatgccatgtaacatttatttaaaaatgagatttaagttcattaaccatagacatacccgaattttggctggtcagaattaaagtcttacctacctacagttccgagggctccatcaaat

SEQ ID NO: 426 - DNA, 346 bp, Glycine max
agagactttccactccctgcagtggcttcagtcccttaccaacccatcaactttgactacctgcaagaggaattcagtggacatggagtcacctttgaaggagttgaagacagttgtattgccaagatggagctgaaaaatggaagcattgtgaccatgatgctgccaagtggattgatcacctcatacaaggcccctatgtggcatggtggcaagttggagttgcttcataccaatgtgtcagagggagagtatggtgatgccatcattcaaggaggggtgtctctaaacttcaattttcaaactgatgatggtgaattttcttggtctccaactaattgggtta

SEQ ID NO: 427 - DNA, 605 bp, Glycine max
  misc_feature (443)..(445): n is a, c, g, or t
  misc_feature (458)..(464): n is a, c, g, or t
  misc_feature (472)..(472): n is a, c, g, or t
  misc_feature (474)..(480): n is a, c, g, or t
  misc_feature (482)..(498): n is a, c, g, or t
  misc_feature (506)..(523): n is a, c, g, or t
  misc_feature (527)..(532): n is a, c, g, or t
  misc_feature (547)..(570): n is a, c, g, or t
  misc_feature (573)..(589): n is a, c, g, or t
  misc_feature (593)..(602): n is a, c, g, or t
tcagaaaaaaagtttctaagttaaggaaatccagagagacaaaaatggccggtgacggtgcagctacatgcatagacatcctccttgccatcattctccctcctcttggagtctttctcaaatatggctgccaggtactaaattgcacatatttttcttttcagaattaaagatttttacacaaaaaattggttactttttttcattgcatgttaatggattgtagagtgtggtgactaatacaacacatggttgatggaaatggtaatggtgatggtaattaatttgttggatgcaggtggagttctggatttgtttggtgctgaccctttttggttatatacctggaattatctatgctgtctatgctatcaccaagtgatcaccctttaactttgtgtaagtgacccttctacttggaagagccttatttttttttttcnnnaaaaaaaaaggtnnnnnnnaaaaattngnnnnnnnannnnnnnnnnnnnnnnngttttttnnnnnnnnnnnnnnnnnntttnnnnnnaagtttcaaggtttnnnnnnnnnnnnnnnnnnnnnnnncannnnnnnnnnnnnnnnnaaannnnnnnnnnttt

SEQ ID NO: 428 - DNA, 404 bp, Glycine max
agtgataagccttgtgtcactggctaatgctggcttctcagagattagagggaagcatttgaactattcaaagttttggaatgctaatccctctgcagaaaagcaggtcaagttgtctagcaaagctggcatgcttttgctgtacactcctgcttttcttgctggccttgcatccttctggatctttcctcaccaaggcctcagatccaccctccttcagtctgcagttaccctgcatttcttcaagagggtctttgaggtatgtaacttctataatagataaaaagatcaaaatacttaattgattgggttatgggttatgatgggatgaataataggagacttttttggcatcaaattgttctctctcttttcttttctttttttttttttttaaaaaattt

SEQ ID NO: 429 - DNA, 685 bp, Glycine max
gtattttttaagattctgtgtaccaataaaaaaaaatctgagaaaagttgttaggcgcctgttagattcagctatgttgccatggaagttcaactctggcagagaaaatactttctcagctatgttgcacattggcccttgtctgtattgcgatcatcgaattcccaagctcctgcaccatttcagttgaaagcagataatacagccaatgaaatgtaccaaacaggcaaacactaacaatagtagtagtgccaattatgcatacctccttgctgtcaacacagtaccagcttcactgtcgcaaccttccctcccactgtgaatttgccttcccccaaatacgaaaggcgtttcctatacactatttgtgtcagcaagaagatgaatatttaacgactatgatgaatcagtaaaagaaaatcataggctaaatgcattctcttcaggcagtgctatctattaccttcacatccagatgaaaagaacttcttatattttcttttgaatccttgcacccagaaacaaataactcagtatgataccaaagagaccaataaaaaataatacacgatagtcacatttaattcaaaattatagaaggaaaacctctctgaacactctggaatgccgaagcagtttcaactgagatccattatttgactggacttcggatgttagggacatc

SEQ ID NO: 430 - DNA, 655 bp, Glycine max
ggatggtgagaatatggcaacatacccctatgagcgcctgagagtggtttctgctaatccagtaactggcattgatttgaccaagagagaggtactgtctgaactcactcaacagtcttgctagcatcttcaccttgctttttcttgctcttggaggatcaatttgaaaggccaattaatgaaattgtctatacattatgcggaacttttattatatgagatatagatatgcattcactcttttcatgctagacaattctttgttttactctctatgacatttgactggaatctacactttgtgatgaatttaggtatatttatctaatgaagagttccgcgagaagtttggaatgccaaaatctgctttctataagcttcctagatggaaacaaaacaaactgaagatgtcactggatctattttagagcaagaccaactaatggctgtgttttgtggcactatgttacaacattttaggatgatacaaattttacctcatttgtgcattaagcgtttgagcttgagttgctcacctttttgatatacgagtcgttgtatttttaccaacttactacatatttatctcttcattttatctcataatgtaatattataaatatgatgcttttggctcatgcaagtggaactatgt

SEQ ID NO: 431 - DNA, 381 bp, Glycine max
aaaagattaatttgttttcgctcttttggtgacatgtcaaagtagagaaataataagtgagatgagtctggcccattttcaaaattttcatcattatagttattattatgattatgatactgagaaagttgggggacctgaaatttggcgtctacagctatcacattgctatatatcttgttttgtttggcaaaagactgcagcatttcactacaaattttgctgtttgtaagatgattgaattgaaattttttcctgttttctgcttatcttttcaactttcctttgctaagtgtatttgagaactgagcttgaggaatgttaattgcatagtcgaattttgtaagccatttatttacactgatgcaaggtctacacaca

SEQ ID NO: 432 - DNA, 1629 bp, Glycine max
ttaatttaacatttaagacttgttggcaaggattatggatctttgtcaagaaaataattctgttcttgatgcagggaaaacatgtttcatttattatagggaaaaatatgtttttgttcccttcggtcaaacttgattttggtccttatacttttaaattgatggatttagtccttcaacttttggaaaacatgtaaatttagtcccttttccaactttgtggcagtcaaaaactgtcactaaatgttaagtttaaatgtgaggagggactcaattcacatattttcagttgcaggactaaattcatcaatttaatactatagggccccaaaccaagtttggccgaaagttcaagcaccaaaaacatattttttcctttattttttttatgctcacattttcccctttattataacttaaccttaattttcttttccagctggtagtggccattctttcgttccaactcctttgcaaaaaccataactgattcctgttgaccagtttcatgttccctgttacaactgacagagaccctaaaacaccagttttgaaacttgcctctctttttcttgtagtatgccactgtgtgaatgagaacatattaaaaagatgatttattccttcaaatgttcaagtgtattgtccagattccagaaagatttcacccttcaaatatcaagcagtgttagcatgtgctgtctatcttccttatttctcttgttcccctagttatttccaaccaaatttactcttacaaaaattatctcgggaaggacttgatatgtttgttcatatttagcataaagttgttatatttacccttacatttttgcaggtagacaatatagaagattgctacagtataataaaatcaaagccaaaacctcttgctgcatatctcttcacaaacaatgagcagctgaagaaggattatgtggataagatatcttctggagggatgctcatcaatgacgccgtcatccatgtaaatattctcttcctacaatttatacatgaaaaattgttgtatgctaacataattttcttcaattatggtcatattttcataaatcaattgttctctgatagtgccccatctgtagagggaaaaagaaaagttatgctctctttatttggcatctttcatttgcatacataaaatgattcaacttagcatgagagaaattctgatggttgaatgatataagttgactttaaaaacaaagtaaataataaagcacttgatgaacttgggcctctatctctagatgattaagactttgcaacctaatttttaatagcatgcaatgaaatgcaacctgaaaatccagagcacatatatttatcaaatgaaaccaaaacttaaaaatttaagctagtatatacatgcatttaaatgtgtttatgtgtagacacttatctatatgcatgcaggttgcaactcgtgggttgccttttggaggagttgaagagagtggaatgggttgttaccatggaaaattctcttttgatagtttcagccacaggaagtcagttctctatagaagttttgatgcagattctaccattaggtaccctccgtatacacctcagaaggaaaaattattgaaggcccttattagtggc

SEQ ID NO: 433 - DNA, 647 bp, Glycine max
actctcattatgccagcattattaaacatgatatcgagtttgccatacttggaaaccgctgtgttcacacagttttcaacgtcgttttcgtttgtgacatcgcaatggacataggaagcggattctaactctttggcaacagagagacccaagtcgtcttgaatatcagctatgactacatgtgctccatgcttagagaagagtcttgcagtggctgcacctagaccactcgcaccaccagtgataatcgccaccttcccctcaagcctgcatggcattggcatgttatgctagcaagtcgtacatattctattttaggtctgctaattagataaatttattcaaacaaatatttctaaaagaaaaaaataataataaaatgaaatatacgttatttcataagctaaaattaactcatggagaaactcactttattttctcttcttatttttttgtttgagagacaattttttgtatctacttatctatctatatgaaaataatgaggagaagttaaaactaacttccttaccttctaaatggagctgaaaccgaagaaacactagccatgattgagtttttcaagatatatgtagacaaggaaataaagatatgttttagagtgcttaattaattgcttatgtggt

SEQ ID NO: 434 - DNA, 1121 bp, Glycine max
tttggtactactgttttcccttctcagccttttgcttcttcttctggtcatttatttgttcagacttcagagaatgttatgtggaaattctcttttaacagattattaaggcgcttaatctttataggaagaagactggcagcgacaagtacttttgggtatgaagtaacgatgtttattttcttcctaatttttatgattttgaattaaaaatttcatgcttctttgtttttcttggaattcaactcaccgcatgatttaatgtgtgttgtgtatattgatgttgttttcagattcatcttgataaacgggtgcctactggggcagggcttggcggtggaagtagcaatgctgcaactgcactatgggcagcaaatcaatttagtggctgtcctgcctctgagaaagaactccaagaatggtcaagtgagattggatcagacattcccttctttttctctcagggagcagcctattgcactggtcgaggagaggttagtccaaacattaggtaccttcctttcttgaagtcagatttgagaaaaaccgcaagatgtttacgtcttatatattgctatatcttgctgtgtggattcacaatgtgtggcatcaattgataatatcttacaattctgattaattgctataattgtgaagagctatgccactgtcctgcaatacaacttaaagaatcgtggtacaaatgtttgatagtcattcactaccgattaaatatcaaccaccaacacacaccaagtggatccaacctttacaattgttagttaagataatgtagattgatctttattcctgaaacctttaattatttattacagacatcagatcattttgtcatggatgggaagggatttgtttgttcctaaatatcccttttaaccttttgcagccagctaaacttatattccatatgatttcccaatcaatatattttatccaagatttttctttcacttatgcaggttgttcagaatattcctccaccagtatctctggatgttccaatggttctcataaagcccccagaagcatgttcaactgctgaagtctacaaggtatttgacttttaggggtagtaatgaaaccatacttcccccctccct

SEQ ID NO: 435 - DNA, 723 bp, Glycine max
  misc_feature (25)..(26): n is a, c, g, or t
  misc_feature (47)..(49): n is a, c, g, or t
  misc_feature (553)..(555): n is a, c, g, or t
  misc_feature (628)..(631): n is a, c, g, or t
  misc_feature (651)..(653): n is a, c, g, or t
  misc_feature (661)..(665): n is a, c, g, or t
  misc_feature (692)..(694): n is a, c, g, or t
  misc_feature (696)..(696): n is a, c, g, or t
  misc_feature (699)..(704): n is a, c, g, or t
  misc_feature (706)..(707): n is a, c, g, or t
  misc_feature (713)..(719): n is a, c, g, or t
tgagaaaaaggtgataaccaacggnnggaagatcttaccttactgtnnnttttctatccataacataaattaaattcccagcaaatctctatcatgtttcttccttttgtgattccttctaaatgcctaaatagttttaaaacattattatctaacggtaaagaagtttgtaatgtatatatgctgtgtttgttatcaagactaacctttgatgttttaagtgtctcaagtctcaacatttggtcagaggattcctaatgattccgaagttatactatctactcaatagcttatgtttctttttctttggtagcatatgatccagaagaaaaaaaaaaatatttaacatactttttgttgctgaatgggcctgaaaaattgacaaaatcttttgtccccttttttcttttctttccctaaaaatgaaatattgtaactgattccttcttaaatcttaacaattatgctaaatgcaggagtaaaattgacgggatttgtgagtggttttaaaaatgcattaagttgaaaggactattggcccttctatttgagnnntttggtgttgtctaaagtatgaatggggtgtattgcatttactggtaccaagcaatcggcttttttcaataannnnagtgtgtttatctaatattnnntgcatacnnnnngcactggttaaggggttgattgccatnnntnttnnnnnntnncagttnnnnnnncttc

SEQ ID NO: 436 - DNA, 1078 bp, Glycine max
cttctccgccgccgcgccacccaccatccccgccttggggttcttcttcactcctgtttcaaggtcccttttcatttatccattccatttaattgcaaattttgggacttgggtttgattcaaattttcaaattatttttcttttcctcagttatcttatgggaaccgattgaaatggaggtcacaagtatcatgtcgtttaagaaggtttattattttgtagaatttcgcttattatgatcatgtggcgtagttgatcttcctgttactggattcattgctgctttgaatgctgattgatgatgggaatatgaaataggctatggtgtttgagatgtgtactcgatttgttatcacttgtttgaactttctccattctggttgatgaggctttctcttgtggcttctcaatcttctttttgtatattttggtttatatgaatttggatgtccatcagaatttggtttttaaccgagcctaatgacatcgtgtaattcatgtagtcaacttcacctagtagaataaggttgttgtgttgtatgaatttgagcattggtgttcttttgatgttgtggtagtgttccctgactctgttgtcccctttgctgatcagaaactcgctcctttaactcatgtgtttagattgaaggattagtggtgtcagagatgccttcaactcaatgggttgaactatcttcaactatcaactggcgatttgacttcctcatgttcaactagtttctccttctttaatgggggaggagatggaggccgctttggaaaggctgggatttccaactccaagatgtctggtaaagatccatttaatggaaggaaatggacagaaattctccttgctgccaatgttttgtaagtattagcatattcccttgaatagtcaatcaagtttatgacttcaatgtgtgcatttttctgtaagcctgtaaattcaagcagtttgtacgatcgtttttggttctgtatgttgctgtttctgttttactagctgatcttattgttgttgcaaatttacatacaacttggtaagattgcttattgtttactgattattgcaca

SEQ ID NO: 437 - DNA, 389 bp, Glycine max
  misc_feature (361)..(363): n is a, c, g, or t
tgccaaaccgagatcagagttagcgccaaggaaacaggaagacactagattgtaatgaagatccaatcaaaggatacagtagccatatgttcatcttggattcttggtgtgcaataggaagaatcattgcagcattgtacttgacattttataaaagacccctacttgattaaagttttttgcctcccttattttccaccccactgacactcttaggattcagcaatgaaaactcttttaagcaccacggccatttctgcaatatattgccaaatttatgccatttgtgcataatgtactcgttgacaatgttacaaatgtcaatggcgtttcttgaagtagttgttatcaaaaaggtgannnaccgggggtgtgggtggggtggaaaa

SEQ ID NO: 438 - DNA, 503 bp, Glycine max
cactttgatgttttctcttggactaggaattctatgtggtaagtcgtcttcaatttgatttagattttcaccctgcttatgtgattgaatatcttatcgtgtgccaattaagccccacttcttcctattgtcctgcataaagccttgtgtccttatctcctgaatcgggctataatgtttctttaatgtgcaggagctgtgggttttcttggttcaaatttgttcgtgaggaggatctacagaaatatcaagtgcgattaaggttttgagtcagacctgagcacttccataggtttgttgctgaagacaataaatttttggaggaagcctctggtcatgtgtggggaaacctaacaatgtttacaggtgaatccacagggttttgagaatgaggatgtattatttttctatattggggaagccctgagattttttttccccggctgtaattgattgtctttataattttagataagtagtacaatattcaactcttgtgatta

SEQ ID NO: 439 - DNA, 1058 bp, Glycine max
  misc_feature (634)..(640): n is a, c, g, or t
  misc_feature (646)..(650): n is a, c, g, or t
  misc_feature (738)..(738): n is a, c, g, or t
  misc_feature (854)..(855): n is a, c, g, or t
gtaacatagagtaatttggaataactggcttgttcatccaacagttttcttattgattctcttccataaaaaaaaagtgtacctttgtcatggactctttagtttttgtgtttggtggctgtgtagaaatgttgtcctattgtattgtacactcttctgtaaattttctttatttatttctaggtaaataatttctttggattgtgcaagtacttcctgtcctggatttgatttttgactgagcctaatggcatcatgtgatccgtgtaactgacttcacattgtgggataagactatagttgttgcttctgctgcaagtccttaccgtccacttaaatatgcttgaccctccaatatctgttgcatgctgtatgctttgtccatgaagcaaagtgatggagtagtgtatgatttgcttggacttattggtggtttgctttcattttttcagattattaccaccttcagtgtagtggataacataaaacagcagttttatgctcaacaggggagaatttccaggttttgtattttctttctagataactttatggggttgctttattaacttgagaatttgacagttagttggttcaaaataaatataatttgtaaatcctgcagtaaagttgnnnnnnncctgtnnnnnaccattttgttttcttgctgtggaacattttatcatttattgaaatacaagatgtcataaattccgtttccttgtatagaggatcagngttgcatcaaccaccttgtactacattatttccttttagcctttgcttattgggctcatgaatccaggaaagatgaagagagagttaaagagctgtttgaagccattgaaaagttnngaactcaatttgagtctatagagagaccaattcttgaaatagagacccctgcaaaggctgaaacaccaccttttgagaaaaagtctgatgctactccttcagtttctgttccagctcaaggtgctgcagctcaaggtatcgagctttcaaagccagaaacggatgagctgccaaaatcaccttcagttaagacagaccagata

SEQ ID NO: 440 - DNA, 920 bp, Glycine max
  misc_feature (865)..(866): n is a, c, g, or t
  misc_feature (871)..(871): n is a, c, g, or t
ggattgtttctgcgagaagacttggagccacacccctcagttccagattgggtactgccaacagtgccctgataaggttcaatggccctctcactttggttccaaacctcctctatatttcaatgctggcatgtttgtttatgagcctaatctcgacacctaccgtgatcttctccaaactgtccaactcaccaagcccacttcttttgctgagcaggtatatatatgctcaattaatagcatgcttcacattaaaagaaaataaaataaaaaaaagttaaacatatgatttagtccatcagcatgtctagcattatgaaatttctcttatacggataaatgttactagtttggtccttagcactgttaaccctcctgtgtattcttaatttagttccataagtatagtgtattcttaatttagtctctctttgtaaggattggattaaaaaatttatacatacaggaaacaaattaaaaatatactacatgtataaggatatgcgttataacgtttgtatgtataatagggatgggtataatcaagtttttgatatacagagactaaattgagaatttgttagaatttgtaatacatataacgaaaaaattaaatatttaaccaaaactaatttagcatatatgagtttcaaagtgtaattgtgaatttgttttcatgtgttggtaggactttctcaacatgtacttcaaggacaagtacaagccaataccgaacatgtacaaccttgtgctggccatgttgtggcgtcaccctgaaaatgttgaacttgataaagttcaagtggttcattactgtgctgctgtgagtgttcaccttctcactatagattcattgaataattannttttnttgtttgatttttacttggtaataatgtttgttttttcatttatgtaca

SEQ ID NO: 441 - DNA, 376 bp, Glycine max
ctgttcctgtgcaagatgatccacatcatcacttctatcaacccacatctactaatcctattcccagtcatgatccgatagtcaacaatggattggggggcatttcttcaattgaaaatgtgcagcagaatgctgcagtagtgctaggtgggaacaagatgggtcaaacagcatccctgcagcgggtggctagcttggaacatctataggagcggattcgtggtggacctccatctaatggggagcagtgactaattagccaaatctcctggatgctttgccaggaaattattctaaaacagttatttctgttggttataactagaggcctattcttctggaatacattgtaattcaattgatggggcacatgatg

SEQ ID NO: 442 - DNA, 505 bp, Glycine max
  misc_feature (396)..(400): n is a, c, g, or t
aaaagagaactcttcactataatttgtttgatgattaacattgaaatatcctattcaaatagatgtaatgggttaccattttaacaaatcgtcggtagcaaaaataactaataattagccaagtaataggataaccagcaggagttaaaaggaaaactacaacatatatgtacaaaaaatccttacatatgatataataatataataatatatacaaggtcagatttcattacttagtttcatattattggccgtttccttccactttctcttctcatccaagctctttaaggtgccttttcatttacaacctgactcttgaaaaatgtttcttcaatcctcaacttcatattcttttgattcctgctatatttctgagcaggcactgaaaaaaannnnntcaccaaatagcatgcctaagcgtattaaaaaagggcgtggctttactgagcgttatgcctttgcacgaagatatcgcactccatctccagagcggtctcctcct

SEQ ID NO: 443 - DNA, 895 bp, Glycine max
  misc_feature (884)..(884): n is a, c, g, or t
cccgaacttggttctgcccaagaacttgctcgtctcgctactcaatacaaggtatttttgtcaatgtatcaaccctcagttaccatactacttttaaaatcaaactttttcctactaaattatacttttaaaaaaagaatatgatcaaatcggtaatgtaacattcctattttaaacatttcaattatattatgatgccgtattgtatttcgaagaatatcgcataacaaactctattaaataccatgtaaaataaagaattaaataaaaactatgcctgttagaccttgagactgaaacgcaattttaaaataatattaagactacttaatgaattggatctgatatggcaacagagcatatggattcagtaagagcatctccaatagtattcatttaagcaatcctctttagattcttaactgggtttgaaagtgagttccagtgtgtcacattacattttactccaatagtgcaacccattaattgaactttttatgaagcttctgttttggagtgtattccggatactaatgcatggtgaacaacaacacagattatatcaaatgaacaggcaaagcgtctgaacgctgtgcaatcaagctttgacaatgcagacacaatagccaaagcaataggcaatgccggcaaggtggttgtcaccattggtccgacagagaacggtccaaccgcagaggtatctgcatcagatgccttgcaagtggttcaggcagcacagctggcaggagtaggccatgtggccatcgtctatgacgagagcagcactggggcctcaacctacaatgtactggatggcctctcatccttcttcaacaacctcttctccaggtctcaaccgttgaccatacaagagttcttgcagnaagtcattgaa

SEQ ID NO: 444 - DNA, 469 bp, Glycine max
atagagcttcaccctgagacccctttttcttcagataaatggcgtcaatacctcactattcaggtatctttgtattggatattaaagccacaaccatggcatgatcttcatgttaattaatctttgatccttttttttttctgtgtgtagtcagggcagatacagttgtgtaacacaagaacaacaacagagaaccccaaaaaaagctccgaagaaccaccttcttctcatcacatgagtttaaaccttgagctaaatttgacgtgtgaatcaccgaggaaaaaagaagaaggttatggttatgaaatgaatgagaaaaagagttctggttcttcccctgggggtttgagtgaacgtgaggatctgtgtaaaaaagattcagatggtaaaattctttctccctcgtggttgtcatcatctgaagatgattacaaagagatggttgcaacagtttgcatgcgctgccaca

SEQ ID NO: 445 - DNA, 343 bp, Glycine max
cattgagagtgtgccagacttgaagtcctatttgggtgccaggttttctctgaaggccggggtgaaaccacatgagctagtcttctagaggaaagaggggtgttactcttgtttttgatatcgtgtttgtttattgatgctggttcttatagttgccctcttataacattcttgttagcagacaaatgaagaacctaaaattttgttagtcaaattgtgacgcgtgctctttacattttgttgattgtgtgaattttagatattgtgtggacctttagcatgccaaatgaaaaaaaaattggaaacagatatacatgtggcaaggctggtgaatggtacttgt

SEQ ID NO: 446 - DNA, 584 bp, Glycine max
agtagttctcccacatgcaaattcatgaatgcgcattcatacatttcaaagtcaaataaaggattcaataaaagagtttaataatctgtacgtattaaaagtcctacagtcctacgtacacatgatgatttctgattagttgaggaagtcgtacataacttattttttctaaatatgaaaatgttttgtatgaaaagatttttgtgacattttgttgttgttgttgttgtgaatatgaattaggatccaaaagtggggaattggtggatgagttttggtgacaacacattggtagggtattggcccgcagagctattcacacacttagcagaccacgccacgatggtggagtggggaggagaggttgtgaactcacgaaccaacggccaacacacctttacccaaatgggctctgggcacttcgcagaagatggtttcggaaaagcaagctacttccggaaccttcagactgtagacacggataacaatctgagttctgtgcagggcatctcaaccttagccgaaaatacaaactgttacgacattaagagctactacagcaacgaatggggcacctactctac

SEQ ID NO: 447 - DNA, 456 bp, Glycine max
gccgtaagcgtcagcgagagaaagtactaaaggatccattgaagtcccataagcctgaactacctatgacaggtcctggctttggtggacgagttggtactagtcaaggaagcttactgacccagtatcttctaaaggtttgttgtttgagcgcatttcttccgtattatttttcttgaatttgcagttttcatgctttagattgtgacagtggaaggtacttacattttaatgtaattgcagaaaggtggtatgatcaaggagacatggatggaggaagatccaagggaagctatcctgaaatatgctgatgctgcagcaaaggatccaaagttcattgctccagcatatgcagaaacccaacctgagccagtttttgcaaagtcagattctgaggatgaggagaaatgatcgggttaccaagttattgtatcacaaagatggctaacaagggac

SEQ ID NO: 448 - DNA, 549 bp, Glycine max
gatctggtctatattaacctcctttggggtacatcccaatgtcaatcttggtacaagttgaaactttatggtcctgaagctatggaattgtgtaaacctggtaaggaagaaaaaaaaacgttgttctttgtgttcttttttcttttacattactaatacaacaaaagcatttaatctttatagccaatatgagtgcctttgtgtggtttatgtagccaacctcacttagtgagaaaaaggcttttaatttttgttagtgtagtactaatgcaaatgtgaaaattggtgttttgatggcagacttggaggagagaatgaaagtgttggcaatgagcacaacagaagaagaagaaatgggagacacttttgctgaaagagcagaaacttactaccaaaagaggcctcagctactgtcccttctgcaggacttgtacaatggctacataaccttatctgaccgttacatccaaacactggccaagcacaagcaccatagtagacactcttctcaagtttcaactgtagatgaaggcttctctgaccaagaag

SEQ ID NO: 449 - DNA, 539 bp, Glycine max
tctgagggtggctcctcattttggttgcaagagcagcccatttcaagaagaccacactcctaattattggtatggcactgtagcagggaaagataataatgaggggcgtacaatgatttcaaagaaaaaggatatgttacaaacagcaaaagaactgaaactttttgacccaagatgttctgatggagcaaaagaacctggtgtgggatttgtgaagaggccgtgtctatttgttgtgaaggatgatctggaagtgatacaaatgacaactacttctagcattgagtatctgaacaatctgggggatgatgtcaagttgggtgatttggaggagcatttggtggaaatcaggtcaaatgaggtaatattcacaatccgctcttgacaacttgttctttgttgctgccacaatatcgacggtttgatataatgaactttgtataatatttcttccatgttaccctctatgcccttttcaatttttaagtgacgtggattgtgcctattttggtcaggtaatgaacctgttgagggcttct

SEQ ID NO: 450 - DNA, 388 bp, Glycine max
cctagtccaggctcttcttgcttaccgagccctcgcgcatccccctttcctccaaacccaaatgctgatggcaattctctcattccatggctcaaaaacctttcatcaggatcatcatcggcatcctcttccaagcttccgcagctgtacattccgaatggctccatcagtgctccagtcactcctccaatcagctctccatcatcccgaaagccccagatcagagctgattgggaggatcagtccaattgtccgacagcgtggggcggaccggcatacacctttgtgccctcttcaactcctccaagccccggccgccaggttgccgaaacagattggttttccaagatcaggattcctcagggaggactagcaccaacttctccaa

SEQ ID NO: 451 - DNA, 681 bp, Glycine max
  misc_feature (661)..(663): n is a, c, g, or t
  misc_feature (665)..(669): n is a, c, g, or t
gtagtgtcttctattcttcccttccctcttaggtgtaattttatcatcatcatcattgttttgtgcactgatatcttagtttttgctgagttctatattttaattttctctattaacagagcagatatatggtcatttggtataacggcacttgaacttgctcatggtcatgccccattttccaagtatccacctatgaaagtaattttcttgtcttctaatatttgtatttaactactgacagagaatgtctctatttatttctgtgagctcagggttgaatttttcccttattttttcggatgcaggttttgcttatgactttacaaaatgcccctcctggtcttgattatgaaagagacaagagattttcaaaggtttgtggtgtttactaaacactttgaagcatctattacttatttgattttcatctaaacttttccttttctctttgcaggctttcaaagagttggttgccacctgcttagtaaaagatccaaaaaagcgtccaagttcagaaaagcttttaaaacaccacttctttaaacaagcacgtgccagcaaatatctagctcgcaccattttagaaggccttgctcctttaggagatcgttttagattgatgaaggtttgctgttcgtttgcaaattcttttgttctnnnannnnnttgtttgggttt

SEQ ID NO: 452 - DNA, 355 bp, Glycine max
caccttttcaattctctcgtgaatgtcaaacgtccgaggacgatgacagccgaagcagcggtggccctaacaccgccgtcgcccaaaaatcagttttaggcggcggaggatgcagcgatggggccacaattgaagtggtgcggcggcccaggggccgcccgcccgggtccaagaacaggcccaagccgcctctcataataacgcgcgagcccgagcccgccatgagcccgttcattctagaaatcccgggcggaagcgacgtcgtcgaagccctagcccggttcagccgcagaaaaaacactggcctgtgcgtgttaaccggttcgggaaccgtcgccaacgtcactctccgtca

SEQ ID NO: 453 - DNA, 1239 bp, Glycine max
  misc_feature (501)..(502): n is a, c, g, or t
  misc_feature (504)..(504): n is a, c, g, or t
  misc_feature (977)..(977): n is a, c, g, or t
aacaatagcaaatactcaattctaccatggctgattatgtgaaaaaggcaagtgatttttaccccttcatatgtggctgtcatggatataaacttatttccacatttgatgacacaataccaggaaaacttggatgtaaaggaccggaagataagcactacccaaacgcaagaacaactcaaaaaatcattcaagccaggaaatgaatttggctttaatgttataattgagcctgaaaattcataagattctagataacttgttatgggggatctagttgttgagcgtaaccagattggcagttattggggcaacaagatttttctctctcaatgatatacagcttaaagagttattttaatggtcagttaggtgtactcctgaaaatgggctgcaatattctattatgagctttgcaggaaaaaatgtttaaaaaactcatcttcaaatttttttcattctgattttaaagggataccaaatggactcagaaaaaaacgnncngagggtggaaaatgagtttgtttaaaaattttttcctggaaaagttcaaaaaaaaaaattgccgcccttttttcggaaaaccccccaatgaacctaaaaaaactctttaagcctgaaattactggaaaaagaaaaattttgttgcccaataatggccaactgggtttccttaacaacgaagaacccccaaaaaggtttctctaaaactttaaaaaatttttagggctattaataaacttaaaacaaattaattcccgggttggaaaaaatttttaaaaatgtccctgcgtttgaggagggggcttacatcccgccctttcacaccattcccggggttgggggacccaaatagaaaaaaaattttattttcgaaccccccaaaaaaaggtaaaataactttttcttttctcttcacccctagcaaaataaatatcttttttttaaaaaacctggagcccttccccaacaaaatncaacacccacactcaaaaccttcccattaccataatactttaccgaaacacataacaacaccaataaccgatcattataccacccacaatcctactatcacctctactctatcaaaccccccacctattacctcattcactttatctctaccttacatgactacttctatccacttaataatccctttcacccaaaaataccctaacatgaatatgcccccacccatagtcatacttcacccctcttttaatacgatatatt

SEQ ID NO: 454 - DNA, 369 bp, Glycine max
  misc_feature (344)..(366): n is a, c, g, or t
atttgcatcaagccatattggaaatgaatgctgatggttcacggctgcggcaacttcatgaaaaggaaaaggagaatgagaaaaggagatggaaagatcaacatcataatcttggatgataagatgaggatgattcgtcacaaagaatagaattgttcgataagaatctaaggtttcacaccaaaaaaccaagaaacacatcattttaatggtgtatctgatctgaatattggcaactaagtgttttaaagagtctatttatatctttctaggcacaataactattctaataattaaaagacttgcaaataatcataaaaagtcctcagtccattgcaagtcannnnnnnnnnnnnnnnnnnnnnnttc

SEQ ID NO: 455 - DNA, 360 bp, Glycine max
agaaaccataacaacttcttcagaagacaccaatggatcctcttcaccacatgtgctctcacagcaacaacagccaaattctactcctactacaccaagaactcgttttcagtggagtaatcagtctaacacaggagtagctatgactctcaaccctgctcatgaaagagtcttcatgtctcattatggtgctaactcctttggggttaaaattgagggacagaatcttcatgagtcttcttacttgcgacctcagacacagaacatggttttccaaatgcaacagtcctctcaacactagttccatgcattatcacttgttgtagtgaattattaatgggcagaagtagaaccagaatc

SEQ ID NO: 456 - DNA, 395 bp, Glycine max
gcggcgatgaccctgaacacgtggaggtcattcaggggattgagaggggtgacgcgttgcctggcctcagaagctacgccgaaatagccgaaacggcgcgtaaggtagggtttgctgttgtgaaggagcgggatctggccaagccgccggctcttccctggtggagccgattgaagatgggtaggatcgcgtactggcggaaccatattgtggtcactgttctcgccgctttgggaatcgcgcctaaggggaccgtcgatgttcatgagatgctcttcaagaccgctgactatttgaccagagggggtgactctgggattttctctccgatgcacatgatcctctgcagaaagccccatgacaaggacgaacaaaactctggttagggtttcgtt

SEQ ID NO: 457 - DNA, 873 bp, Glycine max
  misc_feature (790)..(790): n is a, c, g, or t
  misc_feature (834)..(843): n is a, c, g, or t
  misc_feature (852)..(856): n is a, c, g, or t
accttaacaggtaagggcagactccagaatgttttgtttctttctctttcttgacaatttgttgtgattagttgatctactactgtaagaagaattatggtctaggttatcaaatcaagaattgccaagctaacttttgaattgggaatagatgatatggtgttaaatgtaataattttgaactagaaattgataaaaccacctcaccataaagcaatgaaatagccaaataaagtgcatgcatcgaaggaatgagtggcaaataaagtagtggaataatcgaatgatatatgtttagaggtgttcctttaatttcttttgatttaacaatttatgtctatatgacttgtactttatggaaattggtgacataaaagtgagaaacaaaaaggaaaaagtaataaattgccgaatcatgtgattcatattaatgatatgaaattgcaatggttcattatgaatcataaaatttaaagtcatttgagtttcttatgatacaaatccataagtagccaaatcacattgtaggattcgaataatgaatcttagattctaataactatgattatgcttatttagattcacggtgcaaactctatattcaataatggcataataattataaacaaaaggatttgaaatcttcccttaacgctttattttcatgatggctcagagttggtggtgagcagatagagggagatggtgaaggtggccctcctgaactactattctctcacgggggtcacaaagggaaaatatcagatttttcatggaacagaaatcagcnatgggttatctcaagtgtagctgaggacaattctttccatgtcnnnnnnnnnnctgagagcnnnnncaatgacggagatgatg

SEQ ID NO: 458 - DNA, 569 bp, Glycine max
accatatgcccttttcattttttcttccttccaaaacaaaaaataaaactggcttttcattttgtggttttaggtggagtaaagattctgaatgggaaaccagtcccttgtctcctgatcttgattggaagaagattgtggaacctgtcatgcagttgtatacagaggcaactgatggatctaatattgaaactaaggaaagtgctttggtctggcatcatcaatatgcagaccccgactttggctcatgccaagccaaagaattgttaaatcatctggaaagtgtcctcgctaatgaacctgcagttgttaccaggggccggcatattgttgaagtcaagccacaggtaaagttcgttaaatatctctctatcatcttcctctctctctatatattcactccgagctcaaacttattggacttatcaaagtcttcttctatcctctgcaggggttaaacaagggcttggtagctgaaaaggttctttccaatatggttaatgatggtaatccaccagattttgtgatgtgtgtgggagatgacatttccgatgaagacatgtttgaga

SEQ ID NO: 459 - DNA, 1530 bp, Glycine max
  misc_feature (1520)..(1520): n is a, c, g, or t
ttcccttttccttagccaatattttttctgtgtttcgaattgctatgcataagtgaagaaaacttgtacaccctgtatgcattgctcttgttaacacatatgcatttaacaattgctgcatgtatgccgctgtttttagctcccttgtaagaatatactcgtttttttccctttgaatctgctaacattttaaatccctccttattcctgttttctgatgagtttctcgagttatgctgagtggtatgtcggaggttgtaatttagatgcagttcctaggtgctttgagtttgagcatcgttgtctaatcaggattaaattttcatctcaataatcagcataatcaacatttgcattgaaagtcagccataggttaatgaggtgaaactccaattctattaggaaaatgacacccaaaaactgtacataagttttgtcccatgtcatgtataccttcatcatgttgctatggacatgtttttctctttttctgttgtccgagaatagctatgaatcttaaaggctttttttgtttttttggaaattcttttaggtagacttctctggcatggttgatgataatttcctgaagaatttgggattagagaagggaacacggaaagtagtaaatcatgaggaaagaggtagagttttgcaggccatggatgggtgcagctataaagctgcagctggtggatctctttctaataccttagttgccctcgcaaggcttggaagtcgctccgaaaaagttcctgctataaatgtggcaatgaccggtagtgtagggagtgatctattagggggcttctacaggtttatcttttattatatgcactgttcttattatttacttgtttgatcaaattatcttggttacttaactttgaaacttcaaagtctaatcctgtatcactccagttctagtctctagatagaatacatttacaatgtgaattccaataaaactttctattttgaactccttaactggtgtccttagggcactagttagcaagacccttacctattatctacatttggttgctatagtgcatggaaaagcatagatctgttgtgttaatatctataaagtacttaaattttgatcaaagccagttatctagtctcgcacacagcaccactgtactgtttactcatcttcgggacatagatttctatgttatttaataattccatcaattttgttttgggcaagtgaggtttgatgaatacttatattgcttgtttgtattatttttttaaaaaaaaattagggaaaaattacgccgagcaaatgtgcaatttctttctgcaccaatcaaggatgggactactggaacagttatagttctcacaactccagatgcccagcgcacaatgcttgcatatcaggtttaatatgctataaatggcatctttcagtatctattcagtctttatatgctatttcaggatattttaggcattttgaagtttcttttacctttattggctaataccatgagctctagaatagngaagatgcta

SEQ ID NO: 460 - DNA, 574 bp, Glycine max
  misc_feature (355)..(355): n is a, c, g, or t
  misc_feature (491)..(492): n is a, c, g, or t
  misc_feature (496)..(496): n is a, c, g, or t
  misc_feature (523)..(525): n is a, c, g, or t
  misc_feature (527)..(535): n is a, c, g, or t
  misc_feature (539)..(541): n is a, c, g, or t
  misc_feature (545)..(551): n is a, c, g, or t
  misc_feature (560)..(567): n is a, c, g, or t
  misc_feature (569)..(569): n is a, c, g, or t
aaggagaagcgaaaggggaagcacgacaagccaaagccatgggacgacgacccaaacattgaccactggaagatcgacaagttcgacccttcgtggaacgacggcggcatgctcgaagttagctccttctccactctcttccctcagtaccgcgaaaagtacctccaagaagcttggcccatggtcaaatcctcactcaaggagttcggtgttgcttgcgaactcaacctcgtaactaccttactctgttactcattctctttttcctcctctagtttcaatcaaaaaccctaacttcgccttcgattttgacaatgcacaggttgagggttccatgactgtttcaaccaccacnaagactagggacccctatattatcatcaaagccagggatcttatcaagcttctatcacgaagtattcctgctcctcaggtatatatatatatatatatatatatatatatatatatatatatatatgtgtgaattnnctcnctgttttttataaaaaaaaaaaaacannnannnnnnnnntttnnngttnnnnnnnattttgccnnnnnnnnancatat

SEQ ID NO: 461 - DNA, 735 bp, Glycine max
  misc_feature (127)..(127): n is a, c, g, or t
  misc_feature (142)..(144): n is a, c, g, or t
  misc_feature (270)..(270): n is a, c, g, or t
  misc_feature (365)..(368): n is a, c, g, or t
  misc_feature (386)..(393): n is a, c, g, or t
  misc_feature (413)..(420): n is a, c, g, or t
  misc_feature (435)..(437): n is a, c, g, or t
  misc_feature (443)..(445): n is a, c, g, or t
  misc_feature (463)..(468): n is a, c, g, or t
  misc_feature (472)..(476): n is a, c, g, or t
  misc_feature (487)..(489): n is a, c, g, or t
  misc_feature (544)..(545): n is a, c, g, or t
  misc_feature (558)..(559): n is a, c, g, or t
  misc_feature (599)..(600): n is a, c, g, or t
  misc_feature (608)..(614): n is a, c, g, or t
  misc_feature (626)..(626): n is a, c, g, or t
  misc_feature (646)..(650): n is a, c, g, or t
  misc_feature (658)..(662): n is a, c, g, or t
  misc_feature (664)..(664): n is a, c, g, or t
  misc_feature (671)..(673): n is a, c, g, or t
  misc_feature (677)..(681): n is a, c, g, or t
  misc_feature (692)..(714): n is a, c, g, or t
  misc_feature (720)..(732): n is a, c, g, or t
tgtaatttttcctgtaggaactgaatatactcaatgacctgcatatataaataaaggggggaaaattgcttaatttagttcacacaaaaatacaattaaccattaagatgaacacaagaaacaaatngttgaaagttgaatnnngtacctccaacaagaaggatgccttatctcttttttgatcattttgaggtatgagatctctcagaacctgaaacctggctcaaaaacataattttttcaagcgagcatatattgccaaataatatnaaattacatcaaacttccactcaaaacctacacacaaacaattaactcaacaaaaagaattttttcttcttcttttctttaaagcttgcctttcnnnnatcttgctccttctacgnnnnnnnntttctgaatgctttgaacgnnnnnnnntcaccctcttccccnnnctgggnnnatccaccttcactgccannnnnnaacnnnnnaataaataatnnngttaaaaattgcaaattgaattgcggaatgcaattgaagaggtaaaaagataagnnctttgagacaccnntcaatgaatcaatcgataaaccctggtgggtgttgcacanncaaaccannnnnnnagagagagaaanctttggaagaggtgttattnnnnnttaagagnnnnncntcatcannntcgnnnnnttcatcttgannnnnnnnnnnnnnnnnnnnnnnttgttnnnnnnnnnnnnnaga

SEQ ID NO: 462 - DNA, 522 bp, Glycine max
  misc_feature (61)..(61): n is a, c, g, or t
tatcttctcttgattcttccaggtttgttgccatagagtttttcaagattaagattcacgnccttcagacaaacttccatcatcatataagattaaagtcgcacaggtgaatttgtcaggcttcatatttatgttacaatggtgccttcttttttactggaacccttttatgcaggggaaggaggtcaagatccagatcacctgttcggcggcagagatgaatggatggggacagagatggttgactttgcatctacggtgttcattcaagagaacataaatttggaggcgtagggcgaagcttgtgatgtttggtcttcaagggaatgttgattaaaaattaaatagatagtggtgacttttcccatttttgtgggttcaatataatgatactgttattttcctggtttgctactgttctttagggagtagtataaaactgggcagggttgaacatgtgctgtaatatgttttgatgtaaaaaaggaaactgaaaaatcgatagcttctttcattccaaat

SEQ ID NO: 463 - DNA, 348 bp, Glycine max
cgacgacatgacgaagaagctcgacgacgccgtttttcactccgagatggacaggctcctctcggatccttactacccggtgtcccttccccttagggtttacgtctacgacatgcccccaaaattcacccacgatttgctctggctcttcaaaaacacctaccgagacacctccaatctcacctctaatggaagtcccgttcaccgtctcatcgaacaggtaggttccttccttcaattctcctcttgtagtcgtttgtttattgtattgtattgatctgtgaaaattgcgaattcagcattccattgattactggctctgggcggatctcattgctccccaatcgg

SEQ ID NO: 464 - DNA, 535 bp, Glycine max
  misc_feature (43)..(46): n is a, c, g, or t
ctgcttcagattatttgattggcatattatgagaatttatttnnnntttgtcttgttctatctaatacttgtggtgttgaaacttgtaggtgtgctggatatcacagtgaagctgatgctcctagccggagacttgctaaaccactaatcttttgtaggactgaaagtgactgccctatggaaaatggctatgcccgtccagttgagggaatccatgtacttgttgacatgcaaaatatggttgttcttgaatttgaagatcgtaaacttgtcccccttccacctgctgatccactaaaaaattatacttctggtgaaacccaaggaggagttgaccgaagtgatgtgaaacccttgcagattattcagcctgaaggtccaagttttcgtgttaatgggcacttcattgaatggaagaaggtggttgtttgtctaagtatattttccaaaacaacatcaatgtatcatccttatcatgaattgctataactgattgacaattttttgcagtggaattttcgtattggattcactc

SEQ ID NO: 465 - DNA, 881 bp, Glycine max
tccagcaggagaatgttgtatgccaccaccaaagtaatactcattaccataaaccacaactcctgtgtgcctgaggcacaaacaaagtacacaaattataggctttccagattccaacaaaagaatagcactcttaacgatattatcgtgtacatccaaaaaaatgataagagaaaaaagtagcaaacccaagtttcaggtattatcatgttttgattcatatctatttctatagtaatccataactaaatagacactgcatatccacagatcacagcattaatattcaataaacatgtgtaacagtcaccccaaaacaaatccaatttcgttaagaatacaactagcaatggcatcaatcaaagaaactttttgccctggaccaacaatatagagaagcactcaccatatgccttcaatagctttccccaaaaaggacattgaaagctgccgtgctagtccttggctcaagtcataaacatttagagtaaccctgcaaccctcctgcgatcaaatatcaaatgtaacatgtaacgataaatgtcaaaacaattgccaagtactaagatgtaaaatacaaaatagacaattatctacaaagagacatttggaaaacatcattagtaccacatacctcagccatctgctgcagtccaattgaaaattgattagcctctttaattaattaaacttgcaaaggagtgttgtaagtactccaaaatagaacagatcacaagaacctgaaacagcgaaactcggtaagaatcataccaaaacaaccataaaagagaaacaccctcatgaactaaacatgtaacaaaaaccacaaaatcacgagaaaagtgtcctactaggaaacaagtagatccatcatttgttat

SEQ ID NO: 466 - DNA, 366 bp, Glycine max
attttgctagatgaaccacaatttgtggaggttgaccagcaatgtacgagaagatcttgggctgttttatgatggaaataattgcccattattgtcgggaatatatatatagcatttgtacgaggggagtttattcaccagttgtcgaagaaatttccctcccacccccttcccccaaaacaaaaaagggatctgtatagttcttatacaattagatttgtcaaaatgtcagcttcttgtcacttcggctgtaaaaggagggtcgtttactgatctactggactactattctcccttccaagaaacctgtgttggaacgtgcttcatgacagattttgtgcaactgtaaattgagggcttccatca

SEQ ID NO: 467 - DNA, 531 bp, Glycine max
  misc_feature (402)..(404): n is a, c, g, or t
  misc_feature (414)..(415): n is a, c, g, or t
caaattttggaagagttcattgatatatggaaagaagtcgtgtctaaaaaatcattagccggtcagttcatgcatacagaaccaaattatgcagaatatgggctttctgacaattatacctctcagcatacagctgttcagtatgctgctgcattggcccaactgattcaatctgcacagttacggaactaggaactaggacctttgaagggtatgtaagggatatttattttatgaaatcttattggattcttgtgagtgtggagatggtaatatatatttcaataatgtttgttagaaagtaataaaaaaatatttcctgagatggtcataaaatcatatttattgtgtaaaatttttattataccttcactatcaatacccactatgtcactctgtgannncatagtggannttgatagtgaaggtataataaaaattttacacaataaatatgattttatgaccatctcaggaaatatttttttattactttctaacaaacattattgaaatatatattaccatctc

SEQ ID NO: 468 - DNA, 999 bp, Glycine max
  misc_feature (993)..(994): n is a, c, g, or t
catgcttctttcaccctctaccttacaacgggttccaaacgtctttctgtgataggatggatttgccttgttctcaacataagcgtttttgctgctcctctttgcatcatggtaaaaaattaggagccgaatatctaaatcataaaagaacgcaattaggtgtaaactttattttagatttttagtgtttcttttttaaaagattttttactttttcttaaaataactattcttttaaaaaaaaaatcaaacaaatccctttgataacattatactagaatataatttataacttcttcatttgtttttcatatgctctcagataaattaaattcttatatattgatacatgcagaaacgtgtcataaagacgaagagtgtggaattcatgcctttcagtttgtccttctttttgaccataaatgctgtcatgtggttcttctatggccttctcctcaaggactactacatcgcagtaagttcaattcgatactgctacgtgcgattaagagtatagtattcatataatatctgaccattaaatttttgtcttattcctaccaagacttttcctttactactaccactttagtcatttcttattatttgtagatcccataacttttcgttatgtccgtataattaagtgataatggcaatttagttagagcaattaattaaatgtgtgcgcacttcattaatgttgagttcccatgaaataaaaaaagtcaattaggaaacatgcgcccctattctatattattgtttaattaagaaaggcttaattgtttatatgctaggcaatttaattttattcctttcaatttgttttgacctaccaaaaagaaataatttcgttaagaaaaaataatgattgaatatttgcttttggatgatgcagctcccaaatactcttgggtttctattcggcataatccagatggtgctgtatttgatttatagaaacgccaagccacaaggatagaggagccnncgaag

SEQ ID NO: 469 - DNA, 849 bp, Glycine max
  misc_feature (767)..(767): n is a, c, g, or t
  misc_feature (804)..(810): n is a, c, g, or t
gtcagtctcaggtaaagcgcttccccttgtttagctggatgataattaaattacagttcctcactccaatgtgttatcagaatcatcttgtcaatgaataaaagttgtgtaatttaccagatgcattagttgataaaaaaatggtctttcagcatttgatttaattagaagttgaaggacattaatttcatatacagtgaatatgctttccttttcatttttgttacacttatgagtctcttacactggccataaaacatgatatcattctcctctccactgttctagagatttcgattgcgtcattttcttttggaacaagagtgttctttctcagagaaagacagacaactcctgttccgaagatgatggtgtttgcttttcgtttttgatcatggcattgacatattcttcttagttcttgtgttgcatctttctgtatatggtatattgacaactatctaaaattttgtaagccaggaaaagaaaaataacaacttcgtcattttgcagaaatatcacttgaatcatcattatcggctccagaactatggctttgggatcacatcaccactgtgggataaagtttttggaacggttcctcctcctcaatcaaagggggatgccaaacgtagataagttactgtcaaggttgcatttgttcattggttaagcatagttcattcaggagcttcaaacgagatatgttgataattcattattcatgtcttgattgtctaattattttgctccccaattgatgtttntgagggttaacgtgccaccatcttgtgtcaaacatcnnnnnnnatttcatacatttatcaaatttatagtataaaacttgcc

SEQ ID NO: 470 - DNA, 381 bp, Glycine max
agtagcaagccatgcccaaaaatacttcattcgtctgaactcgatgaataaagacagaaggcgatccagcatacacgatatcaccagtgtcaacaatggagatgtttcagcacctcaaggaccaattactggtcaaacaaacggttctgcggataattctgctggaaaatcaaccaaaccagccccaccagccccaactgctgccttgggtgtaggaatatatgctggtcctaccattggacaacctataggaggacccctcgtatctgcagttggcaccccagtgatgaaccttcctcccccagcacacatggcatatggtctcggagcaccggttcctggggcagttgttcctggagcaccaatgaacttaggtcctgt

SEQ ID NO: 471 - DNA, 411 bp, Glycine max
tctcgagactcacctctccaaacccaataatgctgacgacaacgacaacatcatccctgaattcaaggaagaaagcaccaaactctctgaactcccagaaaacgaaaacaaggcactccaagacctcaagaagctcgttcaagacgctctcaacaaccaccacttctcttccaaagaagataataagaacccaccaccacaaactgctgctcacaaggaagaagttgtaactgaaactaaaactgatgctgccccagcaaaaaccgaagaggagcaagctgaaacaaaggaggaagaggaaaagaaggaggaagtgaaagaaacgaatgaagaagctgcggtggatgatgatggagcaaaaactgtggaggccattgaagagaccgttgttgctgtctcttctaccgttca

SEQ ID NO: 472 - DNA, 422 bp, Glycine max
gcgagtccatgctgaacttctgcccagtcgcacgagcggcacggggtgaaggttctgaccgcacggtagccgtcgttgaagccaccggtttggactaatgttccgtcgggagagaccgaaccggaggagcaccagacattggtttggacaaagagagcgcggaatgtgttggctgcgacgtcgtattcgatggagtgcgcggtgcagtcgcgtttgacgaccaactcgtttgggttgttgcggcatcttccgtcggggagggttaggttggagagtccgaagtcggtgcggtcgaagatgatgacgcggtcgttgtggagaagctgcatgtgcatggcgacaatgccgatgtttttgtggaggagctgccactgtcccttggcttccgccgcgtgaaagaggagaataaggagcaggaggag

SEQ ID NO: 473 - DNA, 1030 bp, Glycine max
  misc_feature (670)..(671): n is a, c, g, or t
  misc_feature (730)..(733): n is a, c, g, or t
  misc_feature (755)..(756): n is a, c, g, or t
  misc_feature (796)..(799): n is a, c, g, or t
  misc_feature (820)..(821): n is a, c, g, or t
  misc_feature (841)..(846): n is a, c, g, or t
  misc_feature (865)..(867): n is a, c, g, or t
  misc_feature (874)..(878): n is a, c, g, or t
  misc_feature (883)..(893): n is a, c, g, or t
  misc_feature (895)..(897): n is a, c, g, or t
  misc_feature (910)..(912): n is a, c, g, or t
  misc_feature (917)..(919): n is a, c, g, or t
  misc_feature (921)..(926): n is a, c, g, or t
  misc_feature (934)..(940): n is a, c, g, or t
  misc_feature (1023)..(1023): n is a, c, g, or t
ctggatcccatagactggcttacgtaagtctcattcttccgatcaagttgttcctttgttttagtatgtggtaggaacacaagatgtgcaatccatcaacagatggcttatgtaatgattaaaaattaaaggaaataaccaaattagtttaatttagaagaaaataagaaaaggaaaaaaactctccaaaacacaaaaatttccaaagattgagtgaaatagattacttatagaaatgacatctcaaggctgtgcatgtgcactgatcatgaatttcaaagatgccataattcatttcaagcaacgaccatcccatattgcatgctcaagcaggagcagatctacataacatacttaggccccagaatttttgcaatggtggattttgctgcaaaattcatggttagagagaatttgtagcatgcatcacttgcaaagggttaaattggcagtgtgtaatgattttgtacttctagacttctagtaatttctgcactgtcatctctgatcttctttctttatgttaaaggtatgagccatatctctgggagaatgagagacagtcttacctacgacatgctgttctctttggtttctttgtacaactcaaccgtatgtacacagatactgttcagaaactgcctactaattcagaatctaatattctganntgttctacagttccccggtttaaatacctccccatcaggttagtcacatcttgtatttnnnntgttttgtctgtcatttcatanncataatgcatggttctgtgtttttttcttttaccattatnnnntgtatttaatctaaattagcnnaaatacaatggtttattcannnnnnacttttatgagcaattttnnnaggaaannnnntaatnnnnnnnnnnnannnagtgattgatacnnnaaatnnnannnnnnatttacannnnnnnctcttggtgaatccagtgctccagcattgtcctctagagggacaaagaaggcctttactccatcatcaagtgaaatctcttcnagaagtt

SEQ ID NO: 474 - DNA, 673 bp, Glycine max
gatgcagcacattagtgattcagcacccgaatgggaaagtagacaagttctatgcacctttgagtgccacacatgtcatgaaaaccaaccctggtcactatgttgctcttctcatctccaccacattgtgtccaaccaaggacattcaaaattgccccaacaagagtgacatcaaaaacaaaaacgccaacaacccagttcgcataactcgaatcaagcttctcaagcccactgacacgcttgttcttggccaagtttatagactcatcaaaactcaaggttacttagttccaacttgcaactacactctctttttgtttttttgacaccaacgctctatttgttgttaaaaaagttttatgtttttatttgcttatttcaaattagagtcttcagaggacgagtcctgatacaacagtaaagttgtaccttgattgctagtttggtcatggtttgaatctaaaatgcagtctctttgcatatataagaataaggttacatacatacaacgaggagcctttgtacactaggatgcccgtgttattacaaatttgagcctttaatttaaagagcttcttttttgggttcagaggtcatgaagggtctgaaggaaaagcaaaaggcaaagatgaggcaaaacgtgccagagtcagctcacaagccagattgagaa

SEQ ID NO: 475 - DNA, 388 bp, Glycine max
tgattaagctttctgggttcattacacgaaaatgttgaagttcttgtcgagagtgaaaatcgagttcaacgcgttggacccgcgaacggcatcgtgtatagagtttctggcgcaatgcaattcacggagggcgaaggagtcgaacccgacgtgcgaagtggacgtgaagcgcgtgagggaagagcgcgcgccgcagataacggtgacattcgttaacggcgtcgaggaagtgttcgacgcgacggcgacgccggctcagagcataagaaacttgattctggaaaagggtcagcacctcgagacggagcagatgtttcgcgaagcaggggaaccctggccggttatcatccccgacgaggagctctcccaaatcgcactccctaccaaa

SEQ ID NO: 476 - DNA, 1057 bp, Glycine max
  misc_feature (317)..(317): n is a, c, g, or t
gtgcctctgacaagtgggtttatgagtataattgatatggcctgctaactttgcatttgtattcatgcattaataacttaaaacacctattgcagtcaactgctggccctcttcttctggaaatgaaacttatgtcagcattgagtatgaggcttcatcattgtttgatttgcggaatgttgtgatctcagtacctcttccagctcttcgagatgcaccatctgttagacagattgatggggaatggaggtgtgatattttctcctttttttttctctgaataaatgttagtggcagccatgattgtttcgggttanaatttgctgtacatgatctggtttgtcttaaaattgatctttgttactcatgttaatggttaacaatctttgaaatactgattggatttggatggaactaaaaagctctacaaaactaatgctgctcccctccccccaatccttcctctcctccactcccaagatcatcagttgatgaattttatcatatatattttgaaatcattttatttcacatttctttctttctctctttataattccctataatttggctttgcaggtatgactcaaggaattcctttttggagtggtctgtccttctgattgataattcaaaccgcaggtatgctaaatttggggtgatagtgtgatgcttttaagaactaacatatgcagtgttattgtcatggtattgttgaacttgttttgtctgactaaatatggttgttgccagtgggtcaatggaatttgttgttccacaagccgaatcatcagcattcttccccatttcagttcgttttatagcaactgaaacatttagtgacctgaaggtatgtttggattttctttctctgcattcgacttaaagttatggtaaaaaatgatctacttaaaactgacacatttatttaaatgaagcttttatggctgggaaatcttatatctaaatagagtatccgttcattcaattcgtttactatcatctttaataatagattataattgacatatctgaatattgatttaatgggagccta

SEQ ID NO: 477 - DNA, 537 bp, Glycine max
tgacttcctcctcttgtttctcttgcagcgaaagttcacccagaggaaatctgaaggtagcttttggctgcacatagaagaaaaggataaaatatcattgagtgtttgtttgcaagcacaagataagagagagagagagagagagagagagagaccaatccaacggatggaagtggagtagatagttgaagtgaataggcaggatcggcgaggtttgcaagcacggtaacctctccttgttgagccttgagatcatgagaagcagtgagttgcaaactgggagcaagatcgatggaggtcttaacgagagcattatggtcttcgaggtcgtagtggaggctaaggtgcttggagacaaagctgaattgaggttcggagatgtcgccgcccttaccgctgtggttgaacgaaaacttgaacttggcaaggctgtccaacaacttgcaggaaatcttatggaagaagactgcgctttcactatcgaactcggatgtaactctgagggcgggcctccgaggaaatgacaagatggaaagt

SEQ ID NO: 478 - DNA, 511 bp, Glycine max
ctccagacttctacacaagagtaagttaagatcatatactcttaaagcatgggattcttgtcatagcaattcattttcaattgataagggtagttgttccttgctatttattgcatgcatatatgataccttcccttttgttttcacctatttcatggcaaaattgttgtgtgatttgataaactttttatgcaggtggggattgctggagtccctaatgatactataatgaagagaactaaggcaatagaggataattggttacctacatggaatgaggcatttgagttccctctcactgttccggagttggccttgcttcgcgtagaagttcacgagtatgacatgtctgagaaagatgactttggtggacaaacatgcctacctatctgggagcttagaagtggcattcgagcaattccactgcatagccaaaagggagataaatacaacactgtaaagcttctcatgcgctttgagtttattaataattgattctgtgcaatgtgca

SEQ ID NO: 479 - DNA, 365 bp, Glycine max
tgctcggggaaaagggttatcaatgcttgaagcattctataacaatgatgttaacggagtgtacactagagattttccaaatcagcctccgattgtgtttgactataccgacccaaacataacgagcactacagaattagccttcaaaatcgcacccaaatcaacgaaagtgaagacgttgaagttcaattcaactgttcagattgtacttcaaaacacggccattgtctctgcagagaaccaccccattcacattcacggcttcaatttccatgttttggctcaagggttcgggaattacaacgccactagagacgaaaaaacggctcttgctcaacatggagtggtcagacccgtttgtaggc

SEQ ID NO: 480 - DNA, 689 bp, Glycine max
  misc_feature (566)..(569): n is a, c, g, or t
  misc_feature (588)..(605): n is a, c, g, or t
  misc_feature (617)..(629): n is a, c, g, or t
  misc_feature (633)..(634): n is a, c, g, or t
  misc_feature (650)..(672): n is a, c, g, or t
  misc_feature (675)..(682): n is a, c, g, or t
gaagcgggtgaagtttcttgtatgctcagcttgagagtattcaagtctacatctgaattaagagatatatgtgtggtggctgcattcactagtgaggatattgttatgccagcagaagctccaacttctgtgtagcatgagcaacattgcatgactccggaattgccattgacatttcttttagtgtgatactttgaacttttctgcaacaattaaaatctcaaattagactgagctaactaacatggtattttgcagtgtggaagaaaatacacgcgaagggaaaggaatcattgaaatcttgagaaacattcagctctagctagtagccatataaaccaccattagctgtaattaggagtgctgataggtggatacccaaatatttttcaattatctgaatccaaacccaagaaactaaatacctgaaaaatgtgcatcagagaagtgatcccccagaaaaccaatctcagttgtgattattaaataattatgaccagattttggaaatactcttatgttagtagagcatcaaatatatgtttcaatcttgtcctttgaactgnnnntcaaattcttcactttacnnnnnnnnnnnnnnnnnngagcatgcacannnnnnnnnnnnnaacnngataacatagcacaannnnnnnnnnnnnnnnnnnnnnntcnnnnnnnnatatcaa

SEQ ID NO: 481 - DNA, 394 bp, Glycine max
cgagagtggaatagaacaaagaagatgagcggcgccagcagcactataaggctatcgccgatggtgagcgtgtccccgaattgcaattgctcatcgatgatggtgatgaagaagacgacgacggcggtggctcctttgtggatgaaaagcaagagcgctaggggtggtattaggtgcgaggtggctattaatgcggtggatgagtcgacgacgtcaccggagtcgaagattggagcgcgtgtgaaggtgaaggcgggtgtaaaggtgtaccacgtccccaaagtagccgagcttgacctcacgggtctggaaggcgagatcaagcagtatgttggcctctggaacggtaagcgaatctccgccaatcttccttacaaggttcagtttctcaccg

SEQ ID NO: 482 - DNA, 540 bp, Glycine max
gagctggtttttctggattctgtcctccagacccgacgtgcaaagaaaaattcgggacgaaatcgaaacggttagatcggaaaaatcaaagggtaaaataaaataaccaatgatgacggtaaaaaatgaaaatccaccagtaaaaaaatatttaaatatataattttcttatttgaaaagaatatattttttaaaatttagtttagatgtatcttacgataatgtgcaggcgcgtttggatacgaggaggtgaaggagatgcgctacctgcaagcggcgatttcggagacgatgaggttgtacccgccagtgccggttgacacgatggagtgcctaaacgacgacgtattgccggacggaactagggttgggaaggggtggttcgtgacgtaccacacgtacgcgatggggaggatggagagcgtgtgggggaaggactgtaccgaatttaagcccgaaaggtggttggagaatcgagccgagagtccgtttcggtatccggtgtttcacgcgggtccacgaatgtgtctggggaaggaa

SEQ ID NO: 483 - DNA, 330 bp, Glycine max
agactgttgctgatcaggaagatctgatgaaaaataaaagaatcttaaggaaaaagagcatttcacctcttgatgtttcgaaggaggaggaaacaactcgtaagggggaccaacctttgaaacccgaaacaccatggagttgtataaataatgcctcagaacattatcgcatattagtagatttcaatgttctaacaggagatactcatcgtgacaaatgtttggagaagttgcttcaaagtgttgaattcatgtttaattctgatgacagcataaagagggaagagaaaggaaatgacaattctgatgcaaccaacaatggaagcaata

SEQ ID NO: 484 - DNA, 692 bp, Glycine max
  misc_feature (632)..(633): n is a, c, g, or t
agatggaaggtgctagtagagtcttatgcttgtttctggcggcatttttgtggtttaatgctcaacatgcttttgtaagttgtgctttgacatttgagttgcaaagcaaaattgctaaagccaaccaagagggaccttacctaggtttaatcataccaaattcttttgaactagaccctcttcttcagaatcctggctacacagctagtgacaccatcatagacttcgctggtatatatttttccaaaatattattataatttttttagggtctcctgaacatgaaattttgcgaaaaaaaggataagctatatatgtattaacttatagtacttcttagttcttattttaaatttttttatgggtgataattaatgaaggaaggagatttcgctttggagccattggtgacaagcctgttatactggtcatgacaggattgagcgtggtaaggcttcgttttcctttccttttttttggtagattcactttcctgttttacttggttctatttgccttacttttacgttgatatatattttaatgcccttgaagaactgttttgacttttgtgcaacataaattaattgggattaatttctttttcatccactgatgtagataaatgcagnnataacgactcagcttctgttgagtttattcacggtagaaggagtgggcatacggcatgc

SEQ ID NO: 485 - DNA, 447 bp, Glycine max
aaagcatctccctctcccctaagcaaacaactgcccttaaccctcaaaaacaagccacccaaacccatccacttcaacccccccccccaaaatcacctccctctctcaccggcattgattctccatggacgagtatctctctctctctcttcaattttacacatcagtaaaccttatttctaatttcttcttctttttttctttctttcaatttcattgacacagatcagagcaatacccaaaggagtattaccctaacgaccaaaccctccccagaagagtctcctcatcctcgtcctcttccacgacgagcgtccacgtgacagccctagacggcctggtgaacgtgaactccctcttcacgatcgccgtcttcgtgggtctctccctcaccaccccgggccagcgcagcctcgagaaccgctcctcctgcgacgccgacgtgac

SEQ ID NO: 486 - DNA, 358 bp, Glycine max
tcgagggatctgtgtcttggtcaaggttgcctgtgaatttgtcggatgatagtgttaagaattaagattggtgatatatagttatatcaaaatataagaaaaaaagattggcaatgtttagtcagcaagtgaataagttgtgtgtaaaaatatcagcaaatctagccatctaatgttgtggccctcatgagaaaagagaagcatgaaggaacatgctgcagatcaagctagaaaaggaagacattctggaagcccgactaatgccaatgctttagggattgttgtattatatctaagtttccttacttgtttatatcataatattaattaaggcattccttttgcctccagactttgt

SEQ ID NO: 487 - DNA, 685 bp, Glycine max
gcagagaggtgtggtgctgatttaactgatgcaaagaggtaccatcgccgccacaaggtgtgtgagtttcattcaaaggcacctgttgtggtggttgcagggctaaggcagaggttttgccagcaatgtagcaggtttgttcattcaataccctcttatcttaagcattttctctttaagagtgaattttgtattgtctttactttttagcattttactatgcatggtagacttgatcatgctttcctattatgtattatcttattttagttcatttgctcttgaaactaacaactacattttatttgtaccaaacaaatcactagaactagcactagcactgctataaaccttttaattaagaacaaagtccaaggttttaaaaaacggtccatgatcgcgatacagctacaaggtcacaattgtgaccgtattggtaacatttgtccaaaattttccacaatataaaaaatcatgactattgcaactgttcaatggactagttaaaaaaataagccttgatcaatgactacaaaaatttggatgctccaaaacaaaatatgacaaggaaataaggaaacatgatctatgaatagaacagaaacactcatatgtcataagtaattgaatttcattgtttattcttcttgcacttttctttccttgttagttttttttttttttt

SEQ ID NO: 488 - DNA, 403 bp, Glycine max
tctgtgtagtcaacactgctctccgccacaccaaatccgtttccaacgcagtgacacggctcctctgctcttcttcaactcagccacaacatgaaaaccctgtcagggaacaaacacagacaccacctcaagaatctctccatgatgagaacaaacaaagatatgagcccaaagaagatgacggagatggtgacagtattaacaaagaaaccggtgagattggtggacccaaggggcccgagcccactaggtatggtgattgggaacgcaatggtcgctgctctgatttttaagtataaccattatagtgtgtttggatccactttatacatgcacatctcaaactaaaatcactcaaattgaaggaaagacgagaatagtagctttcactttgacgtcgatc

SEQ ID NO: 489 - DNA, 360 bp, Glycine max
ggattgcaatgggaagatacagaagttattggaccaaatatatgaactttgacctccctattttgcaacgttgcaatctccaggcgtagcccaaaattcaaatattattactctacctggctggttttatttgattaatttgttggcacattaattgcctgcttcagtcgattctttattgttctttggcgattcttcttgtaaagcccttcatagatgcatagaatttcctacatatatctttttagaagcttagctaatttgtagtgacattcagatgaaataagactcgcataggtattttagctgcttggagaaaccattatttgttgtgtacataattcattcccgtgctatcta

SEQ ID NO: 490 - DNA, 1435 bp, Glycine max
  misc_feature (1416)..(1418): n is a, c, g, or t
tgaatatatgtttcctgatgctgagtgggtttgtggaaactatcttcattgtcacaatccgaggttcatttttttgtcttattatcaataatgacgtttcattttattttgctcatgttactcagctgctcgtggtgaactcttgacatgtatttatgaagaataggaaaatgcttaaatgcattaatgattccattgattgtgaactgaagatatgataaatgaaatgcataattgcatatagacaaacgtgtaagctaaatattactataatcagaaatggtaagactattttaaaaaatctagtttactgtccaccgaaatgttgaggtgaatgcctaggaagtatgatcattagtgtacccttcacacatagtccaggtttacttcaattgaagataagtagatgatgaagaattatttcatatattttagcatgtataacaagcaaataaagtggttttattctatcataggctctctcagcaagagccttttgggcttgaagcttgaatgaggcacattaccactttacttttggttgaaatgttatgaatagtgatcgaataacttggccatgaatacattgataccatactaaagaccaattcttcgaatgttaagttgctaggtggaggccaataagtagttttatatttctaacgagtactagactactagtctatgactggaagatcaaaagtgacagaaaaatttagttgtaaaagggttgcaggaaaatgtagtactagccaggcccctaggactaaaataggctttatgtggagaaaattctccagttctgattagacttgtaactacaaactgtgcaacttaggttctcacccctgccaacatttcctcaaaaaggctactttcaccatttctaaattttatgtttggattagttttttatctatgacacagagttgtaaggatgcccttctgattagcatttgagagaagattatgaaatcattcatttatcctccttggtggggcatgatatatggctttacagtcagggaacaagtttttatgccattctttctttgttgaaaaacctatgaactatatacacagcatctttgaccttgtgctcttttgggatccaaccaatcctggtcatgctggtaattagtatgctcttttatgttttttcttctttattttaatgttattgtggtctctcaattttcagattggagcaaaaatggatagaagttatggttgatactcaagtggatgaactcataaaggctgtgaatcacagattcagatctgaagatttggttaatgctggtggcattcacagaacaatggtgtttgccaacactgttgaggctgttgaagctgtggcaaagatattactccgatctgggattgaatgttctcgttatcataagaattgcacannngaagagcgagcacaaac

SEQ ID NO: 491 - DNA, 391 bp, Glycine max
ttcagataccaatgctatcttttcacttgttctcgatgaagatgacgtgaacagcataagagaagccacagcgaaaggaaaggatctgcttaaagtgattggtgattgtggagatgagtacaggcgtgcatgagtcatgttggcttatcaacctggtgaagtgctttaatttatataggacaaggggatggaaaaaaagggagggggacacaggaaaagtgttcaagctcaattttttgtcagttgaagaatttgtgtgtaatacttttatggattacccagtaatgatcaaaagacaaaatagatgaaaggaggaagtaatgtattctgtagtatatatcttgtgagatttatgcaaactttcctcacatattggccaccctcaaagtaa

SEQ ID NO: 492 - DNA, 941 bp, Glycine max
  misc_feature (375)..(378): n is a, c, g, or t
  misc_feature (525)..(527): n is a, c, g, or t
  misc_feature (602)..(604): n is a, c, g, or t
  misc_feature (617)..(617): n is a, c, g, or t
  misc_feature (619)..(619): n is a, c, g, or t
  misc_feature (648)..(651): n is a, c, g, or t
  misc_feature (654)..(657): n is a, c, g, or t
  misc_feature (687)..(688): n is a, c, g, or t
  misc_feature (731)..(733): n is a, c, g, or t
  misc_feature (736)..(741): n is a, c, g, or t
  misc_feature (743)..(744): n is a, c, g, or t
  misc_feature (746)..(748): n is a, c, g, or t
  misc_feature (755)..(757): n is a, c, g, or t
  misc_feature (759)..(759): n is a, c, g, or t
  misc_feature (762)..(767): n is a, c, g, or t
  misc_feature (785)..(785): n is a, c, g, or t
  misc_feature (787)..(787): n is a, c, g, or t
  misc_feature (793)..(795): n is a, c, g, or t
  misc_feature (797)..(806): n is a, c, g, or t
  misc_feature (810)..(813): n is a, c, g, or t
  misc_feature (815)..(826): n is a, c, g, or t
  misc_feature (828)..(829): n is a, c, g, or t
  misc_feature (832)..(838): n is a, c, g, or t
  misc_feature (840)..(842): n is a, c, g, or t
  misc_feature (844)..(846): n is a, c, g, or t
  misc_feature (849)..(858): n is a, c, g, or t
  misc_feature (864)..(865): n is a, c, g, or t
  misc_feature (872)..(882): n is a, c, g, or t
  misc_feature (890)..(893): n is a, c, g, or t
  misc_feature (895)..(904): n is a, c, g, or t
  misc_feature (906)..(914): n is a, c, g, or t
  misc_feature (921)..(922): n is a, c, g, or t
  misc_feature (926)..(935): n is a, c, g, or t
  misc_feature (937)..(937): n is a, c, g, or t
ctggactgggcttcactcttctgctcctgctccccatcttttttcccaggcccagatgatgggcttcgagttctcggagctcgaagccctggctggacctgggaatgtaaatgtcccgtttgcggacggggcaaaggcggctgctctgctgcggtctcctcatttcgagccgccgcagcagcagccgacgctgtaccggaagcggagggggacagccgcggagattccggggctggagatggtgagaaggaaggggaggaagtggcaggaaggaggaggggagggtgaggaagggagcagtgctgacgtgggcggttccgggttgaactatgagtctgatgagcagaatgagagcaatgggttgaagaaaaagannnngctgcaggtatacatccgaagcaaagtaatgcaatcagaggactgttgctacagtcagggtgggtggtagagaagcttgaagatgattcatgtgtggtcacttatgttgttcaggtacatagaataaaaatgttcacgtttcttctnnncaaacaaaagaaggtgatcttcaatgctttcttcctcatggctttgttttctttcagttggatcctgcaggatgnnngccccagtgcttntntcatcgatttaacacaaaactggttatgnnnnttnnnnaccttaaaaaattagcccaagcatgtcctnntgaaggtgaaatttgattactttgtaaagtttgagagaaagcnnnatnnnnnncnncnnntaataannncngtnnnnnncttctgactatccttcananattacnnncnnnnnnnnnntcannnncnnnnnnnnnnnntnngcnnnnnnncnnnannnttnnnnnnnnnnttaccnngtttttnnnnnnnnnnntcttcccnnnnannnnnnnnnntnnnnnnnnnccctttnnctannnnnnnnnncntcct

SEQ ID NO: 493 - DNA, 384 bp, Glycine max
gctccgtctccgaagccgcccgcatcgacgccctctcccagctccgcctcatgtcaaaacaatcccccgaaacgcgccccatcatcgcccaagcaggcgcaatcccctacatcgcagaaaccctctattcctcttctcacccctcccaagaagacgccgctgccacactcctcaacctctccatcaccctaaaggagcccctcatgtccacacgtggcgtcctcgacgccatcgcccacgtcatctctcaccaccacaccacctcctctccccctgcggttcagtccgccgccgccaccatccacagcctcctctcctcggtcgactcctaccgccccgttgtcggctccaagcgcgagattgtctactccctcatcgacatcc

SEQ ID NO: 494 - DNA, 379 bp, Glycine max
cggaggggaccctgtcttaacggacccgtctgcgccgttaacgttacttcagacggctcgggttcgcatcacggctggtaccttaactacgtccaggtcacctccactgggccccacctctcgtgcggtcaggagcagtacgaggtggagcagtggctcgctctcgacacttcgccttaccagctttgggccgttaggaaccactgcccctacagcttggatcaggcccgccccgtttcggagagacccggatccggatccggatccggatccgccttctctattttgagtgcacttgcttgagtcgctggtgttttgttttacgtgatttcagtgtatttattaatattgagaaacagatccgaatcctagcttgaga

SEQ ID NO: 495 - DNA, 375 bp, Glycine max
catggaaaatggtaccagttccgttgacaggaagctcaagcattgattttcgaattgggatactagatgaaaagttgttgctattccctctggaagctgaaactgcttttcaaacattgctgtatgatccaaatgcaactctggggtcagagtggcaaacttgtgacataaggccatctggtttgtgcttgtgttgtgtaacaatcaaggcatgaaaccttgtcttatctggctctatggagtgatggatacatctatggaattctctgcattttatcaagaatgaagacagcagtgagtgtgagtgttcctcacgatcacatcatactattatctgattttaattttgtgttttagcttgtttgtggctgttag

SEQ ID NO: 496 - DNA, 710 bp, Glycine max
  misc_feature (150)..(154): n is a, c, g, or t
  misc_feature (165)..(167): n is a, c, g, or t
  misc_feature (222)..(222): n is a, c, g, or t
  misc_feature (225)..(225): n is a, c, g, or t
  misc_feature (227)..(227): n is a, c, g, or t
  misc_feature (267)..(270): n is a, c, g, or t
tgtattaaaaagctggtgttgaccacaaaattgaattcagagaaggtcctgctctaccagttcttgatgaaatgattaaagatgtaagttttttccatctctcaatgtcccaattgaaaaaaaaaatattttcactctcttaagtttaannnnntatcctttttnnnctcaaattaaaatttatattttttaatcctttaaatttgtaaaataatttttttngtnantactatgataaaaagttatcactaattatgcatcaaaatnnnnaaaaatcagtcaaaagggactaaaaaaagtatttcatgaattcaatataataaaaaacaaattttaatttaaggattaaagaaaaattctatgagagactaaaaatatactagtatttaaaaaaaaaacaattggaggagttaaaaagggtaattgggtagtgattgtgtgtggtgaaatgcaggagaagaaccatggaagctatgacttcatctttgttgatgcggacaaggacaactacctcaactaccacaagaggttgatagagcttgtaaaagttgggggcgtgatcgggtacgacaacaccctatggaacggatctgtggtggcaccccctgatgctcctcttaggaagtatgttaggtactacagggacttcgtgctggagctcaacaaagccctcgctgtggaccccaggatcgagatttgcatgctcccgg

SEQ ID NO: 497 - DNA, 584 bp, Glycine max
cgaggggtgatacttttaccccatcatatgtgcaggatttcaaatcagcatacaaggaggaatttgaacaggctgagctggggaaccatcctgccaaagaacagacaggatcgcaacaaagatatccaccttctggcccaggcacttttactggagaggtatactagagatctaaaaatgtagaaatattcaagtttctgattctggatcaaattagtcagaatagagataaaaactgatgcttctattttttttttatcaaatatttagttcaatattttatacttgtgtgaaactgtaattgatgagtccatatctctgtattctttgctagtggaaaaattgtaaactttgtctcaaatcaatggaaaagatgacttgtttttgttgttttttgcagggaagatactgatagtaatctgggacatgtgggcggcttgtattaaagtactaatcacattctaagctgattccatgtccttgccgtttggtggaatattgatatattgagctttcgttgtgtatccatcaattttagctgcactgttctgtgacaaagttggatctggtatgtaaagttagta

SEQ ID NO: 498 - DNA, 612 bp, Glycine max
  misc_feature (489)..(489): n is a, c, g, or t
  misc_feature (522)..(522): n is a, c, g, or t
  misc_feature (539)..(539): n is a, c, g, or t
  misc_feature (572)..(574): n is a, c, g, or t
  misc_feature (589)..(589): n is a, c, g, or t
  misc_feature (597)..(601): n is a, c, g, or t
agctcttctttgatatgctgatgatggtgttggtcactggaaaagagagaagcaagaaagaatgggctaagttgatttcctctgctggttataacaactacaagataactccagtcttgggcttaaggtctctcattgagatctatccatagtaagttaatgagatgtgccagcactctatcattcatatatgtaagggctataatttttctgtttcgattcatgagtgaatgttggataagtaacaatagcaatagactgaactctcttcatcatagttgtgttgttggaacagtactgtcaagaaaggaaaaaaaaaaaatctgagaaaaaaaatagtttgggggggatatatagcaggggaaaaaaaaaaggaaaacggggttaaaaaaaaaaaaaactttctttttctcggggttttttttttttttttttgtgagagtggtgtgcgcacaacacatctgtggtggagagagtggtgtgtagtgnttgtgtgatatataccacattctcttgtgtagngagagagaaaaattagngcttatatatatgtgtgtgagagagtggggggnnntctttttctttttangtggagannnnnatgtgagagat

SEQ ID NO: 499 - DNA, 270 bp, Glycine max
acgcgctgtgcctctgatgaagaagagcctcttctcggtataatcataattttcttgttgttgttgttgttgttgttgttgactatctctggtttaattaattgaagttgttagattgtgttgtggtgttgtagagtaatattataatataggcatggagatggatggatggatggatggaaggttgtgttgttgtaagttatttggatccatagcattggacctcatctggaaaactggttgctgcttctgctttcttcatggatctgc

SEQ ID NO: 500 - DNA, 947 bp, Glycine max
  misc_feature (53)..(57): n is a, c, g, or t
  misc_feature (890)..(891): n is a, c, g, or t
  misc_feature (893)..(896): n is a, c, g, or t
  misc_feature (939)..(941): n is a, c, g, or t
tggacttatttgttgtatactactatattgttcaaatgttgtacaatgtgaannnnnaatctgaaaattcaagcaagacttgtttatgttagtgaccttcattattatcaaaagcagcaaaacaaaatgaagtacaaaagtttgagaatgaactgtaaatatggtaaaatcctggattgaaaattgaacatatctaagtaatagtaagtatatcaggatgttaaagccttttttttgtcccttaggaaaaatcctactataatgtgtaatatctcaaccagcttcatgtgttaaccttctcagattgctcaatccatgagaatgatgtcataggcttagtaatccagttttctatttcgaaacatggaagtattactgcttattctcaaatagaaagacaaaaaggagtatattgattattgacaatttggctaatgatatgtatttcatgtctcgtctctgacatcatttacatgctcaacttttcatggttacatgtattcacaatatatttacgggaagcattctgaatgcatgcattttttaccaattattactgatcgtgattatcaaatttagttggaaactattttgatatattttctactctacaacaaaatcttgcagtgcatattccatctttaatgaagacttcagagagcttccagggacgctgaatgcagatcgacttgatagagatataagagcaggacagttttgagccctacttcactgcactctttccaatcatcccaacactactgatgtcaagtcacatgctatatatctgcacaatcacaaggagataattgactagccaaagagttaacaagtacagtgtcaatgaaaatgacaagttttctatgagaagctatgcccccttctgtgtnnannnntctgtactaagatgtattgacatgattgagatgaacatatttnnnttgtgg

SEQ ID NO: 501 - DNA, 1200 bp, Glycine max
  misc_feature (605)..(605): n is a, c, g, or t
  misc_feature (610)..(611): n is a, c, g, or t
  misc_feature (644)..(647): n is a, c, g, or t
  misc_feature (671)..(671): n is a, c, g, or t
  misc_feature (680)..(681): n is a, c, g, or t
  misc_feature (703)..(705): n is a, c, g, or t
  misc_feature (707)..(709): n is a, c, g, or t
  misc_feature (716)..(717): n is a, c, g, or t
  misc_feature (720)..(730): n is a, c, g, or t
  misc_feature (732)..(738): n is a, c, g, or t
  misc_feature (742)..(744): n is a, c, g, or t
  misc_feature (749)..(753): n is a, c, g, or t
  misc_feature (755)..(756): n is a, c, g, or t
  misc_feature (764)..(768): n is a, c, g, or t
  misc_feature (771)..(774): n is a, c, g, or t
  misc_feature (776)..(777): n is a, c, g, or t
  misc_feature (779)..(779): n is a, c, g, or t
  misc_feature (781)..(794): n is a, c, g, or t
  misc_feature (799)..(803): n is a, c, g, or t
  misc_feature (820)..(828): n is a, c, g, or t
  misc_feature (831)..(833): n is a, c, g, or t
  misc_feature (848)..(851): n is a, c, g, or t
  misc_feature (853)..(854): n is a, c, g, or t
  misc_feature (860)..(862): n is a, c, g, or t
  misc_feature (864)..(868): n is a, c, g, or t
  misc_feature (874)..(874): n is a, c, g, or t
  misc_feature (881)..(887): n is a, c, g, or t
  misc_feature (889)..(889): n is a, c, g, or t
  misc_feature (893)..(896): n is a, c, g, or t
  misc_feature (901)..(901): n is a, c, g, or t
  misc_feature (904)..(904): n is a, c, g, or t
  misc_feature (906)..(906): n is a, c, g, or t
  misc_feature (913)..(919): n is a, c, g, or t
  misc_feature (940)..(946): n is a, c, g, or t
  misc_feature (950)..(960): n is a, c, g, or t
  misc_feature (962)..(977): n is a, c, g, or t
  misc_feature (990)..(992): n is a, c, g, or t
  misc_feature (994)..(999): n is a, c, g, or t
  misc_feature (1031)..(1033): n is a, c, g, or t
  misc_feature (1035)..(1042): n is a, c, g, or t
  misc_feature (1047)..(1048): n is a, c, g, or t
  misc_feature (1069)..(1069): n is a, c, g, or t
  misc_feature (1075)..(1080): n is a, c, g, or t
  misc_feature (1082)..(1085): n is a, c, g, or t
  misc_feature (1087)..(1094): n is a, c, g, or t
  misc_feature (1096)..(1100): n is a, c, g, or t
  misc_feature (1110)..(1127): n is a, c, g, or t
  misc_feature (1133)..(1137): n is a, c, g, or t
  misc_feature (1143)..(1145): n is a, c, g, or t
  misc_feature (1154)..(1192): n is a, c, g, or t
  misc_feature (1194)..(1195): n is a, c, g, or t
gagaacatattcaagaagcaagtctctgttttgttaagaatgtcattgaaaatattggcaatcattaaaataatgtgtgaaatctacaaatccttttatccaatttgatgggaagcttcatagtccatttggcctcttctaagtctaagggcaccgcactgctgaacaactacaatgaattggaatttatactactatagtttatgttttgttttgctttatctttgtatattttattgtcatataagtattcaaagattttatatattaaaatatttaaactacagagttttattgtgccccttgacggctagaccttaagattatagatttacaagttgggtgagttcttgacatctcactaaatattttaagctcagaaactattttcagcatgtgtaaataattttgcttggaaggggtggaaattgtttagattttaggttggctcgtatatttcatcaagcattaattcagttagttttctgcagcgactgttaattgttcctcctgaacttgcctatggaagcaaaggagtccaagaaatccctcccaattcaacaatagaggtgaattattctgatctttttgtttagattttgttncagtnngttgatgcttcaattaatactgcgtatccttgnnnncctactgcaagactgattccaacnttttactgnncaagtctaaagtgctcttttgnnntnnnctctganntgnnnnnnnnnnntnnnnnnnaaannngtttnnnnnanntttaatcnnnnnggnnnntnngngnnnnnnnnnnnnnnaaaannnnntttcatgaaaccccaannnnnnnnnaannntgggttttccctggnnnncnnaaaatnnntnnnnntaaaangaacgtnnnnnnnanaaannnnacccnttnanccaaccnnnnnnntaaccccccccccttttaacnnnnnnncttnnnnnnnnnnnannnnnnnnnnnnnnnnaaaaaaaaaaaannnannnnnnaaccccaaaaaaaaaattttttcaaaaagaannngnnnnnnnntcccnnatttttttttttttaaaaacntttctnnnnnntnnnngnnnnnnnntnnnnncttttttttnnnnnnnnnnnnnnnnnnaatttnnnnntcaaannnaaaaattannnnnnnnnnnnnnnnnnnnnnnnnnnnnnnnnnnnnnntnntaacc

SEQ ID NO: 502 - DNA, 613 bp, Glycine max
  misc_feature (553)..(559): n is a, c, g, or t
agccatggctgaagcaattatgggtttcacccctttcaaatcacacactcttagctcatgtctacaaacaaacaagtttcaagtgaaccagtcttcaagattggtaaaatggtccttcgatatctccatttcatcacatgctagtaattcaaagatgaaaaaaaaatatgaaggtgtttctttcttttgcagccaaagcaacattcaaactctagtcttatcaacagaccgtggcaggtaagaatttctattcatattgaaagcagaaaccatgtttagtataaacctttagaccttgattgataccatattgcattattatgtgtatttgtaaacaaggtcttagagggcaagagcaaaaaaagaggatctttgtgtaaagtgaatggcttgccagattggccactgatggccattatagtagagcaaatggaagggcagagagatttgatcactgagaaaacagtttcccatcttagtgatcaggcaataaaaaatgtttgtaagtctcaacctccaaattctgttctttaatttttatttttattttgtnnnnnnnacttcaatttcatttcttattggtacccttttctgtggcagactcttggtacat

SEQ ID NO: 503 - DNA, 542 bp, Glycine max
ttctcttgttctttagttcagctttcatcagagtacctggtgcccttgcctggagcaaagagggtcatgtcatgacatgccaaattgcgcaggtaaaattcgatccattatgcaattcccacttggccaatacaacagagtattcactatcgtaagatttaatggtggaatcttaataattgaaaagtaattgacatttggtgtatgataaataactaggcacttttagagcctgaggcatcagaagccgtgtaccaattgttacctgactatgtcaaaggtaacttatcatccctatgcatatggcctgaccaaattagacactggtacaaatataggtggacaagtccacttcatttcattgacacaccagataatgcttgttcttttcagtattcaagtaagcattacttctatctagtaattaatcttatcatgtgctctcattaaacctttgaatattgatgcaaaattttgttcctttttgttaccataggggactgccatgattcccatggcgttgaggatatgtgtgttgcagg

SEQ ID NO: 504 - DNA, 1414 bp, Glycine max
  misc_feature (1404)..(1409): n is a, c, g, or t
tgtaattgttgctagcacaataactacaaacaaatcccactgtaatgtaaacaaaagttgtatggattacacagtttggcctggttgcctgctatatttttgaaaagcttaaaggagagaatctaaatcaaaatatcacaaaattcttctaaatcttcacaagtttgacccttcagttgagatactcacgcttgatgcttgtatcttgtatctctgcaagaaaaacagagggaagatgttgtcaaacataacttaatttgcaagtttaaaatgtataattgtatactgatacagcaatatactactacaataatccccaaaatgagcattattagaacgaataatacaacttaaaaaaccaattgataccacatgaagaactaagaagtacatcttaattacttaaatccgtatccaaaaggcatgaatatttgataacgctcagactaagttgaacttgaataataacagagtatgaccttcagaatgatatgcatacactgctagttatagaagaatcacaccctcccattgtgctcatgaatctcatgaacaagacagtgtcagcaataataaaagaagaaaatcagatgaagaaaataaaattacaagacaattggagaataagagatcctccataacaaagaatttggaaaatgaataacagaaaaagacaaatcactaatggagcaaagttatctaaccactgtgtatgttacagaaatccccttaaaagaccatgtgtttaaaaccaaattgaagctaattgcctaatcacattccaaaacagctgctcagccaagcatatctcgtaaaaaatatgagctttgtgctcttcccaaatgaccaaatataatagcatggattgatagtcacaaaaatttagcatcctcatttgtattgaaaccattaaagctagtatctacaaattggtccaaagacccatgacacacccgcattcaccaaagacaaacaagcaataaatagtgaaagaaaacaccaccaaacttccttctaatagtttaaaagtcacaaagcgcaaattaccaaaccaattagaaaaattgcaaaactaaagctaaaaacaaccataagcaagcatacatgagggtagcaaatttatgtaaacgcaaccttttaagttgaaagagaatccacacaaacatgattttacaaggtaaaataacttcaaaggaaaaacctgaaattatctatttgaacttgacagaacttcaaacaatccacagcaactcaaccaggaggtcttttgcaccaaatctggagccaatgctacatgaggctgcaaattaatttagcaaagaaaaatatatttaaaattagtttttcacaaaaatttaccaatcataattgtgagatgaaaaacttgtaatgtatatgtgagannnnnntaaaa

SEQ ID NO: 505 - DNA, 204 bp, Glycine max
atgtaaatatcaactgcatccaccaagttcgatgtgtgtgaccatctcatactccatccatgtgcttaattagtgtggtatcgaaattgttgtatgtgtagtttctgctgtgtttcatcatcatcatcatcatcttggtatgtgttcaaccaccagacgttcatgtattgcttttagagatccatgaatcgtgtctatctcagg

SEQ ID NO: 506 - DNA, 497 bp, Glycine max
tcctccctcgctaccccgacggcaagctccgctacctcggcggccacacccgcatcctcgccgtcgatcgctccattccattctccggtcagttctctctctctctctctctctctatcactcaattttcaattcctcatagtttaaacgacgtactcgtttgcgttttgcgatattgtaataataaaccctaatcgcgtgtgttgtacactacagagctattgctgaaactggaggagctctgcggcgcctccgtgaggcacctccgctgccaattaccctccgaagacctcgacgctctcgtctccataacctccgacgaagatctcgcaaatctcatcgaggaatacgaccgtgtttcgtcgctgaaaatcagagccttcctctcgccgcccacgccgcccacgccgcccacgccgccgagatcgccgaacaagttttccactgctccgtcgaaatcggcgtccatctcctcctcctccgcttcgtcatcgtcg

SEQ ID NO: 507 - DNA, 867 bp, Glycine max
atcttttacattacccaagacactcaaaggcatcctctacttcctgaattaaaatctggtactttgatttaccttcaatagttcaataggtaaacatgttcgctgtggttgtattaaacttgctgtggttacatcatgggaaaaatgcattagttgtgcacttgaaaagttgaattgtgttatgtaaacactaaacccatcaatgagaaaaggtcatgtggctcatgcaacaaagatattcttgaataggtggatttcgggtgacaggaaaaatctctactcaatgttctttgtctggtcctattagtggtgagttaactgtagaaacatctgcagttccaattcattctattgacattcagttgtttcgagttgagtccgttcttcttggggagaaaattgtgaccgaaacctctctggtccaaacaacacaggcaagtgatggtgtatttgtattaaatcatacatgtcaattcaaaataagctgttaattctctttttatttagcagatagcagatggagatgtgtgccataatttgacgctgcctatttatgtaatactaccacgccttttgacctgtccaacaaccttagctgggtatgtccttttcacgatgaattctcctccaatgtatttcaattttcctaagagttgtggtacatccaaaactgaacatacacacacacagacttattgtacatgttgattctatattaaagaaccgtgggagaaccacaccactaaaacttttttgagtttagcacttataatttcatcaatatcttttcatgaattactttgtgcatgtaaaaaatattgcatactgaatcgactaagtttgatgttaatgctattttttcatgca

SEQ ID NO: 508 - DNA, 605 bp, Glycine max
acgagtatgttcccccctgtggagattgagaaagataaagatgttgttggaggccatgcaagtagtagttctagtagctctggcagttcaagcagtgattcgtcttcgtcaagcggtatttacctgcccctaacagtctttggtttgtagttgaagctatttttctatctagaaataacctaagtttgatcgctgttgcagattcggattcggggagttcctcagggagtgattctgaagcagacaacgggcactcgtagtagtcagtgggtttttggaactaatggtcatgtagatgaagaaaatgcttttgcttcattggcttcctttgagggcgtggctcgaatacatggacgaggtatgctcatttcatttgatgtattatttttttacgctgtgaatattgtcgcagatggatatgataggctaaatttgtgattacttttcatttcagggattgtgaccgttgtttgttggttcgttttgggagtagcggtttgcattgtggcgctgtccactccaggatttgtggtgtgacatatttgtacaaacaatttcgggaaccgaagtaatcatcaaaacaatttgtaggccagaaagtagta

SEQ ID NO: 509 - DNA, 406 bp, Glycine max
tgaactctctgagaatggagatctccgtaagatacatgagaagtggttctgtaaaatgggttgtgctgaagataggacaagcaactccaagcctgaccagcttcacttgattagcttttggggtctgtatctctcatgcggtattgtcttgcttgttgcacttgcactgtttctgctgctaatgattcgccaatatgcccgcttcaaacaaagacaaaaagatgttgcttcttcatccacagaaccatcgggcattcattgttcccaggttgttgttaacttctttaacttcattgatgagaaggaagaggccatcaagaaaatgttcactcaatgtgacaatcatcacaaccccaactgagataattattatggttgtgttgcaagagggctcaaagtggtagat

SEQ ID NO: 510 - DNA, 1012 bp, Glycine max
  misc_feature (48)..(48): n is a, c, g, or t
  misc_feature (50)..(52): n is a, c, g, or t
  misc_feature (947)..(948): n is a, c, g, or t
  misc_feature (950)..(951): n is a, c, g, or t
tttgggtataaaccgtacaaaaattgaagagatatggttagaggtgcntnnnaggatacaaattactggtctgaaagagtttttgtttaaagaaggcaagctgatctctgttagttttggggcaggtgagtgtcaaatctgcacaatgcttattcgacaatgcaattaataacattttgtattgatatgattaaaatcttccccttagaaatgttattctctgttaatataatattcataaattttttatgcattttagatctagaagaactaggggataaattagtcttgtatttgattgcactagctgtattatcatgcaaaagacatggagattctgatatggtagcattgttaatgttattattagagtttatcataaagttaaaatggttgacaatcccgtgacactcagcttttagtagtgtcattatcagtgttaatataacatgcacaagttttccaagaatttcaggtccagaagaattagggtataaactggtctttgtatgtgattacacttaatatatattatcaaccagatggtcctgtattattattattattattatagcggtttggaaaattggtcctggcatcattgtttatgttttagaattcatcaaagttctcgtgtatgtctgatgatgtatctcattaatcattatttttccattttactggttgacattgtgtcctgcttaatgttgttatgatagtgttgctcctgtgtttttattatgttcgctctactcgtccacactctccatttatccaatgatatttgatgctttattgtgcagctccaactgtgcagctaatgttcagttctcaattgaccaaatctactgccgagaagttcagaggtcacatcttacaagcatttgaatctgtccttggatcttctataacaatagaaattagatgtgagttaaataaagatacanncnnggctgttcaacaacctcttacattgccctctactaatgatagttcgtctcagatagagact

SEQ ID NO: 511 - DNA, 1127 bp, Glycine max
acggtattatttcctcctttgatgctgtttgagttcaatgaatggcgtatttcgaggtttaggattttatttttgttatttttctctttacgcgcgtgtgcgtgtgtgtttgatttattatttgtttatatttgtgatttcttatttatttgttttgctgagtgatgctagtaaaattgaaggttctcaggccacagcgaagctcacagcagagttgctccggtctgtgatttcacagcagcgagtgccacacacaaaccaagccacagctctgattaatgcagtgagggctgtgggggagcagcttattgctgctaatcctgttggtatgttaagattaatgttttttttataaatttttttataatttgtttatgactataaatatgcatgttagagatccatcattgactaatgatatggtcaaaatagaatagatattagataagtgagggggcaaatcttaatctataagctagcttttgggagttgaattaggctcaaatcagaattctaagaaggtattagaacctattttagttgttgttaggcctatatggccattattggaccttttgtggttgttcagtcttgcaaacttcacgcttgagtgtctagtcccccagtgtgaggggagatcccccattgactagttatatggcaaaagtagtgtatataagtgggtggtaaatctcactccatgaactagcttttggggttgagttaggtccaaattctaattctcagaatgcattttgtatttattgtgttcaatgatttataacagttgaagtatgtatttttgggtttatttgcagactgatttcctagattagtagttcttttgttgaaggatgttctagagtcacacgcacaagtttattatgatttgggaattatggagatttatttattgtttgcctatcatgattcatgacatgtaatgtatgtggttgcagagctagctgtcggaaatatcgtgaggcgtgttttgcacattataagggaagaggatctttcccttgcaacagctgctatggatggtttgggggtatcagctgcaagtgatgatgaagatgatgcagagcgagatgaaaatcctgttttatctgctgctgctgtgcagc

SEQ ID NO: 512 - DNA, 283 bp, Glycine max
tcttgttcacaattttgttgctatatagatagatacatcctcagaaagaaattttggtactatccagatttgttaaaaatgacacggcccctaatttatgtaatttgagaattttattaagtaaaaatacataaatatagttcgggcatatttactatatgtttgaatacatgctcaaaatactacgataaagattttgtattttccagatctacaacagctttgatttcgtgatagcagttttgcataccccaaattggccctacacgtagcaagttaattg

SEQ ID NO: 513 - DNA, 412 bp, Glycine max
tgggagtatctgcaattcgtaatcctatccacttgttgaatctgaatatttccaattcaacattttccaaatggcatcctcgtcctctatgatctcaaacccggttccgaacacggaccggtcacgtgacgcgaaacggaggaagaagaaagcgcagctgaggcagcagcaacaacggcaagaggatcagagcaatcccaagtggaaatcccaagcgcagcaacaaatctactcctccaagctgcgccaagccttagccagagtgaatctcgggttggcgccgccgccgcgccgaggcaaagccgtgcgcgacgccgccgacagagtcctagccgtgacagccaaggggatgacgcgctggagccgagccatcctcaccaaccggctcaagctcaagttcaccaaacacaag

SEQ ID NO: 514 - DNA, 612 bp, Glycine max
gttggggaaattcctcttgtacacgttgatgatgtctgtgaagctcatattttctgcatggaaagcacctcgatcagtggaagattcttgtgtgcaagttcatatatttcattagaagagatggctaatcattacgctcttcattatccagaattcaatgtgaaacaagagtaagtggctgatcttggttattactatatttattattactcactcttttttcgtttgtttgtttttgaaagaattaacacaaaggactaaacggtagaattttaaatttttatgaaaacaaatgttaaacaagcacattttccatggaataactttaaaatcaaaactgatcatgattatgtagtcttagaatacacaaatttagctttcttccttttagttgttaacggttttcatctgaaaattacatttcagatatgaagatgggctgaagaaggatatcaagtgggcctcaacaaagctgtgtgacaaaggctttgtatacaaatatgacgccaagatgctattggatgattgtatcaaatgtgcaagaaggatgggtgatatctagtctccatctacacccttgattgctatatctgcttgtaatacaatatgcac

SEQ ID NO: 515 - DNA, 724 bp, Glycine max
  misc_feature (59)..(64): n is a, c, g, or t
  misc_feature (674)..(676): n is a, c, g, or t
  misc_feature (692)..(692): n is a, c, g, or t
cgtgtcatattcttacagatggccgtgatgttttggatggctcaagtgtggggtttgtnnnnnnccttgaaaatgatcttgcaaacttgcgcgcaaaaggtgtcgatgctaggatagcatcaggtggaggtcgtatgaatgtcacaatggatcgttatgaggtatagtgacctggaaatgaccttcaatttgcataacccgggcatctttcattactgcactcccatatggattttaggtgtaatacctcccccctgctttaaaacaaatgttaaaaaatcttttatattttcacaatttattctcttgccactctgtttattcgtatacaagacaattttaattcattaaaaggtgggataggtgtgtgttaacagcaattatattataatatttactaatttaatggtagttcactttatggtgcctgattacatatgtgagctgtgttctgcctttagcttctctctaaatttgaaaatattttggtcaattatagtattcattagatagactctgcctattccattcttacttcaaatttagctttatattttatcatcttatgcaggtacttaacctacaccatttaactttttaactagtctgtcactgatttttgtgcagctatgtgcctattgtattgctatattacctctgaagtttgacaaagnnnaaaatgctttataagnttgaaatgtttttcatttttgtgtgtatttct

SEQ ID NO: 516 - DNA, 387 bp, Glycine max
gaatgatacgtataggaggttgctttattattactattattataattataataatatgattattatgatatgatatatcaaaagaaaccatttttccacccttgtaacttctctttgatgttagttccttctctcagattaagttgcattttatggaaggaaaggaagaagggaatacgaaatgagaaaggtaggcttatatgtgattatcagctggcgataggtaggctctgtggtgatctgtgcaactgtatagtaggttgttttctacgtttttttatttatttatcacgtgtatgtacttaaggtttcatatcttaatttgataggactttatctaattaatagaataacatgtgctcactctcatcccgtatatgcactaga

SEQ ID NO: 517 - DNA, 443 bp, Glycine max
agtatgctgtcgttagagagcagggtcggccagcatctaagttgaagtcagaagagaaaaacgcagcctcggctgattccttgtccgacgaagggaatactaattcttgcaattcatctggaggatcatcttcaggtttgacttcgacgtggcaatcgatgaagactggctttcagagtttcaaggtgaacataggggccaaaaagtttttacctctacggcaaatacaggaaaataccggctctagtcattcctcgtctgagtcccttgatgacatatttcaaaaactcaaacggccaactttaaaccaatctatatacaatgacgacgattagtatggaggccaatacttttggttcttcttgttgatgtatccataatttggaaaggacttgcaattgtaaaagcgttctaggattgggaatgcaggtccatattatcat

SEQ ID NO: 518 - DNA, 399 bp, Glycine max
  misc_feature (281)..(283): n is a, c, g, or t
  misc_feature (304)..(304): n is a, c, g, or t
  misc_feature (344)..(347): n is a, c, g, or t
  misc_feature (367)..(369): n is a, c, g, or t
  misc_feature (389)..(391): n is a, c, g, or t
gatgtgaagaaggtggtcaggtcagcccctatcaggtcatctgcaagaccactaaagaactcatccaagtctaagctgaaataagtgatactcatgttgacaagttaaaattgtatgccttcctcccaaattcattttggaacatatagttcagtttttccagaattattaccatctcattttactatgttccttttaattgattgagagcttgttgatttgtagatgggaaagaggcttaccaaaaatctcccttcatggagttgagctatgctgaccannngttcctgcgtgacacacacantgtgattgatgggagactctctgaagaaggcatacacttnnnncttggaagggaccttcctcnnnaaattgaagacaacattgannntttctgca

SEQ ID NO: 519 - DNA, 350 bp, Glycine max
gcagagaggctgaaaaatcttatgcctaaaagcaaggatgaaatcctcaccttgtcttggatgactttagctatgaagtcactttgtgaaagtcacaatgacatacggacccttatgactgcccttgagcttcctgtgagtgattgggaggacaaatggattgatgtgtacttggacataagttcaaagttgctagacatttgcaatgcattcagctctgagctttcacgtctgaaccagggaaaccttcctcttaagtgtgcactgcacaatttagactctgcctcttcaaagcagtatcttcgggcatgttccctacttgatgattggaggcagcatgttagttctag

SEQ ID NO: 520 - DNA, 703 bp, Glycine max
  misc_feature (65)..(68): n is a, c, g, or t
attgaaggttactcgagcttttggagttggctacttgaaaaaggttagtattctctcttacactnnnnccaataggtttctataagattttgggtactgatattttagcaagtaaatgtgataattataaacccttaaaattcaatctactgactgtgtctgtgaatggacgattgcaaagaataaatctttgtcctaccaagtaccaaacatagatttaattttcttattttattctcctgcagaaaaatctgaatgatgctttgatgggaatccttcgagttcgggatcttaaaagcccaccatacatatccacgcaaccatcattgaatgtccatagaatttcaaattccgatcaatttgttatagtagggagtgatggtttatttgacttcttcagcaatgatgaggcagtaaagcttgtggagtcttatatcttgagcaatccttttggtgatccagcaaagtttctcatagagcagcttgtagctagagcagctgattctgccggttattttcaagatctaattctaaatttaattttattttcatcaatgtaaatgcttatttgttgtattttatgattattggttagctaagtaacgctcatgcaggtcttagcatggaagagttgatgaatattccagctgggaggagaaggaagtaccatgacgacgtgaccgtaattgtaatcatgcttgga

SEQ ID NO: 521 - DNA, 344 bp, Glycine max
  misc_feature (336)..(339): n is a, c, g, or t
tctcgactgttgctaggttatgttaactgttaccttttattcttcgtttacttcacactgcgcgttacttcatcaccaatcgtgccgcacttagaactccggggtatgctgtttatctttgcttcgacttttctaatccatgctgtaattaattaatatctttgcttcgactttaggaattgtaattaattaactatggcgagagagatagctagattattcagctaggttctctatcctatctttaattaattattttaattttaatacatataaatacctaagaacaggtgtgtggttgttttggcaacttaggtttaagaataggtttcatgnnnnatttt

SEQ ID NO: 522 - DNA, 311 bp, Glycine max
ttttttcattcttcccgtttttctgtattttcttacatctaaagctgtaattttttacatcaaaattgtgatttttatctcagattccatgacaacgatatcatatttgcgttcctttccaagtttgtatttttatttgaccgtgactaactattgttcttcctttgcaacacaaaagcttcaatttttttgtgttttctatttttttgtgttataatgacttttcgcaggacaaaaggttaaattttttggtgttcctgagccttctccgacgtacccaaaggctggagcttttttgctgggtttgctag

SEQ ID NO: 523 - DNA, 1029 bp, Glycine max
ttcatcttcttctatatagtaagcctcattttactaatctactatgctttcattttatatttgcctgaggttgaggacttgatttaatcaataagttataggtgcaagtgcccatggcttttttggaaccatcatagacatgtaaatttgttaaagaaaataaacagtgggactttagagacattgttttaggtatagctcagaaaaattgggtagtgaagtagtagaactagtagattcactattactatttttttaaatatcattagtagcctgctgttttataacttgaatttatcatgctttttttaaattgacctcttgtaccacgtcttccatgttgctactttcagggatgcttctttagacaattttataggtctgtgggcaaggctgactacttggctttgcgcaatggatttatcacggtgagtcctactccacaagacatgttcttttaacactgaattttccttcctcttttacaatgcattatgtgtaggtccacctggctcctggaagtaaatttaacttccaaaagtatatcaaaagatccttggaggatgacttcaaggtagttgttggagtcaggtaacactcttttactcgtgcatttgtagcatcatattgtctatcgtttttccagtggtaacttgtttgacatacatgctcactatgttgttgacagtcctgtcctctgggcatcatttgttgtttttctgctactaaatgttaatggtgagcaactactttcttagtgaagtcctatggaattcacatttctttggttgagtattcagttaaagaataacagttggttaatcttgtatgaatttccaggatggcatgctatgttttgggcatccttaattcctgttgtggtaagtattctgttccctatatataatatgtagagtggttaagacctacaattataaaccatttatgtgtttgcagataattttggctgttggaacaaaacttcaagccacactggcaaacatggctatgaaatcacagaacgacacg

SEQ ID NO: 524 - DNA, 398 bp, Glycine max
  misc_feature (387)..(390): n is a, c, g, or t
ctccctctcaacaatagagaggcttggactcctctcaaaggcagaagagttgggtgtgctatctgctgcaactgatcctggaactccagggacactcttgaccctcagcttggggttgctgatccttggacccttatttgtttacttcgttcctgaggacaaccttggattggtggggttgcagattgtggttgccttggtcagtgtaattgggggttctgctggcttggctgcctcaaattttgtatccaacttgcagaaattgaaataaatttgatgaccttttaatgtctcttaatagagccgaagacacgagtatgcagttatgttgaatatttgaagggagaactttgtcaattgtaatgatcttacctagttcgagtaggnnnntctctcgt

SEQ ID NO: 525 - DNA, 400 bp, Glycine max
attgcaaagttcgtggagtttctagtgcagaagcattctttctgagtctggaagataagttaaaagataagaggacttatggtgccctgttgaatgtatacgtgcattctagatcgaaggagaaggcagaatctttatttgatactatgaggagtaaagggtatgtaatacatgccctaccaattaatgtaatgatgactctgtacatgaaccttaatgaatatgctaaagttgatatgctggcttctgaaatgatggaaaagaacattcagctagacatctatacatataatatctggttatcttcgtgtggatctcaaggatcagtcgaaaagatggaacaagtgtttgaacaaatggaaagggatcctaccattgtccctaactggtctacattcag

SEQ ID NO: 526 - DNA, 392 bp, Glycine max
agcacgacatggaaaacatgtacatgtgggttttcaaggagaggccggagaacgcacttggtaagatgcagctgaggagttacatgaatgggcattctcgccaaggggagcgcccgtttccgttcagtgttgacaagggttttgctcggtcccacaggatgcagcgaaagcattatagaggactatcaaaccctcagtgcgtgcatggtgttgaggttgtttccgcacccagtctgatgaccctggatgaggatgatcgaaaaaggtggatagaactcactggccgggatttgaatttcacaatcccacctgaagcaagtgatttcagttcatggagaaatcttcccaacacggactttgagcttgagagaccacctcccccaatcaagagt

SEQ ID NO: 527 - DNA, 1068 bp, Glycine max
ttcagacccctcaactcttcccaatacaccaccccattttccctccaaagccaccactgaaccaccaagtttcaacgcagagccatgtcaacaatgtcctgaaaggttcgtcggggtatttgtccgaaatcagcaaagtgattgatcacgaagaacagtaccgggtagcccggtcgcaggttagccgtaaagttttggacttggaaggttattccatagagggtctttcagttggaggccaagagacatgcatcataatccctgagttcaagtgttcttttgatattgggaggtgccctagtagggctattcaacaaaacttcctttttattactcatgctcatcttgatcacattgtaaggttctccacttttgtcaccaataaccttttatgttctggtgtttttgtgtttttttggattagtaaaaagggaaaaaaaagagaggctaaattacacatgctccgtgttatcataataggttgtattgattattgatagaaaagccagccaattcatacttgattaacatggcctaaaggctgtttagtatggaaaaaaaaatgtcttgtttttattttctgctttaattttatatatgaaataatgaaaacaaaaaataatataaagttattttcactgtttcttgtataaagttttgaaaatggaaaataaagtgaagatactgacattttttgtaattagatgtgaaaactgaaaatgaatgtagaaaatgtttcctcaaaccaaacagtgccttaagtttttaatgttagaactcgagcctatttatggttgtaacttgcaagtggtaagttgatggcgtacataggcatgttgaatgccaattcgattttggagaaggtttgggttcaagatgcattagaaaacgggattttagtaaaccaaacacactctaaaaacaacttacataatctaatgctggcctttctttttgggaggcatcaaatacctgtgaatgtgctttttcatcctagtaatttgtttgcaagttatatgcattctgtgtatcctgtactttggatgttaagtgtaaatttagcctaag

SEQ ID NO: 528 - DNA, 368 bp, Glycine max
tcgtcaatcgagatcttcacagcaaattggacacgaggatggggtgggagcgcgaccccaaggcaccccacgccgatcaggatttggcatactgtgctgcttagacaaattgggcaaactctgagggcgaaaggcatcatctgccctccacgctctgctattaccagagccccaaggaaacaatctaccactctcgggtttcgaattcggagaccctaaattggatccctctgaaggcgaaaccactggaggcgaatccggacaagggttttcgcgcttgtcatcggctgctagagcatctgccatagcctcccaatcatccaaacatccatcatcatcatcgtcatcaccttccccttcttcatctt

SEQ ID NO: 529 - DNA, 387 bp, Glycine max
ttcgctggtggggttttcttaggacctctctgatgcatttcttgagtgattctgctgagaccttcggagaccttacttcaaaatcttacccttttgcttatatgctggcttcatctggataccttctcaccatgcttggtgactgtgttatcactattgttaccaggaatagcaacagggaagccaaagtggtggaactggaaggagggacaacgccccaagagcatgacctagccagagatcattgcgcagtggcggagacaacaaaccctgtattattgaagacttcttctttgggagacaccattctactcatccttgcactgtgtttccattcagtttttgagggcattgcagttggagttgcaggtactaaggcactaaggc

SEQ ID NO: 530 - DNA, 425 bp, Glycine max
taagtgcaatagattatttatttattggtgtgtgtgtgtttgtgtgtgtggtgtataggtttggagaatgagttctgtgcaaggaccagttgtgtgcccttctgtccgtgccaaacaagtagggttctgcagcattccaatgattggggcagtgaaaatgaacgttagacgcatccgaagtgaattttggggtctcaatggcgccaaggctaaacccggttttctttcttgccatataaacacgcgaaagtgcaagactgtgcattgtacttttaactcaccctccaatgacagtggaagtaccgctgacaatttcaatgaaaaagatgaagattatgttatttctagtgtaattgaagctggtatgacaatttcattatcgataaattgattaaataacattttgattgtttttgacttatata

SEQ ID NO: 531 - DNA, 435 bp, Glycine max
tttctgctgctgttgttgttctgatgaaatcttaagcaaattatgaaaacatcgctaatttataaaccttgttgtatgaagaatgggcgaagcaaaggccttggttccggaatcggtggtgaagaaggagaaaaggaacgaggagtgggctttggcgaagaagcaggaactcgatgccgctaagaaaatgaggttcgaaacgcggaagctgatttttaacagagccaaacaatactcaaaggaatacgacgagcaggtattataattaaaattataattgaatcttggagcgttggatttgttatgttttgttttcaatattgccatttttaaaaataatttctgtgttttctttttccagcaaaaggaactgattaggttgaagcgtgaagccaagcttaagggagggttttatgttgaacccgaagctaagct

SEQ ID NO: 532 - DNA, 800 bp, Glycine max
  misc_feature (52)..(54): n is a, c, g, or t
  misc_feature (737)..(739): n is a, c, g, or t
  misc_feature (786)..(788): n is a, c, g, or t
aatttgaagggattagggtgaatttggatggggaaaaacactagaggaagannnccttaaatcttacagttgttctacttgatgacatgtaggaactaaaaagatttccgacactttcaaatgatatagctactgctgcaaatgaagctctggaaaaattccgagaagaaagcaggaaaacagttttacggttggtcgatatggagtctagctatttaacagtggaatttttcaggaagattcattttgaaccagaaaagaatccaaacggaccaccaaatccaaatcggaatggtccccccaatatggatagttatactgacaatcacctgcgcaaaattggtacataattttctgagcctttttgcaacaattaagtataatattgttgtttttaaaacttgtcttatattaaaagtaagttattttatgtttgtaatcaatgtattggaacttctttttctaattttttgctagcatgtgttgttttcaattaaaaaaggtgattttttaatagacaaactttttcataagctcattcgcactaaaatattaaaaaaagttaggcttttggggaaaatgtttacatcccttatctctcatagtttcatattatgtgtaagtttttggtactataaaatagtgagatgcattgaaattttaaccttcaacatctctttttaaaggatggtttaaatttaaatgtgataatcccacttaatttggaattggcttcnnnagggtttttacagatctaccaggttatacattcattattctgttcgnnntacaggatcaaa

SEQ ID NO: 533 - DNA, 395 bp, Glycine max
agcctgtctttgataattcattactagtattgtgattttaacactttcctgcatgccaggatggcttactccgtgttatcttagatgggggtccatcgagagttttcttcaccggtgatgcaaaattattagaggaagatctggaggtgttaaaggtaggttatctacatatctaatctagtcaattcaatgtcatctacaatttgtaacagactaattagatttttggatttattgtactttttttccttataaaattgagagtttgggtaggttaatgcttcaaagtcagtgaatggtgacgtgctttttgtaggaattctttatatctggaggtgacggcctccctcggggtgtagtcgaaaatcaggttgcacgtgttcggcatgtgatca

SEQ ID NO: 534 - DNA, 697 bp, Glycine max
  misc_feature (499)..(499): n is a, c, g, or t
  misc_feature (559)..(559): n is a, c, g, or t
  misc_feature (577)..(577): n is a, c, g, or t
  misc_feature (623)..(623): n is a, c, g, or t
  misc_feature (625)..(625): n is a, c, g, or t
  misc_feature (658)..(659): n is a, c, g, or t
  misc_feature (678)..(681): n is a, c, g, or t
  misc_feature (683)..(683): n is a, c, g, or t
  misc_feature (685)..(690): n is a, c, g, or t
  misc_feature (692)..(694): n is a, c, g, or t
ctgctcatggcctctaccactacctttatctctctctcttcctagttcattcattctcctctctcaaaaacataaacatcagcacttctctcttttgaatattcctcaattttatagctacctagctacctagctacctagctaagctatacttggttttctttaatttctctgacaaatattccaacttcttttctatataggctctagtagcttagtagttatctttcagttaccttgaacaaatcaacagcaaaatatatttctgacacactcatcagagaccattttaaatttaattaacaacaaacaatgtctagcagaagatctcgttcgagacaatcgggtgtttccactgagatcactgaagctagacattgtttgttgttaattaaatttaaaatggtctctgatgagtgtgtcagaaatatattttgctgttgatttgttgttggtggctgatggataactactacgaagctagtggagcctatgtagnagagaagttggaatatttgtcagagaaattaaagaaaaccaagtatagcttagctaggtngctggtagctaggtagcnaggtagctataaaattgaggaatattcaaaagagagaagtgctgangnttatgtttttgagagaggagaatgaatgaactnngaagagagagagaaaaaannnntngnnnnnncnnngag

SEQ ID NO: 535 - DNA, 1222 bp, Glycine max
  misc_feature (700)..(702): n is a, c, g, or t
  misc_feature (711)..(894): n is a, c, g, or t
  misc_feature (896)..(972): n is a, c, g, or t
  misc_feature (975)..(987): n is a, c, g, or t
  misc_feature (989)..(1022): n is a, c, g, or t
  misc_feature (1025)..(1043): n is a, c, g, or t
  misc_feature (1045)..(1047): n is a, c, g, or t
  misc_feature (1049)..(1052): n is a, c, g, or t
  misc_feature (1055)..(1095): n is a, c, g, or t
  misc_feature (1098)..(1148): n is a, c, g, or t
  misc_feature (1153)..(1157): n is a, c, g, or t
  misc_feature (1159)..(1159): n is a, c, g, or t
  misc_feature (1163)..(1171): n is a, c, g, or t
  misc_feature (1173)..(1180): n is a, c, g, or t
  misc_feature (1183)..(1217): n is a, c, g, or t
aattccacttattattataggattgatctagtcattgtctcaatgaggatcttgatgtaaatctttactgtgatgcagaagagggcgctccccatcaccatctttacaacctcagagatctggagctttttcattcacttcgaccatgcctaaaaaagatttaggttgtatgcacatagtatactaaatctcaattctcgagtttatttggttattactgatgtcttccatattgattccttatatttctttgtcattttcacataaaggatgaagatatacatctcattatgtttggatttacaatcttgttacatgtactgaagagaggcgatcggtttcaccataccggttcccccttctacgcactggatctcggtcatcaagtaggcctacaacacctaaaataagcagaccaaccactccaaatccaagcagacccaccacaccaaatccttctaatgcaagacaaagggtgagtaacgtgaatcatggttgttttctcagcatgtcacctataaattctgtagtttccttaactgcatctccatttatgtttccaccagtacccttcagagccgcgcaaatcatcttcaatgcgattatccgcagaaagagaccatggcaaagaactagaacaataccccagtaagagtaaacgtctcctgaaggccttactaagccggcgcaagtctaagannnatgacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnttnnnnnnnnnnnnntnnnnnnnnnnnnnnnnnnnnnnnnnnnnnnnnnnttnnnnnnnnnnnnnnnnnnntnnntnnnnttnnnnnnnnnnnnnnnnnnnnnnnnnnnnnnnnnnnnnnnnnttnnnnnnnnnnnnnnnnnnnnnnnnnnnnnnnnnnnnnnnnnnnnnnnnnnnttttnnnnntntttnnnnnnnnntnnnnnnnnttnnnnnnnnnnnnnnnnnnnnnnnnnnnnnnnnnnnttttt

SEQ ID NO: 536 - DNA, 400 bp, Glycine max
ttgttggtgccaacatcttggcagcagggccattctctggcggctcgatgaacccggcacgctcctttgggcctgcagttgttagtggtgacttccatgacaactggatctactgggttggacctcttattggtggtggtttggctggccttatctacggcaatgtcttcattcgctctgaccatgcacctctttccagtgaattttgatctgattcaagtcatggcctttgtaattcatgtttcttgataataaaaggaggaaaagcagttcttgcttttctttctttttctatctctcttttttttctctctctccattctatgctttttttttcttctcttaatttatttgtaaagtgtgctactactgtttaatttggtgagaattcaagaggttg

SEQ ID NO: 537 - DNA, 537 bp, Glycine max
  misc_feature (438)..(438): n is a, c, g, or t
  misc_feature (454)..(457): n is a, c, g, or t
  misc_feature (464)..(465): n is a, c, g, or t
  misc_feature (475)..(480): n is a, c, g, or t
  misc_feature (493)..(496): n is a, c, g, or t
  misc_feature (512)..(514): n is a, c, g, or t
  misc_feature (517)..(518): n is a, c, g, or t
  misc_feature (523)..(528): n is a, c, g, or t
atatgttatgattttttatttatttgtatgttttatcttctgttttcttattccctttgaattttttaaattattttttggcttgtgttctagattgttctagactatcaagaaatgtgattgatagggaattatagcttgagcctgcttgactgataatctgctgagacatgttaagagtagttgactggaaatttctagataaatgagattgacagctaattgaacatttgctcaattgctgatgtctgaaaactcagattatggggttaatattttgtttctacatttctaaagactatgggttcttttataatatgtttgcatattttcaattgattttcatgagtaacgctgctccttttgtatctctatctttaggttctggctaaacttgaaaaatttaagaattctttatcagcaaaggcgacacccccnactgatgaatctgaannnnttagtanngaggaattgnnnnnntggaaaggtgttnnnntaaagtttgccccacnnnctnncaagnnnnnntttctcttt

SEQ ID NO: 538 - DNA, 366 bp, Glycine max
  misc_feature (359)..(359): n is a, c, g, or t
cgctgcgccgtgagcggcaccgcaaagggcaaagcgaagatcaaagcaggccaagcgctaaaacgctcccgcatcaccacgaagaaacccggatccgcgaccgcaggcccacccatgtcgcgtgagcgccaagaacgtgagcgcctctacgaacaatgccttcaagccccaacccctctccgccacctcacccaaaaggagcgcgaacgcgaagcggagcgcgagaaattgggcctcatcagcaaggatcggcagcgagaaatcgacatgatgaagcgaaaagacgacaaatttaaggtttcggagaagcccacgattattgggacacctgggttggattacgtgagtttaggtttggntggatgt

SEQ ID NO: 539 - DNA, 336 bp, Glycine max
ctaacttgatgatactagtccttagttgataacattgttatcacatcaaacttgcaataacataaaaacttccttacagttcctctttctctcttgtctctctttcttccacccttccctctcttctcgtctttacatcacaccctcttttcccccctttgccaaagctctgatcttgtccccctccaatccccgctactctgcttttcttgatctgggtgtctcgttctcagttttgaatcgtttttctgttctgggtctttctcctcttcgaaaaagatctgatttttcgccctgttttgattcgaatccctcgtgaaccctctttcttgatct

SEQ ID NO: 540 - DNA, 894 bp, Glycine max
ttgtaccaagccacctcaaagccatgccctgcatctatcatcccagaagtggatctctataagtttgatccatgggaattgccaggtatattaattgtaacatcttgccaaattattagctttgttatcaacttattatgcataactttgtgtattattacaccattataatgtctctatgcataattcacttgtcattaactaacaatcccaattatattgcatctctatattatgttccttcatgaaagagctctttgttggtaaaacatgaacaatgtacaagccttcctaccttatccagaaattcaactttttttattagaataatagggcaacaaggattaaattctaaaccacttggtcataaagtctctagtaccatatgtcaaaacagaaatctcaaatcttaaactgttaagtgaagatacattacttaaggtttgaaggttttgtcgtgatccttaacattaagataaattacgaacaaatgggtgatagtcacaattgcagtcacagacaggccaaaaaaccttgacgttgcagctgaaattgtagttgcaaattgtttttaaaaaccttgacatgaatggtattatattacatctctaacacacttgttattaaattaccatggaatgcagataaaacagaatttggagaaaatgaatggtatttctttactccaagagacaggaagtacccaaatggggtgaggcctaaccgagcaaccgtgtcagggtattggaaggctactggcacagacaaggcaatctacagtggatctaagcatgtaggggtgaagaaatctttagtcttttacaagggtaggccaccaaagggtgccaagacagattggatcatgcatgagtatcgattggctgaatcaaaaat

SEQ ID NO: 541 - DNA, 303 bp, Glycine max
tgtatagagaggaggattctgatgtggcacacaatgcaacttcctcctatacatatgacgatcaggcatggagagcagaatttggagcaatatatcaggagcattactaattgactgttggtattattattagcatttgataaatttccttttggatcaaactccaaacaattttgtctggcatatcctacttgggtcaaaggggcatcccttaatgccattattctttttgtgtatttctagaaattcattatattttttccgttgctgtgataatccaacacttgttatggaactgcaacc

SEQ ID NO: 542 - DNA, 504 bp, Glycine max
ctgttttgatattttttattttatcatggactgtatgatttgggttaacttgttgatttgtgatcgaaggttgtgcttagattgaattgtttttatgggttttgcaggatggtgattttgatgtagagcaatcatggccagtggtaacctcgtcgcccccatttttctgcgggtcgccgccgagtagagcagctaaccctttgattcaggatgctcgatttggggatgagaatttttccccgctctccccaccgtcgtgggtggtggttccggcggctgcgtcgggtctgccaccgtctccctcttcctctgcaaggaagggagggtgtgtccgagccaattttggtaacaatcctgctgtgagaattgaggggttcgattgccttgacagggacaggcgaaattgcagcatcccggctctggcttagaacaccctcctcacacgccacacgtctctttgatattaggattcagttcaacatataaacataaccacagaagatg

SEQ ID NO: 543 - DNA, 756 bp, Glycine max
  misc_feature (47)..(48): n is a, c, g, or t
  misc_feature (659)..(661): n is a, c, g, or t
  misc_feature (675)..(679): n is a, c, g, or t
gaatactattatactatatccattgtactgatgaacagaaatattannttggtgttggtctaatgcttgatattttccaaatataacctgactaaattctgatgtccgttacttaggatgaagttattcaaagggaagaagcaataagaaaagagtataatgaacttgacacagtctggtttatggcaggttctctatttcaggtaataaaatttccccgaacaagttcagtagttatgtacattttgagatttagtgcttacattatttgcataaatataatgcagcaatatccatatgacattcctactgaggccttttcatttgagattttcaaacaagcctttgctgctattcagtcttgtgtggtgcatttacaggtaaagtttccttgttatccgatacagaactatacagttagttaagtatgcaataaaaaaaactctgaactaaatagtggctgaccaatcttgtaagtctattttggttcaactctaatgaggttgctacatttgtccatgaaattgaattaccttaatttgaaatgttgtaatcttgcttgatactattaaatatcaggccaaagagctttacttattgatctaatttgtagatatattttaatttttattgattgttggatttgtcagatgaagtgnnnataatttataaatnnnnntagaaaacttttctactgttactactgagtgtgtatgagtttcagcatgcatgtatactattattgatcttattttt

SEQ ID NO: 544 - DNA, 871 bp, Glycine max
cctgcttacagccccacatcgcctggatacagcccaacctcaccctcatatagcccaacctcgccatcgtatagccctacttcccctagttacaatccacagtcagcaaagtatagtccttcgttagcatattctccaagcagtccgagattgtctccatcaagtccatatagtcccacatcaccgaactataggtgagtaattctctggattttttaatatttattttcggtactgaatgtgatatacagaaccttcaaacactgggctatgccaaaacaatgaatctcttctttccctttatttttaagtcaagaacttgggtttttggaggaacctcaaccttttgcaataggagttattttactttgtacattccatatttgctcaagtcctgtgtttttcgtttctcaattgcatatttactcctagcatatgtctaatttgttattttccagcccaacgtcgccatcatattccccaacatctccatcttattctccatcaagcccaacatacagtcccagcaggtaaattaacttcatttactgtcctgcctatcctttgaacagtttatctcatgtctgtgacaagaatagtagtagaattgtagacttttttattctcttttctttttatttgttaaaatttaagagtttttaatatgtgacttattcatttttttcccttttatctagcccttataattctggtgtgagcccagactatagcccaagttcgccccaatttaggtatatgcatatatacacctcattcttttaacataattgtatagatggaaggtatattgctgagcacggtctgtgttatttgtctgtttgatcatttgcagtcccagtacgggttactc

SEQ ID NO: 545 - DNA, 527 bp, Glycine max
tgcatttgctacttggattgggaatccagagctacttaatgttccacaagaggttatacttgaagatcccaacacgaccatgccaacacagccacccagtgaagaactgactaacaagaagaggtaagatctgtgaagtcaatgtcataatcgttatttttgttatatactatttcctcatttttgccctcaatataatagcgatgtgctggagttagtacctgtaaaactagaagatcaaccaaatgtaacccctgattcttctacaactgttaattcgaagtcagaccttgacaactcattgattatgtttcaggtaatgttgacagtgtgtagatgccacttgttatattttttaaatttttattcattttagcacaatgtattcaatatttatgatgttttctcgcaggagatgtttatggatttatacaaatggaaagagaaaatggaacagcagctgatggaggtatcgaatactgtatatggtatgcttgcaatgaagtagacatcactccgaagtatcg

SEQ ID NO: 546 - DNA, 403 bp, Glycine max
ctggggcatgtagcgagccctgttaacctcaccctcatggttgatctgctggatgatctggaccttgccattggcacagccaaagccaccaatgtcagggcggtcatcatcatagtggcgggcatcattctcagcatcatcaagagggagttggacctgcgccagcatgaggtaattgggctcattttcagaagtgtgggtgcccaagatgaccttctggagggagtagtctttgccaggtggttcatggcggtcaggaagccactccacagtgagggaaggccactcgagggcatgcgtaatgaccagatcatacaagaaaggactgttcttcttccatatcttgtactcttcattaatcagtcgttcctcaatctcacccctcatctcttcctcctctttc

SEQ ID NO: 547 - DNA, 763 bp, Glycine max
  misc_feature (100)..(102): n is a, c, g, or t
  misc_feature (140)..(140): n is a, c, g, or t
  misc_feature (142)..(142): n is a, c, g, or t
  misc_feature (173)..(175): n is a, c, g, or t
  misc_feature (182)..(184): n is a, c, g, or t
  misc_feature (213)..(215): n is a, c, g, or t
  misc_feature (218)..(220): n is a, c, g, or t
  misc_feature (225)..(230): n is a, c, g, or t
  misc_feature (232)..(232): n is a, c, g, or t
  misc_feature (245)..(245): n is a, c, g, or t
  misc_feature (247)..(247): n is a, c, g, or t
  misc_feature (326)..(327): n is a, c, g, or t
gacaaagacaaagacagagagaaacaatgtcttccccaagcaaacgccgagacatggacttgatgaagctgtctgtgatcttttccgaattttttttttnnnttttcaatttcaaaaagggttcttttgcataaattgtngnctttttccatttggggggcgttggattgacnnngatcagnnnatcaggatgatgagggattacaagggggnnncgnnnaacgnnnnnntncaaaagttctttngngaattccacggacccaaaaacagaaaatttttgcaaccctttgtgtcattttatttccaattattattttttgttcagnncttggttgagatagtgttgttctatttggtgcaacttttaatgttgttgtttaattgtttggtggtcattttcttcaatgcggatgaattgcatttaggatctatgtctctctgcttaacttcaaaggtgttgtttcctttgtctcatgttttatttttttcacttgtatgttaatcgtgtgcaggtccttatcaaggtggtgtgtggaaagtaagggtggatctacctgatgcctatccttataagtctccatctattggctttgtcaacaaaattttccatcctaatgtggatgagatgtaagttgtttcaatgcagccatagcttcattgaataattgtttatatcatatttaagcagcacaaatatgctccatgggaagtctattggctgttgcacacacacatagcaaaactcactagctcataaatatgg

SEQ ID NO: 548 - DNA, 728 bp, Glycine max
  misc_feature (58)..(63): n is a, c, g, or t
  misc_feature (621)..(626): n is a, c, g, or t
  misc_feature (659)..(664): n is a, c, g, or t
  misc_feature (666)..(668): n is a, c, g, or t
  misc_feature (710)..(712): n is a, c, g, or t
  misc_feature (722)..(722): n is a, c, g, or t
ccctctacatggagtaccgtaccagaaaggaaaaagaaaatgtcagtttcaagaaccnnnnnnttcaggtattctcattctgccaaatctatttctcacaatgtctaaggttctaaattgtctaaatagtttcatcgcaatcttcgatgttgcgagtaattacagatacatgcagtcgatatggctgcaattgtgatcatgatacggttgacgagggtccaaatatctgcattcacagccaaaattacagttgcagaccgatttttaaaacttaggataagaccttagtagaagtatataggactatttcacaatgatcaacggtgtgtttgaattagcgttgaaatcacgttgaacagaaaaattgcgtgtttcaatgcaaaaatttcaaagcaactatggtatagttttatggttagcgttggattcaagtattgatttctaaacacacactaaatagtctaagttgaaactcactgcactggatttcatttatttcagtggtttgaagtgcttgatgggttgctgggtccgtattggaaagcagtgggcttagccttcaactgtactttcctcctctttggatctgtgattcagcttatagcatgtgcaaggtaaagnnnnnntcttaatttctgcaaaaaaaatcgaggcaatcnnnnnngnnngttctgattacacaacatcatttacactttttttggttcctnnngcaaaaaccngtaaca

SEQ ID NO: 549 - DNA, 678 bp, Glycine max
  misc_feature (68)..(69): n is a, c, g, or t
gtgttgctaccacactcacattaaaggcctaggtctcgaggtgagttcctcttcctcttccacatctnnctcctagtaaggtggaaccctattgtgtagtcatgttctgctcttcaattttgaagtgaatagttggaattgtttttgtttgttcaggcgagtggaaaagcattgagttttgctgctgggttcgttggacaagttgaggcaagagaagcatcaggtcttgtggtggacatgatacggcagaagaagatggccggccgggcacttcttctcgccggaccgcccgggaccggcaagacggcattggcacttggaataagccaggagcttggcaccaaggtttctttctcaagactctcattctttgtgttgtgattgttaccccttcttgctgcttataattaagtttattccactctgcaggtaccgttctgccctatggttggctccgaagtttactcctcggaagtaaagaagactgaggttctcatggaaaattttcgacgggccattggtctgcgtatcaaggaaaacaaggaagtatacgaaggggaggtgagtttgtagctattctcttgtcaaaactcggatgtgattgtgccttgttcatattgttgtttatgttttgctggtcttgtttaaggtcaccgagctctctccagaagaaactga

SEQ ID NO: 550 - DNA, 796 bp, Glycine max
  misc_feature (708)..(712): n is a, c, g, or t
  misc_feature (747)..(757): n is a, c, g, or t
tgccactgaccccttcttacagcggtttctcttcaaactcaggacttatacatgacaccaccaatcacagaagggtcaatagaagcatgaaattcagagtttcagcaaaacaagagaagcaagaagagaagaaaaagcaatctttgttcagcagtgtgactgaagctcttgatttttctcaagtgagatccgctgaggatgctcagcttatagaagaggctagagaagccacaaaatcaggagaaagaatgagtagggaacaggtatatatattgtattcttcctactcatattgtttatttagtaaatattttcttaataatcctgctaactaatttttttttaatgcagtatggagctcttagaaggaaaattggtggtacatacaaggattttttcaaatcttacgttgaaggttcaaaatagttattcttgtataatagcaatatatacttttaccttctaaacaaatgagacattagtctgttccttgattagtctccttttaagtagccaacattctttaatcttcattttcttctttggctaatgaaattattctatacaaaatgttcttttttctctgctaataatggaaggagaatttcatgtccttcttgacccaattggtgttaatttgacaaaaatgcattggttactcattgtcaattctatcaccaattggcatttttcattttttgatgatgnnnnnaggtcaatatggttagttgaatcagtgtcttaatnnnnnnnnnnnctgaaaaattatttttccattgagcagtggacggggcat

SEQ ID NO: 551 - DNA, 380 bp, Glycine max
cgatggctctcctcgccgtcacttcgcgcgctcccttcctcttctccccaaaccctaaaccactttctccatcctctttctactcccacctctctctctctcctcgctctcccaggttcccttctctccgcttccgctctgccaccggagacgccagcgacgccggcaagcccgccggtaagatctccgacgagtggggcgaggactacgatcccgaggccgaagcattgacctccaagcttcccgactcggaccctcccaaggacgaggacgagtggcaggaaggaggggcgcccgacgccggcggctacgtcgacggcgggaacggaactccggtcaccggagctgaggatccggcggaggaggaggtggacgataag

SEQ ID NO: 552 - DNA, 549 bp, Glycine max
aacatgcacaacatgagcactctcgttttctttatccttctttcaacgctactaagtgtaagcacagttacccttcttcactgtcactgcttcaacgctcccttttctcatttcatcatgttcacgtctaagactaacatatcatgataactatatgcgtatgtgtgttttatcaatgcaggtttgttacggtggtcgcgacttagtagataaaaacccgttcaccgagcaggcttacgtggcacgctactgggacaaacatgttggcaacaacttgccaaagccatcgtttcttctctccaaagcctctccaatgagcgcttccgacacggcgtcgttcgcgaacctcgccgccaccaactccctctccacgcggctgccggagttctgctccgcggcgcacctcctctgcttcccggaggtccggcccagcctcgagaaacacaccggagactccgatttccagacctacaacgacggccagaacttcaccaactacggcaccgacttcgccggcggcctcgacaccttcaagaactactccaacga

SEQ ID NO: 553 - DNA, 558 bp, Glycine max
acgatctaattcaagtttaaattttcagttctgttctgcttctaatggcgagtttcagaaacgctgccatcaacgtcttcagagcgatcaatactaacaaagccaccatcgctgcttccacaaactctcttcacactctcaggtaaggtacccttcaatcacaccttcacttcttcttcgttcacctcttttcccttttaacaaaggttatcgtttttttttgcaggccccttttttgttattctaggtttacccctttctcttcccacactgaagctgaatccctgcaaatcgatttatctaacgaagaaagcaaaagatgcttgtttaaccggttcgtttcttctttttaaaagctttacgcgttttgatttctatggtaaagctgttatttttatatcgttcttttatttgtttgatttctcaacaggctattgtatagaagcaaacaacgagggttcctggaactcgatttggtcctcgggaaatgggttgaggaaaacattcactccttggatgaaaatcggattaaggctctcattcatgttctcgatctgg

SEQ ID NO: 554 - DNA, 309 bp, Glycine max
cgcctagacgaattaaaccatgcaaggatggatcctttggggtctcgcctagacgaattaaaccatgcaaggatggatcctttggggtctcgcctagacgaacctgctatagttggtagaaacggtgcttttgaacgtagtgccctcccacctggatatgggagtaggatgccaggttttgcagctggttctcaccatatgtattcacgacagaattcagcagaccgattcaatgggtagtttgaatgtccatttttttgttctcatcttctacttttgcataaaaatgctgtatgccttaatctgcag

SEQ ID NO: 555 - DNA, 447 bp, Glycine max
tcctcgatcttgaggacgaagtatcgcgacgagtcgaggacgggctcgacggcggtctcgcgctggccggcgtagacgaagcaggcggcgaagagctcaccggagctcggatcctcgaggcgaatctcgcagcggtcgcgccgggacacgacgcggatccgccccgaccagatcttgtcggactggagccactcgccgcacttgtagccgccggaggtgcttcgcggcgggatcttgtacaccgacacctcgcgcaccaccaggagcgtgtgctcgaacgcctcctcctcctccacctcgaacgacatcgttttcggggagggaaaattagaattacttgagtttgagtttgagtttgagttttgggaaaatttaatgtgaatttgagacgctttgtgaattgcgatttgaggaatgaagaattgaaggtgctgtgtctgtatctca

SEQ ID NO: 556 - DNA, 374 bp, Glycine max
  misc_feature (271)..(271): n is a, c, g, or t
  misc_feature (322)..(323): n is a, c, g, or t
  misc_feature (331)..(333): n is a, c, g, or t
  misc_feature (336)..(338): n is a, c, g, or t
  misc_feature (343)..(344): n is a, c, g, or t
  misc_feature (355)..(356): n is a, c, g, or t
  misc_feature (358)..(359): n is a, c, g, or t
  misc_feature (361)..(363): n is a, c, g, or t
  misc_feature (365)..(366): n is a, c, g, or t
tggttgacccaccaggtgtgtttcaccttgtacttcaatttcgtttgaaccaagtttacttacctatttattcttttggtgactttcttccttgcttaattttctcaattcccattttctgattctatattacatatatatatatatattattggagtagagctacccaacagtgtattgtgaagatttgaaagcattatctatagaaggtgatctggagaaggtggcaactctgtctgaaaaggtgaaggaaaaggagtttgaagaaacnaagaagttgtgggatagggcgttctatcaaccttatgaaaaagctgggggnnaggtgccnnngannntgganngtgttatctcnntnnannncnntgtctatt

SEQ ID NO: 557 - DNA, 372 bp, Glycine max
cggctttatctgctaagcaaacagccaagtcatgtccgtcagtggatgtagaatggccacctcgtgcatcttctggtgttaccccacaatttggtgatactgaaaggcagacaatagcagcaggaacttcatccacatctaatcttgaatctgatgatccttttgctgattggcctccgcatcctaatggctcagtatcaggtggatctggaatatccaacaatggtactttaggaatgccactaaacaaagttgggtttaattcaatgacaagcacttcaagcaatatggctccccaaactagcaacagttggcctgttaattcccaaagttctgccgagtccattagtttgaactcaaggagtgctagtt

SEQ ID NO: 558 - DNA, 310 bp, Glycine max
ataataataataataataataataataataataataatgagtaatgttttcatgaagtgaatagctactatcaaaggtatagtatgtaatgagctaaagaaatcggttcatccaatgcgatcttggcattgtaccaatagcttagtttaggatagcttagtttaggggtatagttgcagttttgtccaaacattaagtgaaggtatataggagataccttattgagtagaatattagattcgagtcttgtcgaagagttttgtcaccttaattaactctactaatcaattaatcggagtttaaagtggct

SEQ ID NO: 559 - DNA, 384 bp, Glycine max
cgatctccgccgaagacgcgttcgacaacggccatattcgtccgatttttccgattttcaaccaggatcttctgttctccgacgattacaacggcggcgacggtctccggctgccgataaaggtcttcgtcgaacacgcggatgtttctccgtcgccgtcggaggcgacgacgccggcggaaggaacatactgcgagtggaatccgaaagcggcggtgaagagcaactcgacgggattctcgaagctgtggaggttccgagacgtgaagctgcggagcaacagcgacggaaaagacgcgttcgtgttcttgaaccacgcgccggcggcgaagccggcggagaaggcgagcagcgtcgtcgtgaagaaggttgaggtgaagaagg

SEQ ID NO: 560 - DNA, 403 bp, Glycine max
cggcgatcccgaacgccttcgccgtgtccctttccggaccgcaggggcagatcgtcggcggattcgtcgccggcaggctcctcgcggccggcacggtgttcgtgattgccgcgtcgttcaacaatccgtcgtatcaccggctttcgtcggaggaggaggcgcagaacaactctggcggcggcgcaggagacgcgcagtctccgccggtttccggtggcggcgtggagagcggacacgttccggctgagtcgtttatgtacagctgtcaccttccttcggatgtgatttgggctccaacccctagaccacctttctgatcatcatcaatcaactctatttttaattcgtgcttgtgttgtgaattttgtttcgttaatctagttgtttgagttgtaatgctgct

SEQ ID NO: 561 - DNA, 479 bp, Glycine max
tcagagattgaaactctcaaaggtctatcaagtgagctggaaaagaaggtagactttttaaactttgttaaaacaactatctgtcctgtgttgtgttgttattttgatttaaatgggaatttatggggttgcagcttgaagatttgcaacagttagtctcgaacccaaagtcaattcttgctgagatcctaggaatagcagctgccaaggtaggcaatgtgaaggaatcatcttcagcaacggtgagttcctcacggttggctactgccaacagcagtggaggttttgactccccaaccatttcaactgcccacaccaatggatctggtggagtcacacaccttggtgtggtgggaagaggagttaagcgagcatcaaatgccactccggcagaaggaagcacaccaaagaaaccggcattagagtctactgaagacaaaggtgatggcaacgcacactgatgtaggtcttgatttatt

SEQ ID NO: 562 - DNA, 556 bp, Glycine max
tggtggaagtttgcaccaggtagatgttctaactacgttggaaaatgccctgctggtgattcttccaccgagccctacattgttaaccaccacttaatacttgctcatggagcagcagtcaattgctacaagaacaaataccaggtcatgcatatactaattaaccaattaaatttcttattcattactaaacattattattttaacatcacacaagttttgtaaaatatttgctttatttgttgtatattaaatgtaccatatatatatataggctcatcagaaaggacaaattggagtcaccatagtgactttcttctttgaaccaaaatctaatagtgatgctgatcgcaaggcagcaaggcgagctctggactttatgtttggctggtatgtatttctcctattaattaaagatacaactttgatctattggattatccaataaattttaattcataagcaattgatggttgaacttaattatatatttattttttcaggtttgctaatcccattacatttggtgactatcctgagagtatgagatctttag

SEQ ID NO: 563 - DNA, 400 bp, Glycine max
accctttttctgggacaaccagtagttccacttcatctatcaaatcacaatcgcatgattcacacatgagtcaaattttgcatcaaagtattggttcaaatcatcacttaagtgggtcaacacatggtttgaatgtaattggtatgccaaaacttgaacagcagaattcttttaatgatcccaagagactgccaggtggatctgtgtctcctgctgtaaacaatacagtgtctcaacaaactaaaaatgcttggcaaccatcaacaaacaaagaacaaaatctgggcttaatgtcatctgtttcttatgtcaaaaaggaacctagtgacttatctactgagcagcaaaataggcatagtttgtctaaattgcatgggtattctcctgttaattctgctca

SEQ ID NO: 564 - DNA, 403 bp, Glycine max
tggatccaagcaatctgctactcttaattcagctcccaaaggaccaaaggttgatttgggggacgatggttttggtgattttcaaaatgcttccaaacccagctccactgcgtttccattcactgcttctcctggaattgatatcaattttactggatcaggtgatagtggtgatccaatggacatgttttttacggcaacttcctcctcggcctctggtggaggtgctgctgcggcctctgatggatttggaacacaggatgattggggtttggattcggagtttggtgggggaggccatgatgtaggtggcaccactactgagcttgaggggctgcctcctcctccttccggggtgtcaggttccactgccaaaggcaaagggatggacaattacaagcag

SEQ ID NO: 565 - DNA, 571 bp, Glycine max
  misc_feature (536)..(550): n is a, c, g, or t
  misc_feature (553)..(557): n is a, c, g, or t
  misc_feature (559)..(559): n is a, c, g, or t
  misc_feature (561)..(563): n is a, c, g, or t
  misc_feature (565)..(568): n is a, c, g, or t
cggcgtcgtttcggactccacaatctccgtagaccgcaccacccgaagccctagaggttttggcttcgtcaccttctccgacctctccgcagctgataaagccctccaagacacccacgtcatcctcggaagaacggttagtttcattgcacgtttacgaatttcaagaaattgttttcttggtatgtgttaataatttatttgtttgatttatggttgcttctttctgtttgcttgcttgttgtgtattataggtagaagtgaaaaaagcaattcccaggagtgaacaacatcaacaccaaaacccattacagagtagagggggtggttattattattttaataataataataataataataataatgataataataataatagtaatgactattgcagtgaccacaacgttaggactaaaaagatatttgtagggggtttacctgctggtatatccgaggaggagtttaagaactactttgagaggttcggtcggataaccgatgtcgtggtgatgcaggacagtgtaactaannnnnnnnnnnnnnnccnnnnncncnnncnnnnccc

SEQ ID NO: 566 - DNA, 366 bp, Glycine max
tatattctcaatactactcacgttgttggtgctgttggttttccgctagggatgtcttctaattactccaataatataattagtaatgttgttaattattctttgttgatgaagggtggttgccaaccttgtcaagtgttcggttccacttctaaacaattgctcagctaattatagttgagaggggaagttttgtgagagggaatttgcttgtttttatgatgagaagcagtgggttgggttctgtagtgttaattaattggtgtatgcatgggttcggtgggtcgtgatgaagaacatgttttctccatgttgttgccgttgttgcaaatgaatttcttttgcttttacaatggtcggaaggtg

SEQ ID NO: 567 - DNA, 505 bp, Glycine max
tgggggagacgagaaaggagagcgatggagcggagcgatgacaaatctgacggagatggcctccaatctcgactctctccagaagcttctcctcaccaaagccgtcttcgtcgacgacgacaccttctccaaagcctccctcgccgccgaccaggcccgcaccatcaagctcctccagcaacgagtccagaccttggagagagaggtcgacgccgccatcaccaccgccgcccgcgctcgctccgagaagcgccaggccgaggctgctcagaaatccgccgaatcgcgcgctcatcagctcaccgccgaactcgaaaacaccacaagtatcatcatcctctccttttcctctttacgatcatttcacttccgatttcagttctcgttgctgcaattgaggtttgtaatagttctgatctgcaatcgaaagcactaatcatttctgatttttgttttttacagaggtgtttgagctgcacatggaagagctgcgagcgaaacaaga

SEQ ID NO: 568 - DNA, 547 bp, Glycine max
  misc_feature (448)..(449): n is a, c, g, or t
  misc_feature (488)..(488): n is a, c, g, or t
  misc_feature (490)..(501): n is a, c, g, or t
  misc_feature (521)..(525): n is a, c, g, or t
  misc_feature (530)..(536): n is a, c, g, or t
gtcatacttgccagaagaaggtgaagtttattgaatttcacagaaaaccatcaatactcggttgaataacatgttataaagtgccgaattatacggaccatgacatgttattggggacaccattgaaattgggattttgatgcatttcaggagaaagaatacaaagacgcccttgaagcttttaatgaaaagaacagggaaaaagtacagctaatcaccaagttaatggaggttagttagtctcatgctcaatcatggttgtgaatgatttgaatttaaatacatttactttccttattctaatatgtgggatattgttattattttcttcagttggtgagtgaaagtgaaagattgaggatgaagaagctggaggagctgagtaagaacatagattcgatacaatgatttagccaaactgctaatgactcctgattagccttgtgtnntatattaaagatgatgacatagtatattttatatgtatngnnnnnnnnnnnngtgcttgtgtaattttgtgnnnnngatgnnnnnnnaactagcattt

SEQ ID NO: 569 - DNA, 322 bp, Glycine max
tgctccttcaggagaaggtatgtttaattttgatggcttgccatgttcagttttctcccatatttctcttagcgtcttcaaaattaactaacaaaattgtcatgtgttgttgtccttttcatagaagggggaagtgttccagccgaggatgcaccttccaaccagtaagcagcaatcagtcttttgatgatgtgctgactattgttctaatacctgagtgagtaggtatcacttctttgttttcaacaataaaggaagcttgtcatgtattcatattagcacaagacaaatgatttgatctgcacctacgcaatagacattt

SEQ ID NO: 570 - DNA, 401 bp, Glycine max
tacttatgaattactagagtccttatcaaagaggcacaggtcatacaaccacatactctccctccttgaatcagaggaagatgactccacacaagacctatcttctctcatcacttccctccaacaagaaatcaccaattgtgcctctgattcggacacccttttgaaccaacacagcctcaccaacaccaccaccaccaccacaacaaatagtaatttagaggattgttcatcctcaacaactaaatattctagtgacatgatggaggaacatgatgacaaagaaggggtcatgagacaccttcttgaagcttctgatgatgaacttgggattccaaataaagaggatgaatcactcgatcttggtgaagatgggttcaagttcaacggtggagacatgt

SEQ ID NO: 571 - DNA, 532 bp, Glycine max
cgttaaggtacgattgcttttcgattcccttcaatttttcatgtttctaaccgaacaaaattgggatcggtgttgcggttttagggtttagtttggtgcgtgcgatgaagatcgaggaattggacgatggagagtgtagtagggacgaggaagagaagtgtgagaggcagattgtgagcgttgatgcgaagagagcgttggttggagctggtgctcggatcctgttctaccccacactcttgtataatgtgcttcgtaacaagattgaagctgagttcaggtggtgggatcaaattgacgaggttttgctctctctctctctctctcacacacacacacacacaatcctatttgatttcgttcttgattaatcgtggttttgttgttttgaattgttgtataattgttaggcgagaatcgtaattggggttttattgaaattttgtttgttatttatagtttttgttactgggcgctgttccgttccccaaagacgttcctcacttgaagaagcttggtgtgggtggtgtga

SEQ ID NO: 572 - DNA, 974 bp, Glycine max
tatatctgagtttgaaagacagaaacgcccatgacatttgtttattgtccacctgccacaaaaaaagcatcatttcatcagtgaaattaagaggtccaccttaaaaattaagctaatcaaagccaaacccacttgaaattcctttaatcacagttattagcacgagaaattaacatcaaatcagtgcgaggttgaacatcatgcccttctctatttaaacattttttcttctttcttaattataactattgttcttctgaatgaagatattgtggttttctttttatatataaaaagaaagaaagaaggaaggaaataaatatatggatttcatcataagactactcaacaactcaaactcaagtacaagagcttatgctgcttgaagccttgaaactttgcttcaaatataatatgacaagtcctcaaaaaactccaacggcaaaactatttcaaacctgaattccttgaagtaaatatttattttacaagaaaaataagataaatgaatctcttccatgaaaaagggtcacttacaaaagttaaagggtgacgatcacttggtgatagaatagacagcatagataattccaggtatataaccaaaaagggtcagcaccaaacaaatccagaactccacctgcatccaacgaattatcatcaaccatgtgttgtattaattagtcacacactctacaaatccattaacatgcaatgaaaaaaggtaaccaatttttgtgtgtaaaatctttaattctgaaaagaaaatatgtaaaattaatatatacctggcaaccatatttgagaaagacaccaagaggagggagaataatggcaagaaggatgtctatgcatgtagctgcaccgtcaccggccatttttttttttcactctggatttccttaacttagaaactttttttctttctgtggaagtagttgcaacttttgcgaagcaaatggaacaattcgaat

SEQ ID NO: 573 - DNA, 603 bp, Glycine max
  misc_feature (564)..(564): n is a, c, g, or t
tctgggagatgcattattgtcctaattccgaaaggcaattattatgccactgcggacttctgtgtccaccatcaggacttgaaaggagaagttttgtctatgttccggacatgcaaatttgaagagccaaatgagggcggagaagtgagctgctgctctggtttaacattgagcggtaattttgaatgtataaagtcttaggcagctagattttgcggaagctttcatgatcttccatccttggaggcaccttattattttttagccaatatgactgtgaagtagagaaacttcaaatgttgtaaggtcaagtgcatactgttgcattgtttgcttgaagcgtaagtactaaaaatgttggagttatttgactgtacaggagatcaattactagtatttgacacatgaatctaatgttcatcatcgactccctcttataaggactgtgaagtagagaaacttcaaatgttgtaaggtcatgtagacactgttgcattgtttgcttgaagcataagtactaaaaatggtggagaattaattgactgtacaggagatcgattactngtatttgacacatgaatctaatgttcatcatcgactccc

SEQ ID NO: 574 - DNA, 311 bp, Glycine max
  misc_feature (81)..(81): n is a, c, g, or t
  misc_feature (129)..(129): n is a, c, g, or t
  misc_feature (220)..(221): n is a, c, g, or t
tgaaagaatgtttcgcggtcaaacttaccatcatcaagtactaatggaactactgcttttggagaatcaagttctcataangtgttttcaaatatgagaaatgcttctcagtcaaacttcccttcctcnagtgccaatctacaagaacagatgagaaaccagatgaaagatccagctatgcggaaggtatgcttgtatttcttgttaaggagataaaatnntctctagctttcttccacatacctggctggaataaatgcaatcaacttgccccttttacttgtcatgttactaaggagtaatttctgatc

SEQ ID NO: 575 - DNA, 346 bp, Glycine max
ggtttaaagggatgtgcctcagtaagcacaactgcgcttcggtttgccatcttgaaggcttcacgggtggcaagtgtcgtggatttcgtagacgctgtttctgcaccaggcactgttagttggtccatgaaattttatccttgttggttgctctttcacctttctgtttctgggattaagaaataaatactccttagtgagtcgtgtttttaatttctaggttcatttgggttggctttatatcttatgctttgatctacctcgcttctgtttcaatttggttggccaatgttgcaattttaatttctagtgttgtatgtttctcttttgtggtgtacttgccata

SEQ ID NO: 576 - DNA, 769 bp, Glycine max
  misc_feature (764)..(764): n is a, c, g, or t
tattgtttttatattattgtataaggataaggattaattaatattggtaagtcgtgacacaatatatccactctgttgccacgtgtagatttcatgttattttaaatttaattgtttattctaaccaaataacttaaagttagatcaatcaacatcgctaactaatcatgtttgccctgtatagtatcatcgagtcctaaatcattatatgaatatgctatttaaattatttttgtttttcaattttattggtgtttgtttattgaagcttgtttctatgttacagaaaggcaaaaagcgagccagaaagcaaaccccaagcaaatcttctggggaaggatccaaaacatctgccaaggtgcgttgtcatactagaaattcattgctccatatctgttatacactagtctttgtgtgcaatcccctgcatcaaaacatgttgccaaatgtttgattcttcatgtagcatgaggtaatctgatttatgatggttcagtatcatttataattatcaactaattggtatattattgctagattttgtctttaattaggctttaatattatttattttcagttgtttgtctgatcctatccctataaacagatttgaaattactatctgtgattatgatcttatggaggtgaactcaaataaaaattgccatctcaaagcatagttttgtcagatgtttgcatattgacaggtttaccattaatggtagtttggttgagggtgttttgtgattcagcctgggagatgntccag

SEQ ID NO: 577 - DNA, 1006 bp, Glycine max
  misc_feature (597)..(601): n is a, c, g, or t
  misc_feature (621)..(626): n is a, c, g, or t
  misc_feature (645)..(647): n is a, c, g, or t
  misc_feature (649)..(650): n is a, c, g, or t
  misc_feature (653)..(662): n is a, c, g, or t
  misc_feature (680)..(690): n is a, c, g, or t
  misc_feature (705)..(705): n is a, c, g, or t
  misc_feature (707)..(712): n is a, c, g, or t
  misc_feature (723)..(730): n is a, c, g, or t
  misc_feature (732)..(733): n is a, c, g, or t
  misc_feature (742)..(754): n is a, c, g, or t
  misc_feature (756)..(764): n is a, c, g, or t
  misc_feature (768)..(779): n is a, c, g, or t
  misc_feature (784)..(787): n is a, c, g, or t
  misc_feature (793)..(813): n is a, c, g, or t
  misc_feature (815)..(818): n is a, c, g, or t
  misc_feature (821)..(823): n is a, c, g, or t
  misc_feature (840)..(841): n is a, c, g, or t
  misc_feature (845)..(846): n is a, c, g, or t
  misc_feature (856)..(856): n is a, c, g, or t
  misc_feature (858)..(860): n is a, c, g, or t
  misc_feature (863)..(868): n is a, c, g, or t
  misc_feature (873)..(875): n is a, c, g, or t
  misc_feature (877)..(878): n is a, c, g, or t
  misc_feature (880)..(882): n is a, c, g, or t
  misc_feature (888)..(892): n is a, c, g, or t
  misc_feature (897)..(902): n is a, c, g, or t
  misc_feature (906)..(909): n is a, c, g, or t
  misc_feature (911)..(913): n is a, c, g, or t
  misc_feature (915)..(917): n is a, c, g, or t
  misc_feature (924)..(939): n is a, c, g, or t
  misc_feature (941)..(941): n is a, c, g, or t
  misc_feature (944)..(946): n is a, c, g, or t
  misc_feature (950)..(954): n is a, c, g, or t
  misc_feature (959)..(966): n is a, c, g, or t
  misc_feature (968)..(968): n is a, c, g, or t
  misc_feature (973)..(977): n is a, c, g, or t
  misc_feature (981)..(983): n is a, c, g, or t
  misc_feature (986)..(1002): n is a, c, g, or t
ttgttagagtagttgaggcttctgctgcagaaaaactagcccaaccagagaaagatttgtttgactgggtcaaaaatgacaacagaaggtttctccatgttgtgtaccgtgttggagacttggagaagactataaagtatgctgtactttaattttggaaatgatacttcactgatactttaatataaacgtgtgaaatctaattcagtagcgatgtgtgtaatttgattacattgttggggtgcatgcaggttttacactgaatgccttggcatgaagctattgagacaacgtgatatacctgaagacagatattctaatgcttttcttggatatgggcctgaagatttcaattttacagttgaacttacctacagtgagttgagatttgaatgcctctcttttctgtataatcattatgtatatgcttgtaacttatcacaaaattgcttctcatcatacttgctatttcatggagatcgcagattatggagtggataactatgacattggaagtggctttggtcattttggtgttgcagttgaagatgtaagccatttttttaaaagataataatctattattgtgtacaactnnnnntacatatatgccatgctaannnnnnaaactgtttgattatcatnnntnncannnnnnnnnnttgtcttactttgaatannnnnnnnnnnagatcaaacttatantnnnnnngttacttttannnnnnnnanntttttttgnnnnnnnnnnnnnannnnnnnnnaagnnnnnnnnnnnnaattnnnnaatccnnnnnnnnnnnnnnnnnnnnnannnnttnnnttttggtccccgaaccnnatcnnttttggaaantnnnaannnnnnaattnnntnngnnntaaaannnnntcttnnnnnnaaannnncnnntnnnggatatnnnnnnnnnnnnnnnngntannntttnnnnnaaatnnnnnnnntntagannnnntccnnnacnnnnnnnnnnnnnnnnnaaaa

SEQ ID NO: 578 - DNA, 403 bp, Glycine max
ctttgacaatgacaacatttctaggaccgtggttttctctgaagatctttgtgaaggacgatgaaaactgagaaaacttggccattcaaaatgttttttatttttttcccatttttgtgagcactttcaagctttcaaccaaaaagttttttaacctcatgaatcataaggcacagaatttccaaataaatttaagcattttgttggtgagtggaatggtaatgtgaatgcaataattagtagttagctgattatttatttaaagatgagttggtaatagcttgtataaatagaataaaatttgccaaacggctcactagttttatttattcttgtcttgaacaaaggaagatatcacctgtattcttcgattgggtaaaatcacctgtattcttcgattggg

SEQ ID NO: 579 - DNA, 463 bp, Glycine max
  misc_feature (454)..(456): n is a, c, g, or t
tagtacaatgtgaggattctaaatacttgacccttttattttacacttgttgactttttatgaaaaagcatcgttttcccccctatgtttttggttaaatgaatatctgatggcacttactagtgaagcacagtaaacattttaacttccattgttgcagcgtgatgtcgttgcatcatatttagatagtggaagccctgtagatgagcaaggtgttgaagatgcctttgagctccttcatgaaatgaatgaacgtgtcaggacagggatctgggttggggattgttttatctacaacaattcttcttggaggcttaactattgtgttggtggtgaggtatttactcttttcccttttagattctaaagagctccatatttatttattgaactctttgttatcatcttttctttgtgttgatgaatttcttatatgtatatttattgaactacnnngatcata

SEQ ID NO: 580 - DNA, 369 bp, Glycine max
actccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgatcagttggaatatcaacgatatgtaatatgtctgtgactaccacatttcaaggatgcttagtaaattatatggtatggcctgtctatacaggcctacaatacatatatagtgtcaattatgtatgtttggttcttatcaaaagtttaagttgtgctagaaactacgatattgggcgatgtaa

SEQ ID NO: 581 - DNA, 804 bp, Glycine max
  misc_feature (730)..(732): n is a, c, g, or t
  misc_feature (747)..(752): n is a, c, g, or t
  misc_feature (794)..(799): n is a, c, g, or t
gggcctgtggtagtagcatcacttctaattttctgtttagctggaagttgctatgggaaggttcacttctcttccttgaaaagaacccttgatgtcactgcttcccccaagcaggaacaaggtaagtaaaaactaaaaacatcccttctcagattcccccgtccatttcactattcaaattctactatatatcactaattttctcccaatcagcgaggcaattttccaccttgtaattggttatgccaattaaaacacacagggatgaattaattaatcagactgcgttttagtttttctttgtaggtagaaatcaaagacaaatatcaaagctttacaatcatacactttactcaatcaattgaactaaattcttcaattgaactaaattcttccgaccagatcatgtttagttctgaattttaattaattgtagttaattttaattatagtcgattagaccttgttctgtgctcatgaagaaaatttgcgaaagttgtatgtagtccatgatttgatgaattgggtcattaaattgataaattaagtccttttatgctaaacacgatatgaatatggtgttagtaattaattgattaatttaattaattatgcagttctggaggctggattagacaaaatcacagtgacatgggcattgaacaagaccttacccgcggggacagactctgcctacaaaaccataaagctgaagctatgctacgcgccnnntagccaaaaggaccnnnnnnggagaaagaccgaggacgagctgaaaagggacaagacctgcnnnnnnaagat

SEQ ID NO: 582 - DNA, 421 bp, Glycine max
  misc_feature (376)..(376): n is a, c, g, or t
  misc_feature (403)..(403): n is a, c, g, or t
cgggcgccacgcctcccttgacatctgctccatttgcttcagtgctttctccgtcgtgtccctctttgtcttcttctatattgaaaagagaaagggaaaggcttcttcctcaaagtgatgattattgaatcacaccagaaaaacgtgccaggtttacatttcatggtcattaataaatcatgagccacctgtttttccctcccataatagtcgcttatctttagtacaactaaatttcacgtcaacattgtgaagcatgatgtccccctaaagctgtaatatgagggaaagagcagatattttatgtatgtgattaggacatgactattagtgtaaaattacttgctgcatgtttgtttatcatgatgcaagaagnagttgtacaccaatagtgatgttgtantcacatacataaaaaatc

SEQ ID NO: 583 - DNA, 323 bp, Glycine max
ccttctctctttctcttgctcgatattttccaaccaaaataattattaaaaccaaacgtagctaggcaccacttctaggaatggcaagtgagatatttcttgcccttctgatcacaacctttgtggttgcagcctctgctggtaacttcaaccaagactttgagataacatggggtgatggtcgtgccaaaatcctcaatagtggggaacttctcaccttgtccctagacaagacctctggctctggatttcgttctaggaatgagtacttgtttggaaaaattgacatgcaactaaaactcgtgcctggtaactctgcaggc

SEQ ID NO: 584 - DNA, 521 bp, Glycine max
  misc_feature (397)..(453): n is a, c, g, or t
  misc_feature (460)..(515): n is a, c, g, or t
ctttctgatcatgctagactcacagctgtgttttcaccagcaaggatgagatgttctgcctcacaaaactgaatgtacttcatggcactaatagtcttagcccacagaaaaatattcaattttgggaccagtttggtgtaggggtaaactgaagtgatactttttttcactttcatttttagtcccctaccaaacatgtcatgccataattagtgattagtctgtcttgtatatgtgtttggagtcaaattaaagtagtgttgtgctgtaatcagttttggtaagccctggccatgtttttttctctggtaatgggataacaatgtaaagatatttttgcaatgtagaagtggatgtgcatattatgtatttccttctcactgtttgaatccattgnnnnnnnnnnnnnnnnnnnnnnnnnnnnnnnnnnnnnnnnnnnnnnnnnnnnnnnnncataacnnnnnnnnnnnnnnnnnnnnnnnnnnnnnnnnnnnnnnnnnnnnnnnnnnnnnnnnctcttc

SEQ ID NO: 585 - DNA, 400 bp, Glycine max
ttcagtgtattacaaaatatacgcttctgcaaagagaggaggtgcagcgagtggagcactgttctggcagcttctaacggagggcatggagtctttccaagacggttacggaatcattcttgggcagagttcctctacggccaatctcattgctcgccagtcccgcaagctgtacctgattcggaagatcttcgcaagggtcgcgaacatgcggcgatggcaaagggccagagccagaggattttctggctccggaggtggaaacggaggcagatacattgacaactgagaacatgtttggtttgcagtttcaggattttatctgttaaatttacattgaagcgcgcgtcacagtatttttaactgaaaagcttgtttgtgttgggaagacagacatctt

SEQ ID NO: 586 - DNA, 636 bp, Glycine max
gaaaacatttggacatgacatattctatcaaatgggattctaccaatgtcacttttgggcgtcgctttgatgtctacctggatcatcctttctttgagcatcaggtacaactttgcttttaaaattgaaatggtgttgtttatggtttggtgaattgctatgtattcatccatgttggtcctaccatatctctgtcactgagaattttgctcctttgttttctttttccctagattcattggttctccatttttaactctttcatgatggtcatcttccttactggattggtgtcaatgatattgatgcgaactctgagaaatgactatgcaaagtatgctcgggaagatgatgatttggaaagtctggtgatggtttcatgacttttatctttaataatttggggaataggatcctttcttcctagataaatcattgtggttctaattgttgaatatttggtcatttcttccatgcttacaggagagagatgttagtgaagaatctggctggaaacttgtgcatggtgatgtttttcgacctcctcgcaacttagttattctttcagctgttgttggcacaggtgctcaacttgcgttgctggttcttcttgtcgtcttgttggctattgttggg

SEQ ID NO: 587 - DNA, 517 bp, Glycine max
attgattgtgagtgcaattctgccacttaaatctgagttaatcttctttcatgcattatgagttacacttgataaatgaattacttaccatgttctctatttatttcaatgtagaacaggaaacatactccgtagatgcttgtatagtttttaatgcctcgggaggtttgatatcaggccagtgaacatatatgtttaaatcttccagatggatgcatttgaattcattttatagttgatagaggtcgttcaatttttttatgtgccagtgaatagcttgttagaacatctgatgctactggagcaaatcaccagtgagagggttgatattgttatagttaatatcaacagatgcgcattgtgcaaaatcttttagtatacccatttgtttttgttgattttctgagcagaaatattgttggacaatatgttgaatgtagatttgcttttgcattgttaagtatagaatgaattggatgagaatagtttttgcacatgggattggtacccataagaa

SEQ ID NO: 588 - DNA, 372 bp, Glycine max
ctttgatggagcgtgctgccaggctttttctcttaaaatcaactcccctggatgaacttccaaagaagctgattgcgaagaagtaaggagatttttgagaaggcagttatttctctgtacagtatttcttaactgtttgcaccttgtacttgggtgtcagttgtatcctctgatgacttgtggaactctgactgatgcatgccttttctgttcgttttagtgttcatattgggctgtattttgatgtaataaataccgttaccagcagccaaaggaagctgaacactgtataacccaagaattatgcattataaacaattccaacttttctttttggtattgtattatgagataatgacgagtatcatcaat

SEQ ID NO: 589 - DNA, 1025 bp, Glycine max
  misc_feature (417)..(419): n is a, c, g, or t
  misc_feature (428)..(429): n is a, c, g, or t
  misc_feature (491)..(495): n is a, c, g, or t
  misc_feature (516)..(521): n is a, c, g, or t
  misc_feature (527)..(528): n is a, c, g, or t
  misc_feature (532)..(533): n is a, c, g, or t
  misc_feature (547)..(551): n is a, c, g, or t
  misc_feature (562)..(563): n is a, c, g, or t
  misc_feature (565)..(566): n is a, c, g, or t
  misc_feature (569)..(570): n is a, c, g, or t
  misc_feature (574)..(575): n is a, c, g, or t
  misc_feature (579)..(580): n is a, c, g, or t
  misc_feature (583)..(588): n is a, c, g, or t
  misc_feature (590)..(590): n is a, c, g, or t
  misc_feature (597)..(597): n is a, c, g, or t
  misc_feature (600)..(604): n is a, c, g, or t
  misc_feature (609)..(609): n is a, c, g, or t
  misc_feature (612)..(613): n is a, c, g, or t
  misc_feature (616)..(636): n is a, c, g, or t
  misc_feature (640)..(640): n is a, c, g, or t
  misc_feature (642)..(648): n is a, c, g, or t
  misc_feature (650)..(651): n is a, c, g, or t
  misc_feature (656)..(660): n is a, c, g, or t
  misc_feature (662)..(679): n is a, c, g, or t
  misc_feature (681)..(684): n is a, c, g, or t
  misc_feature (687)..(692): n is a, c, g, or t
  misc_feature (698)..(704): n is a, c, g, or t
  misc_feature (706)..(708): n is a, c, g, or t
  misc_feature (712)..(717): n is a, c, g, or t
  misc_feature (731)..(736): n is a, c, g, or t
  misc_feature (739)..(749): n is a, c, g, or t
  misc_feature (751)..(754): n is a, c, g, or t
  misc_feature (760)..(765): n is a, c, g, or t
  misc_feature (768)..(775): n is a, c, g, or t
  misc_feature (779)..(784): n is a, c, g, or t
  misc_feature (786)..(789): n is a, c, g, or t
  misc_feature (791)..(791): n is a, c, g, or t
  misc_feature (794)..(794): n is a, c, g, or t
  misc_feature (796)..(800): n is a, c, g, or t
  misc_feature (802)..(804): n is a, c, g, or t
  misc_feature (806)..(808): n is a, c, g, or t
  misc_feature (812)..(816): n is a, c, g, or t
  misc_feature (826)..(829): n is a, c, g, or t
  misc_feature (841)..(845): n is a, c, g, or t
  misc_feature (854)..(860): n is a, c, g, or t
  misc_feature (868)..(872): n is a, c, g, or t
  misc_feature (875)..(875): n is a, c, g, or t
  misc_feature (877)..(885): n is a, c, g, or t
  misc_feature (891)..(891): n is a, c, g, or t
  misc_feature (894)..(896): n is a, c, g, or t
  misc_feature (898)..(898): n is a, c, g, or t
  misc_feature (904)..(904): n is a, c, g, or t
  misc_feature (916)..(917): n is a, c, g, or t
  misc_feature (930)..(941): n is a, c, g, or t
  misc_feature (944)..(952): n is a, c, g, or t
  misc_feature (960)..(964): n is a, c, g, or t
  misc_feature (977)..(978): n is a, c, g, or t
  misc_feature (980)..(981): n is a, c, g, or t
  misc_feature (983)..(983): n is a, c, g, or t
  misc_feature (985)..(988): n is a, c, g, or t
  misc_feature (990)..(991): n is a, c, g, or t
  misc_feature (1007)..(1007): n is a, c, g, or t
  misc_feature (1009)..(1009): n is a, c, g, or t
  misc_feature (1012)..(1018): n is a, c, g, or t
gagggtaactgcaaacaaagcaagcaaaacaaaagacgcagtgatggagaggatgaagagggtgcttctgctgcttctggccttcactgttcttctcatgttgccagaagcttctgctacaaagtttactgttggaaacaaccagttttggaaccccaatattaactacactgagtgggctaaaggcaaacatttctaccttggtgactggctctgtaagtaccctttctctctctctctctctctctctctctctctctctctatatgtgttttctaccttgatgatgagagtgttgctgtaccctctctatgaactggatctgaattagttcaacactaagataagttgattaaaacttggtagcttatatatatgataatttaccatgttttgaaaccaagagggtctacattnnntgatttcanntcttatggttttctatcttttgttaacctttgagcctctcattggatccatgttttctgatnnnnnaaatggaaaaaaaattggatnnnnnnaactgnngaanngtaaatttgtaatnnnnnttctgcccaanntnngtnnattnnctgnnaannnnnnantttttanggnnnnntcttnggnnttnnnnnnnnnnnnnnnnnnnnntccntnnnnnnncnnaattnnnnntnnnnnnnnnnnnnnnnnnannnnaannnnnnttggannnnnnncnnntttnnnnnntttgtgccttggtnnnnnntcnnnnnnnnnnnannnntttgtnnnnnnccnnnnnnnntgannnnnngnnnnanacnannnnncnnntnnncccnnnnnattttttttnnnnattttgaaaaannnnnaaaaatttnnnnnnntttttttnnnnnccncnnnnnnnnngggggnaannntnggggcnccccccaaaaanntttaaaaaaaaannnnnnnnnnnngtnnnnnnnnngggacccnnnnnggtttttaaaggnnannanannnnannaaaaaatttttttttntnttnnnnnnnttttttt

SEQ ID NO: 590 - DNA, 713 bp, Glycine max
  misc_feature (666)..(666): n is a, c, g, or t
  misc_feature (684)..(688): n is a, c, g, or t
ttcataatttcgatcgcaaagcaaatgatcccacaacaagaacccgatttcaatctcaatcacctcaaattatattacggttcgttactttcacttcccgtttcgcctttttcttttaatctctgtatcaaggtagcataatttcccttgtttcgtactgggttttaaccttttaaaggttttctcttctcttatttttgttttccccaggaaagctgtttccgtttgctgatttagttagatgggtgtcgtatggcaacggtaagaatatcaccaagcccatgcttccaatgagtgttgaatgaccttcttaattttaattttaaggattaaatatatttttagggtgatgtttgtttttttgtccctctaaaaaaatcgaatcattttagttcattgtttatagaaatgtgttaggtgttttccttgttcttcacaaaaatgtctcttttttggtcattcgtttatggaaataggaaccacacatgacacactttcatatgtgatagaccaaaatgagatgattatttttttagggattaaaagtgagcatcatttcatttgcaggtctagaaacaaagtttatttttagttttaaattttttgtggggattatttgtagatggaaagcaccctggttgtgatcaatcctacattgggcgaagngagttttccttcactctnnnnnatgatatatatctgcgtttccaatc

SEQ ID NO: 591 - DNA, 897 bp, Glycine max
cttgagagctgcgacagagaatctttgtatcagtcctggcagttggagcaagcattttgggatgctttgcattttcaaaagaactaataatgattcttgaagctcctgttaaaacacagggtgtaagatttcttcagctagctcctggtgaatttttcttcacaactttaaaggtaagatttcttacatatatctctgagatggttgttgtttcctttgttatcaaatgagctgtgatattttatttcttggtacacatttcatgtaaaattaaaccagtgtttatgctggtgctcttgctttatcaggaatgtacgaagctctgccgtaattcttatgtccgcctcataactagttcccagatcatagtatttgtgatggccaaaatctattttgtgtgtgtaccactttactcattttccgtcacgattttttttccagcgggtggggtgtgtggttaggaattatttgttaaagaatcggacctaggacctaactcaattccacaaaattgacttgtaagatgaggactgtcctaaccttaacaaggattacttgatttaaacaaagaaaatgtgttactacctaacttctaggcaatgttgtgttgtgcatttaacaatttttgcatacccatctaagttgagatcaaactctaaagataaaatacaagaagctaccttgattgaattaacatttttgtcattctgaactgcaggtgtctgggtactgtggccttctcttgggaagtcctgtcatcctctatgaagtcatagcttttgtacttccaggacttacaaaatctgaaagaaggtttctagggccaattgttttaggctcatcagttcttttctatgccggaataactttctcctacttagttctgacacctgcagc

SEQ ID NO: 592 - DNA, 453 bp, Glycine max
ttatcctgatgttgcttcatattctgaaactgtaagcaccttgaagtttgctgaacgggtttctggcgtggagttaggcgctgctcgtagcaacaaagaggggagggatgtgagagaacttatggagcaggttatttctatttttgaatgcattttacttggatgttttagttatcagcgaagcaccaaatgttatgaattggaattttagttattcattttgttttttacacttgtgccccatcatcaatatccaggtcatcactcttgctgtaggttaagctgatattacaatatcatttacaaacgcacactgacttgtattattcttgcagttggcatctctcaaggatgtaattgcaaggaaggatgaagagattgaacggttacagtcactcaaggctaaccataatggtgcaaagcttggtatgatctcagtaagacatgggtcat

SEQ ID NO: 593 - DNA, 386 bp, Glycine max
ggcggagcgtgctcgaagaagggtcagggtcgcgtcgtgtggttcgttcggtgtttcttcctgtggggaaggggcttgacatagcacacgtgtcggccattggggggggctccgctgctaagagatggttcaagcatgttgaccaacaatcaggggaggtgcacgttattagacgatgaatttgtgcatatttcatttgcagtcatgaggtgcattttcaatgcagcttcaacgaataaaaactaaaacaaatgttctgattctttggccgaatgagttttgtctcataattattttgtaccagatttttaacatgttctttgtctcactagggttacgtacgtttttagttttagcagcacttctattagggacagattgggaca

SEQ ID NO: 594 - DNA, 309 bp, Glycine max
gtcggaggtggccattgtggtggagaaatttaagaaactgaatattcaagtagggtgaagttacacatggcaatggcatgggtaatggtggtatcgacctgtggtggaaagatgaggtttgctttggttggttggtactttgttgtagcatatagtcagtaagattatatgtttcttttttctgttttataaaaaaagttgtttattttttgggagaataaataaaagtccgatcagagagggaatttaagatagagaccaataaagaagaagaggggccttaattaaggttgtattttttattttttt

SEQ ID NO: 595 - DNA, 605 bp, Glycine max
ctagtttggttttgttgtccgtgttatttctccttctccaacgtcctctctcatccttctcagccaactccgaaggtgtgttttttaatgttccacttattgattattttgcttgtggtcctgtcctagctaatttctttcttgttttgtaggaaacgctcttcatgctttgagaagcaggctttctgaccccagcaacgtgcttcagagctgggacccaaatctcgttaatgcttgtacttggtttcatgttacctgcgactccaacaatcacgtcattcgcttgtattattctttctaatattccccttcccttctttctaacaatctcatactccaacaatctaatccttctttttcaatttcagagacttgggcaattctaagctctccggaactttgggaccagaacttgcccagctaccccacctccaatacctgtttgtatctgtctcttttgtttctcccaacccaacaatccatcatggtctcacttattctttgttgagagtgcagggagctctacaggaataacataagtggcaacattcctcgggaactttctaaattgaagaaccttattagtatggatttgtatgacaacc

SEQ ID NO: 596 - DNA, 398 bp, Glycine max
tccgcttcaaggccttcgagcctatcctcctgttgggtaagagccgcttcgccggcgtcgacatgcgcatccgcgtcaagggtggcggccacacctcccagatctacgccatccgccagagcatcgccaaggcgctcgtcgcgttctaccagaagtatgtcgacgaacagagtaagaaggagatcaaggacattctcgtgaggtacgatcgcaccttgctcgttgcggatcccaggcgctgcgagcccaagaagtttggtgggcgtggcgcacgtgcgaggttccagaagtcttaccgttgaagaagaatggtggtggtgttttcgtgtttttggcttttggtttcggttcatgttttatgctgtggaaaaaatgaatactttcgttgctggtggttt

SEQ ID NO: 597 - DNA, 459 bp, Glycine max
  misc_feature (445)..(455): n is a, c, g, or t
gtgccgttgagaaggacccactctcttctgaatttctatagactgaaccaaaaacatccattattggtaaaagcaatattaaggttaaatgaaaacccagtaatccacaaaaaaggatgtgtaacaaggcaaaaagagaggtaatgaaaaaatagatgctggaaaaggaagtacggataagtggattgcattattggtaagataaatctaggagtaaagacacaacaagaaaaataaaatgtgaaaaataattgcaatctatatgaaacaacagacattaaactttgaaaataaatgagtgaacaatatccctgaatgcattaaagaatgatttagctttgcaccagaaaaaaaggaaatctaagacatcaaattaaagtaagattagtatcagaatgaagtgcttcccccctctctagctacatctagaacctgattatggtgnnnnnnnnnnnttat

SEQ ID NO: 598 - DNA, 682 bp, Glycine max
gtaggagtggtggttacttataatattggaacaggacttgtggttgcacgtagggaagatggttcatggtctcctccatctgctgtttccacctttggtgtagggtggggggctcaggtgaagtaactaatcttaaacgatattggccaaacagtgcaattactaatgactttgcttatgaatgactatggatcagttgccaaaaatctatcactatatgctatacatactgcttccggtcaactgtaataccagaacattttattttgttggactctagaatttaatagtaacttctggtgaaatttacagaaatatatattatgcaatagctaagtttccacacagatcttcattttaatattattctgtttactcctcaactgtaccaagcactgattctgacttcctactccatacatatgtagtctgtctcaaggttttactgatatttatttgtttctatatattctgaagtgttgatttatttatttaaccacataggctggaggtgagttgacagacttcattattgttttgagaacaaatgatgctgtcaagacatttagtggcaatatgcatctttcacttggagctggtttgagtgctgcagtaggcattgttggtaggtcagttgaagctgatgttcgagctggtgatggtggctatgctgcttgttata

SEQ ID NO: 599 - DNA, 401 bp, Glycine max
actcttgggatcaattcatcgattttcctctccctccttccatctccagcttcttccccggcttcgaattcggattcggctcatcggtggttaacacacgtgtggactggagggagactcccagagcccacgtgtggaaggtcgtgcttcctggcttcacaaacgaggacgtgctggttgagctacaagaccagagggtgctccaggtcagcgtggagagtggtaacttcctgacgaggtttaagatccccgacaacggtaacctcgaacaactcaaaaccaacatgcgtcacgggattctccttgtcactgttcccaagtttcatcaacccacttctaataggaatgtcagggtcgttgagattgaaggcaccgactgaacccagttagcaaactctgtc

SEQ ID NO: 600 - DNA, 751 bp, Glycine max
gagtagtatatctgagacttttgggttgcctgactagttttttctgttggttcggcataggtattttgcctgaagattaaataattactaatttgctctgaagtaaacatgattttctcttggaaaacgggctagtggagattagaattgtttgctaaaacatttagttattttaaatctttagccactattctgggatggggtaaatggcctttaaaactactattctgctgagatgggatcaatgttcttcaaaatttagaaagtttcagctttcttttattccaaattaggaagctttggtgcgtaaatttcttaaatctttgcctaattctatgttgttctcgattgatttttcattccaatttctaatttatattaaaatttttgtaatagtgcatcacgagattaattctatactcttgcaggatggaaggtgcgttgtgcagagtatttcccatattctacatactttgagggatgccacagctctgcctctcccaactcggccttcagtcagttacgtaagaactctgaaaatgagagtctaaaccattcagtggatggtcaaaatgtgggctccatcacatcaaacgggaaactagaggcatttaaagatctcactatctgatcaaatcaaatacatccatcaggctaaagacacgtgcgtgttaccctagtttggatgcttataaaaccaaacggcatttcatactcccataaacgactgcgttgcaatttgcagcaacaa

SEQ ID NO: 601 - DNA, 757 bp, Glycine max
  misc_feature (595)..(595): n is a, c, g, or t
  misc_feature (661)..(662): n is a, c, g, or t
  misc_feature (716)..(717): n is a, c, g, or t
  misc_feature (720)..(721): n is a, c, g, or t
  misc_feature (727)..(729): n is a, c, g, or t
  misc_feature (739)..(744): n is a, c, g, or t
  misc_feature (747)..(747): n is a, c, g, or t
tttggattgtgttggagatttaacgttaactagtgatatggccaaaagtagtgtatataaatgggagtaactcattgcatgagctagtttctgggttgagttggtttaaacccaaattataagatgcagatgttattaaagcctatcctagggttgctgttggacctatcgggtgtcttgttattggatcactcacaaatgtccaatcctgctaactttacgccaggcgtgatgcatatctctcattgaccagtaatatgttacaaaattagtgtgtataagtagggagcaacaccactcacctcatgagccagcttttaggattgagttaggcccaaaccaaaattataagagattatgtttctattgttgtgtgaaaggctggcttgtgacagctttcctctatgatcacacttactggagttagctaatttggagccatgcattattgaaggttgtctattttttttgtttcaatctcaggaaggttcaaattgggtgtttactgctgaacattatgagggttctcgcccattcactgttcaaacgaactatagaggtttttctgaaggtgatgatgatgttttgctaaacnagtgaagactcaacccttccttttctttcacaatgaatttatgcattaaagtgagtactgaacttnnttaatggctgtcaggtaccgaaagtgggtgatgaactttgtaattgatggtggnnatnnatgctnnnaagtcaccannnnnnctngtaatgattt

SEQ ID NO: 602 - DNA, 435 bp, Glycine max
agcttttgtgagcaaggcatggaaccctctatccctcatacttacataaacaatttagtactaaaattacaaacttacattgttgttgttgtttcacaaacaggcagctgtagaccagagagtacatgctctatacggactgaacaagagggtggaagcagtaggcaatgtgaggaagctcactaaactagacatgaaacttaatgactctcttccacaaatcactgtcgacccagataactacactgttacagcagatggcgaggttctcaccagttttgcaaccacctttgttcccctttctcgaaattacttcctcttttaagtactagctcccataaataaagcttaaaaattatctctcttctaaggttttaatgtgtagcactacccttataaattttttagttcccctgctcttgttcttatgaattc

SEQ ID NO: 603 - DNA, 439 bp, Glycine max
  misc_feature (192)..(192): n is a, c, g, or t
  misc_feature (356)..(356): n is a, c, g, or t
  misc_feature (400)..(400): n is a, c, g, or t
ctctcgaacagcgtgaagctggtacaacaacggctgttgtttctgagcaaacaaaagcaattgcaggtaccttttttctccgtatatacaggtttaattttctgcgtattcattaagtcgtgtttttatctcagatttggaggtctttgctgttcttgtttaaaaaaaaaaaattcctaattgctttaacanattatcattatctcatcacttgctattttgttagcaatctatattttcgctgaccttaattgtatttgcagctaaaatatcaaattgggacaatgttgttttggcctacgagccagtttgggccattggaacaggaaaggttgctactcctgctcaggctcaanaggtatgcttgcctatattttgttaacagtacaattgttttggngaaaacttgcttgccactatgctgttttttttttggggg

SEQ ID NO: 604 - DNA, 629 bp, Glycine max
tcaccaaagcccatttgcagagctacattcagacacattatgcggctcctaggatggtatgtagaaaattaataggatcatgtgtgtatgtgtattcttgttagtgtgtaattactctgaagacacggtcattttgtaacttatattctgtgtgggttttctttcaaaggtgatagctgcatctggagctgtcaagcatgaagacattgttgaacaagtgaaaaagttgtttaccaagttgtcaacggatcccactaccacatctcaattagttgctaaagagccagctatttttactggttctgaggtaagaatgtttgtgtggagcgcatttgaacccatctttatggtaaatttaataactaatttctctctgtgttgctcttaaaacaggttagaatgcttgatgatgatattcccctagcacaatatgctgtggcttttgaaggggcatcttggaaggatcccgattcaattcctctcatggtcatgcaagctattttgggttcttggaataagacagcaggaggtggaaaacacatggggtatgtgacttgaacgccccttcctgaaaaaggaaaaattctctccctgatactaactgaatgcattttgactataaacagttc

SEQ ID NO: 605 - DNA, 688 bp, Glycine max
aaacatgggaaaacagagcacagaattctctgccctcaactgcatcgacctctccaaccctgacatcaaccaatccgtcaatttactcaaacaggtttttgcttcctcaattcactttgttttttgaaccatgattttttatcatgtcatattaatgttttttgtttttgtttttaggcatgtttggattccggttttttctacgttgtcaatcatggaataagccaggaattcatggaagaggtttttgcacagagcaagaaattcttctctcttcctcacaaggagaagatgaagattctcaggaatgaaaaacacaggggatacacccctgttcttgatgagttgcttgatcctgaaaaccaagtgcatggtatgtactatatacccttatgcctttgttgcatgtttacatagagtccaccatgctttctgattcttattattttgtgattctgaaccggtaaaaatacttagatacacagtttcttatgtacttttggtgttattagccgatcagaattgaagtaaaccttcatcaaacctttattattaaacctttattagataaaactctaattctaatcagaaaatgtatctaaagttgtacatacaaaaattctgtctttctgagacttgctaacctttttctctgatgggttaagtaggagactacaaagaggggtat

SEQ ID NO: 606 - DNA, 379 bp, Glycine max
accatttctcacaaaacccttcattacacacattattatcattatcacacacacaaaaaaaacctctcatttcaaagagagagagagagatttcacagaccaaattgcagaggacgacaaagttcacaacttcaaggaaaatcgaaatggcccaagtgagcagagtgcacaatcttgctcaaagcactcaaattttcggtcattcttccaatcccaacgaacccaaatcggcgaattcggtttcattgaggccacgcctttggggtccctcaaaatctcgcatcttggtgaacaaaactggaagccttatgggaaattttaatgcggggaagggaaattccggcatgtttaaggtttctgcctccgtcgccgccgccgc

SEQ ID NO: 607 - DNA, 361 bp, Glycine max
ttctgtttcctgtcttagcagtagtacttattcttccattcactttcctaatgagataattattgggtaggaatttgttttaacccaaatggaggattggagattgtagatcatttactgcatccagagtcattaattattgaatcagttagaaagctgatatgtggacaatttgcatcaaatatttaacttaattcctctgctatttataattctgccaagcgtgattttactggtgaaaaattaaggcaagtatctggaagaaaagtgaagctgagctagagccccaacattttgaactcttaggcagttcatttggcactgagactcccgggcaaatgaaggcagctcgtagctatat

SEQ ID NO: 608 - DNA, 359 bp, Glycine max
tattaggggaaatgccaagagaagtcacagatctaaatggattaaattttttaaacttgtcccacacccaattgattggtcatatttcacaaggtattgataatatgggatctttacagtccgttgatttttcgaggaatcaactttctggtgaaattcctccaacttaaccatttcaaatttgagctttctgagcatactagacttgtcttataatcatttgaagggaaaaatgccaacaggaactcaattgcaaacctttgatgcctccagctttattggcaacaatctatgttgtccaccactgcctataactgtagctccaatgtgaaaactcatagttatgaaggaagtgatgg

SEQ ID NO: 609 - DNA, 372 bp, Glycine max
acaatctagtttcatttcagtatttcatcttctcctcttctatacttgcttttttccattttccaactaaatggaggaaactttggtgccaaagaggcctagagaagaagcccaagtggaaagaggcttggactttgaagaagattactcctcctcaaagaggcacaagccatacaaccacatcctatcccttcttgattcggaggaagaggactcaacacaagacctctcccctctcatgacaaccctccaacaagaaatcacttgtgcctcgaaaaatacccaagacgtccttttagtgttcccaactcaagaaaatgaccaaaacaccctcacgatcagtagtttagaggacaataatgcaacaacctc

SEQ ID NO: 610 - DNA, 647 bp, Glycine max
  misc_feature (56)..(58): n is a, c, g, or t
  misc_feature (544)..(548): n is a, c, g, or t
  misc_feature (586)..(586): n is a, c, g, or t
  misc_feature (588)..(588): n is a, c, g, or t
  misc_feature (590)..(590): n is a, c, g, or t
tctaccagcgagtcgactcggcggcatctccgagtcactgcagatccccattgagnnnttaggctcgtccttgataccctcgcctcgattctgcactccgactccgaacctctcgtcgccgccaagctcgaagaaatcgattccgtcggcgtcgacgtccatgatctggttttgttcctctacattcaatcctacaagaggctcctcccgcgcacgcacaaggactccgccgccgtcgccgatgtctggccttccacctccgccttcgacggctacttgtccgctctctcgccgcttcaggtgaattcttcgttttccttcaatcctagctttttcggtgacgcaattcgatgtgttattctgcggtgcgctattaggcattgaggtgttgttctggagtctggaccaatgcattgcttaattcctgtaatcttggattaatttcttgtggatattttgactatcgaacacttggatttggttttatttatttattattagctggtgatcggtgctttttcattcgttatgattctatttctgnnnnntattctgttgttgattctgatgttaaatgttatgcagnangnacgcagcaacagtcggcggtttatgccgtcccaggctgagaagaggcacatcaatgt

SEQ ID NO: 611 - DNA, 297 bp, Glycine max
gtaaccctcctcccgttcaagagatgaaatctaccgatgacaaggaaactcctgaaacgtcttcacctaacaacatcgagcatactgagttggagatagaggctgtataaggaaggaaggaatactatgcttttttaatagagaattttttcttttgacctttgactggagttctttcttcctgtttcattgggcgtgtcatatgtaggagtaccacatattactttcctcggctatagagagccaaattataccgtatccttaattttgaatgttttccggcttcaaccattaatc

SEQ ID NO: 612 - DNA, 353 bp, Glycine max
atatgttgcagaccgcagcagagttggtgaaaaaggcggctccgtaaatgccatgctgcttcgccacgtcgagaacccaggggaaaaatgagtcatagacaatgcaggtgacgggggagggagtttgttggtgttttttgatgagctcagacaaggtcctggagccgtttgttctgaaggaggcaaggaagagttgcacgttgttgttggtctgggcgaagccggcttggtcgaaaccatcggagatggcttcgaccgtgatgttgggtgcattgatggagttggcagtgtagtgggtggtggcaactgtggctttgacaccctttgaagctaatctttttgcgaattggaca

SEQ ID NO: 613 - DNA, 359 bp, Glycine max
ggtcctcgacaccggctccgacgtcaactggctccaatgcaaaccctgctccgattgctaccaacaatccgacccgattttcgacccgacagcgtcctcctcatacaaccccttaacctgcgacgcacaacagtgtcaggacctcgaaatgtccgcttgcagaaacggtaaatgcctctaccaagtctcatatggtgatggctcattcactgtaggagaatacgtcaccgaaactgtgtcgttcggagccgggtcggttaatagggtcgcaatcggttgcgggcatgataatgagggtttattcgttgggtccgctgggcttcttgggcttggtggtgggcctttgtcattaacttcac

SEQ ID NO: 614 - DNA, 691 bp, Glycine max
caagcacttttatttgacaccagcaaatgtgtgccttgttctcatgttttctgcaagtatgtattgtgtactgtgtttatttcttgaatctttgatgcattgaatactctatttttagctcatttctcatattctacctgtctgaaattagagcatgcatattgcgcttcaaggactgcccgttatgtggggctgatattgtgaagatcgagcctgatgctaatcttcaaggtgtagttgatcactttattgaaggtcatgcaaggatcaaaaggtctgttagttcagacaaaggagaagaagcaactgagagtaaaaaggtcatatatgaggatgtgtctttggaaagaggttctttcttggtgcaacaagccatgagggtaagttggtctttttaaatgttaatgttaaatctttatatatgaatgattaaatggagaaagataaagattctttaaaacttttgtcgttaatgtaattggcaatgatgttaataattcttgatagtgtactggtatgcatgattagatgtgttggaaaatatctttatctaggagagacattgatgttaatacttaataactgttgctctgctgcagctactgccatttgtttttactaagttacatattgaactttgttggttttgtactacttcttgataatgtgtattttgctatatgcaattcaa

SEQ ID NO: 615 - DNA, 348 bp, Glycine max
ggaaaggtcatgttggttcagggcccccaatcaattacagttacccccaaacagtagcaccatattctgcatctccttatccaaaccctcctcccactgcaccctcactttatccaatacaatggcagattccttatcctcaagtttctgcaaagaaagaccaacatggggatccgcctgctgctgtaggaatgaacccttattactatcccaagcaatgaatgtatttaaaactaaagatgatgattttggtactcgtttcttttctttgccttccttttcaaatcgttttagaccctagttacctctcctatccccatcacttattaatgcagttctgcgaccttt

SEQ ID NO: 616 - DNA, 395 bp, Glycine max
gttcttcaggttacaaatattaacaggtggctgattggtgattgcttgacagttgctgttttgatacatttttggagggtgaggctgctcccgccccatttcatacggtcatcccaattctttgtttctgccggtatatgtacctgaggatatgtttgtgtaaatagaagactatagtttattagtatatgttttccgggcatttgtgtcattatccggaagtttggtatcaaggtggacttgaatgcatttatcatgttttgctattcaatattcttttcactttaatatcttttactgtttcctttttttcttgtctagaatttgcactcattttggatgcaatcgatgtatcttgttttgtaatgattgaaataatacacaatcgctgatgg

SEQ ID NO: 617 - DNA, 764 bp, Glycine max
  misc_feature (221)..(221): n is a, c, g, or t
  misc_feature (752)..(757): n is a, c, g, or t
cacctttgtatttgctttctgcctggtattacttgtcagccttccccatggaagtattgatcccagtgagtatttcattctgattacttgttttctgtccgcttcaagcagctggttatgatataattggtattacattgtattataggaaagggaataagtgatggtttgagatcatgcagaatgcaatatgagataatattctgttgctaatcactaanacttttctgtataggcatggctggacttgcagtaacatatggcctgaatttaaatgcacgtctatcacgatggatacttagcttttgcaaacttgaaaataaaatcatatccattgaaagaatttatcaatacagccaaattcctagtgaagcaccagcaattgttgaagattctcgtcctccatcctcatggcctgagaatgggacaatccaattaattgatctgaaggtactcagctcaaattcacattaggaatgttctttgctccttgttttcactaagaagcacatgcttgtcctatcgttttaattgaatttctagtcattttatagtttgcttttgtccttttcttttttaagaggtaaaattatcccttatatatcattgtttgttgcactcatttagcatctaaactaagctcttagcaatgtgatatgcatcaaagtttttataatgattattctactgcaatcagctctttctcatgctgatgcatctccttttgaaggtacgttacaaggaaaatcttnnnnnnggtgctt

SEQ ID NO: 618 - DNA, 373 bp, Glycine max
tgggtacttgcccccattcctgtagaagccaaagcaactgatgaagtcaccactctgctcacaggattctgagatttaaattgtagcataatggaattttcgtgatctctttttataagatatggatttgtcttgcaatgcttttgactatgaagttgattgctaaatcattgaatcagtgttttgcagaatatttgtaatcatttcaagattgtagttctgaggattcttgtttcttcaaaatcttcaccttgtttctgtttaatttatgctggctatttccttttactgtctccaatgtttcattaatcattttagaaaattaaagttcaattttgtagctcatacactatgcaatgatgaggcttcaaga

SEQ ID NO: 619 - DNA, 706 bp, Glycine max
  misc_feature (35)..(37): n is a, c, g, or t
  misc_feature (580)..(584): n is a, c, g, or t
  misc_feature (613)..(628): n is a, c, g, or t
  misc_feature (644)..(646): n is a, c, g, or t
  misc_feature (664)..(665): n is a, c, g, or t
  misc_feature (684)..(701): n is a, c, g, or t
gtctttcttaaacccaaatcttgtgacatcacaannngtaccctttttgtttatttcctttgtgggttttcaattcgtgcaaatttctgcgacacccagatggattttgcgctgaatccgtgtcctttgcgatcttctacgttcgtgaatttcgtcgagagggttaaacagcttggtaccctcgccttttctgcagtcattgggaacatcttctccgcgatcttgaccttctgcttcgcattaggtttgattcgtcttttccttttattcattttcattttcattcgttgcatttctcgctcaaacgcttgatctgcttctgtttacctcgtatcatgggtttggccttttttttaatcatttttttttgggggtgggggggatgattgttgtcattgtctggtgttgtacgatgttctgtgctttcaattaagacagaaaatgtgtgttttttataatttgtttgaaaaaaattgaaacttggggtgggggtctgctatttgttggctggattgttttgcttaggttgtcttatttggttattttcatattattcaaaaacgtccaaagtttggttaannnnntcttatatccctgccctggtgttttatcnnnnnnnnnnnnnnnntgtgctttgtttaagnnngtttttgtcttctgcagnnggcactttgttgggggctnnnnnnnnnnnnnnnnnnccccc

SEQ ID NO: 620 - DNA, 385 bp, Glycine max
actgccaactacccacctcaaggaactcctcagccaggttatggggttccccctacatcccaagcagcttatggcaatcaatcacagcctggttatggtggtgcagtgcaaccagggtacggtcctcaaacatatggtgctccgcagggtggccagcctggttatggtcaggcgctgccttcatacagcaacagttcttatggtgctggttatacacagactccggcgtataccggtgatggtaatgggaatgctcaggcaccccagagtgccattgctaaagcatccccttgatattttggccacccttcccctccccttctcatagacgatttttattgtgtttcaccgtttatggtactagtgacaccaatgtagcattgca

SEQ ID NO: 621 - DNA, 399 bp, Glycine max
  misc_feature (381)..(381): n is a, c, g, or t
tgtttgatgctaaggtcttgagtaagatccccattgggtccattgaaagccaagttatcttagttgttaatctttgtaacatctgaaagaaagagctccacttgtttgctcaaggaagttgccagggccagtgtcttttattgaatgtcgatctttgctatgtttgggttggttttaggctgtggtatggtgtcaatggcaatgggtttggtttatcttcaaatagtagtttctaactgttcaagcatatggattttactggtttttttttaaggtttgtatgagttgttcaatcaaataattgttgttgtatgataaaatacttgcgtcttttttttttttttttattttttagttatttttctttacctttgagtttanttcgttaccgtctgtatt

SEQ ID NO: 622 - DNA, 400 bp, Glycine max
aacggggaagaagaagcagctcttttggccctatgtcctcaactgtcccttgttttctcctccttttgttctgtctctcaggatctgctgaggcctacaagaattatacagttggagactctttaggatggtttgacaatactgagaagtccaatgtcaattaccagaagtgggctgacagtaaagaattcagcttgggagatttcctcagtaagtttcttcatcatgtttttctgcttgcaatccttgtttgtgtgttttgttgttgtctttaaaaatagtggttgaatgttttttgacaatttctttatggcttgattgttctagtttcaattctttgatctgatctccaatttgcattgatctggttttatttgactaaaattcaacactactatga

SEQ ID NO: 623 - DNA, 409 bp, Glycine max
tatgagagtccgataagttttggggctacgcatctgcttgaacgaatggctttcaagaccactagaaaccggagtcactttcgggtagttcgtgaggtagaggcaattggtggcaatgtgcaggcctcagcttctagagagcagatgggttacacttttgatgctttgaagacctatgttcctgaaatggtggaactgcttgttgattgtgtcaggaatcctgttttccttgattgggaggttaacgagcaggtacctttccaatctccatctccctgtcaagaatgcttttagtcatagcttctcttactaatattgcaattatatgcagcttctgaaagtgaaggctgagattggtgaagcttccaaaaatcctcaagatttacttttggaagcaattcattctgct

SEQ ID NO: 624 - DNA, 382 bp, Glycine max
ttgacgtgtaccagacgcaggacgaaagagaagtggcgcgcgacttcacttacatcgacgacgtcgtcaagggctgcctcggcgctctagacacggcggagaagagcaccggcggcggcgggaagaagcacggcgccgcgcagctcagggtttacaatctcggcaacacctcgccggtgccggtggggaaactcgtttccgtgttggagacgttgctcagggtgaaggcgaagaagcacgtgatcaaaatgccgcgaaacggcgacgttccattcacgcatgctaacgtgagcctggcgtggagggacttcgggtacaagcccaccactgatctcgccactggtctcagaaagttcgtgcagtggtacgttgggtattacaa

SEQ ID NO: 625 - DNA, 380 bp, Glycine max
acttgtatgaagttcgcaaaagagggaagtaaactggacttgttcatttcacttggctgttacgtttgcgtgaccctgacccataatgtgaaaacagggttcatttttgcagcttcagattctgtttacttagtaccaataaagaataatgccacagccattcagactttttttttatatgaatagactaaaactatccctaaatactcaatttggtagcaacttcctaatatgttaatacaaattttagcattcccagttacgtgttgttctctgaaaggttagagggtagacatgctcaaagagactaatttgttgtgtttgttacgcgcgaggaaatcagaattatgaaacccgtgactgcactaaaactgtttttt

SEQ ID NO: 626 - DNA, 770 bp, Glycine max
ttggttacggaactagagttcctggtgacatgctgattgtcacaattgtcttctgttactctgttattgctcctgtgataatcccatttggtgctctatattttggcctaggatggcttgttttgcgaaatcaggtgaagttcttggaattttgtttaatgaacccagttttatgttttatgtggtaattttttatggctaaattttagttttcattccttatgtttatgaagtttaatgatcatacactaatagtataatttcacactgtcaagtgtcaactaataaaaaatcattgttcatatgacttttaatatatttattacaaaagtcaataaatttaccctagtgatatgtgattgagtgatgaccatgttaaactactttacattatcagtgcatagtttattttctctatgtttatttaaagtctcaatttagttcttttatcaagtcattttgaaatcaagtatgttagtaaatatatttttaaccagtttgtgtatatacttgtattaatcaacaggcactcaaagtctatgtaccaacatttgaaagttatggaagaatgtggccacacatacacaaccgtattctagcatctttgatattataccaaattacaatgtttgggtactttgggacgcagaaattctactatacaccacttgtgcttcctcttcccatattgtcattggtctttggttttgtctgtgcaaagaaattttaccccgcctttcaacatccagcacttgaggttgcagctaata

SEQ ID NO: 627 - DNA, 718 bp, Glycine max
  misc_feature (686)..(689): n is a, c, g, or t
  misc_feature (695)..(695): n is a, c, g, or t
tataattcatttgagcttttctcttcatatgttctgacaattctccagataaactttacttcattgattatgaatatgcatcgtacaactacagaggctatgatataggaaaccactttgcagaatatgctggctttgaatgtgactatgacttgtaagttctttatgcttgcttctctcctttagtcataatttctgtgactactcaagttacttcagttcctcatttaatttctgtgactataatttgtgtgacctcaatttttgcttgaatgtgactataatttgtgttagttacttcagttcatcattttcataatgcaggtacccaaatatgaatgaacaatatcattttctccggcattacttgaaacctgaaagaccccaagaggtactaattactgtgaaggggttaaatatttcatattctattttatttcattgtctccagcttgtcaatcatctctaaaataagatgcacatcatgttattcatagtctggcttgttggtgacatatttcatttgtgctgtttaagatttaaaaaccattttagtggtgcttggcatttgtatgggtattctggttaaatcttttactacatgttgtattgggtcataatggatttttctgttctgatcttcacgttgcctgactttcttttatcagctttgttttgattgctannnnaataantgctcttttattttaatatttat

SEQ ID NO: 628 - DNA, 418 bp, Glycine max
atagctcaactttttgttctttgaatcttttccctatgtagaagaatgcgttgcatgctgggcattctaaattgtgatcctgatagttgtttccgttgttgtgcttatgctcaatctgcttgcattattttgattcaaacatgctttgattttgcaggactagttcaaccaaccgttgatgacaaggtcttaaatcatgattaccaaccttttaagcgttcgttcctcgttttttttagcagtaactttcagttcacttgttcataaatcaaaatatacttgtgacagctattgtgattttcacactaaattttatcctacatagtatattaatagattggatacattatatattcaagcttgtgaattgtgattctaaattgtaaataaaattttgctgtcaaggtgtatgttggtt

SEQ ID NO: 629 - DNA, 1191 bp, Glycine max
gctttaagctcctccaaaagatgggatggaaaggaaagggtcttgggaaggatgaacaaggtttgtgccgtattatctctttactcgatttttatcaatttgtttctctctttatgaagatccgcataatgcattatagtttctggtatgctgcatgagttgcccctactctttgatttttcttgcaacattttctctcccccctctgtgcacccttttttgtacctccttcatagtgttgacacaacctgccttttcccctttcttgtactttattcctatggagtgggtggcaaggaagaagaactctctagcatgacttcaatctcattaatgctgcggataaactgacataattatttttcccaactcatattgctgtgacatctaatatcttgcaaacatttaaaacttagactgtgaagctttctgttttttatccttaatgctacctcattctgtcaatctacacctagtagtagtagtttgttgtaagcatgacaaagagtattgtaattgttattttgttccagtatttaaattgaccttatatttgtatttgtattcaataaggatcttcataaatgtgacctttagcacccttgttaatgctatgcaaactgcgaagtattaactcaagcttttttttttaccttccaggagaagagttatatttttctctagcttagggcttgattctcatttattgaatcacctgtgtatttgcacctacctcattcaaacagggattttggaaatgagtttgtgtttttttacttcctttctttcagtatcaattttgtatgttcctaacattgggattctttacctgaaagtgatttgattttggtcattggtgttgtccttgattttcaatgttttatcttggtttttgaaattgacatgggcttgtgtttaggaatcattgagccaataaaatctggaattagagatccaaggctggggattggtaagcaagaagaagatgatttctttactgcagaagaaaatatccagcgaaaaaaacttgatgttgagttggaggagacagaggaacatgtgaagaaacgggaggtatgatttataactccttagtagttgctcttagtgcaaaaaccacatagtagtattgaggttgatgtttatattttctcaaacctgcacctcatagcagaaggcagcatatagcat

SEQ ID NO: 630 - DNA, 377 bp, Glycine max
ggggtagaagaatttaatgtgatttgttcttgtaacctgtgagtgtggaagaaagaagtgagttgcgggctggaattcaaagtttgcattaattattggtgaaggagatgaaagatggtgggggcaacgctgtagagattgagaagaagaaaaagtagagagaaggtatgaaaaactctggtgattattgaaagttgaaacttagaagtttgaagtgttcaatgttcatatcatggtattcataagtcaagcaaagcttcatttcttggccagcatcactgcttcttcatcatccacgttactactactttgatgggaccctcaacagtaaagaacaattgaagggcaataagttgaagtttggctacaaatcgtga

SEQ ID NO: 631 - DNA, 649 bp, Glycine max
gaaggctatccaccgccaggatacccgccgccgggatacccaccgccgggatatctgccgcaacaaggctatcctccgccgccctacccggcgcaggggtatcctccgccctacgctcctcaatacgctcagcctccgccccgtcaacaaaattcaaccggccctggttgtttggaaggctggtgcgtccctctctctctctctctctctctctaatttggatcgccgagtcagatccgatccaactagattcattatttgtttgtttaaaatgccgtattgtatgagtaataattgtgacgctagttgataaaaatgtttatattgaaatagaaaaaaaaatcatattttattacttgcgtgcgttcttattcatatgtttgaattggtgcagtttggctgccctctgctgctgctgtcttttggatgcgtgcttctgagatgagatgacaaattcaaaactgtttgttttagcattggactcaatgaaatttgtttccacttctctctccctctctctttcctttgcttttcctgtttcttaatttgatgctgctcctccattacacttggacttggttatcaaatcacatcatgaacaatgagaggattcgcttggctagggagtcgtaccattccacaattctca

SEQ ID NO: 632 - DNA, 845 bp, Glycine max
  misc_feature (57)..(57): n is a, c, g, or t
  misc_feature (61)..(61): n is a, c, g, or t
  misc_feature (808)..(808): n is a, c, g, or t
  misc_feature (814)..(832): n is a, c, g, or t
accttatggtcactcagcctctaattttgtaaaggtacgtaggtatgcttgaggttnttgntcgatctcaaagggacaaaataattgtatttgtacccaaagaaaatgatcaaatataaatagtcattataatatatcgttagtataacttttaaaataattatcataaaaatcaacaaacttatcacatatgattgtttataataattgacactgatagtataaaatgcttttagacgatgagtccaataataattggtgattaatatgagtaattattatcataaaacttataacaaaatctatcatacacggatattttaatggtgatacacatgtactgatactataatacaaatttttgtgcatgtaaaatctatcatatagataccacgctcaccatatatatacatatgatatttttttcttaaggaactgtataatctgggagctcgtagagttgcagtactgggtgcaccaccgattggatgcgtgccatcacagagaactctggctggagggctaacaagaaagtgctcagaaaagtacaattacgcagccaggttgttcaattccaaactttcaaaggaacttgattccctcggtcacaacttgtccgataccaggatagtttacattgatgtttacacccctctgctcgatatcattgaaaactaccaaaaatatggtaatcccaagtttacttagtttcattcatcagaatttatttaatttcttcgataaaattcactacaaaaaataatactagtaacaaaacaatttatatgtaattttttcactaaattantacatnnnnnnnnnnnnnnnnnnncttgattattttt

SEQ ID NO: 633 - DNA, 842 bp, Glycine max
ataaaacccaccattttccacttccatctacttgtgttctgttgtgtactttctattctcataagataactaactcactttgtgtgatagagttctcattctcatggctattaccggcgatattttccggcagagcataacggaaatgcttgcggagtccccttccggtgcgccagaacttcacgttctcgccgtcgatgacagcctcgttgatcgcaaggtgatcgaacggttgctgaagatttcttcctgcaaaggtaacccggtgttgcgattcacctgtctgtgaatttgtttgggaaaattgagattggttctgaagtgttgtgtgtgtgtgtttgtttttcagtgacggttgtggagagtggaacgcgcgctcttcagtatcttgggttggagggagagaacggttctcttgggtttgatgtaagtgaattctgcttttgggttattggcttttgtttggatgttggttgttgaatttggtgcttatgtagttgtttgtttgattggttgtggttacagagtgttaaggttaatctcataatgacggattattccatgccggggatgacaggatatgaattactcaagaaaatcaaggtgtgtagtagtgtatttgatttttgtttttatccttttaagggcgttagtgatattaggatagtgagtatttctttttctgttttggctagggttgataagttctagtgtttgtgttattgagcttgccgaattaattagttgggcacagaggtctagtgtgtttttctgccttttgggttgggtttgaagttgctttttaattggtgtactggaagttgattcttaattttatacct

SEQ ID NO: 634 - DNA, 557 bp, Glycine max
cttgatgcctccttcttatgtacaaagggtcagtctaaatagtcttcatttcgtcatttaattacaaattacaaatctaaattaaaagagttttaaattgcagtcacggttacaatttcatcacaatctttgatattataagaaattcagacaaatgcaattgatacaactttgattactattgtgatcacgttgttgttgcaatgatcccataaaccttgacagtcaaaattgtgctcatgaatcgttttttaaaaccttacagaacaaaagtacatgactttgattttttttacaattgttttaaccttatgccaattatggtcacagtttttagtagttgatatgttgtaattgccagcggtcaaaatgactccaaaaatctttgatggtcaaaattatagtggtagaccgtttttagaaccttaaacacaagtacacgagttcgatttgttttacaattgtttcaaccttaacttacattaatttccgaaaatgttaaaatactagctagccaactaaccgtgccacatgtgcggttattcaaaaaaaaaaaa

SEQ ID NO: 635 - DNA, 795 bp, Glycine max
attgccgtatacccttaaggtatagaaactatatgccaatatatataatatatagtgtatgtacaaattgcaatccacattttcccatttgatattgatcatgcatgcattatgtatagttatatatatacatgtcattctctttgttttagttttattatccactcttcaaacttaacaaaactaaacttggatgcaggtgcactcacgcgttatatttattttattttcttaagttgttgacaaaaatgatttgtagttgtttcatttccctcaattccaatttccaaagcccaaatagatgtctcaattgaatgattaactaaactaccattctcataattttattgtgttaattttttcgaagtttctttaatgaattggcttgataaatattctttcaaaatgcaattatgtgattgaattaaattaaagttaattaaaaacaattcaggttttcatggccaaccgattacatttatcagtaatcacaagtgttcgaagttaaccaaattaatcctacatttttttgtaatttgttgtaactttgtttacagcttagcaactactgttcttttgagggggtgctctactgcagacctcactatgatcaactctacaagcgaactggtagcctggacaaaagttttgaaggtaaaattgacttaaaaactagaaacacaaatctcacatgaaaattaggttctactattactatatatctactttctcttccatcacatttcaacccccatttgtctttatatctctctgttcatttcctaccacatcact

SEQ ID NO: 636 - DNA, 817 bp, Glycine max
cctctgattataagcccatcttgactatctcgaacttttctatgactgtcccgaatgctccttggaattccttgccatataagcttgcgcccatttgcaccaacctccaagctgtagctgaatttctttgcttcattgtcatcacccatgaatcgcaaaaatgccatatacactggagctgagccaagctggaacgcctcaaagtgcaagcagaaatgccttccaaaactattaaaaacctgcaagcaagaaacttcaacatgtcaagtggggatctttatattaggctttaggatcatgaggtcacaagaacatttgtgataacatgtattcagaaaatgaaaggtggatccataaagaaatgtttagaaacaaatcaaggaggaaaaaattccaccgtgcaagtacattccatgtgttcaaattattcatcaaaagtcgaaagactatgcctacatatatgccatgtgacccatgacaattctgaatattactttcagagaattaaaaatagtcaggaagtagatatttttaaaaaacaaacgagcaaggccatgtgcacatgcacactgcacacattaggggatatggcatcagactacactgattaaataacaaaaataacatgtaaaaaacaccaatccatgagaaatagcacataaaatcatcaaacagtccggccaatataattcattaaataacttacagttagcatccatgtggcattttcaacttcatgtggatttgctttgacatatcggtgattgaaggtacatccatcatgcatgtcaaccttgtgatcatccttgagatgagc

SEQ ID NO: 637 - DNA, 631 bp, Glycine max
tttcgcttcagcccacaacgagccatggaagcacaagagtttttccagaacaccttctgtccccaattcccctcagacagcaacatcactccctccaatgccaacccctccgccgccaccaccgaccacttcctcgtagaagacttcttcgacttctccaacgacgacgacgccaccttcgactccctccccaccgacgtcgactcccccaccgttacccctgtcgacaccaccaccaactccaatttccccgcctccgcagacgcccatttccccggtgacctctccgtcccggtacatacacacgtgtctctaatatctattcatgtcatgcctatgtgtaacgtccacactctcccaccaccaaaattttaattattaatatttccttcctcaattaccatgccacgtccaacacatacaaaaacaaatcccttgtcctttttctaacttttcttcttatgttttttccaactgtccgaatttcatctcatttagtatgaagataataaattaattgtgtgtaatttgttgagcagtatgatgatcttgcggaattggaatggctgtcgaaatttgcggacgaatcgttttcgagcgaggatttgcagaagctgcagctgataacggg

SEQ ID NO: 638 - DNA, 267 bp, Glycine max
acttttttccttttagtcttcatgatgatccatatctgacccatccagcaaaaagtcaggagtcaacttgtttccttttggccatatatatataccctaatagaacacaagaattcatcaaccaaagtgttaagagctcttgaatataattcacaagcttgtcattgctcaaaagaccctccaagagataagaggaaaattcctgaaagataacaacaaaaatgaagggctcatttcttcatgacctagctaatggaatttctgtcg

SEQ ID NO: 639 - DNA, 411 bp, Glycine max
attcgggttcttcgccttcgtcagcgccaagaagaaggagctcgacggcctacgcgccgagatgcctgtggctctggcggagtgcgttgatccggcgaaattcgtgctggaggcgatctccgaggtgtttccggtcgacaagagaggggacaaggccggccacgacttgggctgggcctgcgtccttgtcctggagtcgctgattccggtcgtggtcgaccccgtcatcggaaaatcgaggctgttggtgactcctattgtgaaggagcaggccacggagatcgcagagacttggaagaccagcctcgaggagcgcggtggcgtggaaaacgtgaagacccctgacgtccacactttcttgcagcacgtcgttaccttcgggattgtcaagaacgaggactccgatttgta

SEQ ID NO: 640 - DNA, 403 bp, Glycine max
tcgatcagaggggagaggagggggtccgcgttgcggaggtagcggagcgagatctcgacctcgccgtcgcaggagagtgagcgagccactatgcgagggaccacagtcagggctcgaggcggagcagccttggaggtggtgttgcggccaacaggtttggcgggtttgatgggggcttcggaggtggaggggtccggagagaccttccggatcttgcggggacggagggggattttcgtagctggggaggttgtcggctgagggacattgtttagttcggagtgggccgtggcagcatcgggggcggggaggggttgtgcttgacctagcgtctgttcgcccatgtgagattcagattctgatgatgcctcactctgctctaacgcctttctttcatcctcaa

SEQ ID NO: 641 - DNA, 543 bp, Glycine max
  misc_feature (264)..(264): n is a, c, g, or t
  misc_feature (285)..(285): n is a, c, g, or t
ctctaggattcgacaatgcacatatatttgtttccatgatcagtatttggaacttccttggccgtgtcggaggaggttacatatctgagcttgttgtgaggtaaaaaaaatcagtttatacattgattgcatgtttaattcagcttattatgctttttacacggtcaatcaatttttatagcaattatacaaaagttaataattttatcatacatgacaaacgtgatataaatatttaggtgtacgatgtatctaacataactncttatttgatttcaaatttcnttgtgtttttttcttgagcagggatcatgcatatccaaggccagttgcattggctgtatttcaactcattatgactcttgggcatgttttccttggtatgggatggccagggtcaatgtatgttggcacgttactagttggacttggttatggagctcattgggcaattgttccagctacagcctcagagttgtttggtttgagaaactttggtgctttgtacaatttcattactatagcaaaccctgcaggaaccct

SEQ ID NO: 642 - DNA, 825 bp, Glycine max
ttttgggtggtagttatataattctgtttctgatgggaaagggtggccatagtcattcacacaaccaacccatggagaaaatggctgtagctggacttattctcgttcctgcattgtctccttgtgctacaacactcccggtctttcttgctgttggaaactcctcttccatgatggtgcttgccatcatagtactactattcaggtattaatcaatggcctatgattatttaaagtgatatgttatttgttggtaaaacggtgtcagtgattatcaatattaaaaattctgatgttgaccttaacattgaataaagcaaaagctcccaagaaatcttttacttcatgatcatgaaaatttgttttgattgttgagaaactaatggaatacaatctattcaatgttgttaaaactggaccaaagagtgaaactaggtagggaatagggagattccataacttttctgaagttgtttgaccatctactcagttttgagagtgaattataatcggattggtcaagtgacgaattcatggttagaccagtttggccatctagtatgagttttaagttgtaaatcacatgaaacaatatcaaatttataaaacctttcaggaaatgtaaacacaggttaaaccaggttgagtattttagttggtccaaaggtgtttgaccctcaattatgttttgagactgaattataattggacaagtgtccaattaatggttaagctggttggactgcctagtcaacaattactctatcacttgaacatggaatattaagttgttataacatgacatcatgtataccttttttcatg

SEQ ID NO: 643 - DNA, 383 bp, Glycine max
tgcatggttggagaatatttcatacctaaaaattcaagggtgatagtaaatgcatggacaattatgagagacccaagtgcttgggatgaggcagagaagttctggccagagagatttgagggaagcaacatagatgtgagagggaaagacttccggttcttaccttttgggtctggcagaagggtctgtccaggattgcaattgggcctaaacacagttctcctaacagtggcccaactggtgcattgctttgattggaagctaccaaataacatgttgccatgtgaattagacatgacagaggagtttggcctctcaatgcctagagcaaatcatctacttgtcattccaacatattatcgccttcatgatcaaagttgtta

SEQ ID NO: 644 - DNA, 367 bp, Glycine max
tgttagccgatggctcaaggagctaagggatcacgccgatgctaacattgtcatcatgttgatcgggaacaagactgatctcaagcatctcagagctgttgccaccgaggatgctcagggttatgccgagaaggaaggcctttctttcatcgagacttccgctcttgaagcaactaatgttgagaatgctttccagactattcttgcagagatataccgcattatcagtaagaaatcactctcttccaatgaccctgctgccaatattattaaagaaggcaagactatcacagttgggggggcacccgaacccaacacaaacaagccttcttgctgtacatcatcttgaaaccattgctacttgctc

SEQ ID NO: 645 - DNA, 959 bp, Glycine max
  misc_feature (687)..(690): n is a, c, g, or t
  misc_feature (700)..(704): n is a, c, g, or t
  misc_feature (720)..(721): n is a, c, g, or t
  misc_feature (723)..(724): n is a, c, g, or t
  misc_feature (727)..(730): n is a, c, g, or t
  misc_feature (737)..(740): n is a, c, g, or t
  misc_feature (748)..(752): n is a, c, g, or t
  misc_feature (755)..(755): n is a, c, g, or t
  misc_feature (757)..(767): n is a, c, g, or t
  misc_feature (773)..(775): n is a, c, g, or t
  misc_feature (782)..(792): n is a, c, g, or t
  misc_feature (794)..(798): n is a, c, g, or t
  misc_feature (800)..(802): n is a, c, g, or t
  misc_feature (804)..(804): n is a, c, g, or t
  misc_feature (806)..(806): n is a, c, g, or t
  misc_feature (812)..(813): n is a, c, g, or t
  misc_feature (817)..(818): n is a, c, g, or t
  misc_feature (827)..(830): n is a, c, g, or t
  misc_feature (833)..(836): n is a, c, g, or t
  misc_feature (838)..(838): n is a, c, g, or t
  misc_feature (843)..(845): n is a, c, g, or t
  misc_feature (847)..(856): n is a, c, g, or t
  misc_feature (860)..(867): n is a, c, g, or t
  misc_feature (869)..(876): n is a, c, g, or t
  misc_feature (881)..(882): n is a, c, g, or t
  misc_feature (891)..(894): n is a, c, g, or t
  misc_feature (903)..(915): n is a, c, g, or t
  misc_feature (917)..(932): n is a, c, g, or t
  misc_feature (935)..(938): n is a, c, g, or t
  misc_feature (940)..(940): n is a, c, g, or t
cctaacccgtttgcgttgttgtgagtttcgccacctaaagtttgaatcttttctgtgtttcctcatccgggtcctgatccctttctcggatgcgtgcaggtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttggtatgttctttataaaccattttatttttaatgtggtttttaggtatctgggtgtgttttgtttaagtctaggaatgatttggaatctgggtttgtgttttggttggatttgatgttatgttactattgtgggtttttgttagattgggtattggctatgtgtatgtgtgttttattgatagtaactgggaaaaggatgtctttcactgactaacatttttatattttcaggatttgaatctgaaagagaaaaaaaagggaaattaatagtgatggttattactattataattgtttttgtccatttgtctccaatgagatgaggggatctcattttatggttgagtttgatttttttttttttttccccagtgggggggnnnnggtttttcannnnnattgggtttaacgggnntnnttnnnngggaccnnnnaaaaatannnnnttngnnnnnnnnnnntttcannnaaaaaannnnnnnnnnngnnnnngnnncncntgcttnnattnnacaactctnnnntcnnnngngagcnnngnnnnnnnnnngcgnnnnnnnncnnnnnnnntcccnnctctctttnnnntttcttttnnnnnnnnnnnnngnnnnnnnnnnnnnnnnacnnnntnttcttcacccagcctcccc

SEQ ID NO: 646 - DNA, 911 bp, Glycine max
  misc_feature (23)..(25): n is a, c, g, or t
  misc_feature (853)..(853): n is a, c, g, or t
  misc_feature (855)..(856): n is a, c, g, or t
  misc_feature (889)..(890): n is a, c, g, or t
cttaccaccctagtaagcttatnnnacttcctatatccatttctataccattttccatctactattttgtcaatttgttatcatttgattgattgattgatcttcatgttacaaaatgttactttttctaagctaagataacaatggtcttacaattatttgaatttatgaagtggtagcagttggttaattagtgataaaaaagagcaccttgttacattcccatttgaaaaaactaataagtgataagtgttaaattaactaattaaaatgacccccttgttgttatatgtcctttcaggctttggtggaaatggtgcaactatgtttttcttaatcttctccatactagcagccgttttgggcatagtgtccaaacttttgggtgcgaatcacattaggacatggaggagtgacagtttagcatctgcaggagccacatcaatcgttgcttgggcagtcactgctctagcatttgggtaaaccacacctaaactaaactaacctcactacgtgctcttaattttatattttatttttatctctaaatctaagtttcttagaatactaccaaaagagatccaacccacgatcttttgcgtattctcttttgtctttatcatataactcaccttatatcttggtggtcttaattaattatgttatgaggggtaacaaaaagttatgtgtgtgtggatgaatgaaacaggttggcttgcaagcaaataaacataggagggcacagagggtggaggctgagggtagtggaggctttcataataatactcacattgacacagttgttgtacctgatactgatccacgcaggactatatagcagtaggtatggtcncnnggtaccgtgacactgactatggtaatgctcatnngtgtgggagggactacaggag

SEQ ID NO: 647 - DNA, 818 bp, Glycine max
ttccgtgcactccttgatgttggtcttgttaggactacaacaggaaatcgcgtctttggtgcccttaaggtaatctctaatactgcaactcttggtatgattttgttttagtggtggtcaaatctaataattgtgatggtttacagggagctctggatgggggtttggatattcctcacagcgacaagaggtttgctgggtttgataaggagaagaaggagcttgatgctgaggttcatcgcaaatatgtttttggtggacatgttgctgcctatatgaaggcatgagataagattgtatattgtacaagtcttctttattatataatgctatatttggatttttcagccatttgttagacaacctatttttttattttctgcagatcttggcagaagatgaaccagagaaataccagtcacacttcagcgaatacatcaaacgtgggatagaggctgatggtattgaggcactttacaagaaggttcatgctgccatccgtgctgatcctactctcaggaaatctgataaggagcccccgaaggagcacaagaggtaaagttgattttttacttgaactggaatactagattctggaaatagtgtaatgtatgcatctattttctcatttgatttctggcattaatttttacctgttgctggcatggatttattttcaggtatttttgtgctatttatcttgggtgtgatcatatatttttttttacttttagaacttttgtattggtaacatagccttagtatttactgattggagaatgttcctgagaatatctggctcttttgtaggtacaaca

SEQ ID NO: 648 - DNA, 397 bp, Glycine max
gatcaataatatcccaatatgatgaagatcatcagctccaaggcatcaatgatgatgatgataataacaacaacaactttgtaagcactactaagctagtgaaccttcatcatcttcatcagcacaaaattagaaacaaagatcatgagcaagagggtggtggagtagataataacatggtttctcatcatgaagagttcgattctattttgtcctttgagaaccaaaacaatgctgcttgggacaagtccacttgtgattccatgccagaaaagagttctgaagcttctgctgctgctgatcatcatcatcatcatcatcatgatatagctgctgctcatgagaggaacaatgtcaggcaaaaatctgagaatagtagtggtgctcctccattgtc

SEQ ID NO: 649 - DNA, 401 bp, Glycine max
gatatttcgtgcattgtagttcgtttcaagggatgaacaagggaaaccaacacaacacaactactccctacattttcttggtatatattttatcaatatgccctcccatttgtttggagatctcgtgaaatccattttctacaacataggttttgctcattcctctgtaaaattgaagttcttcaaattagatggtgccattttagtatctcaagatttgttttgtgtagattattaccatcatttttctttgtaatttgcattattacatggagcagtgtgaagatggacatagacatagcttttacatttgaatgagttatgcgtttgttacaaacacaatttacgaattacttgaaatgtcctaccccgaatgcctaattttccactgctacaattca

SEQ ID NO: 650 - DNA, 1690 bp, Glycine max
  misc_feature (362)..(362): n is a, c, g, or t
ttttaataaattttaatcaattaaaaaaagtgtttgaaaaagagtgttaaagaaaatagttttatttgattatgttgatgtttgaacacatttgttatacatgtataatattaattattgatttttaattaattattgagatctattttgcatttcttaatgagtggacaaaattaatatgcctctaaattgaaatactaaacaaaatcgatacctctctaagtgaaattaattactaaatacatgcatggaaaagtcttttttttaattaaaaaaactaggaaaggctttaaataaatagaattaaaatctcaaaatggcttttaaaaaataatataattttaaattagaatacgaaatantatttaagaatcccttcaaaattttaatttcagaaccgagtttaatacattttgaagaaaaaaaaagttgagggagtagtgtcattaatttgcaaataaggtagtgcaacattaacttgaagacaaagttgtactctctaacacaaaaacaactttggttctactttaagcagccaagtatccactattacacaaaacacattttacgtcacctttactacatcatttcgatagtttacaaaattgatgtagtaaactgtgttgtggtattttcataattaaatgcaactttataatattgatagtttacaaaatgatgaagaaaacaattttttattttagttcaaatttgatctaatgttaaaactatgattttctttcttatactaatttaaactctcacttgcctcctatcttaactctccacaaaccagaatttttcatcttgatcctgccattaccaccacgaccatgtcgtcactatgaactcaaatccaccacttccacctcgcctccacgacaaacccataccactaccacaaacacaaaccccctatctccattctttactttctcgttttctcttgaaatatcttgaatcttgcatccacaatcacaaacacgatcaagtcacctcaatcaatgttgttgtcatcatcatcaaactttcattgtcatgccaccacaacttcaccaccatggcactagaaagtaccttctcattctcaccactatttcattcttcgttcactttatctcacttctttctctatggatgactttgtgtcaaccaaagttggtgttttatgttgctcagttattatattagagtaactggtttttttaactcactacttgagcttgatttcatctattttattatgtgattgcaatctttattattgaaactttgtgttactatatctatgcctaagtattctttattttaaaacctaattggtgttgttaatctaagtttgttgtattttaaagcacttttaattctagttctcattatgagtgaatatagatgctttggtttggtgtactttcatttgtggtttgctgcaatttatatgagataatgatttttgaatttaaaacctttatggtttaatgcttggagttagtttcggttgcttccaatttaggaatgttatattactttcaggcttgctctatgattgcttttcaaattttatgtcagtcaagtataatgttatttgtgtatgtttttcaatgcatgatttaataggaaaatgacatgtaactattggtacttaatatagaaattgttggttgagaaaaaaaggagatcaactgaccag

SEQ ID NO: 651 - DNA, 2489 bp, Glycine max
  misc_feature (1028)..(1028): n is a, c, g, or t
  misc_feature (1064)..(1064): n is a, c, g, or t
  misc_feature (1377)..(1377): n is a, c, g, or t
  misc_feature (1487)..(1487): n is a, c, g, or t
  misc_feature (1868)..(1868): n is a, c, g, or t
agttgtcaatgtcggtctccggtggcgccgtcgtcgccggcgggaatgtgaggaggaaccaccgttacctcggcgagaaccgtttctactactacccaccaccgttgcggaaatacagagaagaacaggatcatgagaaggagcagaaatcaacgttgtcggagaacagacccggttcctcttcggattgctctttttcttcgagtggaacaacgtgtgatgtctccaacttgcgtcggttcttggagcacaccacaccacatgttcccgcccaatattttcaggtaaagtaattcagtgcctttcaattttcaaatgatactttttattttgctttcaacagtttaattttcttaatttggagtggaaaattagtttgttattttttttttttttttgaaatatctgtttcattgatcactttaagaatgccccttggattttagtatttataatgctaatggtagtatggtagagttgaacccataggattggcatagttgtgtaaggtctcgtgagactctttcattttcatcgtgtgtaaaattttcttggcgcatagggagcggaattagtctttgacccaatgggttaggagacaacactatgatctctaacataggaccatataaaaaagtatggtagagttggggttgcagtttggacaaaatttagatgtacttccttaggtgttgttggtggtgttctcttatcagagttggcgtttgacatcttaattcacgtaataaaggtttgtattaaaggattaacgagctaaaattttaattatgattgagaataataagaaaaacaccaatgaagctgtatgtaagtattgttcttacagttttgtggtttgttttaaagggaattattgttcttattaagttgggtttgggtgggaatgaacagagaattaagagatggaaaacgatggagggagagttgcatgcgtactttgtgcttggggacttatgggaatctttcaaggaatggagtgcatatggggccggtgttccgttggtgtnggatggaagtgaatgcgtcacacagtattacaatgnctccttgtctgccattcagctttatgttcatccatcaaaaccttccccacggttaaggtcagtgtttcattcttaaaacattttagttctacatttgtctttccaatattgattattgtgtgtgtttgtttggcaatttgtggttgttatatcaatttagattggtttcatgttgtgaatcatgacttaagtcttgaggatattttagtgaaagagagagggagagaggaattagtgatattcattagaattgttttagtgacaaccacaatcatttagatgtttggaatgtaaaataaggagactgatttantatttttcaaacgataggcacctatctcctacccttttcactcatcagtttatcactttggctgaattacaagacataggatactactactattttttgtatctatgaantggtatcattctattttctgttatattacaggagacccagtcagagagactctgaatctgctacagagacaagcagtgacagcagcagtggctattgtcatgaaaaaggggcaaagagtgtgcatggcacttggaaccaggataactcgtcagatgcaagatatcaatgttcaaaaagagtttcactaagtaaacctttaacaagttcatcaagtgatgagaatgagagctgcaacccacccagtcagcttatattcgaatactttgagcatgaaaatccttataatcgcgagcctttagcagataaggcaagatcattatccttcggttcaattccaccttgatagattatcttttccaatcctaatatagattcatatnttcttgcccccagatttccgaccttacacgtcaatttcccgagttgaagacataccggagctgcgatctttcctcagcaagttgggtttctttggcttggtaaatattctatcttatccttttggttaatcggattgttagggttgtataaagcacatgataattaatcaattactaatttaaaatgattttttcctgcatatattataaaggtatccaatatacagaatacccactggtccaacactagagagcatgagtgcctgcttcctgactttccattccctatcaacagcagctttgcaaagtatgtattgatgtctttgtttagtttctgtatgtgcttatattcaagggtcatcaatcaactataactttgttgtctgaatcaggtttaagtaatgatggattccatctttgttcaagaggtatgaacttgtcatccaagctatcattaccaatatttgggcttgcctttcacaagttgaaagcttctgtctgggatcctgatgaggtttctgaaggtcagaaagccaattctttgttgcgagccgctgataactggattaggctattgcaagttaaccatcctgattacaattacttcttctcactcgacga

SEQ ID NO: 652 - DNA, 386 bp, Glycine max
gactaatgtcaacaagacttatttgtataatgttactctagattcattaaaacttaagggagaaatgatctgaataatttggagtttagtaagaaagtaaataaaatttaattaaaaactattttctctaaggatcaaatttaaacattatttaaaggatttaattttaactttaacatattaatattgtttctaatgatgtgattgattttgtatttttttttattggaatgttgattggggtgaaaaaagaaaggggcaatagacaaatgaggttgcatcatgtgaggaatcgagacaagtgcattgctggctttgggcgtgtgagcatgaaagcacacgaggaggtgcaaaagatctcaattaacggcttttattatagtatt

SEQ ID NO: 653 - DNA, 2488 bp, Glycine max
  misc_feature (1028)..(1028): n is a, c, g, or t
  misc_feature (1064)..(1064): n is a, c, g, or t
  misc_feature (1377)..(1377): n is a, c, g, or t
  misc_feature (1487)..(1487): n is a, c, g, or t
  misc_feature (1868)..(1868): n is a, c, g, or t
agttgtcaatgtcggtctccggtggcgccgtcgtcgccggcgggaatgtgaggaggaaccaccgttacctcggcgagaaccgtttctactactacccaccaccgttgcggaaatacagagaagaacaggatcatgagaaggagcagaaatcaacgttgtcggagaacagacccggttcctcttcggattgctctttttcttcgagtggaacaacgtgtgatgtctccaacttgcgtcggttcttggagcacaccacaccacatgttcccgcccaatattttcaggtaaagtaattcagtgcctttcaattttcaaatgatactttttattttgctttcaacagtttaattttcttaatttggagtggaaaattagtttgttattttttttttttttttgaaatatctgtttcattgatcactttaagaatgccccttggattttagtatttataatgctaatggtagtatggtagagttgaacccataggattggcatagttgtgtaaggtctcgtgagactctttcattttcatcgtgtgtaaaattttcttggcgcatagggagcggaattagtctttgacccaatgggttaggagacaacactatgatctctaacataggaccatataaaaaagtatggtagagttggggttgcagtttggacaaaatttagatgtacttccttaggtgttgttggtggtgttctcttatcagagttggcgtttgacatcttaattcacgtaataaaggtttgtattaaaggattaacgagctaaaattttaattatgattgagaataataagaaaaacaccaatgaagctgtatgtaagtattgttcttacagttttgtggtttgttttaaagggaattattgttcttattaagttgggtttgggtgggaatgaacagagaattaagagatggaaaacgatggagggagagttgcatgcgtactttgtgcttggggacttatgggaatctttcaaggaatggagtgcatatggggccggtgttccgttggtgtnggatggaagtgaatgcgtcacacagtattacaatgnctccttgtctgccattcagctttatgttcatccatcaaaaccttccccacggttaaggtcagtgtttcattcttaaaacattttagttctacatttgtctttccaatattgattattgtgtgtgtttgtttggcaatttgtggttgttatatcaatttagattggtttcatgttgtgaatcatgacttaagtcttgaggatattttagtgaaagagagagggagagaggaattagtgatattcattagaattgttttagtgacaaccacaatcatttagatgtttggaatgtaaaataaggagactgatttantatttttcaaacgataggcacctatctcctacccttttcactcatcagtttatcactttggctgaattacaagacataggatactactactattttttgtatctatgaantggtatcattctattttctgttatattacaggagacccagtcagagagactctgaatctgctacagagacaagcagtgacagcagcagtggctattgtcatgaaaaaggggcaaagagtgtgcatggcacttggaaccaggataactcgtcagatgcaagatatcaatgttcaaaaagagtttcactaagtaaacctttaacaagttcatcaagtgatgagaatgagagctgcaacccacccagtcagcttatattcgaatactttgagcatgaaaatccttataatcgcgagcctttagcagataaggcaagatcattatccttcggttcaattccaccttgatagattatcttttccaatcctaatatagattcatatnttcttgcccccagatttccgaccttacacgtcaatttcccgagttgaagacataccggagctgcgatctttcctcagcaagttgggtttctttggcttggtaaatattctatcttatccttttggttaatcggattgttagggttgtataaagcacatgataattaatcaattactaatttaaaatgattttttcctgcatatattataaaggtatccaatatacagaatacccactggtccaacactagagagcatgagtgcctgcttcctgactttccattccctatcaacagcagctttgcaaagtatgtattgatgtctttgtttagtttctgtatgtgcttatattcaagggtcatcaatcaactataactttgttgtctgaatcaggtttaagtaatgatggattccatctttgttcaagaggtatgaacttgtcatccaagctatcattaccaatatttgggcttgcctttcacaagttgaaagcttctgtctgggatcctgatgaggtttctgaaggtcagaaagccaattctttgttgcgagccgctgataactggattaggctattgcaagttaaccatcctgattacaattacttcttctcactcgacg

SEQ ID NO: 654 - DNA, 1239 bp, Glycine max
tgactaccaccttcactctcctcaagcatttcagcctcttccccgctcagactccttagctttgggagccaaattatcccttacgttctcgacttcaaccatatgtgatagctgcctatgataccatggctacttccccttagttctttatctttcctttccgctttattccatgccttaccgatcctctgaagtgtctttgcattagcttcattgaaacctcacgcgatgaaaggtgtgatggtctcctccgatggcgcacttctcatagggtaacctaattgtcttacgaccaacataggattataattaatacaacccctcgtccctataaaagggacatttggaaatccttcacataagcataacactcctacccctctttctttccactgtgggaaccaactaatggacgctcctatcatgcctgccaagagttcttcccaatttgcctcgtcctttcctgagcacatgcgatgaccttgtatggggtagacagatctactttcatgattgaagacgtgggataccaaccacacataaagagcaggcgcacaacagaaaatcctcgtagtgctcttcttgcatcttaagtcaaatgtatcatacacttatgctaaaacaacaatgatcgggctttccttgctatggtgataagcaagaaaagcatcgattgctactagatccaccaactcgtctacattcgaaaatagtactatcccaaacactagcagtgctaatacgtcgatgaatgatgcccactctccttggctggccagagtttccgccttctcctccaatcacttccttggtattccccctaccctattcctactttgcttcactcagtctaattctcatttcgagatcttgacaactcctgctattctcgccatagaaggatagtacccagaaaaaaggtatggcttccttcctcctatcgggcatcctaagatcccttcgaactcctctatggttggtgctaactgaaagtccccaaaagtgaagcatctgagtgattggtcatagtattgggtgagagatgcgatggcttcaacgaacacttctatcatcaccagatcccaaatcttcccatataccttgttgaaggactgacgttgagctcgatccatccgatgccccagttttcgcaagatgactacttctagattcttgagttcgacacgatagaaccttttcttaaaagacagtgcttgtctgaccccatctcatcagact

SEQ ID NO: 655 - DNA, 635 bp, Glycine max
acaaaaaatatactaaaggattttatcaagttggaaaaataatgactcagcctttgtctggtaaagaaaaataagacggcgaggaaagaaataaaaaaaaaagtgaaagtgtttgatagaaagaatgagagagaagagaaataaaaatgtataagaatcactagttatttttattatattttgatttatttctttctttcttatttctcttgaaccaaacacggttattctcattttatttttcactcatttttatttaaactacttgttaattatactgagaattacaaagagagaaaaaccagctctaaaatttttgttcatattaaatttaaaacaaattcaaggtaaaattatttctttttaagagtgtggaatataaattttgaaataaaagaaaaatagtttgtcagagtaatttgacttatttctataagagaagggattaacttacaaagacataaattatttgtttttttgctagcaaggaagccggggccaattacattaaactataatgaagaaaagaagctcctacaaaatcttcacaaagaagctcctatgacaccaggtggttcatcatacactatcatttccttctctatgcacatcatgaaattgcagttccaatggtc

SEQ ID NO: 656 - DNA, 302 bp, Glycine max
  misc_feature (43)..(46): n is a, c, g, or t
ttcccctgagcgtatgaggaagcctgattcggatgagtttgannnncctggatgcccctttgcttataaggtttgaaaatatatatggtttcttttgagatctattttaatgttactgatacatattattggctagttgagttaacatttgtggaaactctgcaggaatttgtaaaagcagttgttgcttaccagaagaagctgaacaatttaacatccgtccaaaagcccattaagcttaataaggaaatggaaatcaaaaggaagattattgtgcgtagtttttcacttgccaaaaacct

SEQ ID NO: 657 - DNA, 1297 bp, Glycine max
  misc_feature (1274)..(1275): n is a, c, g, or t
gtgaaacaggtaatatatcctgttttcttgatagacactagttctcaatttagtagaaatttcctttacacaacttgccatgctaacaatggatgcctcctgctggttgcaatttttatccaggtgttctatgaaaaaaaataatttatgtatgtgttcttgtaaatatactttctaatccacatgtgcttatttgtgtgcctgtctctctggctctactcactatagatccaaaatagaaaagcaactgtatggtgtgctttaaatatcatgattgtgtcatatgaaataggatcagatgtttggttattttcaatgtatagttttttgggttgagggtactgttgaagtgatttgaagctattaatcttgtaaagtcaatgatatttcatatctgaactagttgttatacatcactctatatattgttctatagagaagttgattttaaatttactttttgatgtgtaaaacccataatttgattccaactagatgacaaatatttcataaaataatttccattcccaaattcttagcaaggatagtcggatactgaaactgaaatattttccattctaaagaaatcctcagtagaaatgaaaaacaacaatttaatcaataaattcaaagtttaaaaacataattagtgatttatgatctattttcagcatctcattaccgttggcatttaatttcatctattacgttagctgtgacttgtgattcacttcaaaagctttacccattcatcttggtcacttagtgcttgctagccaaattttcatttagcgttaccaacttcccatttagcatttaggtggattcactgaggatgcctatatagtgtaaatgtaaggtcacaaagtacagtgatggttaatgaatgatacattaacagaaacatctttgaagatcattaactgctatatatacactaccaatttacaacttcaaaaagttttagcttggctaatgaatattagagatttaaccatgctctatgtgaaacaggctgaccatcttcggcaagaaaccttggagcaaatgtctcgaatacttacaatccgtcaggcggctcgatgcttgcttgctttgggggaatatttccaacgcctgagggctttgagctcactgtggtctaatagaccccgggaacctgcttagtctcacaacaagattacaagagcgcaaactcataacatgaacgtgatgtgatgatgaatatgggtcagtttctttggcaaagagcatcaaaaccatgttcagagagnngaaggaacgtatatccacagat

SEQ ID NO: 658 - DNA, 666 bp, Glycine max
aatatgatgggagtgattctggagctcgtccagatgaagctgtttcatggggaaagatacgagactctgctcagactgttaaggtacatcctatgcaaactttcacaactggtttccttgtcatagttctttaacttttgccatgcatactgttgtttttgcttaaggatcatgagtttttttattacataattgtagccatgctgtaaggatgggcttagggagacccaaaatattcttataataccagcaattatatgaaagttacatttgatgggcttcttataaaaccagcaattaataaatatttgataactcaaccactctactcatacacatgaaatataaaatggtaccaaacacccagcaatacatataacccttaaatgtctttttgttacattaaatcaggtacactgtgatgcaacaatagcatttcctctgctggttgctgaaacgtttgcttcaagagtgaaacctccccattgatgaaggttaaagatgaatttactctgaagttcattttaattgtgtgtgtttgaggatcttgatggacaagttcggcattggtgttcaatttgactatcatttgattcctaagctcctcttagcagtggagacctttttgaccattcaaaggtaatccattaatcctgtcagtgagga

SEQ ID NO: 659 - DNA, 679 bp, Glycine max
cttcttactggttttctgccatgaccatgaagagtgttggaagtgcagctttgaagatggttgaggaggttcgtaggcagttcaacaccattccaggactgatggagggtcatgccaagcctgattatgccacctgcgtcaaaatttctactgatgcatccatcaaggagatgattcctccgggtgcccttgtcatgctcacaccactcattgttggaatcttcttcggggtggaaacactttcaggtgttcttgccggggctctagtttctggtgtacaggtaatactgttactccggccactagttatgtgaaatttggtctaacgtatcacattatttgaaagtgtgctgaatcatgtccttctgcactggttttcattagattgcaatatcagcatccaacactggcggtgcttgggataatgctaagaagtacatagaggtacgtaataataatttctggcgctttataaaaataggattgcgtttttgtgttttttgtccccgtgataattataactgctaagaagtacattgaggtaataatttatgaaaataggattgcgtttttgttgattgatgaaattccttgtggggttcaaatttcaggctggtgcgtctgagcatgcaaggaccctgggcccgaagggatctgaaccacataaggcagctgatat

SEQ ID NO: 660 - DNA, 1409 bp, Glycine max
  misc_feature (570)..(570): n is a, c, g, or t
  misc_feature (589)..(590): n is a, c, g, or t
  misc_feature (592)..(593): n is a, c, g, or t
  misc_feature (605)..(607): n is a, c, g, or t
  misc_feature (620)..(621): n is a, c, g, or t
  misc_feature (624)..(630): n is a, c, g, or t
  misc_feature (644)..(646): n is a, c, g, or t
  misc_feature (648)..(648): n is a, c, g, or t
  misc_feature (650)..(652): n is a, c, g, or t
  misc_feature (661)..(662): n is a, c, g, or t
  misc_feature (664)..(669): n is a, c, g, or t
  misc_feature (674)..(685): n is a, c, g, or t
  misc_feature (687)..(687): n is a, c, g, or t
  misc_feature (689)..(717): n is a, c, g, or t
  misc_feature (722)..(726): n is a, c, g, or t
  misc_feature (735)..(735): n is a, c, g, or t
  misc_feature (738)..(739): n is a, c, g, or t
  misc_feature (742)..(744): n is a, c, g, or t
  misc_feature (746)..(760): n is a, c, g, or t
  misc_feature (769)..(770): n is a, c, g, or t
  misc_feature (773)..(776): n is a, c, g, or t
  misc_feature (779)..(789): n is a, c, g, or t
  misc_feature (791)..(808): n is a, c, g, or t
  misc_feature (815)..(818): n is a, c, g, or t
  misc_feature (824)..(824): n is a, c, g, or t
  misc_feature (828)..(830): n is a, c, g, or t
  misc_feature (832)..(843): n is a, c, g, or t
  misc_feature (852)..(866): n is a, c, g, or t
  misc_feature (869)..(869): n is a, c, g, or t
  misc_feature (873)..(874): n is a, c, g, or t
  misc_feature (876)..(876): n is a, c, g, or t
  misc_feature (878)..(880): n is a, c, g, or t
  misc_feature (882)..(890): n is a, c, g, or t
  misc_feature (892)..(900): n is a, c, g, or t
  misc_feature (908)..(909): n is a, c, g, or t
  misc_feature (912)..(937): n is a, c, g, or t
  misc_feature (939)..(941): n is a, c, g, or t
  misc_feature (943)..(953): n is a, c, g, or t
  misc_feature (955)..(966): n is a, c, g, or t
  misc_feature (969)..(971): n is a, c, g, or t
  misc_feature (973)..(978): n is a, c, g, or t
  misc_feature (980)..(980): n is a, c, g, or t
  misc_feature (982)..(987): n is a, c, g, or t
  misc_feature (990)..(990): n is a, c, g, or t
  misc_feature (992)..(994): n is a, c, g, or t
  misc_feature (1001)..(1008): n is a, c, g, or t
  misc_feature (1011)..(1014): n is a, c, g, or t
  misc_feature (1020)..(1020): n is a, c, g, or t
  misc_feature (1029)..(1039): n is a, c, g, or t
  misc_feature (1044)..(1052): n is a, c, g, or t
  misc_feature (1060)..(1077): n is a, c, g, or t
  misc_feature (1079)..(1086): n is a, c, g, or t
  misc_feature (1096)..(1098): n is a, c, g, or t
  misc_feature (1101)..(1101): n is a, c, g, or t
  misc_feature (1107)..(1109): n is a, c, g, or t
  misc_feature (1112)..(1112): n is a, c, g, or t
  misc_feature (1114)..(1123): n is a, c, g, or t
  misc_feature (1127)..(1131): n is a, c, g, or t
  misc_feature (1137)..(1176): n is a, c, g, or t
  misc_feature (1179)..(1186): n is a, c, g, or t
  misc_feature (1188)..(1189): n is a, c, g, or t
  misc_feature (1194)..(1198): n is a, c, g, or t
  misc_feature (1201)..(1201): n is a, c, g, or t
  misc_feature (1203)..(1211): n is a, c, g, or t
  misc_feature (1213)..(1229): n is a, c, g, or t
  misc_feature (1231)..(1244): n is a, c, g, or t
  misc_feature (1250)..(1259): n is a, c, g, or t
  misc_feature (1263)..(1264): n is a, c, g, or t
  misc_feature (1267)..(1272): n is a, c, g, or t
  misc_feature (1274)..(1274): n is a, c, g, or t
  misc_feature (1276)..(1278): n is a, c, g, or t
  misc_feature (1281)..(1289): n is a, c, g, or t
  misc_feature (1299)..(1303): n is a, c, g, or t
  misc_feature (1305)..(1308): n is a, c, g, or t
  misc_feature (1310)..(1314): n is a, c, g, or t
  misc_feature (1317)..(1320): n is a, c, g, or t
  misc_feature (1322)..(1333): n is a, c, g, or t
  misc_feature (1340)..(1340): n is a, c, g, or t
  misc_feature (1342)..(1346): n is a, c, g, or t
  misc_feature (1350)..(1357): n is a, c, g, or t
  misc_feature (1359)..(1360): n is a, c, g, or t
  misc_feature (1362)..(1365): n is a, c, g, or t
  misc_feature (1368)..(1378): n is a, c, g, or t
  misc_feature (1380)..(1388): n is a, c, g, or t
  misc_feature (1392)..(1405): n is a, c, g, or t
tctatgatagcttagcaaaatagattgataggggggatatttttccataacagcacgaacctacatgagtaaccagataagaaacgtaggaaccaaaaacaaatattaaaagaaatcaaccagaaatatgtagacaatactaatggcttcgatgattgaccatttcgggacagattccaacaaaaaaggataaagaacaactcaactacacaataccctccagaaattggtagccagaaccaagtaggcaattgcaaattacaaatgaaatgaaaagaaatcaaatcatataagctcgataatagaatagaaggtgaaggtgctcaaaaaaggagagcttgaaagtcacacctcagactgcaagtatacatcttttggtaaaaacaaccaacattaaaactagcagtatattttactaacttggctatcaataaacacagctaccctgagaaagacaactagcctaagaaacattcaaattgaatgaagcagaacaccttttatctaccaatttaacaaaataaaacttcacatgacttagatgcaaaccatacatacctgatcaatgtnctcgcaagacagcaagttnntnntgaccatatgcnnntctgcttaaaatnnttnnnnnnnttaccacaagaaannngncnnnccgctagcnntnnnnnnttttnnnnnnnnnnnnanannnnnnnnnnnnnnnnnnnnnnnnnnnnntcaannnnnctttccccntannccnnncnnnnnnnnnnnnnnnccccccccnnctnnnncannnnnnnnnnnannnnnnnnnnnnnnnnnncccccgnnnncccatncatnnnannnnnnnnnnnnaccaaaaannnnnnnnnnnnnnnctntctnnantnnnannnnnnnnntnnnnnnnnncaataacnnccnnnnnnnnnnnnnnnnnnnnnnnnnncnnnannnnnnnnnnncnnnnnnnnnnnnccnnncnnnnnntncnnnnnnccngnnnatacccnnnnnnnnttnnnnttcttngcttttacnnnnnnnnnnnaaccnnnnnnnnncccccacnnnnnnnnnnnnnnnnnntnnnnnnnncccctctccnnntcnctacannntcncnnnnnnnnnncacnnnnntccccnnnnnnnnnnnnnnnnnnnnnnnnnnnnnnnnnnnnnnnnccnnnnnnnntnntttannnnnctnannnnnnnnncnnnnnnnnnnnnnnnnntnnnnnnnnnnnnnnccaccnnnnnnnnnnctcnnccnnnnnntncnnnacnnnnnnnnntccttcactnnnnntnnnntnnnnnccnnnncnnnnnnnnnnnnccctctncnnnnnctcnnnnnnnntnncnnnngcnnnnnnnnnnncnnnnnnnnnattnnnnnnnnnnnnnncaca

SEQ ID NO: 661 - DNA, 269 bp, Glycine max
tttgcataatagcctgctataagcattaagcaatgcataatcaagtttatatgcatgaatctgctaagataacctgaccaactacagaactccaatctgcatttaactcttgatacagaagttgaaattatttggaaaaatttaaattggaaaaaaaggctttaaatgaatttaatcagctattctggataggaactaatggcatttggcctccgtatatatctgggagttgactctcctctatctcttctagcaatgttgatttcagc

SEQ ID NO: 662 - DNA, 864 bp, Glycine max
attgattgcataggtggatttgtgtgtgcaatgtttgccatctgcattcctcatctttcagctctgggaatttggctaggattttcaacagtcttcagcctggcatatattgttatatcatttgtgttgtcgcttaaagatggtaatctcttatatctgttcctgcttatcttacaataacttgttaataaatctgtttgatttagcgttgtctaaaaagtaatgcacgtcacttgaagcacatacaaatagcttatgcatgtgtttttttaacgcaaaagcaaacacactaatagtttgatttttcaagtcaaaacgagtaacaagtagtttaagctttcacgtctatgaagagaattgacatgacttttcttattaaaacgggtatccaaacacacattaagtatatgtttgattttgcatcatgtcaatactaaaaattgacttgcaatatggtttcgtatgtttactttgttatgttgaatatattatgaaagacatgcccagtgtgtctgcgtactaaccaatagaacgttatcaggattacaatcaccgcctcgagattacgagattccaggagatggtgtaagcaaaatctttacaataattggagcatctgctaaccttgtgtttgcatttaataccggcatgcttcctgagatacaggtaagacagaagcttgtaaatcttcatatattgtgttgttcgttgatacacaattttctttggtttcatatgtgctctagaaattgagttttatttgtttgcataacttgcaggcaacaattaggcaaccagttgttaagaacatgatgaaagccttgtactttcagtttaccgttggagttctaccattgtacctgg

SEQ ID NO: 663 - DNA, 390 bp, Glycine max
accctcctctacacctactcctccgccgcctcaggcttctccgtccgcctcaccccatcccaagcctcccacctccgccgccacccctccgtcctcgccctccactccgaccaaatccgccacccccacaccacccacaccccgcgcttcctcggcctcgccgactccttcggcctctggcccaactccgactacgccgacgacgtcatcgtaggggtcctcgacaccggaatatggccggagctcaagagcttctccgaccacaatctctccccaatcccctcctcatggaaaggctcctgccagtcctcaccagacttcccttcctccctgtgcaacaacaaaatcatcggcgccaaagccttctacaaaggctacgaatcctatctc

SEQ ID NO: 664 - DNA, 484 bp, Glycine max
cctctatctctctcttctttgtgtctcaaatctagggttttcgtatctcgaaattaaactactcctctttgggaaattaattaatcggcaacaaaacttggtgatggttctgattgttttgttgttcgttttttcaggattcttcggaggtttcgggttcagctgcggagcaacgaaggtggacgctaaacgatttcgatatcggaaagcctctcggaaggggaaaattcggtcacgtttatttggccagggagaagactgtgagtttcagtgtgctaatttcttctcaactaacaataattgtgctaatttctgttgatcttgtatttctctgatcattgatagttcgtaattgtactaatttctatggattatttcattcgctccttgatttatttgcgttgtccttacaattgcttggggaaaagtttgctcgcgctattattggttgctttggcaagatttgtatgtgattttcgcattt

SEQ ID NO: 665 - DNA, 841 bp, Glycine max
tttggagcttggtgggaaatccccattcattgtatgcgaagatgctgatgtagatgaggctgttgagctagcacactttgcattattctttaatcaggtatatgagtatatcccaaatatcaagttgtttgtaaaattgtctttcatagagttcagaaaaaaattaattggtggtttttgtgacattcagggacaatgctgctgtgccgggtctagaacatttgtacacgaacgtgtgtacgatgaatttattgagaaagcaaaggcacgcgctttgaagcgtgctgttggtgatccattcaaggggggaatagagcaaggtcctcaggtaacatacccatacgtttagtatcaaaatgcataggaaatattacactaattttatatttccttacttttttttaaatgtccgactctattgacgaattttgtgtatgatccaaaaatcagattgattcagaacaatttcagaaaatactgaagtatattagatccggtgttgaaagtggagctactcttgaaaccggaggagatagatttggcaactcgggcttctatattcagcctactgtcttctcaaatgttaaggtataattataataagaggaatgttagcaacacattctctgatagatactctgctagaaaatttttgtaatttttgatatatttttgtaaataatagaaagtttgtttaaaagattgtgttatagagttcttgctagcatttctctaataataatatcttttaatttcactctcattgtatcaaggatgcttaaaatgtgaattctttgtgttactaattgtaaaaacaaccaggatgacatgctgattgcga

SEQ ID NO: 666 - DNA, 335 bp, Glycine max
tgttagaggttgggcttttgctccacatgctgatgtgatatggatggaaactgcaagcccaaatgtgattgagtgcacacagttttctgagggggttaggtcaaagcaccctcagatgatgctggggtacaacctctctccatctttcaactgggatgcttctggcatgagtgatgaacaaatgagggacttcattccaaagattgcaaagttggggtatgtgtggcagttcatcacagtgggagggctgcattctaatgcactcattacttcaacatttgcaagggattttgccaataggggaatgctagcttatgtggagaggattcagagag

SEQ ID NO: 667 - DNA, 631 bp, Glycine max
  misc_feature (575)..(575): n is a, c, g, or t
  misc_feature (585)..(589): n is a, c, g, or t
  misc_feature (593)..(595): n is a, c, g, or t
  misc_feature (598)..(600): n is a, c, g, or t
  misc_feature (602)..(602): n is a, c, g, or t
  misc_feature (604)..(604): n is a, c, g, or t
  misc_feature (606)..(611): n is a, c, g, or t
ggtttcaaattgccatacctattattgttaacgacagggtaatcaagcatgaagttttcttcttgtttgctacatactaataaaattaaacttgcagggagtggctaaccgtggttgctcaatccgtgtgggaagagacacagagaagaatggcaaaggtaagtcatcaacaattatggccaggccactttatagtggctctagatgaattaaaagtacaatcatttagatttctaatgggggactaaaaaacattatatctgacttctttagcttgtcgtgcttgactgaagttgctagctgaaaattttagtatttcaaactttttgaataattgctaattgcctatgcaacaacttcagcttaccattaggcttatgggttggatagtcttgcagtgtcactctggtccctttttttttttttttggtcccccccaaaaggggaaaaacccccaccctttttttccaaataggggggtttttaagaaaatttggaggttcctctttttcccggaccccccttccaaattttatttcttttttttttccttcccaacctttttttttcccccnatttttaacnnnnngccnnnaannncnanannnnnntttttaaccccccccccccc

SEQ ID NO: 668 - DNA, 835 bp, Glycine max
ccttgctatatatgacaacgacaccccagatagatggttcaaggtggcagctatgatccctgggaagactgtgtttgatgtgatcaagcagtatagggaactggaagaagatgtgagtgaaatcgaagccgggcgtgttccaattcctggctatcttgcctcttctttcacctttgagctggttgacaaccacaactatgatggatgcagaagaaggcttgcacctgtcagaggctctgatcaagagagaaagaaaggagtcccatggactgaagatgaacacaggtgagtttcaccaatttagaatatccaatagtttatctgacttgaccttttgctcccttctgtagttgctgcaagatattggtattgaaattctgctgatcgaacatgattttattgccctaccaaccaattagtcttggattaaatatttaatcattgttcatatcatttaccttgaattccaatgtttttatcactgatccaattgtcttctatactagctattttgtctatctagcaaagcagctatactataatttgatcagtgagtttttaattttttaaaataatttgcaatttgaactttgggcatggccaaaagagccggcatgtcaaacataattttgagtttttttgtgtgtttcctatataaacttgttgcttttcatcttatctgttgtgctaagtgaggtatttcaatctctatcctttttggttcctgtacttgatgactttggttttaaattacagacgttttctgatgggacttttaaagtatggtaaaggagactggagaaatatctctcgcaattttgtggtcactaagact

SEQ ID NO: 669 - DNA, 691 bp, Glycine max
gcatttggaagtaccatgatttaaatataaataaagtaagactaatacaattggtttgtttctcaattgtgcatgtgtaggtcagttttacaggttcaacagaagtagggcgtgaagtaatgcgtgctgcagctaacagtaatttgaaaccagtttcacttgaactaggaggcaagtcaccattcataatttttgatgatgcagatctagataaagcggttgagcttgctctcatggccgtagtatataacaaggtgaagtttctttcaataatcatattcctttttacatagcaacaacacatcttcattagtgacaactatttattgttgttgtctggttttcagggagaagtttgtgctgcaggctcccgcgtatttgttcaggaagggatctatgatgaatttgagaagaggttggtggagaaggcaaaagcttgggttgttggggatccctttgatcctaatgttcagcaagggcctcaggtataaactagcacaaccccattatgtttactcttgttctcctacaactttatttcaagcattgccttagtaaaaaacagagaaatgactcaaacaagaaaagttaattactaattaggatcctcctctagttacttacattactacttgctatggtaggttgacaaaaagcaatttgaaaaaattctttcctacatcgagcatgg

SEQ ID NO: 670 - DNA, 303 bp, Glycine max
gtgaaatcggtgactacttggatgtggctattctgtagtttattatggatactacttgcatgtggctggttatgtttgaaggccttgaaacacttattttagagttaagaagactgtaatcgtggaaatgtttagctgttaatgtttacatgaactaaaaagaggtccagtttctctggttgcaaaaatgatagattgaagatttctaatgcctatattttttatcacggtcccttcctggttcttttgttcacctcaaagataaaaggaaaggatgatgtttatgggtgagaatcattggtt

SEQ ID NO: 671 - DNA, 161 bp, Glycine max
gatgcagcttgttcatcccacaccttctctctctgcaatgattgtgaaccactacaagctaagagggaatatccaaagttataatcttggtggcatgggttgcagtgctggacttatctctatagaccttgccaaacagctcctccaggtttgttttgcac

SEQ ID NO: 672 - DNA, 455 bp, Glycine max
  misc_feature (432)..(432): n is a, c, g, or t
cctctaccaagttcatcactaatcccataagatatatatatcttgggtcctacgtcattctgcaaggagtaatgaggcaatttagctgcaacattgagaaggccccacttggagtgaatatactgaagtaaaggtagtttgctgataaactcgggtctttggtacaacagaaattcttcagaagcactaggtgaaggccaatctttcaatttcaataactgcggccaaccattttcaagaatatgcccttcgaagtatcctttcatgaactgagcaagctcaatatcaatctgtcaatattaaaataacaaaatgcagccataatgcagagtaatttagcataaatgatgaaccaaaaacagtgcaatagataaaaccaatacaatttcaatcaccaaaaagagaagaggtaaatatatatttgtgcctcanacccatgtaagcaatctatggcc

SEQ ID NO: 673 - DNA, 956 bp, Glycine max
catcgtcttcgccgcgcgaggcgaggaatctggaggagaagctcgctcaggctgccatggggaacgcttttctccttcagggcggtgattgcgccgagagcttcaaggaattcactgccaacaacatccgtgacaccttccgtgtcatccttcaaatgggtgtggtcctcatgttcggtggccaaatgcccgttatcaaggtcaatcttttcaattatttcattcggtcatctaaaaatctttttttttatttatttattgttaattctctgtctgataaatttgtattttgagtgatatttgggtacgtgtaggagtgaaccttcctttaggaaaaaaatgagtgttagagatgtcatgttaactagtgatatgagatgaattgtaagatggtatcaaagcctatcataatgatagttgttgggctcattgtgctatccaccatcagtaaatgtctagtcttgcaaactttatgctcaagatgttctgaccctgcatgaggggtgatatgaccaaaatagagaatagaagttggtggcaatcctcactctatgaactaatttttagagttgagttaagcccaaactcaaattctaagagagtattgtgttgtggtggggttaatcaaattcttgctcagttatttgaagctttggcttttgccttgtgagattattgacttggaggaagaggagggtgtcttgtattgtgatttgtggttgatcaaattcttccattgagtaatgattagatagtctcacatattactggttttaaaattttatgatggatgaggatgacattcttcaattgttggatatggtgattcaggtggggagaatggcaggtcaatttgcaaagccgagatccgattcatttgaggagaagaatggagtgacgctcccgagttacaggggtgataatgtgaatggcgatgcattgacgcggcatctaga

SEQ ID NO: 674 - DNA, 405 bp, Glycine max
agatggtgttatgaaattccagcaaaaacaatagtctatgtgaatgcttgggctatccatagagaccctaaggtttggaaagacccagatgagtttttacccgagaggttcttagataatactatagattttcgaggtcaagattttgagttaattccatttggtgctggtcgtagaatatgccctggcatgcctatggcaattgcttcattggatcttattcttgctaatcttcttaattcttttaattgggaattgccagcaggaatgacaaaagaagacattgatactgaaatgttgccaggacttactcagcataagaagaaccctctttatgttttggccaagtgtagaatctaaaattatgattaatgaaaaatgtactgattctgtttgtaccctgcc

SEQ ID NO: 675 - DNA, 714 bp, Glycine max
ctgaatcccagtgctgaagatatggggtatggacgccatccaggtcagccccaaggccatgctctctttcaaccattggagtgtgagccaaccttacaaattgggtattattttcctcttcattcaaatattaattcattcatatatagttgtggttgtacatatattatttcgtaactagcatgcatgcaatatgaaagaattaatgcatgatttaagagattgtgtggtgtacatagtatatatgggatttgatacagactattagaaactacaaatattgcgtaacaatttaaaattcccaatcatgaatcatgttgattaacgagtaacgggttttagattttaataataattttaatttgtttgatcgcagatatcatcctgatccagtatcagtggtgacagaaggcccaagcatgaataattacatggcaggatggttaccatgaaagagtgtcaagtgtggagcgtaattaaagatcctgccgtttaatttcaaatttatttgaagttaaggaaaacggaaatttgtaatagcacgtaatggacttacactagactctaccttctaattaagctaggaacaatataagcagtgattttgtgtgtgagctttcataaacagtacctagctagcctcttccttgtttcaataatcacttcttccttttcctaattaataaaactatcgtatgcaccctttgcctttac

SEQ ID NO: 676 - DNA, 591 bp, Glycine max
gaagcttttgcctttcttgtttgatgattaaactagttctaatcgtttcagatgtttactgtgatggcattgggggggatcttatgattgtctgttgatgggttttgcagcttcaggcatattttcttgttcttgatgacattatggataactctcacacacgccgtggtcagccatgctggtttagagtgcccaaggtttgtagaaagaataacatgtgccattttgttatctttatgctactgttgtgataaagcaattatctctagttacggtatggtgtaggttggaatgattgcagccaatgatggagttctactaagaaaccatattccacgtatccttaaaaagcacttcaggggaaagccatattacgttgatcttcttgatttgtttaatgaggttgtacttgtacaaatgttgaagtttaatttatgtggatttcatcttgttaaaatgcttaaagttgactatcatgcttttcttttaggttgagttccagactgcttcaggacagatgatagatctgatcaccacactggaaggagaaaaagacctgtctaaatacacattaacactgtgagtactgaa

SEQ ID NO: 677 - DNA, 809 bp, Glycine max
  misc_feature (767)..(773): n is a, c, g, or t
tgtgtacaatataacataacaaattaacactctttatgaaccttctatcttaccaaatttactaagttatagaccaattcaaatttgattatgactattgcctttgtgtacaaggtatgtggacgctgttctgaccataccaaagggcactttattccccatgtgtggaatgaacttggcattcgaccgtgatctcattggaccagcaatgtactttggtctcatgggagatggtcaaccaattggacgctacgatgatatgtgggctggctggtgctgcaaggtccatttcttttgccttattttcactataacatcaatataatcttattgaaacagttaatacatatttgttaatgcttaaatttgaataaattactgtttttttaagttctcttagaaagttggtaaaattaagcaatcatttcttcttattgaatcagtacttgttatgtaagcacttatgcataagttgttttttataatcaaaatggaaataaaattgttttcatatatgctattctaaacaagttttcttgaacacttgcaaaagggcttattatgagataagtccaaacaagttgcaaataaactttttataccgttaatagttatatgaattttatagcggaaagaaaaacaattgacatgttttcatgatgatggttcaggtgatcactgatcatttggggctaggagtcaagactggtctgccctatatctatcacagcaaggccagtaacccatttgttaacctgaggaaagannnnnnnggcatattctggcaggaagacatcattccattcttc

SEQ ID NO: 678 - DNA, 365 bp, Glycine max
catgctccagggaccctgccgcgcctttttagctgacctcgctgccggcgaccagcaaaaaacgagaatcgccaacggtttcttctcgttcttcatggccgtcggcaacgtgcttgggtatgctgcagggtcctacagcggtctccacaagatcttccccttcacggagaccaaggcctgtgacgtcttctgcgcaaacttaaaaagctgtttctttttctcgatcctactgcttctctttttagcaactgttgctctgctctacgttaaggacaagcaagttgaagcaattcctctggatgatgccactcaaccctcttgtttctttcagcttttcggtgctctgaaagagctcaagaaaaaaa

SEQ ID NO: 679 - DNA, 407 bp, Glycine max
aacaccatgccaaaacaggagagagtacttgttttgggatgcttttcatcctactgaagctggcaatgttgttgtggctcagagagcttacagtgctcaatctgcatcagatgcttaccctgttgatatccaacgcttagctcagatctgatctctgaacaatgaacatggtctagagggtagtggctattaagctagtatgccacaaccacatttaatgttcttggaatgtgttacatcttttaaggcataagagtcttaattaagttttctctctttttcttacatattcacatatgctaaatgttcatggtttcacaagtacaggtgtaatttgtggaaaagttttggaagattgcttatttaattatagtgaataatagtagtatgctgttggctgatcgatt

SEQ ID NO: 680 - DNA, 539 bp, Glycine max
tatgttattgaatgattaagtgagtgatgtaccaagacaaacagtggaagaaataaagaagcatgtggaggcaatgaatcttccaaaaaccctcagctatcaaagtatctgcttccttcttagtaggaatgacaaatgtttttcaaaagttgaaagatgcaaacctcacagtagtagtccataatctcaaaaatgaatacacaaccctggcatttgactattggtctgatcctgatgtcaagattgcaacttatatccaaactgccaaggttgatggaatcgtgacggattttctagccactgcaagtagattcatgagtgagttattccattctaaatgtcttttctttatcttagcaaactataatttcagttactgtatgactaaaacattatttttggtaagcaaaacttgaaacttaatgtaactatttgtaatttgcagggagtcccatgatcctgcctggtgatctattaaacaccattcctactgaacttcagccaccagcacttcctcctcttaaggttgcaaaggttgt

SEQ ID NO: 681 - DNA, 644 bp, Glycine max
cttattatatatatagaaaaaactaagccatttcaggcaccacacaacacaacttccttgtgcagccaccattattgttgttattggagatttcaattctctgtctttcaaactcctcaagttgggtttatgtgatgatggctctcaacatctcttctccagctgaagtcaagtccatttttttcgctgattccttcaagtctaactgcctcacagcaaaattctcaggtcttttcttcatctcttcattctcgctattcttccttcattgtgtgttctgggaaaagtcagaagccaacgactttatagagaaacccccctccccatttgaattattgttattttttgtccctgaaattatgccattttttggttctaccatgttatgagctgctttgttgatgatgttacggtgttgtgtgctatgatgttttgttctgtggaaaggcaatatttgttgtgttgtgttttgatgtcaattattacatggagcatacatggtttgactttgatggtgctttgattctcaggtgggtttgcttttaagagaaaagagcgtagagcagcatctggaggacgggtttattgctcagtgcaggcaacaccaccaccaccagcctggccgggacgagcggttccggaac

SEQ ID NO: 682 - DNA, 730 bp, Glycine max
agctcaagccccatgccgtgtctgtctttgtaatggtaagctaaaattaaatactaaaccaaattccagttaaaccattataaccataaattatagaagccatgtctcttaattggtaatatcaatttattttgtttttgtcattgcagacctgtgattcagcagttcagctgcggaaggccgggaaagtcactgtcagagaatcaaacttgaaaaaattaggtgctacccattttagaaccggcgtagcaaacgagcatttcgaggtatataaacatcttagtatgagtataattgccaaattaaacattgtttattagcaagggtcaatttatagattgaaaatgacatttgctcataactatttatatcaattgttacattcaaaaatataattggcataaataagtgatggcaagacttgtatttatttgtgttttttaactacactttggagggtaattctctagaagcatgatgtatatagtttattgtttggttttaaggtgacaaagtttgcacttttggagaccataaaagaagctgtaccagaaatgtggtcaccggctatgaagaatgcatggggagaagcttatgatcagctggtcgatgccattaaatctgaaatgaaaccaccctcctcttagactccagtttaagcagttcctttccttccctctcaattctcaaattgttatattaataaaagtgagaaagtttaggcttgtgc

SEQ ID NO: 683 - DNA, 555 bp, Glycine max
ggacaagggctactttattgagccgacaattttctccaatataagggtaaattccaagtgcataaagttattaattaatcgggtatcttcagcataattagataactaatcatcatgtttcctttgtaaaatttattaactacccgtttgtaggaggatatgcttatagcacaggatgaaaatatttggcccagtgatggcactgaagaagtttaagtaagtttattttaatgttattgtgtcatgtttcttgttaattaccatggtgaaatcctcatatttattatgttaactattatgatatatgaacaacaggaccactgaggaagcaattaagagtgctaacaataccaagtatggcctagcagcaggcatagtgaccaagaatttggatacagcaaacacagtgtcaaggtccattcgggcaggcactatatggatcaactgctattttgcctttggcgatgatgttccctttggaggatataagatgagtggatttggaaaagatcatggattggaagcccttcacaagtacctacaagttaaatctgt

SEQ ID NO: 684 - DNA, 852 bp, Glycine max
  misc_feature (845)..(846): n is a, c, g, or t
gaggtgagagtgatatttggttacacttttgtttgtttcttactagattatgttaattcataaatataatcggtagttaaatttaatttggtttctgaaaatgctagcggatgaatcatgagaatgtcctgttgtaatgtaactaacaattatcgaatataatccttccactggaaacttgtgagttttactaatactgtgaattgttccgttccaggaaggaaaacctcttgttttgaatgtagtgaggcgagttgaacagcaactcataaatgacgtgttagtacctcactataaatatactttctttcttctcatttccggtgacattatgctctgaactttttatgatgttctgttctgcattattttcaggtcacgcaacaaggaatatattccgatcgttgggcttgctgattttaataaattgagtgctaagcttatttttggggctgacaggttaataatagaaacaaaatcagtggtttcttgtttgtaaagatttttcctaatcagtacctaattgtttatgttttacattttttgtcatagccctgctattcaagacaacagggttaccactgttcaatgcttgtctggaactggttctttaagagttgggggtgaatttttggctaaacactatcaccaagtaaagtgctttgtccttgacttttttgtcctcctttttaaccgatgttaatttaatgatcccaccttaacattttttactgcacttgtcaattcagcggactatatacttgccaacaccaacttggggcaatcacccgaaggttttcaacttagcaggcttgtctgtcaaacataccgctactatgctccannaacacg

SEQ ID NO: 685 - DNA, 450 bp, Glycine max
  misc_feature (354)..(354): n is a, c, g, or t
ggatttatcttagatactggcagagaaaaccagaaactaaacatagaggtgatctgagtgaagattttgctttctccacattttccccagaatttttaaggtaatttcagcttttagtgtgtagcaaaaataagtgattagttgtagtattgtctgtctagattttaataaactcttttttatgtttttgctgccttgtagaccagtcatagaccctattgcttcaatatttcatcgaatgctctgtggaagatatgatgcttctaatgatggtcaaggcaacagtctggaaagtgagcctttaccaggttcggactcaattgaggcatccaggagacgataattctacatagntgttgttaactttaattgggtcacttattattgtcaagtagaaattgcttctgtggagcatgtcgtgcaggaaaatcaaataaataaacaatagac

SEQ ID NO: 686 - DNA, 730 bp, Glycine max
ccgccacaacgaagcctccggccgccctcgcccgaaacccccaccctctggagaattcctggaccttctggttcgacaacccttcctccaagtccaaacaagccgcatggggcagctccatccgacccatctacactttcgccaccgttgaagagttttggaggtcaagctttgatcttttccctttcccttcctttcctcccaacttttcctctcctgggtcgtaacctaattgcttctttcttgattcttggaaacgctaacccttgtttttctttttttttaatgttcagcatttacaataacattcaccacccgagcaagttgggtttgggggcggactttcactgcttcaagcacaagattgagccaaagtgggaggaccctatctgcgccaatgggggaaaggggactatgaccttcccaaggggaaaatctgataccagttggttgtatacggtattgttttacattaacacctgcttttgatgcaaaagaattcatttctttgtggagttttatttataaatttaattagaatgcactaatggtgttacatattgttaatttttaataattactttaaaagtcatatctgataaaatcctatagggtaaaaaaaattttagtgatagggcatggaagttggactctattaaattggaatatgtagtaaaatgataaaatcctataggatgtttttgagtgcatataaatactcattgtgtag

SEQ ID NO: 687 - DNA, 367 bp, Glycine max
tcgctgcagcagcggatcagagatcaagctcaagaacaaagtccgctccaagcacctctgccacgcttgtcacaaatcctttcgatcctctcgcgctcttgggagccacagaaccctgtgctctccccgtctggaagcccaaaataacagcatcattagtaataacaacattaaggtttttgaatgccccttctgttacaagctgtttggttctggccaagcgctcggtggacacaagagatctcacctaattccttcttcctcttcaaccgttaatcattctgtcaagttgaaacagagcttcatagatctcaacttgcctgctccggccgaagacgacgatcttagcgttgtttctgatgcctaa

SEQ ID NO: 688 - DNA, 244 bp, Glycine max
  misc_feature (16)..(16): n is a, c, g, or t
  misc_feature (18)..(18): n is a, c, g, or t
ttctgtcggttgggtncngaacgtggtgggtgctcgtagggcttcgtggaggattctttcctcgattgaacagaaagaagaagctaaagggaacgatgtgagtgtgaagaggataaaggagtataggcagaaggtggagtctgagttgtccaatatctgcagtgatatcatgactgttattgatgaataccttattccctctagctctgctggtgaacctagtgtctttttctacaaaatgtga

SEQ ID NO: 689 - DNA, 498 bp, Glycine max
ggttttcatcctccccctggcagacaaagagaactgggttttacattctcattcccagtgaggcaaacatcgattgcatctgggactctaataaagtggactaaaggtttcaatattgaagatgcggtaattcttgtcaacctgattacattatattcaactttatttgtgcaaccattttttcttctagtcatttatcttgattgatctgtcatgtattgttcacaaactcactttgagtctctcgatttcacacacactatgtcactaccacactattgtcgtgttaaattgtaagtccagtcattgcaatgtttaccttattatggttcaaaattgtatcatagtcataggatctctttctgttttcaaagagaacactcttctactaggtttctctttgtttctcagacattcgttgactcagcatggtaatctgacttcatggtttgtttgtaggttggtgaagatgtggtgggagaactaaccaagtccatg

SEQ ID NO: 690 - DNA, 210 bp, Glycine max
  misc_feature (63)..(63): n is a, c, g, or t
cgcaaaatgcctcccaaatctgccaatccaaggaagctccagctgagcgacccatcctccttngagtctcttctcacctcaaaattggcattgtatgattcttattctctctccaaatccacaaattttcgattttgacactatcctcacctacccttttgcaattacaaaaatgggtcctccctctttcggcttcatgttcatgcttga

SEQ ID NO: 691 - DNA, 816 bp, Glycine max
gagagagagggcaaggagcttccagatgattactttgttgttctggtcggagacatgatcacagaggaagccctgcctacttaccaaacaatgttaaatactttggatggagttcgtgatgaaacaggtgccagccttacttcctgggcaatttggacaagggcatggactgctgaagaaaacagacacggtgatcttcttaacaaatatctttacttgagtggtcgagttgacatgaaacaaattgaaaagacaattcagtaccttattgggtctggaatggtaagatcctatacaactgtagtctattttggtcttccgcaatggtagttttattaatgaatcacacaatcatgcaatgtcaaagaaactcttgctacccatttatggatactttatttgtttgagagggtggggggataactgcctgaaatataaattttattgattaattcctctggatgcattaatgtgtcactgtcagcaactttcatattcacatgaatgtctttaaactattgaaggatcttcacagaatgaagggctagatttcaaagaatacgatgacactttcctgaaattcattattaaaatagattattatgttgctctgaagttattacactaattgattcttcatagctgctgcttttgtcactttttgagtattgacctttcttgactgattgaaattgatggataggatcctcgaaccgagaacagcccctaccttggtttcatttacacttcatttcaagagagggcaaccttcatatcccacggaaacacagccaggcttgctaaggagcacgggga

SEQ ID NO: 692 - DNA, 410 bp, Glycine max
tcgcatcgctctgaatgaaatgaataataattctcagatttgtttctctgtggcgcttcaatttggactattaagggttttagttgcttcttatatattataataaggttatgtttttagttttcggtgttttgaaccgtgttaattggattttagaaaaaccaaaaagaaaaaatagataggtagctatttgggcatgccttgtaatatgcctatacttgtttttacatattcagcgtcgtggtattgtgttgagttagtagtgcgttcgtggtaaacgagaatcgaatcattcttgtttttggatattcaatcctatttttgggtttaattttttttattggattcaaagtctgttgctttcagcttctcgttctagtttttgcattagttgaacgagttcgattcga

SEQ ID NO: 693 - DNA, 357 bp, Glycine max
gccgcatacctgtctgtggaatgatctcgcagtacaatcttactcagttcgatggtgtaacaaatttggcaaatctcatatttaagcgggttaaaatggaaggttttattgcaactgatttctatcatttatatccaaaattcttggagtttgtcctgcctcatatcagagaagggaaggttgtgtatgtggaagacattgctgagggccttgagaagggccctgcagccttggttggcctctataccggtcgcaatgttggtaaacaagtggttgttgttactcacgagtaaaattatataaatatattgttattctctaagctttaattccgaattttcaattttctgttggata

SEQ ID NO: 694 - DNA, 1135 bp, Glycine max
  misc_feature (1074)..(1075): n is a, c, g, or t
  misc_feature (1125)..(1128): n is a, c, g, or t
tttttttcttatacttttgtaggcatgcattgcatggaaccctttattttgaacttagaagtatctgtcacaatctcctcttccatatagcatattagtgtataatgagaaattcattcaatgcgtatggctgagtcatgcattgaagtttcttgtttcatgtttggcttttgcttgaggttcctaaagcccgttgtgctgtattattctgtttggactgttgcatatagagcttgagctttaaataatgtacagaagaaatattgttagaagaaaccaatagtccattaggttgtcctgctagaaggtagcatacagtacaatcctacctctagctagcattgttaagtagacatctatatgcgacatttatatttttattagtctaagcagtgcattggataacagcaatttagaaaacgtttagaagccagcttatgattttattatgtatggttttcttgtgttctttttttcaggacctaccaagaagaaaaagcttgactgggagctgcgtctaaaaatagcacttggagcagcacaagggcttgcttatctacaccatgattgctgtcctagaatcatccacagagatgtgaaatcatctaacattctattggatgcagactttgagcctcatctcactgattttggcattgccaaaagtctctgcccctcaaagtcccatacttctacttacataatgggcacaattggctatatagaccctgagtatgctagaacttcacgtctcactgagaagtctgatgtgtacagttatggtattgttttactcgagttgctaactggaaggaaagctgttgacaatgaatccaacctccaccatcttgtaagtttactacaaatttgaatacaagcgtgcgtgtatacacacatgctgacggattagccttggtcttttatgaacttaggtatatatttattgctctatctttagtctgaatattcgaggcatgctagaatgcttgctttatcggactcaaaattgcttggcttatgatttaagattgcaaatctgatctctgctaaaacatcactctcaacttggtaatnnttaatccttgttctattgttcacatactaatgtctcttatttgtgtagannnnccaagca

SEQ ID NO: 695 - DNA, 498 bp, Glycine max
atggaacacaacaagagaaaataagaaaaagtaattgatagggaaagaaaaaggttagaaaatagtgtgaccttgatgtacaagaaaacacagaagagaaagctgccgaagatgagagctgaataaatttctcccaaatgatgataaacaatcgtagggttgaatatcccaaaccaccagagagcaaaataagtaatcaaggtgacaaaataggcttgcagaccatttgcctgaaagaagtggttagtaattagtaatcagtaatcagtaattagtaattagtaatgaaaggcatgtctgtgaggtgtgaccttgtagacaggtcggtggccggttggagaaatagggccgtaaacggttttcccgggaagaagaagctgaagtgctgcctcaaatgcagcatagactgcaatgattttgcaggcggtgggagtgggggtgggccatatatgtagcaaaccctgcaacccattctgccttaaataatggaatgtctcg

SEQ ID NO: 696 - DNA, 412 bp, Glycine max
tcaatcgaaccctttttaaacgctcaaatacaaatttctggcaccaaatccttcccactctcctcaattccattcatttcaactcaacaatctctcagatccgtcaaacaaaatataaaagatagaaaaccctagttctgtaaatatataaaggaaaaaaggtctgatagatacccattgtcaataagatctaattcttcacacacggatttccccacaatttcttaacgattataacctgattgcgggaaaaaaaaattgcccttttgttgatttttttttgtcaaaaacaattttgtgtgtgtataaaaccatccgtgatctgggttcttttaaaaattggttcttttgtgtattttgttacttttgtaaggaaaattgagggttttggtactgatcactgtggaacatg

SEQ ID NO: 697 - DNA, 700 bp, Glycine max
ttgctcgaccgagtgcttcagaggagaagtaatgactgcgatcgcgggaacgcacgtttttggtgttgtgagttttcagctcaaacaagctgaaatgccttttgcatgttcttgcttaatccgcaagcgtattggagattctcctcagcgcaatgtggctctaagacgcagagtaaatggaacaattcttccccaaatcagagcccagaatcttccaggtacaaatgcattatgcatgtgttctctatgactctaatgttacttaatttgttgtttgctatttgtttttctttcccagattatgttccaaaatccgagttttacaaagtagaagcgattctcaggttacaagctaaaaccctcttctttttttgtggctcggggaggttcttgctatgtaattagttgaaatgagtttttctagcttgatgtatatatattcggcgtttttatgttgttgaattcttgtggaacaggccatggcgagttccccaggtttctgcggtacgacattaccttttgactgatattttttggggtttaatttatatataccgtggggtatctacagcaaaatatagtattgttattttcactgtattgaatgcactgccacaacatcccttcactttgatacttgtgttttcttgaagtggagctaagcagtagatttctagcagttggtaattcgtgcaaatta

SEQ ID NO: 698 - DNA, 470 bp, Glycine max
atctgctcaggtatatataattatatattgctgtttatcatgcattctagttgttactagaacttacttgttactgatttgctgaacttaaaatttgtgtttacttgatgcaggatattgctcttgctgacttggcccccactcaccccattaggctgggacttgctctcaacttttctgtcttctattatgaaatccttaactcgccagatcgggcttgtaatcttgccaaacaggtatatctaaaggcttttttgtgttttcaattccttgcttttggtggtatgtctcagttgttcattgacgaataaattgtgtttaagtttgacttactcatttgttccctgaacttgcaccatctttatgttttagtccctacacatacatgcactttttaattcgttttagttcctacatatacagttttcatccattttggtccttgcaattttggatgtcaaaggctaaaa

SEQ ID NO: 699 - DNA, 406 bp, Glycine max
cttactacatttgcataatggtaaaaagtgaaagctagaaaaccgaagaagcaaagtctcttttgagttttttttttattcccacacgagccaaggaaactttacaccatcatcaacattcctcatggggttagagacaatacaatgctcgatcacaaaatgaaaaaaaaaccaaaaccccttgaaactcacttgcatttttttttctctatcttttccccctttatcttgaaacaaaagttgtctaactcttggcttgaataaatcataaaataaaaaataataactaagggttactttcatgatctcacactatatataaaatggctcgaaccctctgtttttttttttggggaggactttaaattaacctacctacctggtaaaaaaaccctttccccaataa

SEQ ID NO: 700 - DNA, 558 bp, Glycine max
caaagctgatgctatttttatgaaggtgaattttaaaatctgaatccattccattgtcttaccaactctagaaattaaaggcctttcaaggttttcttttctcaatcaagttttgagccgttactttttggtaccacaaaatcatgtttcacttgtttatgttaatgacttgtgatatcatttacacattcagtggatttgccacgattggagtgatgagcactgcttgaagtttttgaagaactgctatgaggcactaccagataatgggaaagtgattgtggcggaatgcattcttccggtggctccagactctagcttggccacaaagggtgtggttcacatcgatgtgatcatgttggctcacaatccaggtgggaaagagagaacagagaaagagtttgaggctctggccaaaggctctggattccaaggtttccaagtcctgtgctgtgctttcaatacctacgtcatggaatttctcaaaaaggtttaagttctttggcgtggattcatatcaagttgcatttggattttgactttgagactctgcttggg

SEQ ID NO: 701 - DNA, 563 bp, Glycine max
tcggtgactacaggagttttctggaacttattccgtagctgaccacaagctgcatttgcatccagtcctctggtttgacgtacactaacagttattttagaggactccaaagcaccagaaaatgcaagcacctaccaaacgaggaactttggattaaacatcaaaagttacaaagatcactcaagtcatgaactaaatcttgttttaaatgaacaaaagaaaagaaagtcaacatactgctctcttggaaggacgctgatactcggagccttctattggattgaaaggtatcaagttgacgtgatatccgctgcccgatcgatggagtaattcagcaagctctaatgcatggtttactgagtcattcactccagctgctcaaacataatgccaagaaagtgccatgtgcattataaggattccaccaaactttttgtatgaaaaggaaatagtatatattggaactttcaatacctaaaagtgcatattcaaaggaaacccgcctactagtttgctgaaagtattctctgcagtcactcataagtgcatccaatgggtaggat

SEQ ID NO: 702 - DNA, 525 bp, Glycine max
  misc_feature (463)..(465): n is a, c, g, or t
  misc_feature (510)..(510): n is a, c, g, or t
acactgatttctactccatgatggctgctggtggcaggaactcaaactttggtgcctctgatgtttatggcctttcagcttcaagagggccaactccaaggccttctaactatgatgaagatggtgggaagccaaagtttcattaccatgctgctggtggaactgggcactaccctgcacctaaccctggcatgttctctccctctaatgggtccaaaagtgttgctgctaatgctaatgccaagaggcctaatgggcaggctcagctgaagcctgaggatgggaatagggaccttcatatgtttgtttggagttcaagtgcttcaccagtttctgatgtgtttggtgcccatgagtatggaggaggtcatgatcagaaaaagatggtgacgcacttgaactccaaacaaacatatgaaggtccctattcccatcctcaggcttcagctgagcctgcccattnnncctcttggcattagcattagcagcaacacttttggacccattagngggagagaacatgcc

SEQ ID NO: 703 - DNA, 722 bp, Glycine max
  misc_feature (687)..(688): n is a, c, g, or t
tatgaaaaaaaattaataacatgtgacgtgaagatttgtggggacgatatagtctccgaccatgtaataatttttcagtcatacaagtatcaacatacatataagtaattaattctaagttaataatctgactttgtgttactttttttgtggaattagtcattcactttgaagaagtacccggcagagctctcactgacagcttggatttgtgtgatgggtattattgagggttcaatcgcatcccttatatttgaacgagacttcagtgtatgggccataggctgggactcaagacttcttgcttgtgtttactctgtgagtaccttaatttccttattaataattaaaattaaaaccattgcatgatggggatttctaattcattaatgattcaactaattaacaacttagcactaaaaataataaccagggggtgatttgttctggaatggcatactatgtacaaggggttgtaaccagggaacgtggaccagtgtttgtgacttctttcagccctctatgtatgattatcaccgcagcattgggttcccttgtcttagccgaacaagttcatctaggaaggtatgtattaaatttgcatcaatcaaattaatagaaaattcaaaatttacttgtgattaattaatgtgctaattaaatttattgtgtttcttaattcgtacnnagtatatttggggccattctcattgtgtgcggac

SEQ ID NO: 704 - DNA, 527 bp, Glycine max
  misc_feature (490)..(492): n is a, c, g, or t
gagcaatcatcgccgttatagtctttctcttttctctctgacacttatcagaggccctacagaattcaaggaattataaattaaaagcaggcgatgataaataagaaaaacggaggagaaaagaatcagaagaaaaaaaaaacaccctacctcgctggggatgaagctgatgaactcggaaaccctttcctgaacggtctctttggcgtcctttgcgattttaccgttggcaggaagtgccttcttcatgatgcggcttatgttagcgatagggaggtacctgtcctgctcgcgcacgttagagcgagggctgtggtcgccgctctcgtggctgccgccgcctgggctagccggaccgtcggccatgctcgccggaaccctaatttgagaaaggaaaacatggtgaaaatgaaaccctagctagagaagagggaggggtgtgttggggaagggaaatgttaagaaggatacctgggttgggttgacacgnnntttgtatttggcgcgagatcgggagagaatcgacg

SEQ ID NO: 705 - DNA, 583 bp, Glycine max
  misc_feature (286)..(287): n is a, c, g, or t
acttttcttcttctgcaggtacctacctctctttctttctctttccaccactatgttatgttctgagcattctttttatctagttttcactttcaattttgcgtttatccatttattttaactgcaatttccataattccacgttaattgctatgaattttgattcatcttaacttccaaatcattttttagtagagggttcatgctaaagaacttgaatttgatctttggatttttgcttgtttgtctttccaggaccaaattgatatacaagatcattgttttnnagagagagagagagagagagagagagagagagaggatgtttggttcaaagaaaactcctctgagagatgctaaacctacctctgttgaccatgcccataacccctttgattctgatgaagatacaaaagataacaagtataattcttctaagaagactttgaccaacaccaacccctttgatgatgatcatgttaatgccactggccactcttcatcatcttcttatggcctttcgtctacccatcgaaataggtataagaacgatttccgcgactcaggggggtggagagtcaat

SEQ ID NO: 706 - DNA, 662 bp, Glycine max
cctcaaaaaccaacaaacaatcaaataaactacaaaccggatatcaaactcaatccttgctggttgaagtaggtctctgggcacccgggggggcggttggcctagggaaattataatcaaattgcatgccagcaaagcgcggggcctccacataggggctctacatccatttgtatcaaaacaaatataaaatgtcactataaatatttacattaatgtaaatgaaatagaaaaaaaaatagcctgaattgtataagaatttaaataaactgacctgaatctagtcaaatgaaaagaaagaattaaaggatcagtgggaaaaattgcacctgggatgtaagtatacctgagacgaaaaatcaggacttgaagatttgggtgatgtactaggagaagtatcattgccagtttcacttccattcaacttgtgtactgccttatttggtacactttcattctcgtttccattggctgatttaaccctctaaattggaatcgtgaattcaaaatcatttcataatcagtatacaatattgctaaaaattctatgaagcgtagggaaagaaataccacctggaagattttaccaagagtttttaaccctttagctcgagcgcggagttcttctttcttggcaccgttgtcttgaagaaccatttgac

SEQ ID NO: 707 - DNA, 403 bp, Glycine max
ttgtggaaaagtggagcaaagaaaattggacagaaagccaatttataaatggcgagcatactttgaacattcctctatgtggaagctacaatgtgaacttctttagggtagtgtggaggactgcatatgtgattatcactgccgttgtagctatgttactcccattcttcaatgactttttggcccttattggtgcactctctttctggccattgacggtttacttccctatagagatgtacattaagaagtcaaatatgcaaagattttccttcacctggacttggctcaagatattgagttgggtttgcttgatcatttctattatctcacttgtgggttccatccaaggcctttcggttagtatcaagaaatacaagcccttccaagcagaacaatagaa

SEQ ID NO: 708 - DNA, 660 bp, Glycine max
gacttatgattttctgtatttaccgattgatttcaaggtaagtatttctggttgatttattctttccttttgagaagaaatcataaatatgtttctaattttagtctacaacgattgcagaacaaatgtaatgttggctatgcattcataaacatgattgatcctggtcaaattattcctttccatcaggttgtttggattttcttatgctttgagctatctatgtactatgaattttgggttcctcatgttgatggaactaaataaagaaatgttttgcaggcttttgatgggaaaaaatgggagaagtttaatagtgaaaaagtagcctcacttgcctatgcccgaattcaaggaaaaggttctcttattgctcatttccagaactcaagcctgatgaatgaagacaaacgttgccgtcctattctcttccatacagatggcccaaatgctggtgatccggtaaatcaagcttttgttctttagttaagaactttgtattatctgattcttctggtggtgataaaattgatcaatatttttttgtctctgcaggagcctttccccatgggtgccaatattagactgagacccggaaaatctcgcactgctggcaacgaggagaatcgaagccaagggagcccttcaactttgtcaagt

SEQ ID NO: 709 - DNA, 845 bp, Glycine max
  misc_feature (46)..(50): n is a, c, g, or t
gggctcaccttaccctcggtattattctattccttcttctatcttnnnnntgaatcggtcaaagtcaaatgcagatctcaaagttctttcttttttcagaaaaaaaaaataactatgattaaggtctatgataaaagatcgaactttgttcgggtttcccaataaatttatatgttgttttgaatgttcgatatattgaaaatttatttttgggttctcatcattaaatcaacgaaaaaaattattgagactcagagtattcgattatttctcacagactttaaacatatttaagtctctaattaatgtattgaaacttcacttcacttcaatagtttacatgcctaatgttaaattaaattgaaacctttctttgattattccaattttatttaatgaacaatactataaaaaggagcatataaggaattgaatatagtagtataagttttatgcttaatttaatttgagtaataattaataattaactaaattggttttttgaattggcagagggtactacaagtgcagcaccgtgagagggtgtccggcgaggaagcacgtggagcgagcgcaggatgaccccaagatgctaatagtgacttacgagggtgagcaccgtcacgtgctgccgttaacttccgctgccggcgttagtttcggccattgagttaatcgacggcgtcttttggaaacttggcgggggacgttaaatgagcgtcggatcgtgaagtaacggcggatgcgaacaaggatcgattcggttcgaggacggaaaaagaaaagtggcaactaaagtcaactttcgcgttgtggaatgattttgttgacgaggacttttgtgt

SEQ ID NO: 710 - DNA, 768 bp, Glycine max
taagggtcatgttatgttatctctacggaggatgagaactatcgtgtgagttttctgtttgagttatttggtttgtctctgttcaattttacaattaaagcaggatgaacttagaccttgtttggacaaacttttgtataagcacatatagaaaaagaaaaatgaaggaaaaatggattgagcttcttgcataagctaaaatttaacgtgcataagttgatttaagcttatggagaagctcaatacattttatcttcttattttcttctcctgtaagtgcttatgaagaagtatatctaaacaaggtcttaggtagcatcgtttattagttttggagcttttgatgctttggattttgaaatgcaatccagatcatttatgcataattacttatatctgaaatcatacatgtccaatgtgtaaattataagtgcatttttttgtgcgtacaggaacccgaaaagcagcatgttgcatttcagggagtgggaagaactcttggaagcagctctacatcaatggctcctgaccctcctgctgcctcaacacctcccaacacagcaccaactccttctgctggcctggtagttgatcaatcattgccatcaacctcaatacaactcaggttggctgacggaacccgcttgatatcacattttaattaccaccacacaatcagcgacattcgtgccttcattgatgcatctagacctgggggtcggcagaattatcaacttcagttgatgggtttccccccaaagattctag

SEQ ID NO: 711 - DNA, 533 bp, Glycine max
  misc_feature (343)..(351): n is a, c, g, or t
  misc_feature (360)..(360): n is a, c, g, or t
  misc_feature (362)..(362): n is a, c, g, or t
  misc_feature (443)..(443): n is a, c, g, or t
ttttttatgataatcactatcatatcaaccccatttatttctgaagtaaatgacagattataggggttgctaaacaaatctaaatacagaaaagaatgtaaaacatataacactccaagtggaagacaaacccaaatcatatcaacacaagtaaaacactatggtaattggttgacgaattcccaattgaacttgtgaggacctgaattattggtcaccggggggtgtggtgatggggatgtggatggcacagggattaatggtgggacagaatcaaacaattcccaatttgtggtaactacaactcctgaggtggaattccttgagggttgttgttgttcannnnnnnnnaagtgagcntngatggagctccttacctcagaaagatagacttgaaggtctatggaggctacacacaactcctcaaagctctagaaaacatnttcaagttgaccataggtgagaaagagttttagtttttgtttgttttattgagatgaaatgaaactacttagtcaaattttataatattt

SEQ ID NO: 712 - DNA, 725 bp, Glycine max
tacccttgtcataaattaaggatgaagaaatttaattatctagtgtctgtcatgatactttttgtttcggttctatcgctaatatcagtgactgttagattcaggcttgatgcctgttgatgcttctgattgaggcatacgaaaaatggctgaggctagaggtatgggcatgatacaaagtgccttggactgaagaaattgcatagctgctcccacatcttcttccataagcttagccacctgttgttctgtgccatcattggaccacttgtcccaggcttgctcattggctccaccttctatgtcctgatccccctgctcgtagaatcaatatataagtatataaccaatgtaagaatctaaatggaaaaatgtctataaagttatgggaatacacatatatacaatatgtaaagcaaagtagacttaattaaaatataaaaacataaatttacatgtgtagtgcagtgatatgattgctatgattttatctgtgatcatatcccagtttagatacgtagcgtacgtggtacaaaaatttgcaagtgtagtgtagtgcagtgcagtgctagatgaaaataaagaaaaggtagattgacatgataaaaagggtatgaaaaaatataaaaaagtagcatttcaaaacatatttggagtatttatcatcacctccactgcagaaaggggaacatcagccacaagctgagcaacagcaccagctccac

SEQ ID NO: 713 - DNA, 355 bp, Glycine max
caaaactagttgttaaggttgttggttcctttgcttggtccagatggtggaaccggccccttcggaagcatgttcaggatcattggcccgtatttccctccggcgagtctcgttcccggcaacgccagcattccggcgaccctcgtgtggccacatcctgacacgtgtcggggtgctggctcctccggcaccaccaccctgtcgctgggaagcgcgaggttcaaagaaggctcagtggctgcaaggctgaaatagttattttcatcattcaagggcctagcagatgatgatgtcagaaacagaaacactagcagcagcatcgctgcaaggtggtggtttgccattaatgactaaa

SEQ ID NO: 714 - DNA, 373 bp, Glycine max
  misc_feature (348)..(348): n is a, c, g, or t
gttcccagcagttccaggtccttccatctttttggtcacagttggtgaaggaacaatgaatacaggattacccaaaggacatgtggtcaccgaaggtgatgttctttttgccgcagctaacactgagattagtgttactagtgcatccgagttgaatttgtacagaacaggggtaaatagcaagttttttcaagcttcataagtttcaacaggggatcacccaaatttttattttttttggtcatatgctgttgggagtcaaataatgcaactatctgttgcgtgtaatagaagcagtttaatgtacatgcaagagtaaaaaaaatcacttagtatattgagtcttanagaaatgttcattatagagaggtgg

SEQ ID NO: 715 - DNA, 362 bp, Glycine max
gttataatacaaagaagaaggaggtcaggagttatatataactactaaattataaactcaaacttaatggcaatgcatgtctgtcctaagtcctaaattaacgtacacaacaacagtatatgctattacattaatatattaattgtagcaaacacacacatatgaagcatgaagttgttatttatatattttgggtgagctagctagccagggaaagcagcaacctcaatggcttcagtgggcctgcttgctggtgcatcatacttggtgaagagtttgtaggaggaaacgagggaaagcaagacatagcaaaacactgccacaaatgtgatagctactgatgctgtgaccttatggcaaaa

SEQ ID NO: 716 - DNA, 792 bp, Glycine max
ggaggtgcagtggcatgcaaaggctaggatcaatgcaggggctaacttctatatcgttggtcgtgaccccgcaggcatgagccatccagttgagaaaagagatctgtatgatgctgaccatggaaagaaagtattgagcatggcaccgggactagagcgtctaaacattcttcctttcagggtaattgagaatttgccttctcattaatacactgagtgaagttcacttaggccactttgatatatgtgttgatgatcattttcattcatttacaggttgctgcatatgacaagactcagggtaaaatggcattctttgacccttcaaggcctcaggacttcctgttcatatcaggcacaaaggtatatttatttgttctctgaataacaaaccttggtgtagtttggtttgagaaaatgttgtttatgttttcacttttaattactaaaacgtcaccttatttttgttttatttcctattttcaaaagtacaaaaaataaaaaacatttcatcaaccaaatggcaccttaggtatcaaggaagtctagttcaattagttgagtagaatgtatgagttgttacaaaagaacacaagtactttctagacgtcacaaaatggtgttcattgtgataatagtgactatgttcttacatatctgtagtatgttaacaaaggttacttgcatttacagatgcgcacactggcaaggaacaaagaaagtcctcctgatggatttatgtgccctggtggatggaaggtgctggttgattactatgatagcttagtactc

SEQ ID NO: 717 - DNA, 344 bp, Glycine max
agcttgtcctttggtttgttggtgttgttggttggtgggaaagaaagaaccttgagaagctccaagggtcttgctcttctgattgtgaaggacttcactatgaactggcctccaaatttgataccctttacctctgagcttggcttgaaggagaaatcagagttctgctttgtgctttggtcattggggtgttggtgcttttgcttcttgttcttgtttctcttctctttctctcccatggctagtgggtgaggagttgaggggttttgttttggtggacacaaaatggttggttatctatcttgattgatatcataacataacaagaccaatctacaatccca

SEQ ID NO: 718 - DNA, 758 bp, Glycine max
  misc_feature (746)..(750): n is a, c, g, or t
tggggccgcgccacagtttgtgggattgtgattggggcaatggctgttgcacaagtgtttttttcagtgtattttagtgcatggtcaaacaagtcatactttaggcctcttgtattcagtagcatagttctttttcttggaaatatcttgtatgcattggcatatgatgttagttcaatatggattctcttaattggtcgtcttttatgtgggtaagcagtcttccatttcttaactcctcctgtcattcattacttgatgaagataatttattgtattgtgccttaactttagagaagattaaatctctcactctcagtctcaccagtaggcttaccaccattttcagcaatccagaataagacacctcataaattgaatccatggaaaccaaatcctaattggaattaaaagaggatataaaatagattttaaaataggaatcttagtataccattgttttcatggttttcacagattatgttctatgttggagttgaaaagtttatacactgattaccatcatcatcatgctaagaatattatgtggtaccagtcacattaagacctttttatgactgacaaacacttgatattgttgcagatttggttctgccagagctgttaaccggcgttatatcagtgattgtgtgccattaaaaattcgcatgcaagcatcagcaggttttgttagtgctagtgctcttggaatggcttgtggtcctgcattagctggcatactgcannnnnaatttaaa

SEQ ID NO: 719 - DNA, 647 bp, Glycine max
atctgctagtcttgattgatgacatctacaaatatgttgacgatgttgtggtacgatattgttgccttctttaatctctcgccttgtcctctgagattgtattattatataatttttcaacacaggaaggacgagtggcaccagacaacaaaatcgggagatttatatcagaagctgtaggttcccttcccaaattgtccccatcagtttttgataagcttgtgaatgacagtttgcaggtaagattatgctttgtgttagtggtttattactgggatttcttattttgatgaaaattgtgaaatgagatggaacagattttttgtttcttatatttattggcttgtcaggcaagtcttctcagcttgccgtccatagttttattgtgctgacacgggtgtttcatccatttcaggatcacttgcttttgctgtatttatctagtatcacaagaacgcagcttagcttggctgaaaaattgaacacagctgctcagattctgtgattcttccgcttgtttatcgccgaagtcaaatttttctgagtttcttttcttgtcttatttccagaaacgtggaatgtcagcgttttatacttcacttttacttcgcttatttttttatttatgttttgtgctggtctttgct

SEQ ID NO: 720 - DNA, 378 bp, Glycine max
ccttcatcgcctaataagacaccttaatttgaataattcatacagaatggtactggatgataactaagaaccatacttctatgcttccaatgaatccaatgaccattttcatcagtgtttcaaattaagcagtaaagcatccaaccatgaagtgtcagtgtctagttgctgaatatttattatcagatcccacaatctttaaatcgacttttctagcaattgccttagacatgctaaattttatttcttctctttttgggatacaaattgatggctagtggggaagggaaacctgactcggtgcttattgctttgttgcatattcagcttgtccactaataaacaagttcttgggggacgaggccattagagtagtta

SEQ ID NO: 721 - DNA, 372 bp, Glycine max
gtatgatattctactgttgcaagttgcgagatatgtgcttgtggtcctgcactgcactatgtcatctgagtcgaagcttttttgtatgctgaatatcagttcaagtgtaatttccaattttcataagctcaatgctttggttactgattaatatcggcagtttttgtaccagccaaaattttacatttcataattttggttgctgtggatttatggtgctctttccctgcaagttgtgaattcaagggttatgtcctgctgtctttctattggttctttcgcaaatgaaatatatatgtatattttcaagatatcattggcatgaaactgtgacttaatcagttgtgtgagtataatgtatgaactggttcg

SEQ ID NO: 722 - DNA, 489 bp, Glycine max
gaactttaaagccagtggccatcgaattaagtttgccacattctgctggggatctgtcagctgccgtcagtcaagtcgtcttacctgctaaggaaggtgttgagagcacaatttggctactagccaaagcttatgtcatcgtaaatgactcttgctaccatcaactcatgagccattggtataaattttcattttcattttcattttcattgctatatatcaacatatatagataaattcaatctctaatccctctctctcaagtgtatattaattacttttgatttcttcataggttaaatactcatgcggcgatggagccattcgtcatagcaacacaccgacatcttagcgtgcttcacccaatttacaagcttctgactcctcactatcgtaacaacatgaacatcaacgcacttgccaggcaatctctaattaatgctaatggcataatagagacaacctttttgccctcaaagtattctgtgg

SEQ ID NO: 723 - DNA, 363 bp, Glycine max
  misc_feature (341)..(345): n is a, c, g, or t
acgaaacataggtaattatcctcctacaattgacataatttaagtctataaaacatcacaccatcccagcaatataaatttgttatatacaatgtcccttagtcaacttgacaaggcaaaggcgaagttccgtggtgcactttccacaatagcaaactattaggtaccttgagatcatggataacaggcaaatcagaaaatggaaatgccggagaagagactaacatttcaagggcctgtcataagttggaggaagggaaggacagtgctcgttcatattggcataaggatccaaggtgttatagccaggcaattccatcctatattcaccaagaatctgnnnnnatattcaccaagaatctg

SEQ ID NO: 724 - DNA, 578 bp, Glycine max
gaggtaaccttcttctccccagtcttttccccacgagttcttcacaatccaatagtcttcgccacccaccgaaccataacccacgattaaacaaacaagagtcgcttttgttgaattctttgagcagttctcaccaccatagactccctgtgatcattagaacacaagaatttataaaattagcatagacaaccttctaaacattaattgtacgtacccaaaattttcaaatttgagtaatctttcaagatagtatatatataatcaaattcaattaaccacttgtcaataaataaagatacttacacccgcataaaattgaaggccagttgcatctatgctcacgctaacaggttgtttgctaacacggcacaagagagcttcttctggtccaaccacaactagaagattatcaatactaacaaccttgtttgcattcgccttcaagaaaaagaaaaccttaaattaagaagacaaaaaaaaaattgttttcaaaacgcaaaaactaagctaggagaaaagagttttaacactgaccttgcaagtaccgttttgggctgtgtaaggataatgagctt

SEQ ID NO: 725 - DNA, 385 bp, Glycine max
actgctgtcattcaagcggctaccttaaatcatttactctcatcatcttccaaagaaaaagcttgatttgacttgagctggaaaatgatccttcatccattctcaggattcaccctcaccccttaaagaagaagaccccttttgtaaggctagattgtttgtgtacagtggttgctttatcagagggcatgaatttttagggatcgttccttccgactcacgtattttgcgtgaaaaatcattatcttttctgatgccacttgtataattcatgaacttccaatatttctcgatattgtatatgaagatggtatagcaagatgctgaatgctagcattgcatggaaacaaattgcagggtgcagtgcagaacaatttattcaaaa

SEQ ID NO: 726 - DNA, 642 bp, Glycine max
gtccttccagagatgcagccttatctatgtatttctgagagaaaatttctattatacatcaagtacatcaagtaaaaggaaataagggaagtgaaggctctaatttgttgagcatgtttacctgggcaatttcaaaagctttttgcttttcttttgggtccacacactgaccaatccaaacaaacacttctgtgtgcgtgtcaaggatcaggatatcttctgttaacaaatcatcttgggaaaagttgtaaacctcctctacctgaagagtacaatataagaatagatttagaagacaaacactgctgacaagtttcctagcagtagtgtgaaagtccacataatgaagttgcagtcacaaactcacctgtaactttcctggtacatccatgttgcaaaggaagatacaaaattaataattggtcagaacattcaaatatcagtaaacaaatatgctatcttataacaaaattttatacagagaagtactacacaagaaattttacctctattaaaagataaagtgaacaaatgtgggtctctgacaatgtcattagtgacatttttgctggtgtaactttgttttcctccaagtgcaaaccagaaagttgaggtttctgttccttctttagcaagctttaa

SEQ ID NO: 727 - DNA, 515 bp, Glycine max
attgaattccataattaggtgttaagtgtgaggcaagacagagccttgtttataaggaaaatggactaattgcgcgaacctctgtgccaacactttgagcaggtagcttcaccctctctttcctcacagcttcaggaagttgagcagctgtctcaccagctattgcggtcaagactttatcaacttcttcttctatctcatcttctatgtcctcagaatctagcgctgagtcgacggcatcgtttactatctcctcgataactcctgcctgaacgagacaaacattccccataactaccaatgtaactatcttcactaaacacatgtatgtaactatcttcactaaacacagggaagggagaaaagattgaaaagtggtatttttcttcggcattaaaaggattgcaggcatacctttgtcatttctttgctgaactcttgcattgtcaccgccatttcaggagccttcatgagattattgacaagcttcataacctcagcactctttgatagat

SEQ ID NO: 728 - DNA, 433 bp, Glycine max
tttattcttcacagggtagttgggcccatgaccttgcacgaggccacattcattggcccaaacaaacaagttataagatatctttaccataattttatagggtagcagtagcagactccaatactacgtatatacattatattatgtatgtattatacatgtagcaaactaggtaacaacgtagtaagggaatttttagtttgttattttatgttccagttagtatttatttatttttctaggttagattatcaataggaataccattattgaattctttgtttatggccggggaaattctttatcggttcgggaatgtgcgactgtaatatttgtctaaaataaagaaatggattcgtatattaattttctgtattctgtctgcgatattgcatattattacaacattgtcaacgtgaggtgtgttcaaata

SEQ ID NO: 729 - DNA, 486 bp, Glycine max
cgggcggcgccgctacctcctccaccgctaccaccacgaccaacgccgacgactcgatcttctattacgacgaggcggggcagaacgagttccagcgcgacaagccctgggccaacgacccccactacttcaagcgcgtgaagatctccgcactcgcgctcctcaagatggtcgtccacgcgcgctccggcggcaccatcgaggtcatgggcctcatgcagggcaagaccgacgccgacgccatcatcgtcatggacgccttcgccctcccagtcgaaggcaccgagactcgcgtcaatgcccaggccgatgcctacgagtacatggtcgattattcccagaccaacaaacaggttcgttcgttcgcctaaaccctaaccctaaccctaatttcaattttggttgatttttttatatatattttaaatataggctgggcggttggagaatgttgtgggatggtatcactctcatcctggttacagt

SEQ ID NO: 730 - DNA, 515 bp, Glycine max
  misc_feature (24)..(25): n is a, c, g, or t
attgaggatttagaaatgctttcnnggatcaaaatttcccaccaggctccactgttttctacaaacaatcacccactggaacattgggggttagtataatcaccaattgcatctgaaattgaagactaggaagctgcactgcacatatattatatatagtttaattttctccgtggcagcatgttttatatattttcacacaagtttgattaattttgtacaaatgcagcttagtttctcgaaagatgagacaataccagaacatgagcatgcagtgatagacaacaagccactttcggaggcagtgctggagactatgatcggagagattcctgtttcccctgctttgaaagagagtttggctacaaggtttcatcagttcttcaaagagttagaggccaatcccaacattgaaaactgagagttgcagcagttgccaactatctttagaagaccttggaaacaagaagaagaacagcaaaaatttgaagagacatctaaataatgtaaccccc

SEQ ID NO: 731 - DNA, 574 bp, Glycine max
  misc_feature (468)..(475): n is a, c, g, or t
  misc_feature (487)..(487): n is a, c, g, or t
  misc_feature (494)..(495): n is a, c, g, or t
  misc_feature (499)..(502): n is a, c, g, or t
  misc_feature (514)..(516): n is a, c, g, or t
  misc_feature (524)..(528): n is a, c, g, or t
  misc_feature (540)..(545): n is a, c, g, or t
  misc_feature (549)..(551): n is a, c, g, or t
  misc_feature (554)..(555): n is a, c, g, or t
  misc_feature (564)..(565): n is a, c, g, or t
  misc_feature (567)..(568): n is a, c, g, or t
ggtctccgaagtgacccacaagacacgcctctcacatcgctcgtcaatcccgcatgtgccgtttgtcgacaacaacctaacgtgcctcttcccccccctcctctctctatatcactttctctcccactatttaacaccctccacactccccttccataacgcccaccactgttcttccggttaaaaaccttcgggtgggtggcacacttcttccctacaggcagcgtcagctaagaattaagccaaaataattaattaattcttggcaaaatcacatggccgccgccgcagatgggctcttccggccgatctacgagggctgcatctccgcctacgacaacgacgtcgagcgccgcccctaccacaagaactgcggctgaaggccatgtgattttgccaagaattaattaattattttggcttaattcttagctgacgctgcctgtagggaagaagtgtgccacccannnnnnnntttaaacagaanaacagtnnaggnnnntatggaaagggnnntgtggagnnnnnaaaatagtgggnnnnnnaatnnnatnnagagaaggnngnnggggaa

SEQ ID NO: 732 - DNA, 422 bp, Glycine max
ctcgtctttggacacgtggcgtatgtcgtaagccttgagcggtgggccccgcccgctagccgcggcttcggacgtgatcggcgtaatcggtgcgcctttcaagacgttttccacggcggcttgacatagctgccagctcccggaccataacaacccgacagacccgtaaatcgggttcaatatccgaccgcatgcctcgtacaacaacgaacgaaagatcgctgcaaagtgaaaacaaaatactgccacttagtatcatcttccatgtttacataagctcatatctgacagatgtgggacttaaaagaaagtgcaagaaaatggcacaaacctggacgaagatgttcggggcctgcgttaaccaggttcattagaccagcacggccgtagaacttggcaagaaacacagtagcattggcttg

SEQ ID NO: 733 - DNA, 1071 bp, Glycine max
  misc_feature (1024)..(1035): n is a, c, g, or t
ttgatccacggtgggcttctataattgagagctgctggcataggtgtgtattctcatctctctgaaacttttgtatcccaatctcccaaatagctttgaatatccaagcatgaattttatcacccaaatgaacatagaagtggcttgtgctccaatagttggccagcttaccgtaaaaatcttcgtattacttgctgtttcatcgaactggaatcatttggcttttttttcttaatattagttaatgcctaatgttacatttccgtgctgcagtgaataagaaactagccgttgcatagttgacttttggttgttgcgtttgctacctaggcttaaacatgtttctaattcttaccgtttagtaattattcattttatacttttagtttttttttttctgttttggtcctgataaaattttgttttacgattttagtagttgacattatttttttagtccttgtaaaagtgtaaacttttgatttaggtttatctttttttgaaaaatattcattttggtccctattatttaaaaaacaacagtccaatagatgattgccatgccatcagtaaataatgacaataaaactgtaaaaattttatagggaccaaaaccgacacaaaaaaaataaattatgggggcctttttggtttatatgtaaatccttgatcgcatctatttttctacctccttttagtagttttactcaatactcaatattgaatccatgtggagttaccaaacacttttgccgacttataaatttgtgtattcctatttcctaccagtgatccagcttgccggccaacgttccccgaactgcttgacaagcttaaagagctgcaaaaacagtatgtcattcagttccaggctgcccgatccactgccaaggaaagcacccaaaaggagtcctagacaaccttggagctattttttctgtcacctgtgcctgtggctgtggctgatgcttgatgatttttttgcatatattttaccaaagctgctggagtagatgagttagtnnnnnnnnnnnncagctggtcttggaaccatgtagagtagctgatcct

SEQ ID NO: 734 - DNA, 369 bp, Glycine max
ttcttgctcaaacaaaactgagagtactatatatctgcctttacttgagatctgatcatatccttcaataaagcagcaaagcagcaatgagatccaaaacaacccaattcacatgtaccttcaaggtagcccttctcagccttgcggttttctgcctcttcatcttggtattcaggtcatccatattctcattgtctcctcaactcacctcacaaaccaacatgtcaagctcagacacaatagtaccagtgtcaccacaagaaacagaaaatgcaggcacgccatcatcatcatcatgcccaaattcaccccccttgaaccccccatgcaccaaggcccctccatcattagccaatgccatcatccact

SEQ ID NO: 735 - DNA, 718 bp, Glycine max
atgtactcattgccaccatagtaccttacatgtacaatgaggttttgtgaaattttaattatatttgaaaatgaataaatcaacacatttttaaattctcattttccaagaacaaaaactggataccaaaacaaacatgttttctaaatcttgaagatatggaaatgaaaaacattttcttaaatcaaagagacatttttaccttttacccggcaatccttctgagtacttgtttgtgaggcacgacccaactgcttccatcactgctctagatgtaaaattctcagaagcaataagctcaagacttttaaattgtcggtccttttccttgtcaataattgcacgaacatcaggatcagcttcactcaagccatagtccaggaagctacttccatcgcctagtatttgcaatagcatgtgattccatagacaaaagaaaccattcttagtcataaattcaaataacagtatactgaaaccaagtcaaatactaaacatcaaaacagagaaatcaataactccaaagccactttgttattgccaaagagatttactcaaccaaaagtcaaatacgtcataaacagatgttaacattttcatacatatattacttgacattcacaccaaactgagtgccatttttaaaacactgccaaatatctacaataaacacagaaggagaaacaaagagcagagaaagtcgcagataaaaagaaaa

SEQ ID NO: 736 - DNA, 307 bp, Glycine max
  misc_feature (226)..(226): n is a, c, g, or t
  misc_feature (228)..(239): n is a, c, g, or t
  misc_feature (244)..(252): n is a, c, g, or t
  misc_feature (277)..(279): n is a, c, g, or t
  misc_feature (286)..(286): n is a, c, g, or t
  misc_feature (288)..(288): n is a, c, g, or t
tttcatattttgttcaaaattcaatattttagtattcaagtcatgaaaatttaccatccaatgcatataactagttgttatccaatctatatatctttatgctttcaggtggggtaatatagaatttccattgccttttggaagaattctgagccctacagaaagcttcattcattccttggatgataaggtatttttttttttacttttatctgaataatttctngnnnnnnnnnnnnaaaannnnnnnnntttttttttttttttttataatttnnngaaaacnantttttttcccctttttttt

SEQ ID NO: 737 - DNA, 380 bp, Glycine max
tttcgggtttcggaatcaatcaatgccgtgtttttagatactagtacctgctttagctacccttctcatagaattggtaataaaatagcaagtcccagattttttatttctttcttctcctctgtctattttattcccaatcctctagggtcttggccttttcttcattccccccctttttcttttataaaaaaaataaggcaataacttttgttgcttgtactttttgggtttagggttttgcaccccctttagctaaaacacacaagtggcaagcctatgttcaacttcaactccatgcctctccaattctgaacattctaaatttccgattatataaatccaaacataaaaacaatgtcttcttcgtgtctgagtgg

SEQ ID NO: 738 - DNA, 1065 bp, Glycine max
  misc_feature (731)..(732): n is a, c, g, or t
  misc_feature (971)..(971): n is a, c, g, or t
  misc_feature (979)..(979): n is a, c, g, or t
  misc_feature (1001)..(1008): n is a, c, g, or t
  misc_feature (1017)..(1017): n is a, c, g, or t
aagtcaaacatacatctttccttggacttaggatgagctcaatagaaatgaaaatggaacgagttagggcaagggggaagaaataaacagagttaatgtatcaaagcgtgtattatgtctaaatggccaccaattattacttctcccataaattttgttttcacataaagcacagccttaaatggaaatggcatgctggtcagttaattgaataccttcaaccaggatgctagatgtgccaaagaatgtgccaacatacctccccctcctggtgggaagaagctgaagtgtcttacactaccttttaaggcatcaaactgaaacagaatgcacaaattagaaactgaaattcaaaagtaaatgattcattctagaattgatgtagaaacagacaagtgcatttcatgaaactgcaatttttgtaattccagaattgcttcaccggtcaattctaattgttttgtacaaatttatcactatggcagcttcacaagataggagcattacagaatgtaaaaaatataacagatggaaagtaaagaaatcaatttaaagggactgatatccatgctataagcatccagagtatataacctttagcaggtcttcaaataaaagtttaacaaggtcaaaaagtaataacaacttgcagaagaattgaagaaatgtagcaatcttataaagaacatgtaatacaaaactccatgtaaagttaaatacagacaaaaacnncgcttgccttctgctttaactgcagttgtgtgtctgtgccgttgcttcgtgtttcttcgggaagggatgctagcaccaaatccaaaattgaatctttatctatacctccaagataagactgcaaagatgctatttctgtctcaattggcagtcctttagatagtgcatcttccaatgcaagtgctctctgcaggatccatgcagaaaaaagaaactagtaagcaggattggaaaaatcnatacaatnctaataaacccatattttgtcnnnnnnnncctctatgnccgaagacagataaaaacagcacaaagaaacaggagaaagaaaaaata

SEQ ID NO: 739 - DNA, 375 bp, Glycine max
gataataactggaatggcgaaatgactttgcccctgctagtagacaagtccaccgtctgtatgttaaacaaggatgaggaagtagacgagcccctcagtccgggcaaacacatgaaaactgcacaaagtgttttatcatttttgatagcgactattgcgcttctttggattctcaccgacctatgcagcctgttatcaattatcaagcttcagccagaacatggccccctgcccatttggttttctttgcttgaacctgttggtttcatggtgtttgtttgggctgttgctgcaaagattgttattggtgcaccattttctcgtttggtgagtgccattcttttattttggggtatttggctgcttgtcagatct

SEQ ID NO: 740 - DNA, 705 bp, Glycine max
  misc_feature (377)..(383): n is a, c, g, or t
  misc_feature (387)..(398): n is a, c, g, or t
  misc_feature (424)..(428): n is a, c, g, or t
  misc_feature (633)..(635): n is a, c, g, or t
  misc_feature (676)..(678): n is a, c, g, or t
  misc_feature (694)..(699): n is a, c, g, or t
cttgattcctttggccctggagaatgactccttcttaagcgacctataccaaacacacctgttatccccaacaacaccagaatcaaattatttcccatctccaactttccagatgaatgagtttgatgggatctacaacaggtcacattcgaaatccgatatcaatgagatcatttccaccaacacatcagcaaccaattctccaattcctgatttcaatttctcacttgatccggtggaaattgatccaaatttccctttcaataccccaggatttttgtgctgattgcactataaatggaatactataagaatgtagtcttcataaaacgggacaatttcagacagcagtagaattgtagaataaagaatgagcnnnnnnnagcnnnnnnnnnnnnctggggtattgaaagggaaatttggnnnnntttccaccggatcaagtgagaaattgaaatcaggaattggagaattggttgctgatgtgttggtggaaatgatctcattgatatcggatttcgaatgtgacctgttgtagatcccatcaaactcattcatctggaaagttggagatgggaaataatttgattctggtgttgttggggataacaggtgtgtttggtataggtcgcnnnagaaggagtcattctccagggccaaaggaatcaagctgtgnnngtcttgtttcatgcannnnnntgaagt

SEQ ID NO: 741 - DNA, 373 bp, Glycine max
gatctatatgattttaagaccttatcagtacttttcctcattggttttgtttccatagctccaacacttttgaagcggaagcgagtatatgaatgaaggtttcctggctcatcttgcacaatccattttgtcaaaaggcaagttacgggatctaattagatggtgatgacaatggatcaaagaagataatatttaagaaagatatccatgaaaagggatgtattgttattttgttattaacttaaacagtggcatatgctccattttattttctgtggtggagcctaagtctttttgtttccctttttgttttttgattgtgtggagagagtaagggtagacttagctgagtggtgaacaatcaattcagcta

SEQ ID NO: 742 - DNA, 1200 bp, Glycine max
  misc_feature (1101)..(1108): n is a, c, g, or t
  misc_feature (1140)..(1151): n is a, c, g, or t
  misc_feature (1193)..(1194): n is a, c, g, or t
caggtagtattttatatgctaattctgtaagtagataaaatgctccctaacgctaaaagatcgtttcttagtaacaatcaatcattctgtggggacaccaccaagccgttgcatagcaacaacaggctcactgcacctggaacacctaaatgatggagcagcagcacatcgtgtcctaagacagtagtaacaatatctgccacaaacaaattgtcaaccattgcttagtccttctcttttaatgagaagcagctgaatttgaagcatatataaacattccgtaggctatagtcccactgaattatgaaaagaagtttagagtggtaaaacaatgtgagatgagaatgcatatctagagagatgtacctgtgctgacaaggtagagcaacataaggaattgttggagtagcctggcaaatgggacatgctgtgccatcctcggctgaacccgatgatttatctttagagaaaggtcgaagaagatttttcacagatgatgaattaagtagggggagaagcaacaataacatttcctgtcatcagaatccgacctagttagctccaatggattgtaaagtcagaagtgaaacattcttgcaaattcacttgccatcaaatctagaggtcacaactaactgcaaggtagcatctagctgttgtaaaatgcccaaaacaaccaatagcagctctcgggatgtgacaaacatttttagaaattggaatagggccgcatttgagttaccaatttaatatgctattatccaatgagagcttactcatatgtttgataattacactaattgaaataagctagtaagagcttataatgaaagacttttctaagaaacttattgaaattaagcaaaatagagcttatgtgaaagtcgtaagctacttttactgtgacacaaccaacatacccttctctcccattcctatataaaagatgtataactgttcccctccatttttaatcatttcctgcctaagtgaatatagggccctaactattcttgggccttccagtgtaaacctgaagagatttagaggccccaagggttatggggtttggggtccaatcacattcagtcagctacgccnnnnnnnncattcatttgtcttaactagtaaataaatgannnnnnnnnnnnaataacccatcagcttccacaaagtaagtacaaataaattannaagagg

SEQ ID NO: 743 - DNA, 381 bp, Glycine max
  misc_feature (341)..(341): n is a, c, g, or t
  misc_feature (344)..(344): n is a, c, g, or t
tgctgaaccccctactgatttaagtcagaatgatattgttactgttgatgattcaacttctgctgtcccggatgatgcaccaaggagatcatatgcagccattgtgagtttgtccttatatatatatatatatattcttgccttgtgctactcttctgctcctttacattcattaaattaatgattttcatttacatgaaggtaatgaaaagtcatgtagcatctggtcatgtctatgttcccagccgagctgcaagaatagcatatgctaaatccagtgaacaattgcctactactgccaatgccaaatcaactcctgcgcctgaggcattagctcctantantgataatgcatctgggagcagtgatgttcatgaaaaa

SEQ ID NO: 744 - DNA, 705 bp, Glycine max
tacaattcattattagcttattcatttaatattttttcaaaaacttttactgcattgatccctgtttaattatattcatttattggttgtagattcaaggacatatttcaagaagtttatgaggcaagctggaaatcaaagtttgaggctgctggtatatggtgagtggatgagtaccttgtttcgagggaaaaaatgtttatattatactataccatttgtttacatttatctgatgaacttggaaggtatgagcatcggctcattgatgatatggtggcgtatgcacttaagagtgaaggaggttatgtatgggcttgcaaaaactatgatggagatgtccagagtgatttcttagctcaaggtttgtctgatgtgcttatttattaatcactttctttgtgcaacttcatttgcatggatttcttttcctgtgtaactaatacctattcaccctgtttccaggttttggatcactaggtttgatgacatctgtattggtagggtttattactactatttgtggtgaatgatttaatgaattgaaccagatttgttatttattcaataaatcaagttttaataaattccccctttgatgggtcaggtttgccctgatggaaagactattgaagcagaagcagctcacggcacagttacccgtcattttagggttcatcagaagggaggtgaaaccagcacaaa

SEQ ID NO: 745 - DNA, 550 bp, Glycine max
  misc_feature (479)..(480): n is a, c, g, or t
  misc_feature (527)..(528): n is a, c, g, or t
attcttacacgtagataccacatttttgttacctatataatattttccacaatataaccacaaatctaataaaaccaagacatgcataaagttggatctaaccggacagtactactacaacacaagtcatgtggtgcaataagaataacgttaaggccacatgctagtcatagagctcacagcattattactattgattccactattgaaatcgctgcaaggaatattatccaagtttccaagcccaccaagaggtgaattttgtccactaactgtaattccacctccatatgaagcatcatcattcccacggacggtgatggttggcgaaacatgtgtcatgcggtgtagattatttgtgttgagttgaggtgggaaaattgatgatgcttcatatggaggtggaattactgttagtggacaaatgtcacctcttggtgggcttggaaacttgaataatattccttgcagcgatttcnntagtggaatcaatagtaataatgctgtgagctctatgactagcatgnngtcttaacgttgttcttattgc

SEQ ID NO: 746 - DNA, 289 bp, Glycine max
gagcatttgtgtgtgcagaaacatatacatagtgttgttaacagaattattatacaacgttatacacaccttatgaacaatatagaaaccaatgaagtcaaatgtcacgtgttctccaaaaatcaaaattaccacaaatatcttactttaacgagaatacaaattgacaaaaaatgaaattacaggagagctttacagaggtttgaacatacatttatttttccatggatgtcgtaagtttcactatctggtttccctttttacgggtaagaaaccctaatgactagca

SEQ ID NO: 747 - DNA, 396 bp, Glycine max
actcattaaggtcacaaataaaataaaatctacaataaagtttaaaatttcaacttaaatagcaatccccgcggaaaggaccaggaacatagtcacttctctagcgattaccagtgttatgaagagaacgaaaggaaaaagatacaggctttctacaaaaatttcaatctataaagcgatgtggaaataggagttcctctatgaataatgagctaaaaatgcaatttcagttatctacgtcctccattttggtgtacttggcttttgcagctttcaccatagatttaatgctcatctacttcggcagtatctgaaaaacgaaacatcccctaatgactccattgattgatcataaatggctatagcccaagtttagataggagctgacgccataaa

SEQ ID NO: 748 - DNA, 343 bp, Glycine max
  misc_feature (303)..(303): n is a, c, g, or t
  misc_feature (320)..(322): n is a, c, g, or t
  misc_feature (332)..(339): n is a, c, g, or t
tcatcaccgacttcggcgaaatggatccgccgccggtaccgatccggtggcgcgcaaccgccatcccattctttgtgttggttctctttctatccaccatctccccttcgcgcgcaatctactgcgacgaagatgattgctacgatctacttgggtcagccaacattccctttcttccccccaattctctttcgtttctgcattattcgttttcgtaacccttcctcctcttcttatttgcagggttactcaaagtgccaatgcttccgaaatcaaaaaagcttactacaaactctccttgangtagtaagtgtttctcnnntacagcttcnnnnnnnncgct

SEQ ID NO: 749 - DNA, 373 bp, Glycine max
gagggggcagtctctaaggatgaaaacatcaaaattagctttggtggtttaaagaagcttgttttagaggctgtgacatttggttcttttctctgggatgttgagagctatgtggactcaaggtaccattttgtgttgaactgagtaaatctttatatgtgtatcctttttagatcccaccaggtgggagggaacctcgtgcattcagttgtccttttgagttctgtttgctctcatacatcacaaggcatagtttatagtgtgttggtactgactgatggagtaaatttgaatgtaacttcggtgttaaaagtccaaatattgtttcactaattaatatgtatatactgtagtggtagtggctctggatttc

SEQ ID NO: 750 - DNA, 200 bp, Glycine max
tgagttctgaagcattttttgagttcaagacacagaggaaatggacttaccgtgttttgatacagaagtatctcaagaaacattatcgaaggaaccatatattttggaactactaatacatagttccattcaaattctaggcaagtagttaattggaatactcttttactgaattgctagcaaaacagtgctgcattcac

SEQ ID NO: 751 - DNA, 950 bp, Glycine max
  misc_feature (907)..(915): n is a, c, g, or t
ccctgtaaggcagacaatgctgaacctctaatgatagggatttcatccccagggaacttgtagaagctcagaagctctgccaaacacatgattaacataaataaactttcaatttttaacaaacacaaggactatagaaacttatgtgggtgtattcattttctgagcagggacgagagggaaggtgaagccttagagaaacaccctaccacggagctccatttctacaagctctaacaactctggatcatcaactgcatcaactttatttagaaaacacaccagagatggcacaccaacctgcataatacatttgaaaagataatgtgtgcattaatctagaagccaggaggacactgtagacctaatgtatgcttagattatttacaaaccactttagtaaaatacctacttggcgagcaagaagaatgtgctccttggtttgaggcataggtccatcaggtgcggatacaacaagtatacctccatccatctgggcagctcctgtaatcatattctgcaaaacagacaattattaaacatagggcgaatatgaattatttttgtgattcgcactaaagaaaatgattagacaaaccaccaggtaggaatgctaaagccactaatgttcctaggaaagcagtaatctaacagatgcagctaaggcattgcaatattttgcgtgatctattctttataaaatgatttggatagaaactaatctaattccaaatccctaccttaaattttccatctcattttgaatagaagatcaagctacccaaatatgttaaatttcacaattaacaagtattatacattgttaaattgcttaaattccattccagcaattaacaatcctccatttaataattcaatcttctctctcaagctatccatccagtgnnnnnnnnngtgttaggtaattaataactctagtcaataacatc

SEQ ID NO: 752 - DNA, 290 bp, Glycine max
gctgttagtgaaaatgaaaaggatattcctgtggttggtgggagtgggatttttaagtttgctaagggatatgctcatgccaagacctacttctttgatcccaagactggggatgctaccactgagtacaacgtttatgtcctccataacgagtaaactattgatttgatctctgaaatatcatattttctcttaaagatagtctttacaataatgaaattgtatcaatggtctctgaaatattcaatacccatcatttagtcgttacggttatatattttaataatcgt

SEQ ID NO: 753 - DNA, 328 bp, Glycine max
tcgtttctaccaatagcccaacacaaccaactcttttttatttatttccaccaattcttttcttttttttgtttttcattctgcttcatcggataagcataagacaccatcttattcatatgatgaggggaagaaggagacatcaagatgagcaatctcgcgctttgtacgacctctcctctctcgttctcaacctccttcgctcgcctctgacgttctccgacgaggttccgccagcgtcacggcgtccgggccaggctcagatatccccggcgggattcgcgtcgttgctgctgggaatatccctggcgttgatgctgtgtggatc

SEQ ID NO: 754 - DNA, 600 bp, Glycine max
ctccagctttgacaccatcctctcatcaatcttgcttagcccagcagaaccacttcccacaaacaccaacaaaaatgtccctataatctccgctaacacctgccatatccattcaaattctcaataaacatcatcgtcatcacacttttctaatgattaatcaaattaaataacaaaacaacccactagctagagtcttgataggtcctaggttataacctcactgcgaccggtgtgtagaataaaaaacaaatcaaattaaatttacaacaacccatgtataagtttgtgtgtttcaaggcacaaacttttgtcagagaatgaaaaaacatggtataatttaagtgttgtgggttggttacctttctgggaaagccgggagggtaactttgtgcaattcttgcaagagagccaggggaagatgatgatgatatctcagggatgcttggacttggtgtctcaattgtgctagggatgaaggcaaacgtgctttggctgctggtcccctccattgttgtaagattatggaagtgctatatagcttatagttcaggaaatgtgatctctccctctctctctctctctctctctctctctgtg

SEQ ID NO: 755 - DNA, 397 bp, Glycine max
ataagtttgatccatcagtggcttctagcttgtacaaaaattgggtgataccctttaccaaggaggttcaggttgagtacctattgcggcgtctagactgaaggcattataatgcagttagaaatttacaagaatggaagtgaatatgatgttgttgttcaaatgattaagctcttaagtgatcctttattgccaacttcatggagctgttgattaaaaaatattaaattgtagctttagattgttacttttattttcatcggctttattagaagaaaaaaaaaggattagatcatgaacttcaatatgtgtcgtgagaaaacacattttcgaactagaatctcagcccttttcctggcctagtttatcaagggattagattcctttcccatgatgg

SEQ ID NO: 756 - DNA, 706 bp, Glycine max
tttcaagcactgcacaaaccatgttacagacatgcttaaagaataataataactttcgaagctttagaaactaaactacaagtctcaatagtcataattgaaaagaagttcataccacggattccatcaggggatgcaactaatcctctaaacaagcaattgccatcctcatttctgctagcatagcctgcaataggagtgcggcaagacccttccaacttttcaaggaaggctctttcacaggaaactgctagtcttgtttcttcatgattcagtgaagcaaggtattccgcctgcataaatcagccaaccacataaagagaaactaaactaataattatgcaattgtatcaagctcggaattgttttctccttgaaatatttaagatagaatagttcctcagtcctcactataaagtctcttatattgataaagtctcttatactatggattacaaaatgtaatccatcattaactaattatcatctaaggaaacatctctgtaacaggcccaaggggcaagatgatgcaaataatgcattatagttaattaaatactcaccattttatcatcattacttctacaggctattccaattgcaccttgggcaacagctggaagcatgtcatcaattgataggatcgaagtcacattttccgtcatatttaaacgtttgagtccagctaatgccaatagggtagctt

SEQ ID NO: 757 - DNA, 345 bp, Glycine max
actgtttgaattaaacacttaattacttgcctgaaggatgaagaaagaagcccatgaaagggtggcaagtattagaagaatagagcccttaaaccaatccttttcaccagaatcagtggtgttttcaggtacatagtttctggggtgatgcatgtacttagaccccaagaaactgattacttgccctttatacaatgtcatcaacatggccccagcaactgttacaatagttccaatcacctttgcttggcatcttacttttctcatgtccaacttctccatcctaatccagcccaagcatagagtaaaaccatgttatctcaaagcaataaaaaaaaaaaaaaa

SEQ ID NO: 758 - DNA, 874 bp, Glycine max
tttaatccaataatattcaatccataccactatgcaactaagctcaaaaccttgaggttgctctctcggtttcactcttacaacaataatgccactgtcactgcttccaaaagaaaggatgacttgcaatctccattggtgacttaactctctttctatatataatatctcctcaattcccgttttttttttattattcctctaataacagaatctttactaacttttcttatattcatgattctttactaacgtttcatattttcatttctgcgcctgtatgtggtcgcaaattcctgttaaatatccaactgaagtttaataaactaaatactaataaagggccttaatgtgtataacatatatagtaaatcttgtaataatgacagtgtcttaggaccaagatttattccttaaccatatgatatgtctaatgctatttacttgatatgatcaaatatagattgggaagaacacgagcagggctcctcgccgtctgatcacaatatcaccaggtgatggcaaatatcatggggattggacttgtgactatcgcgtctctttgcacgacctagagttacaggatttgattgaagatgataataactcacgtaaggatgctcaagttttcatcaatctctctatccaaaaggtgcttacatatactttattttcgtgtgtgaatgaaaattttggattaaaattgtgattggaattgactaatgtaccaaaatatgcgttcatgcatttttaatgttaatgagaggattttgaatttattttgtatctttattgatgactagaattaatactcccagatttctaagtcaattgtttaatttagtccgttgaacatggtaatgccagcatgcta

SEQ ID NO: 759 - DNA, 373 bp, Glycine max
  misc_feature (174)..(174): n is a, c, g, or t
cccttgcctttgggaagagacacccaaggctttgtccctttgccaataatgaagacattacccatacgagttgcaaattcatgaccagttgcatcctggacatggatggtctcaaaacttcccttgtgtttttctctgttcttgatgacaccgacccggcctctgttccttccncccgtgaccataacaacattccccacatcaaatttaatgaaatcagtgatcttgttgctttcaaggtccagcttgatggtgtcattggccttgattagtgggtcaggatagcggatggtgcgcccatcatatgtgtttaaataggggatacccttttgcccaaattgaacagatcgaaccttgcagagcttaaactaaa

SEQ ID NO: 760 - DNA, 471 bp, Glycine max
gaagagcctcccatagaaggatccaggggttgcattaacaaagcatggaccaaacttgtgtcccttatcttctaccaatattgtatagaaatttggaagtgacttgaagatggtattgaatccgtttccaaataaatcattgagataaaattggaattttggtggttcacgattcaagctagtgcaagcggtattgacaatgtcaataatatttgatatcaccagaagtgcatttggtcctacagagcaacctaagtttgccactttcatgcagtttggagaaaaatcacgatatagtctcattatagtttcttcaagtatgggtttggctttaagcattagttttttctgcaataaattaaaatagaagttagatccatgtagaagaaaaggagacaaattaatataatgataaaacaagatagtacttgtagcaagcagttgtttgtataactcctttctcccttgcca

SEQ ID NO: 761 - DNA, 1160 bp, Glycine max
  misc_feature (11)..(11): n is a, c, g, or t
  misc_feature (1107)..(1112): n is a, c, g, or t
  misc_feature (1147)..(1148): n is a, c, g, or t
actctttttcntctatccctttgtcaacatacttgactcaacatggctattttatcctttctagtgatcttaacagtaatttaagcagcatacatattctataaaaggctacccttaatacaaattctgacattacatgggctgcattctattcatgtttaaaatctataaaagatggaagaaaaattattgggtcatatgttggatttgatagcctatatcttgtctgctttatatttatttacttaagttattaacagtggtatagttacatgtgaattaaacaagctgttgttttatgtggatgtgggcatattttgtggttgtgacagtgtaatgtatattacaggaataggtgcctattttggagcacaatgtgagaagcatgggatgttagttcgtgttgcgggagataacatcatgatgtctccaccatatattatatctcctggagaagttgaagaggtaacttcacaaataaccttcacaaagatatcttcatccattttcatttagtttgacctctggacaagaaaaaaatcacataaaaaacctgaccttgctggagtaatgaatatgattgtggagaatcacactaatcaataacccctgggcttttttagagacctcattgctagggacggaagtagcaaattattgatggggatggtaatggtaatacatacaattggccacaccccaaaacatacaattagtgcaattacccaaattacttgactaattatacaattagtatattgaggttttttggaatgttgctgtgtgacttcaagccaagtccaacactcccaatgtatgctcgttatgtgtcttctctctgtgtatatctgacatacaaacaatactataatgcagctattactttgaattaaaattttgttacaagttttatatatgaatttcaatttttacccccagttaatcagcatttatgggaaagctttgaaagaaacggaaaagaaggtacaggagctcaagtctcagcgcaagtagcttaggcctcatgatggaataataaactctgctgcgcccacttccgggggaaaaggaaatattgtagtaacttgataagactttgttccaacnnnnnngttattgtaaatgtcaataaattggtttcctagtnnctcctaatgata

SEQ ID NO: 762 - DNA, 568 bp, Glycine max
ctggagttttaactattgcttttctgctaagcaaccaaatttacaaacccccagaattcttctccccttacatcttcaagggtgccaattatgaatactatggaggtgagattttgtgtctcattacgaactaacaataccaaactctttgtccattgttctatcttatagtgctctttctcctccctaactctcactcttatgtcatttaggagaaccaaaaggatcaaagtcatcatcacatgtaggggttatagttggtgctgtagttgctgttgtggtctttgttgttctagcattctttgcagggatgtatgcccttcgccagaaaagaagagcaagaagatctgcagagttgaacccttttggtaagaagtgattgttgcaacctttggatgaattttgttccttgcaaggaatttttctagtagtcttttattgattcaatgtcatcataaatgcagcaaattgggaacagaatacgaatagtggcactgctcctcagttgaaaggagcacgatggttttcttttgatgatctaaggaaatacaccagcaacttctcagaa

SEQ ID NO: 763 - DNA, 965 bp, Glycine max
  misc_feature (902)..(903): n is a, c, g, or t
  misc_feature (905)..(907): n is a, c, g, or t
tattgcatccagactgtatttttactattcgtatagctatgaacttatgggagatcttgctgaaattcgggggtgagttaggtgctaatctttgtaatgttaaaaaaaaggaggttcaagactgaattatatttaagtaattttaaattttgcattttttgttttcagcaaccttcttgcattgcaccgaattgccaccctccgccatgatgagctgggtcaggtttgtttcaaacttccttgagctattttacttaagggcttatgatcattgttagaattgagctcatgttaaaaccaaggacatatttgatagcttttatggattatcaattaattcacatgactggtttgtaagtaattatagctttgatttatcttaaaatttcaattgtattccttattaaatcacgcacttacaataaatattccttgaatatagaatgatccgtcaaacaattcatgcaaattatttaatttttaactgatctgttgactgttgattcaatgcaggaaacacttcttaatttgttacttcgtaactaccttcactacaacctatatgatcaggctgagaagttgaggtcgaaggctcctcgatttgaagcacattcaaaccagcaggtatagtagttcttttatcctgagcacctaagctttgatttttttattttgggtaaacaatctctaccttttattccagtgctcagagatgttgtgttaaatcccttgtgaatgtcctcaactattgtattattggtgtttatgtagtctaatttattgttgctctgagactcttttttgattcattttcccttcactttttatcctcatttgttgtatttcttttcagttttgtcgttatctcttctacctagggaaaattcggacaattcagctgnnannnaccgatgcaaaagagtctctcctgcaggccgcccggaaagctcctgtgctcacgggtt

SEQ ID NO: 764 - DNA, 358 bp, Glycine max
ataatggtgcatcattatatgattatattgatgatgataaacattgtgtcttgcactctaatcttaacaaagctttatcctgttcttggagttggatccaaccaatcccgttatgcgttatcgtgtcccgtgttggcccccccacttgccagttgccaccaaagatatattccctgcaaaacaaacactagaaacaattattaatagcataaaaacaacaaataattaaatcaaactaaaaagaattaatacgtgttgtaaacgtatctcaccaagtaaacaaatacacacgaaaatatatcagtgaaaaatacggaatatatcagtgaaaaatacggagaaatacacacgattacga

SEQ ID NO: 765 - DNA, 381 bp, Glycine max
caatgcaagaagcgatgggtggttggagattgagatgggggagttcttcaatacaggcttagatgatgaagtgcagatgagtgtcgtggagactaagggtggtaattggaagagtggcctctttattgaaggaatagaagttaagcctaaggaagagaattaagcaaatatcttgtttagtttaattcacagaactatatgcataaagtcttgcgtcttagatggcaagaatgctgcttattttaaccttcaacctttgaactttgtgatgtatttttcttgccataactgttgcccttttctcttgaactactatatgcgtaagttatattgcttgtcgtaattcttttgactgatgagtgatgagcgaggtaactaacg

SEQ ID NO: 766 - DNA, 629 bp, Glycine max
ttttactttattatcatatccctataacttagcctgaaattattaattgtcattcaaaaagaaaaacagtacgtgagatagatatcacataatcatacacgatgcacatgcgctgttaattctttggtgtttagattatggaactgtacccgcgggttcccctcctttttaccttgtattgtatatgtacaaattgtactagtagtagattaaggtcttgtttggataaacttctccataaacattaatatcatttgagggcttccacataaaaatacaaaaaaagtctattgttctgctaaaagtagatagaatttattctatttaactatggctgatatgtgatattcgtaccctggagtatccccagagatcatgcatatcaaaagaaatgaaatatcttttataattggatggatcatatgaacatataacatatatatcaactgatttaattaacttgggaatcttgtttctgaattttatgacaattaacaggaccaacatctatatcaatcctcgagtggcacctccgcttgttggtggctatggctatggttatggtggctggggatggtctccattttcattctttgcaccaggtcccagtgtagctgtaggcgttggag

SEQ ID NO: 767 - DNA, 442 bp, Glycine max
tccacctcgttcgctgaacaagatttcttgaacatgtacttcaaggacatttacaagccaatccctttaaattacaatcttgtcctcgccatgctgtggcgccacccggaaaacgttaaattagaccaagtcaaggttgttcactattgcgcagcggtatgggactaattgcccgaacttgttcattagtttgtttttgttcgcgtgaattattcatgaaatggtttttgttgttaaatgtttgtaggggtccaagccatggagatatacggggaaggaagagaatatgcagagggaggacataaagatgctggtgaagaaatggtgggatatctacaatgatgcttcgcttgactacaagccattgatgaatgcaagtgaagctccagcagcggatggtgttgacattgaacaattcgtgcaggctctatcagaggttggt

SEQ ID NO: 768 - DNA, 903 bp, Glycine max
  misc_feature (39)..(44): n is a, c, g, or t
  misc_feature (897)..(898): n is a, c, g, or t
gagtaacagaaattcaactaagagaattatcttaaaaannnnnnaaaaactaatctccgattagttgattcacaatacatgtctattaaacttagcatattaaacattaatttcatcaagcttaattttattaactttagaaaaatgtatatatatataaaaactattaggaatacatttttttccatgtataaactacttgcaattaaaacatttgactcctgaattgttcttcaactattcctacagtcaataactatttggaccacccagctatatgactaattttcaatcttaggtatagtcacaatttaatcttctcttatgcaaaaattgaacttaagttttgtataaagtccatatatattatcaactgagttacttattaaatagtactacattcttaagacgttttttaatatactttattaatttgaaaataacaccctctaaataaggaacaagactcacgtgtttaataaaactctcatgaatttcatgcaatattaagaaagaaggcatctaaaaatggtttgagagagtgaattgctaatatatatctcaaagttgagatagatgtgtaaaaattaccaggccagcaaagggaaagtccttccagggatgctgggatgccacctggcaatcggagagtgcagcaaaggcgtctggcaacacgtggaccaatgaggttgcaagaattacgccggcagcaaagcatttgattaacaagatggctatgttgtagagggactttccctgaaagtatcgtgccagtgtgacaggcgcacatacgcctgtcacgctggtcacaaaaatcataaagatggaaatcacttttaagtgtgccgccgtcgtgccgtttcggcatgcggcagcttgagccaagtccgtcatgcnntccgt

SEQ ID NO: 769 - DNA, 770 bp, Glycine max
agcaatgtgtccaggcgaaaaagacggtccagcttgtttgatattgttgcagatgaagtttgtacccttatttgcaaattacatcaaaatgcatacaatgaaattgttgctgcttaatctgttcctgactttgtgaccgttgattagattatctaaaatttgtttctttgaagatattgtgtgacttgttctggcttctgtgatgaatgagttagttaatcttagttaatttcatacacaatatcttagttaatctcatacatgatatattggtggtccacaatctgtaatttatgataattgcccatttcctttcttctgcagcggatttgacaattttttatcttgactggcttcctgtgcattagtaactttgtttagattatatatgaaatcatggctctagggtagtttggagatattgcattttcacatgtgatactttttcgaattccattattataaatatgtaacttgccctttgtccttagaaccttctcatttttctagatttcttgtatttttgttgtgacttgcaggcagctgacactgcaatggtacagcaagacttcttgtctgctaatgagttaccaactgaaacagaaggcaataaccccttgcctgctcctcctcccctcgatgaagagtgtgaatcaatggattccacaaactcaaatgatggagagcctgccccatcaaagccagaaaacacacatccatcttatcctatgttatatcctgcgtattattctccagtgttcccgtttcct

SEQ ID NO: 770 - DNA, 334 bp, Glycine max
gacttctttcgtggaagaaagcttgatcaaaagctgctcaacaacttggaaatcaagctgaactccatacaggctctggctaatgatgcagaactaaagcagttcagagatccacttgtcagaaactggcttcttaaggtcaaagatgctgtgtttgacgcagaggatatcttggatgaaatacaacatgagatctccaaatgccaggtcgaagctgaagctgaagctgagtctcaaacctgcacttgcaaggtaccaaatttcttcaaatcttctcctgctagttcctttaacagggaaattaaatccaggatggaacaaatccttgatccta

SEQ ID NO: 771 - DNA, 353 bp, Glycine max
  misc_feature (13)..(14): n is a, c, g, or t
aggctttgattgnngaggagccactgaagccatggctgactctaaagaaaaacgtgaagaacataaagtacctatctacaatggttgatataagcttcaaggataggtatgtgtatgttgatgttggagctagaagctatggttccagcattggaagttggtttaggaaacagtacccgaaacagaacaagacctttcatgtgtatgcaattgaggctgataaaacgtttcatcaggagtatgaaacgaaaaagggtgttactttgttgccttatgctgcatgggtgaggaatgagagtttggtgtttgagattaaccgcgacccgggggagaaggagaaggagaaggagaag

SEQ ID NO: 772 - DNA, 611 bp, Glycine max
tctctgtaattctttattccctgtcagaggtccatctgttcctctggcacagtatgttcgctatgttgaccagtattgggacaaccttaatgctcttggacgtgctgatggaagtagactccgcctgctgacttatgacattgttctggtatgttattcagctgcaatatgttctgtctttcctgtttcttgagtggtgaatttgactcgacaagattataataaaaaaaaactgatgaaggaatcttgtttgtgccatttacaactgatgtaaatggttcatttagataacttgcgtccctggtttcaaataatttctctagaaaaggatataactagagttatctttatagtgcttgaatcaagtgattttgtctcactctggtgttcatgcatccccccccaccccatctttgtagatgttagctcggtttgcaacaggagcatcattcagtgcagattgccgaggtggtggacgagaaagtaattcccggttcctcccatttatgatccaaatggcatgccatctccttgatcaaggaaacccctcccagtgtcgaaccatggccagggccgtatcagcatacatatcctcttcctcatcagatctc

SEQ ID NO: 773 - DNA, 360 bp, Glycine max
cctcttccgttaaaccgaacggagaatggttttgctaacggtcttttaactttggctgagcatcttcgccatgcttctagaacccagagttctccgattctctcgctgcgaatcgttggtcccacatcgctcgcagccgcgccttcttccgacacgacttcctcaacctcgttgaagctcaagcgtcttgcacctggtcttgtggaattgtcatcacccatgaagagcaaagagattgaaccattctctagtgttgatcttgagggtgaagcccccacggttcttactccgacccagtttgcgacattgtggcctcttgcttcgcttaatgggtcgaatgcaaacttgttggggtttgag

SEQ ID NO: 774 - DNA, 702 bp, Glycine max
  misc_feature (63)..(65): n is a, c, g, or t
tgtagtcttgtctgttactgttcccacacactaagcctccctgatcaggttacaagccccttnnngactatttcagagtgcacaattatgttgatactatcaatgtttatttgtgcatgtaaataaatttacatccataacaggtcaagcttgcagagtcactggagcaagtaggtgtagatattattcaaactgagggaggaaaatgttctaatcctacacaatctggtgttatgggtttgattgagaaggtaactagaaaaatatgtttgattcacttatgaattttttcctattgcctacatcttcattgctggagatttgaaaatgtaaatctcagctgaagaatgttagtgccaaaaaaatggctaaaacagcatcaatgacattacacaacgtaaatcaacatattagagatgtgctgcattcgctcttgtatgtgacaactccaaatcttgatatgctattggccgtttctgtacgatgtgcttgactgtatttacaactttggcattctaaatagcttgttaatgcttttgtccccccaaacttcataccgaaactacattttcagcccttaaagcaattaataattaatgtttctttacattcatacggattgttgcattggtaaatgatagttgattatgacgaatccttcgttaaattaccaaatttctaattactggtgattgtaggcaa

SEQ ID NO: 775 - DNA, 383 bp, Glycine max
ttggacatctctgaatctaacaaaggtcgaaataattctaagtagactacagttgctaacttattcgtcaataaatgctctatatatcttttctctacagaaacagctaaacgaaacaaccatcaaaacccagcgagtagggaggtaaactctttcttgtcttgaaattatatatacatattgcacaacagttgttgaaacacccagttgggacttggtaggttcttcgttttttgtcacacttgttcgtttcccttgagaatattgtacttgcagagaggacaagttgcattcatcttcagccatttcacaatgcacgacgaatggaaatgatggttgcagggaagagcatgcagctctgctccatcctcgtatgaacagag

SEQ ID NO: 776 - DNA, 765 bp, Glycine max
gatatagtcttgtagaagtgagacaggtaatcctcctaatgttattacctattgggtgtaaagcacgaataacacaaattttcattttaccttcatcccatcagcatgccaagaccgacagttcataattatcacttggagcactaaattgacagaccaatcaccattcattctttgggcatccatgcgactattaaaaaaatctaacacctgcaaaataccaaatagaccacattgcttgaacacactcgaaacataatgttttctataaagacaaggttcacaagtgtatcatagacaccatgaaatgtgctatttaaagttgcaagattttaaagggcaaatgtatattgtaatatgattagaatgaaatacatgaaacatacagtgtagatgttttcaacaagctcatcgaaacgggggtgattcttgaaaggctgaaagacttcctgcttgtgcattattgcatacaccacctgtctcagtcacaagcaagacgtttgatgtaaaagatcagaatgcaaatgtagtttttgactgttgggaaccgcataaaaataggtgcgcatattttaattttcaattaatcaagaggaacattaaattgtacctcaggattttgaggcagtacataagtcagaattgcatttataatttctagtacaagcctcaagaagtcagtatatatctgcaactctgctgactgtatcaaaagaatatacatttagaaaaaggaatagtcagaagtctgtaatcaatagaatc

SEQ ID NO: 777 - DNA, 401 bp, Glycine max
gttgtgaggcattttgattgttatcagctggaactaatggaagtggcagcttcactttctttttcttcttaggctcctcagaagcttgttttggcatcttgggaacaagttgagactcagcaaaattctcagaatctgaagatgacttggatgatatgacattaggctgcatgttctccccaacaaaagaagaggcaggggaaatgaggttcatggcaggcctaggattgaaggttgctggacgtggacgcttgctgcgtgtacgtccacatggcacagggatgtaaatctctggactgcttagtggaaaagtcttgccaccagagcaagaactgctactttcaaggacagaaactgggcttgatgtgtgaaattgggtgtttactgagtcctccttggta

SEQ ID NO: 778 - DNA, 473 bp, Glycine max
tctctgttggtggtcgtgatctcattgtggatggttgtgtgacactttcatttggaaggcattatggtttggtaggaaggaatgggacggggaaaaccactttccttaggcacatggctatgcatgccattgatggtgttccaaggaattgccagatactgcatgtggagcaagaggtgacaggtgatgctacgactgctttgcagtgtgtcctcaatgctgacattgagaggactcagcttctcgatgaagaaactcagttagttgcccaacaggtgagaaattgaatgtgtgttgctttgcttgttatttgtatgtgctcttgaaactgggacaactgaggatgttgtggttgtttgacagagggaattggaggacaaaaacgaaaaaggtgatttgaatggagtggtcggtagggatgacatttcaaaaaggcttgaggaaatatataagaggcttgaactcattgatgc

SEQ ID NO: 779 - DNA, 745 bp, Glycine max
  misc_feature (640)..(641): n is a, c, g, or t
  misc_feature (688)..(688): n is a, c, g, or t
  misc_feature (704)..(705): n is a, c, g, or t
  misc_feature (712)..(717): n is a, c, g, or t
  misc_feature (730)..(732): n is a, c, g, or t
  misc_feature (736)..(737): n is a, c, g, or t
agagataaatgagaaggttgccatcaagaagatacagaatgcctttgaaaaccgggttgatgccctgaggactttgcgcgaactcaagcttcttcgccaccttcaccatgagaatgtgattgctttgaaggacatcatgatgcctgttcacaggaatagtttcaaggatgtctatctggtttatgaactcatggacacggatttgcatcagattattaagtcttctcaagctttgtctaatgatcactgccagtatttcctctttcaggtatgaatctttggcccatttttggtgaagcggaataatattccttgcttcttatatgccaatattaatatcacgaatagcatgctgttcatattgtctactatacatgcatgtttagtattattgtagagttgacactaagcagaaaacacacatgttgaacttgtttgtacgtttgtgacagtcttgcagagggattttggtaaaaggtcttgtataaacttgtgtgctcttatcattttgaaataattttttttgtttttgatgtgttttgcatttttacccctctacctgataaatccccccttgattttctaagtctatagttcttccctgaagaactgacttcagtcatgtcaaggcacattttanngctttggttatgaataatatcatttgtgatgcttagcaaatgattgnattttaccaaaattgnnaattctnnnnnncagttgctccggnnnttgnnatatcttc

SEQ ID NO: 780 - DNA, 660 bp, Glycine max
ttctataaacaagtcaacatggataaattccatatacagcctacaggattaaattaaatcatattgtaaacaacataaaatcaatattaacatctactggactagtctgcctaaaccgaaggaaacaagaatttccattcctatgttccctattataaaattataaataaatatacacatctatgccaagtgtgttggtctttcaactgaacagaaccgcgcacactgtaattcctcgttcaaccttggttttacctgttgcagtcaaaaagttgaaatgtaaatatagattcacataggttactacaaaagcaggcgattcactcagaattatgtatacacagattctcaccccctagaagttttccgattctggtttttgtgacccttttcatgtgaagcagaaggaatctttgagataattaaagagctctgcaatccttctaatagctgccaaccaaaagttaaccacatcagactcaacagaagacaacgatatgaaaacatttttttatacagataagacagtggaaatggcttattatacttgagacaaaataatattagacgcaacttagaacaacaaatttcagttgaaggcaggcatgttcttactcttgacgttggctgaatcctgcgaatggatctacgaggctcagt

SEQ ID NO: 781 - DNA, 497 bp, Glycine max
aaagtggcttatacctagctgacagctgtgcccttttcatcctaatactaacccgttaccatctttatataaagttattaagtaatgttttactgtcttataggatatttataatgttaataatcagattgggttggttctatcatataattttctcaatcacatcatttatttcctttagtttctaatacaatattcatttatttgtttgaaacaaacagaaatatggaaatactgacattgagggtgttgattcaactaatgcatgctatggaggaactgctgctctgtttaattgtgtcaattgggtggagagcaattcatgggatggacgctatggacttgttgtctgcactgacagtgcagtaagataatttcctaaacattcacgttgaatttggactatattcagcaatactaaacatgctttgcactttcttatatgtaataaggacaatacaacttcctaattcaaagttctagattatgtcgtaatg

SEQ ID NO: 782 - DNA, 409 bp, Glycine max
  misc_feature (384)..(406): n is a, c, g, or t
actgaacaaacacagaactcacaaatgtgtagatgaaacctttacaactgcccaatgctgccaggaagaacagtttcaacattacaacttcaaccactccaaacaaggacacaggccccaacaatatctagcagggtaataatccttcaaatacacctctctgccatattctataatgtagaaactgaaggattgtcgacgatgagccatggtgacacgagttactggcacaactgagattgcatgcctttcacatatgacccttgcagtggcaggcacttgagctctttctgcaatgacatcagaagagaatttgttgagaaaataagaatcagcaaaaaaggctggagtgcattggtatgcttgagtgttgcacaattgaannnnnnnnnnnnnnnnnnnnnnntac

SEQ ID NO: 783 - DNA, 1181 bp, Glycine max
  misc_feature (60)..(61): n is a, c, g, or t
  misc_feature (496)..(496): n is a, c, g, or t
  misc_feature (1122)..(1125): n is a, c, g, or t
  misc_feature (1174)..(1175): n is a, c, g, or t
gatttgcacgcgacatgcaggtaataagcccatttttggtttacaatttgtacatatacnnaaacttaatagtgatccataaaaaagtcttgtaaatttttattaaaattgttaaggtattataaatttgtaagaaagggttttagtactcaatcatatgtatatgggctgggcccacatgcttttatgtacatgacctagtaattacaaacatgaggagtcactagacactgtaatatatcccattacagttttactcacatgcctctttatctttttccacttttctctctacaaaaatgacatgagaacttgtggtattatccataaaaaaacgggggacaaaaataaacatgcaatatatcatgggatctaagcagtttcctcatatacttatacatgctaatcctgttttttttttttttaaaaaaaaaaaccaaaaaggtttatttctgacattttttttttttttgttttatacctaaaaaaaatcagnattttattaattggggtttcaactttcaagcctaaattaaaccctcaaaagggaccattaggagcagatctagacacaggctggtcattgatttgcccttttcagttgaaatttggattgtgacagtttctaaagaacacttgattttcatatatttcagtttattaaaagataataaccacaaatgtttagatcttgcatatttattttctttgtagtatagctgacaagaatcactgttttattagttggtgattagaccctcaaaagggaccattagcaacagatctagacacatctgatcattggtttgcctttcagttgaaatttggactgtgacagtttctaaagaacacttaaatttcataacatgtttcaggttcgtgggttgcctactgtgttctttattagccctgatccgaacaaagaagctattcgaaccgaaggacttgtccctatacagatgatgagggatatcattgacaaggatatgtgaaacaacaacaaagtgttctgatcacctgacatagtttgtgttcctggatcctgcaatatactgtctggtgtaatgctagcctatctgggacagaattgaagtgctaaccgattcatatgattttggttannnnaggttgtaaatcgtatgatatttatgtaaactttgagctcgacatactnnacatag

SEQ ID NO: 784 - DNA, 352 bp, Glycine max
ttgaatcctctgggccattgagcaattcgatggaccaagaaacaataatatcagccattaagacctaccagcaatatttcagtttgcaacccaccggcaaactaaacaacgagactcttcagcaaatgtcgttcctacgatgtggcgtccccgacattaacattgactacaacttcaccgacgacaacatgtcatatccgaaagccggtcaccggtggttcccccacacaaacctcacatacggttttcttcctgaaaaccaaatcccagccaacatgaccaaggtgtttagagattccttcgctcggtgggcccaggcctctggggttttgaatctcaccgagacaaccta

SEQ ID NO: 785 - DNA, 650 bp, Glycine max
  misc_feature (56)..(57): n is a, c, g, or t
  misc_feature (480)..(484): n is a, c, g, or t
  misc_feature (553)..(555): n is a, c, g, or t
  misc_feature (557)..(569): n is a, c, g, or t
  misc_feature (572)..(574): n is a, c, g, or t
  misc_feature (582)..(589): n is a, c, g, or t
  misc_feature (591)..(601): n is a, c, g, or t
  misc_feature (606)..(607): n is a, c, g, or t
  misc_feature (609)..(616): n is a, c, g, or t
  misc_feature (628)..(632): n is a, c, g, or t
  misc_feature (635)..(643): n is a, c, g, or t
  misc_feature (645)..(645): n is a, c, g, or t
gccttggtcctatgcattgacataacattttcaaagagtatccagaataccagcanntgtattgacctgcataagatgtacacaagttactcacatcacaaatgaacaaaagaaaaccttctttaccaagttttgccaacttaaaatgtttaccttggagttccaactgcattaaggagtgtgatgatagaaggtatatacacagcaccccacttgggaacttccacttctggaactaaaacagttgctggcataatcacacagtaaaatacaaatgtgaccacatgagcaacaattttccggacaaagaagaaactataaatcacatataacttcttccacatggaaactttctgcatggtatggtaaaaaaggaattagaagagatggtggatactaatataatttgacttcttcaaacaacaacctaaggacattgaagattaattacaaggaaactgataccttgtttctcatgannnnnattgccattttcttgaaaagattagctgggccacatgaccacctgtgctgctgataacgataggtttgnnngnnnnnnnnnnnnnaannnaaattccnnnnnnnntnnnnnnnnnnnttccnngnnnnnnnncccagcggcttnnnnnttnnnnnnnnnanaaatc

SEQ ID NO: 786 - DNA, 827 bp, Glycine max
  misc_feature (772)..(773): n is a, c, g, or t
tccagattttgtgtttcagttgagtctttatgttttcacacggtgccatctatattttcttttttgtaatgttattttgtacaactttttcattttcaatatacggcttctgaaaagtatttggaaataaagcagttttagcatgttaggaatgccctatgctagtattgttaggaaccaagagatgatgagatgaaaagaaagaatattattgatgggtaagggaagtacaagaactaagagaatgaatcctcctctaagggttgccccttcacaaagagcctagctcaatttacaaatttgatgaaaaatgaataatccttctttcccttaacacactctatttacaccaacagacctgcacatttcaccacagcctaataaccttctcacctttcccaaactaccccgttcctcctctttctataattaacttgcaactgtctggaacctgcattctcagtcctaacatatatcctcacaggaattctttgttatttgtgctgaaaatcctttttcttgctgtatctattttcttaatagcaaatttagttttagatcatagtgcttggcactaaattgtttcatacttttattcacacaggcatgacttggaagtgaatggagggacgggtctcattgtggatcccagaacaaaatatgtgtacaacagaccatgacacacatgaacttctatcattagttgataaaggaggaccattcactgcagtttctaaattatttgccttgcccttattgtcgctgttaacannaagaggggcttgtatgaatttgaaatgtgtatggaagcattctttttttttttt

SEQ ID NO: 787 - DNA, 387 bp, Glycine max
tttggaatattatcagggctgccagaaagttgagattgatagctagcaacttctcagtgacttgcacttaagttcagattctgaacaaccagaaatggttcaaatttacaactgacgggagatgaaagggcaactgaaataaacaagaaggcagtgctttcctgattgctgctaagagtgtgcttgagcatgctcaggtttgtgactgtactcataatcaagatgaacaaaagcacgctcaatctcgggcaaaagctcaagcttttcttgcaacgattccccaatatcatgagcctcttgcaagggcatatccgatggcaggacaatatcaacctcaacaaagtagtgagatccaaatgtgtatgcccgaactgtatcaataaaaaa

SEQ ID NO: 788 - DNA, 359 bp, Glycine max
ctgtagtacttgtttcccgtttttataaatacatctacaatctttgcccacggacagctttttaatgaaacttctcatactatttttatgccaggtaattatactaaaggctagcggaattattataccaatgtacataattattaagattctcggagctattcagagttgtattcagcactataaggatgctgactatgatacatcaatgtctgaggaagatgacgaagatgagatacatcataatgtaaatccaagacatttatagattatttgcttactagtgtatcagagcattatgatgatgctcgtcaaataacattttgtggcataatttatgataatggcattcagatcga

SEQ ID NO: 789 - DNA, 744 bp, Glycine max
  misc_feature (734)..(739): n is a, c, g, or t
gctcacattactcacaatgacggggcacaaatatattcttatttaaagtcaacaaggtacaaaacttttcattaagattaaatatatgatataaaaatgaagtaatatttagttaataatcatattattggttagtacaacacttaaattgtatacttaatcacactagctagatccattttttatacacaaatgagatggaacaaattaatatacatgggtgcatataaagaatagatttagtgtgattagatgtataatttaaatgttatattgatcaataatataattatgtaccacatattgttttattttattgcagaggatttacactcatatgatataatattttgtttagtcttgaattgattgatttatgtatgttaccgaacattacagtaatccaacagcgactatatttaagagttatgaaggcaaagatccattagccccatatattgattcattctcaggtagaggtccaaacaaaatcactccaaatattctaaaggtaacttcacggcataatatttatacaatcaatctaaccgttacaactagctagtacaaggttatttgcttattgcaattatctcttgatgttgtagcctgatttagctgctccaggggttaacattctagctgcatggtctccaattgctcctatctccggagttaaaggagataagagaatttcaaaatacaatatactatatggaacttcaatggcatgnnnnnntgtta

SEQ ID NO: 790 - DNA, 1160 bp, Glycine max
  misc_feature (347)..(351): n is a, c, g, or t
  misc_feature (356)..(379): n is a, c, g, or t
  misc_feature (388)..(392): n is a, c, g, or t
  misc_feature (395)..(395): n is a, c, g, or t
  misc_feature (400)..(400): n is a, c, g, or t
  misc_feature (402)..(402): n is a, c, g, or t
  misc_feature (404)..(409): n is a, c, g, or t
  misc_feature (411)..(416): n is a, c, g, or t
  misc_feature (424)..(431): n is a, c, g, or t
  misc_feature (438)..(465): n is a, c, g, or t
  misc_feature (469)..(472): n is a, c, g, or t
  misc_feature (476)..(492): n is a, c, g, or t
  misc_feature (495)..(499): n is a, c, g, or t
  misc_feature (501)..(503): n is a, c, g, or t
  misc_feature (508)..(510): n is a, c, g, or t
  misc_feature (512)..(515): n is a, c, g, or t
  misc_feature (518)..(523): n is a, c, g, or t
  misc_feature (533)..(535): n is a, c, g, or t
  misc_feature (537)..(542): n is a, c, g, or t
  misc_feature (547)..(547): n is a, c, g, or t
  misc_feature (549)..(569): n is a, c, g, or t
  misc_feature (571)..(592): n is a, c, g, or t
  misc_feature (594)..(609): n is a, c, g, or t
  misc_feature (614)..(615): n is a, c, g, or t
  misc_feature (617)..(638): n is a, c, g, or t
  misc_feature (641)..(646): n is a, c, g, or t
  misc_feature (651)..(677): n is a, c, g, or t
  misc_feature (682)..(687): n is a, c, g, or t
  misc_feature (690)..(697): n is a, c, g, or t
  misc_feature (711)..(719): n is a, c, g, or t
  misc_feature (723)..(727): n is a, c, g, or t
  misc_feature (729)..(729): n is a, c, g, or t
  misc_feature (736)..(750): n is a, c, g, or t
  misc_feature (753)..(755): n is a, c, g, or t
  misc_feature (760)..(764): n is a, c, g, or t
  misc_feature (773)..(782): n is a, c, g, or t
  misc_feature (784)..(784): n is a, c, g, or t
  misc_feature (787)..(790): n is a, c, g, or t
  misc_feature (797)..(810): n is a, c, g, or t
  misc_feature (812)..(829): n is a, c, g, or t
  misc_feature (840)..(852): n is a, c, g, or t
  misc_feature (855)..(858): n is a, c, g, or t
  misc_feature (860)..(860): n is a, c, g, or t
  misc_feature (871)..(877): n is a, c, g, or t
  misc_feature (886)..(905): n is a, c, g, or t
  misc_feature (907)..(911): n is a, c, g, or t
  misc_feature (917)..(933): n is a, c, g, or t
  misc_feature (936)..(937): n is a, c, g, or t
  misc_feature (940)..(945): n is a, c, g, or t
  misc_feature (950)..(956): n is a, c, g, or t
  misc_feature (959)..(971): n is a, c, g, or t
  misc_feature (975)..(979): n is a, c, g, or t
  misc_feature (992)..(994): n is a, c, g, or t
  misc_feature (1004)..(1019): n is a, c, g, or t
  misc_feature (1021)..(1025): n is a, c, g, or t
  misc_feature (1028)..(1037): n is a, c, g, or t
  misc_feature (1039)..(1042): n is a, c, g, or t
  misc_feature (1047)..(1050): n is a, c, g, or t
  misc_feature (1052)..(1062): n is a, c, g, or t
  misc_feature (1064)..(1079): n is a, c, g, or t
  misc_feature (1082)..(1093): n is a, c, g, or t
  misc_feature (1097)..(1099): n is a, c, g, or t
  misc_feature (1101)..(1105): n is a, c, g, or t
  misc_feature (1108)..(1120): n is a, c, g, or t
  misc_feature (1126)..(1127): n is a, c, g, or t
  misc_feature (1131)..(1134): n is a, c, g, or t
  misc_feature (1136)..(1138): n is a, c, g, or t
  misc_feature (1140)..(1152): n is a, c, g, or t
  misc_feature (1154)..(1157): n is a, c, g, or t
cgtgtgcatggtttgggtaccatttgatggattatggtgatgcctataatttcacagtttcgcagttcatcaatggagatggttggcttgatactacgtccgttccttatgatgatgggatttgagcaatgtataataagtttagttcgttaattgttaaggtacttacaattgtcactatcctctggagtatgactactaaggtacttactaaagtaacattgtaaaataagaaaagttcatggctaattacacagggattacctaaggtattgttgcttttaagtgtaacctcttctcaatatattcagaaaatagatgtaaattatttttgtgcctaaacgctnnnnngatgnnnnnnnnnnnnnnnnnnnnnnnngtgtgtagnnnnnccntcagngngnnnnnntnnnnnntttcttcnnnnnnnngtttcgnnnnnnnnnnnnnnnnnnnnnnnnnnnncatnnnnaatnnnnnnnnnnnnnnnnntannnnncnnntaccnnncnnnnttnnnnnnttttttcatnnncnnnnnnccttntnnnnnnnnnnnnnnnnnnnnnannnnnnnnnnnnnnnnnnnnnnannnnnnnnnnnnnnnnctacnnannnnnnnnnnnnnnnnnnnnnnttnnnnnnattannnnnnnnnnnnnnnnnnnnnnnnnnntcccnnnnnnacnnnnnnnntcccatttaaaacnnnnnnnnncaannnnncncctcacnnnnnnnnnnnnnnnaannnccccnnnnnttaaaatannnnnnnnnnanaannnncttttannnnnnnnnnnnnnannnnnnnnnnnnnnnnnnccattatttcnnnnnnnnnnnnnatnnnnanttacttcctannnnnnnttcattcannnnnnnnnnnnnnnnnnnnannnnntctacnnnnnnnnnnnnnnnnnctnntcnnnnnnttctnnnnnnnccnnnnnnnnnnnnnctannnnntcttttttctttnnntccacttacnnnnnnnnnnnnnnnntnnnnntcnnnnnnnnnntnnnntcctnnnntnnnnnnnnnnntnnnnnnnnnnnnnnnnttnnnnnnnnnnnnattnnntnnnnnccnnnnnnnnnnnnntttacnnctgnnnntnnntnnnnnnnnnnnnncnnnncca

SEQ ID NO: 791 - DNA, 392 bp, Glycine max
  misc_feature (377)..(378): n is a, c, g, or t
  misc_feature (380)..(381): n is a, c, g, or t
  misc_feature (383)..(386): n is a, c, g, or t
gtcaaatgctgatgtcattcctgtttagagttgttttcttttgcttggaaatcagtgtctcacgcctctgaaatgacaaaaaactggaggggaaatcctaccatatggaatccagaatattttccacttggtgggttgtgtaaaatggtgtgtaggaagatgctaagcatactactaagactaagattgtcatgataatcagaatatgattggattaatatgacgcaaggattcacaagggccaactacaagcactttgagaaagtcatatcaatgtaatccatccaagaagttgcattgttctttttctgcttattttattatgtacataggtagagggacccgaaggggttcaaagtagttgcctcttgccgganngnncnnnngcagct

SEQ ID NO: 792 - DNA, 1119 bp, Glycine max
ctcgacccctccgaacccacgtgccaagtcctgcacgtggaagtgggcattctccgccccaattggctccacggtgcaacctatttgggtcagcaacatgttggtaatttcctctgcaacgtgtgggagaaagttgatttcattgtctactacgaggatgtcctcactcgtaggcctgttaagtgggtcttctacacaggtactacacgcacctctgttcttagtttttagttatacgcacaatttcgttttgagcttaattcagcttaaaaaattaactcatttatatacattatttttttcgtatcaccggtcaatgagaatttcaaacacacctctctcacgccaaaagcttaatttcttgaacataaaatttacaggatcagacagtggtagacggtcgatgagcccgataacaactactaagatagactgtaatatcatattagagtttgtgtttaagcttaatttaatctcaaaagctctcaaaagctcactcttgtagagtgaaagttgttcttatatactacatcctttatgtatcatttgatgttttagccttcttttttttaatctgaaaacaattaatgttttataattttaaagtctaattttttttttctcaattacacccctatttaacagctactatagttgagataagcagaaatttgtaatataattattactactaataggatattaaataagggcttttttgtccaaatttgcattcaataaatattttttaatctatatgcattaaacttaaacatctaaatatatacaagtaggaaggaaaggggtagtagtactgtagtagcactctatttttgtcatatcacttgttaagtcagtctgacaattatttattgtcggttaatacatttgttagttatatttgcatgtctcccttatttgaaacctttccttgggcattgattgaaaataacaagcattgatctgatagtgaatccgatttgaatttggtgggtgcaggatacactgctcacgtgatgacatttgaggttggtgcagtgcttgaggatccaaattggcaggctcctgtgtattgttttagtgagaatgggaaggaaaacaatagccccatttaagaca

SEQ ID NO: 793 - DNA, 598 bp, Glycine max
gctaagagagaaaagggagagtgctttgaaaatgggaaagtttagttcaagttacagtacttctgattttgttcactttggagttctacttccctttcttctgttatcacagttgttctttcaacttgcatggtgtggctccatagtaaagttccttcctggattagagggaccccttccttttgttcttgaaaccgggtgggttagttacacttagctagcaagactatggttttaaattttaatttatgggattaaaatcattaatttgcttgaatatcttagacatgttacattatttatttttgttgaataggtatgtgggagtgggtgaatcagaggatgtgcaggcattctactacttcattgagtcagagaacaatccaaaggaggatcctctcatgctttggctcactggtggccctggttgctcagctttctctggccttgtcattgaaataggcaataccaactctgtttccaaattttacttttgctccatacttatgtatgtaccaagtgacaagagccgagacttagaaattttactctatttgcatgttgcaggtccaattgcatttaaaaatgaggaatacaa

SEQ ID NO: 794 - DNA, 655 bp, Glycine max
tcacatgaaaacagtctggaatcagaaactattgaagtttcattttataaaaacatactacagaagtggatattaaataaacatcctatcctagcgcgacgtccaaatataaacctggcctccacttgtagctcctgctagcatcccaacctcgtaagagtgtgtatcaaatctgcaaggaatggcagacatgtgctggctctctagagtcataactattttcctttcaactgatgagacaacatcaactcctcttttcatgtttccaacaaagagatatgagtcatcccaaccccattttgctctgctaccacaaaagctcacaaaagtcaagtgctttttttagaataagttggcaatttataaggtatcaacaagtttgcattataataactacacacaagtttcagcttatgccgatcaaataaattcttttctacttgtgaagagtggaagcttaattgaaatgtaaaaatcagctcttgagagtttaaaatcccaagcttttgatttgcaaatacttttgcaggatggggaagttaagcagacggcaaaataacaagtcaatcttaagatagttccccagaaaccatacctgaaagtagaaagccatctgccagtcagattgttatgattaataacagctgcatcctcc

SEQ ID NO: 795 - DNA, 366 bp, Glycine max
atgatgactgtggggatgatgatattgaaagcagtgatgattatcacgacgatggaaacaacagtgaaaagccttcatctcttgttcaaaaatctatttccagtaaggataatattcaggaaaaacaaaagggaaatgttcattccaaaaaacgtccaagaatagttgagctatcctgagcataacaagattttgaggattagatccttatgctataacaatttactgagattattgcgaccagtctagttggaattttctgtatgatttatgctgcgttaaattataaccaatgtatctacgacctctatgtcaggggcagcggctggtgaagtaacaagacttgctacttggctttattgtagc

SEQ ID NO: 796 - DNA, 402 bp, Glycine max
ttcttaaaggtactttgtttcctttgtcattggtataatgaacagtactatacaaaaaaagcagtttcaaaccatcatattcaagtctgaaaggtcatccatgggaatttcaaggcccataaagtcatcatgatcttgcaatccatcgtcctcaatattcaaccatgaaccaagatcagcaccttggtcaccaagatcatcaggaacaccaagcacatccattccaggcagttgcaagttggacaaatcaataggctcatggtcatcgaattcacccatgtcaaactcatctttctccttggcagttctgttagtagacatttcgttaaacttcgaaacagaaggcaaagctgttttaggttgctctgatagcttgccaaggaggccatttacagaaacaga

SEQ ID NO: 797 - DNA, 563 bp, Glycine max
  misc_feature (458)..(462): n is a, c, g, or t
  misc_feature (471)..(476): n is a, c, g, or t
  misc_feature (480)..(481): n is a, c, g, or t
  misc_feature (487)..(493): n is a, c, g, or t
  misc_feature (498)..(505): n is a, c, g, or t
  misc_feature (512)..(532): n is a, c, g, or t
  misc_feature (536)..(559): n is a, c, g, or t
atttattttctgtgtttatttatccgtcatttttcttcactcgaacgtaagtgtttgtcttttatgtgttgattttagcttaatttaatctaatacactgattgtgccatgttattgcagcctgcaaggccagaggcgctgacctcagagttcattttaaggtacttagatttgttaccatttgatgatcttctgtgtggtgatgtactagaccattatgtgtaatatgcctaaccctaatttttagaattgaatgtgatgtgttttttaatatgcatttttgcattgtccataattgggaaacctgatgaaaaaagcaggggtttgttttgattatgtggacttccctctcgtaaacttcagtgatataattttccattgttattgggtgaacctctgttctttggctgtgattgaaggttcagtaaatgatggaacacgcttttccactatatgcnnnnnataatgatnnnnnncttnnttaacnnnnnnncgtannnnnnnnatatacnnnnnnnnnnnnnnnnnnnnnttannnnnnnnnnnnnnnnnnnnnnnncatt

SEQ ID NO: 798 - DNA, 622 bp, Glycine max
catatcgagtagggtgtgtatatcatattccatcacaaaactgcaataaagtctaacacccagaaacatagccgtcagctcctgcgatttaagcgaaagccctgcaaggatttaaaatcaaccgttacatcttacatgcaaacacattagaaaagatatgtaagactaatttctgttaaaatcctaacaagatcgtacattaacaccacaaaaatgacatcaatccaaatatccaaaggtccaatttaatataaccctaacctgaaatgttgagggcaatttttttcatattttaatttatgagaaaaagaaagagattggtgggtaccggcacaggttttttccttggtgagtttgtaaatgaggacggagattcctaatgcatggacaaactcggcggcgacgaagaggctgtcgtggtcgtgaacgacgattctgaggaagagcaaggccgcaagggcagacagcaccgcgagaaaggcctttatcttgggcggttggcgccgaacccatgtcgtgacggcgtggatgggcctcttgctacccttcatttccgaacagaaaataatcaattgattgtcttgtcttctgacttgtgttgtgtccttcttcccgtgataat

SEQ ID NO: 799 - DNA, 1039 bp, Glycine max
  misc_feature (987)..(992): n is a, c, g, or t
gtcataaaaacctcttttagcttttaagcactatgacaacctatataacttcacagtttatatgtgtgtgtgtgtgtggtggccttctctttgtggcaaagctagccttatcagttctccgaaaaaataggctagccttaccaaagtattcactgaatcagcatatgcaattcatgaaggattaaaggatcattctttgaacatgacacgttttagtggtcacaccgcgacctgcattttatgcgtaacacattaatgctaagatcaccatttgcataaatctaaagccataataataaaataaaaaaataatagatgctagagcaacagtcattacatttttacaaatgtttagcttcataaccttaaagcaatccaatcattgaatgattgaaacatagtaacatacagttgaattggttacaataacataaattgattataagtctgtttgcaatcagaaggtgcaggaaaatagcagaactatgtaccttaaaaacataatgttctcgatttttttttaagaaataaatcttcaagatatataaccaagattttattttttaatgtaaaagtaaatgagtctagtttgaacagatacaaatataaatagttagacaatcgacatgcaaatagacccagaagcctgaaacgataaggttagcaccccaactatatacatacattaaatcaatacatcatacagtattatgaaatggaaatctacttcccaaacaacattgaaattatgcaagaccaactatagacatcattaactgttgctaggatacatgtacagttggatacagttttagactgaagaaaaaagtctcgttaacaacttcatcagaattttaggtgagagagaaaattcttttcttcaagagtataggaatgttataagataatatgtaaatgctaaaagtaaaaactcacatgatgcactgctatgtctggtgcaaaagctcttctatggattcaaattcnnnnnnattattaactacatgatgaattttggcagatagcttttcattgtgct

SEQ ID NO: 800 - DNA, 405 bp, Glycine max
ttgtgatcttcttcaaccttcagagtgagaaaacacattcagaaaccacgtttctctcttcttcttcttcttcttctttttcttctctcgaggtcattattaagtattcaccatggaggcaccatctcccaccaaacccaacgacccaacaaaaccttccaacacttccaccacccttagtctggaggccggcccggcccaagcgagcccactccgaaaaatgtttgccgtggcgtccatcgccgccggcatacagttcgggtgggctctccagctctctcttctaaccccctacgttcagcttttaggagtcccccacgcggcggcctccttcatctggctctgcgggcccatctccgggctcgtggtacagcccattgtgggctactacagcgaccactgtaa

SEQ ID NO: 801 - DNA, 375 bp, Glycine max
tgatgaagtcctaaacgggccagagccgaagggatccgagtcatcaaaagctggaaacccatgagcatggtcaaaatccgcactgttgcgcactgaatcaaattgttctgtcgtctcccgagcaggcaaaggtacactatcatgtgttctgaaggaatcaaatcttgagaagtcaaaagcagtttccaaccactcttttggcctttgcggagagctacttgaactgaaaagtggcgtgcttggaacagaatcgtcaaaactgaatccactgctcctctggaagggatcaccagcctgtggcgaacctgttttgatggggtttaagcccagttccccagaatcaaagaaatagttgttcccagctctatcaagttc

SEQ ID NO: 802 - DNA, 952 bp, Glycine max
  misc_feature (37)..(37): n is a, c, g, or t
  misc_feature (850)..(854): n is a, c, g, or t
  misc_feature (885)..(896): n is a, c, g, or t
  misc_feature (944)..(946): n is a, c, g, or t
tacaaataagatttgctatggtttgttctaatactcnttgttgcttgtttcagttatggctgttccctatgatgtgaacaagatacaacttactattcaaatggtcttgcaaacaaaaagactttagtcttttcatgcatgtgaaacatatgatgtgaacttgtcaccaaaggatctgtctcctttaaaataacccactttagagggtaaagtaagttgtctcagttgtcaatgagaaaaacaatggtcgatattatatgcacatgcataacaaatcatgaatgtgttggaatgtcaactgttgatgttcttgtcaatgactaagattattactttaatccttactcacttcagaggagccaaatccgtcacaaactaccttttgtgatttggtgactggtgtatctaaataaaattttcaacatcagtgtttgtaaaagatacttttaacaacagaactatctacgcactgctcttgatcagtttacttgtattttcttgctatacgtgtatgtgtgcttgcttgtgtatatgttggtttgtaattcatacataaaaaaccatgcaggttacagtcagagggtcacaaggtcatgctggaactgttccaatgtcgatgcgccaggatcctatggctgctgcagcagaacaaattgtagtcttggaaagcctctgtaaacaccctgaagaatacctttcttatgatggtcattgcagtgattcaacagtgaaatcactgtcaacctcacttgtttgtactgttggagagatatcaacatggccaagtgccagtaatgtcattccaggccaggcaagcgatgaatttctaaaatgctactgaccctggaannnnnaagtggccatgcttcatcatttattattttnnnnnnnnnnnncccatgttgacagtgtcttgacttgttgtaggttacatataccgtggnnnacgagc

SEQ ID NO: 803 - DNA, 653 bp, Glycine max
  misc_feature (647)..(647): n is a, c, g, or t
ttctgaagttgcacttaggagaatagaagaagtaatagcatatagcaagcatatatttcaatttccactagacatgcacaaaaacctacacagacgaattaatgttgacatatgttggtgtgtcatttcgttaataataaattaagcaaatagatgaacctgaggaattatgtgctgcatagcccactcaggtccaaattcttcagcaaggcgtttcaagttgttagcagctgcttcgcgaattgaatgaacctacaataactaaggttgttaacaaaaacagtcatgtgcaatatgcagttcccaaaatgcacccacactagcaaggaagtggagagcacaaaccttatcctgtaaccactgcatgcaaagagcaccaagtttgtcatcaaaaaacctaacccccaattgacttgccaataagggtatatattctataattgcaagccggaccctccaatgcctatcctcagcaagctcaacaatggctggtaacaaagactgagataacagatcgattcctataacctgcaagaatacattgattaaaatgtctttcaaaggttttcttttgctttgtacttgttttgtgagtatagggtggtaggcagacataaggcttaaataaaagcatcagttctgaatgnaagaat

SEQ ID NO: 804 - DNA, 346 bp, Glycine max
tgaaatgaggctcggaattatagctatagcctagaggttggggccaatggtaggaaactcatttgggagggtacaccacgaagtgttcgtgatagtcaccgtaaggttagggatagccatgatgggctcattattcaaagaaatatggccctatttttctctggtggggatagaaaggagctgaagctcagagtcacaggaagaatatggaaagaacagaattcagatgctggggtgtgcatgccaaatctctgtagttgacatgttatttgaaaggaattcttacatgtgtttctgacactcttttgagatatatttgtaccaactttgtgcatgttgtaataga

SEQ ID NO: 805 - DNA, 395 bp, Glycine max
actaaaacatatttcaccaactgcaaaaacaagaagatgcaacagaaagatatttcaacagtttaccttaaaaaatagcagtaccaaaaaacaaaaagcaaaggaagggttggttccagcaacaaaaaaatctaaatttcataacagaggtgtattgaaaatccaaaaaattggacctaacatcttgatctattctctaagcctccctacgcacaaagtacagcttgcccatcacatgaaggatggcaacaaatgctatgaagccaatgctcattacaagaacaacatttggggagatcttgagtccaggggcatcatctgtgtaaaattggagcatagttccagctgctcctccagaggccgcaccaccggttgttctccttctcctcatgctt

SEQ ID NO: 806 - DNA, 619 bp, Glycine max
  misc_feature (331)..(331): n is a, c, g, or t
  misc_feature (511)..(511): n is a, c, g, or t
  misc_feature (587)..(589): n is a, c, g, or t
  misc_feature (595)..(596): n is a, c, g, or t
gagaagaagcttccgggcgtaggattcaagaagctcaaaaagatattgaagaagtgcaggagaaactcttcatcccagaaaccccttcatgcatcccttgccgccaaaacctgccccgaccattgcccaggtaatcaaaatcttttttttttttcccctttttttttttttcaagttttaattttgacccttttacaaagggaaaccaaccaactggaaaaaaaaaaaaaggagggggggaaaaaaacccctttccccctttttcccggttttaagggcgggctggaaaggtaaaatatatataaataaaaaaaaatatatatatatatancccccccccccaatttttttttttttgggggagaaattttttttttttttttttttaaaaaaagggttttctttttttttttttgggggggggggggggaaaatattagggggggggggggcccctcccccccccccctccaaaaaaaaaaaaaaaaaagggggggggttttaacccccngcccaaaaaaatgggggaaaccccccccctttggggggaaaaaaaattttttttggggaaaaaaaaaaaaaaaaannnaaaacnnccctttttttaaaaaaaaaaaaa

SEQ ID NO: 807 - DNA, 439 bp, Glycine max
tagattgctatcgctattgctgttgttatcctcagagacatcgattttgctcttcgaagctaaatccgtgttttcaggttcattgttcttggctctgtgactctgtttgcgctgattctggctcttccgcgtcttcaccggaatgtaaaaccgatcatcgccgcgaacgccgccgaattgcagtgcagttcccagcattttccaatcgttttcagaactgcgttctactcctccgttcggtcgccgagaaaacggaggaaatgagaaaattggtaatcgcagagaggatcaataaaataaggaagaagagaatcggaatcggtgatagaagacgaagaaaagaaaacgaggttgaaggcaaagggaagaagacaaggcagaggaagaagaaaagcttcaacactcttctttgcaacgaaacagaccgagagtgcataga

SEQ ID NO: 808 - DNA, 521 bp, Glycine max
acgctattactgcgagtactgcggtatctgcagatccaaaaaaacccttatcacctcccacatcaatttgcaccacaaggtacccttctttttaattttactttcacttatgcaaaagaaaaccgttttcaaccagcgttgtttgaattattgcaattagatcaatatgcagggttatgtatgattctgttgttgacttttgatgtgtttttaggaagagtatgaaaaagcaagagctgaaagagatcccgaagcagaggcttcgaaatcgaacacttgcgaggaatgtggtgccactttcaaaaaacacgcctatttgttgcagcacatgcaaagtcattcacttgaggtatttgaattcttgattaattattatttaagaaaaataagttggatacagtcaaactctaaaagcacataagaaaactgtatttaaaagctatgtcttatagaccgttgtgttccttgagaaacatttgatttgcggaagacaggctttgggttgtgacttgattgtgcta

SEQ ID NO: 809 - DNA, 589 bp, Glycine max
gtacgtggagagtcactgctaatagctaattcaatttaaagatcagcttcatctgagctcacagagaagatatcaataggagtattaatgcaatcataaactcctttacgtcttgatctaccattttgtgattcttttgaatgatcgagatatagaacgatcactgtaatatcatcatgaaaatggcgccttagacctttatctgttttccttagatccccatacctcatttctcttttctttgcaacctcttctagtgcagctctcgccaatcgttttgcaattccctacaatgataaaacttacagttctcaccaatcgtttatttgtttgtttatactaactttttaatttgtgctcataaatatactaagaaatagtctaacactaaaccattaacatgagtatgtagttcgggagttttgttgagtgtgtagtgtgtacacttactattctgggacttctggagatgatttcaacagccgcttcatcagttaaatgctcccaaagcccgtctgatgcaaagatcaaaaacagatcatctgccttcaatttacgcgccaatatcgatggttcagctgtcattaca

SEQ ID NO: 810 - DNA, 349 bp, Glycine max
tcaatcatacctctatactccttttatgaaatatcattacctttctcatccttgtcaacgattgtggaacgatgcataggggttgccataggtttggcttcatccattctgaacctttttagaaggggctttgtatatttctcttgatggataaaaatcccatgaactttctgaatgatttgaagtcctaggagaaactttagctcacctttcatactcgtttcaaacccacccttcattaactcagaaaactccttgcacatcctttttgaggttgcaccaaagattatgtcatcaacatagatatgaataataagaaggtttcctttttgagcctttctgaatagtg

SEQ ID NO: 811 - DNA, 379 bp, Glycine max
attctgaggaggagctgaaagaggcgttccgagtgtttgacaaggaccagaatgggttcatttctgctgctgagctccgccatgtgatgaccaaccttggggagaagctcactgatgaagaggttgatgagatgattcgagaggctgatgtcgatggcgacggccaaataaactacgaggagtttgttaaggtcatgatggccaagtgatggtagtacaccatctccactaaattctgaactgatggaaaaaaatgacaaggttgaacttgtgatatagtacacctagtccttgcctaatgtcattactgtcttatttctagatttttatttgatgtttttgaattcaatctaaacgacatttagtggaaagctctgct

SEQ ID NO: 812 - DNA, 1180 bp, Glycine max
  misc_feature (600)..(601): n is a, c, g, or t
  misc_feature (1092)..(1094): n is a, c, g, or t
  misc_feature (1130)..(1138): n is a, c, g, or t
gagctgctcgtgtatctgagcttttactcttggctcaatgtctgaaacataccggtatattcctgacttcgttaggacccttgtcttcaatggcaatgcaactggaccctttatgatgtccgaaactgaaatgcaaagcatgatagagcttagagatcaagtgattagaatatggggacttcttcgatcctccaacgattttgatccagctattttgctgccaatactacaggtgatttagttattttaacagagcattttgtaaatatcattgcatactaaattgaaaggtagtttgtgaacatttcaatcatggagcatctaaacatgttgtatgatggagtaatggatcaaggactttgatagttgaaaagatgtgtccatgcaaccaaaatatagcaaactattactatagccctcaatcaacattaaaaaataggcaatgctattaagagctaagatgatcttgaaaagtgaattgtatattagtttagatatgggacaaagttaactgttgaaatttgcttatttacattaataaatttctcttaaaagtatttagtggaattgaattgaaactttttcagctttttttttgcnnttgtaattttacaaaaaacgatatttaatatgaacaggtcattgagcaacctgaggcacgccaacttggggggcgtgtcgtgggtgggatcactcaacgacttgcagcacgcttttttcagcaagtactccgagttccaacaacagcttatgaataatttcgtggcactgtaaatgctagataaggcatgcattttatatattttccctatgaagtttgaattacttttgtgatgctcaaggtttattgagatctaattactggtttcatccatagtgtgctgtggtagtatagtccattcttattgattgaccagatgggccagtttgtttaaacttaaaataagcaattttaaaataaacatttttttaaaaagcacttatttaataagcatatcggattttcttatcgaaataagcagaaaattgttcctttttaagtagaaacagtttagacaaacaaactaaaaaaatataaagctgtttatttannnaaataaatacttttttcaaggaataagtttaaacannnnnnnnntatgtaacgatgatattctgtttttgctaaatcataatgttt

SEQ ID NO: 813 - DNA, 383 bp, Glycine max
ggatctcagaagaatccctcaaatcctcaaggctaatatactgctgtttaaccatcctcatggaatcaccccctatgtcatgaatccaaacataagggtgacaagtttcatcatagtaataaagcaagctcttcaatcccacaccatcatttccattcttaccaggcatatatgccttgtatatgcgtttacttctcagcctcttacatgaacctggcttcaaagtgtgaaccttcttcagtattgatcccacccttatctgcagctccactggtcgatcactgaagttccagatccttgtacctaatccataggcttgagtgtggtcatagcaaccatcgaagcaaccaccaagagatagaaggctcaaacctctcactttc

SEQ ID NO: 814 - DNA, 814 bp, Glycine max
ctgttaaaacatctcgtgatattattcacattttacaaaaccactatccagaaaggcttgctattgcttttatgtacaatccaccaagaatattccaggctttctggaaggtttgttctcctgccctgcaagttatatttgttctgcttttgcttagctttatttatattttaatatttgttctacatttaaagatcaagcaatacttgcctaatatttcttgcttatgtaaatgttattatattctgtatcacttttaacttttcgaacatttcataatcttttgtgtaattgaatattcaaatcatatcatgtcagtcagttagggaaaatttagttgcctttcagcaaaataaactcaattaaaattttacactgtagttatacctgaaaatcagccgtgtaactaattttgctctttaatctgtttttcttctcgagttcatttggggatggggtctggaattatgtagaaacatgtgtgaatttggtcccccccctccttttccttttctatttatcttcttctaccttgtcgtatttgaaaatttggatgttggtcaatttttatgattgtgctcaatttgtggttcgaattatgagctttcgacactcacctcttccatttcacaaatttgaagtttccctcattctgataggccatcagattcttcctggatcccaagacagtccagaaggtgaagtttgtttatcctaacaataaggacagtgtggagctgataaaatcactcttccccacggaaaaccttccaagtgaatttggggggaaaacaagtctaaactatgaccatga

SEQ ID NO: 815 - DNA, 395 bp, Glycine max
tcatcttccttagctatcacgttgatctgcgccgccacggtattggtggcgatgagtcggtggccgacagccgtgggcggcggggaccaccacttgggaatgggatgggtttccagcacgtgcaaggggaccattgctgagtgcctgggaggggaggagtacgagttggattcggagatcaaccggcgcatcttagccaccaacaagtacatcagctacgttgcgctgcagaggaacactgctccctgctctcgccgcggcgcctcctactacaattgccgacccggagcacaggccaatccttacagccgtggctgcagcgccattacgaggtgcaggagctgaattttccttttttttaaaattttttttttcggatgtgaattggaatgtgt

SEQ ID NO: 816 - DNA, 416 bp, Glycine max
gctaaaagctcataaatctcattcacatcatcgaacagagattcacaaaaatgatatcataatccatacagcgaattagatgttggatatttaggaattgaaaggtctgcatacctacaaaatgttaagaatccttctcatctggaggatcacgatcaactacagcaagtggatcttctccagtttccgatgggtgctcagatggagggggttgttgctcttcattttcattgttctcagggtggaaattgatggggaactttgtgacccttggtttatcagacaaaatgttcctttgaaccctatcgattaaaacctttggtggaggttcctctctcagctgctcatcatcataatcattgttcacataatagccaacacgacgttcactgtatggaatatgatgtcatttttgt

SEQ ID NO: 817 - DNA, 440 bp, Glycine max
aagatgaggatttcatagagggaaaaatagccgcataattctgtattatttttgttcagtctcttgttaacttcaaagccaaaatctgtacatgtcaaagaggccttaacaaggggtgtctccatctctcaggcttcatcctccagttactttcaatgtttcttggcttcaacattcgctctatttcgattcctgattgaagacaagattgcagcctcttcaaatgtccacaacattgcttgtgatcgaagcaatcactgctgctaacaatattgccttctgaatgtgtgtatctttcatacggtgactgccacttggcttgcagatatgctagagatctccatggaggaagcggcatagaattctgtttcaaagaagatctagtagcttcttccattattccaagaaattgtttcagccttgtaaaggaacccacatag

SEQ ID NO: 818 - DNA, 891 bp, Glycine max
  misc_feature (728)..(728): n is a, c, g, or t
  misc_feature (785)..(790): n is a, c, g, or t
  misc_feature (801)..(807): n is a, c, g, or t
  misc_feature (823)..(825): n is a, c, g, or t
  misc_feature (829)..(829): n is a, c, g, or t
  misc_feature (843)..(847): n is a, c, g, or t
  misc_feature (851)..(851): n is a, c, g, or t
  misc_feature (856)..(860): n is a, c, g, or t
  misc_feature (867)..(887): n is a, c, g, or t
gatgcacatgcaccatctatctgaaatgtatctgaagaacactgctcaaatgttcttgaaattggatcatccagtcttggttcatatacctgataaataatagtaatattgaaaacataaacaaaataaagtttcaagttgctccataattaagcttccttaaccagtatatgtagaaaaatactagtgtgtttttaagagctcaatcatcaagttggctagcataaacgaccacttttgtttttaaataagctaaatcaataaatcggctcttcctaattcacatttcactttcaaaagtgctctttgcatgtgcaatttacaaacttgggttttaagtcatcaagctatttattagtgttttagtcaaatcccccaaaaaaaagtcaaattcaaaaatgtattcaatcacagaaacattccaaagtgactatcttttcataaagatatttttttaaagacattttcataaagatattaagtagttacaaataaactattgatatgataaccatgaaacttgatatttcccgctacataatcaaaatataacaactatactaaatcacaatatattatcatatattgtaacagtttataactcttttgagaaacaagagattcatcaatatttccttcaaaatcaaatcttgaacccgttaaatacactccacaataaataatgagattgattgaaggaaaaaatgcaaaacctggttgccataagnatccccaaacgtaataccgatcttatccgcagtgaacttgggcgatgaacaacttgnnnnnntaactaccagnnnnnnncagttcgctgcagtcnnnatcntttaaacacacaannnnnaaancaaannnnnatatatnnnnnnnnnnnnnnnnnnnnntata

SEQ ID NO: 819 - DNA, 1003 bp, Glycine max
ctactgctactccttgtctgaagaaagaaacaccttgtccttagccaatatactgatataacaaataaattttatccacttttattatatatactgtcagtttagttcagtaacaacagaattttatttcatccaggaggataacttctgccaccaagcatctgttagctcctatatccacttttttaggtgggggcagttattacattcacatattttttgagacctaacagaaacattaatacactcaattgaccaagtacagatttaggcctcacctgaacaacaagacacaaggcaaagtcttgatagccagttttgtaacaaagaatggtgcattctgcatttcattttcaatagtgaacttcattcaatttctttaccaagacaaacagttgcattaagataatctgtccaatgttacaacagtaacattgactcaatccctaagaaaactccaaaatcatctctatagagtggttagtgctgacctctgcatcaagcttgatgaacttcgtatcaatatgcattggtgcaagagactttaaatgcttatccattatcctggaaacatttatcgatacaacaacaggcacatgtaaccgtgcacgccagaaattaagagacatagaaagataatgagtcacaaggaattatatttaagtcaacaacatacttgcatctatagaactccctatggtagaagtgacaaatcactttttcacttccagtgacttcacctaagaaatcaccctcggttacttccctgaattccccatgacctttcttcttccattcctcccgtttctctgcttctttctattaaagaaaaattcagttgcaaatagcaaggcaaattataaataacagaagtaaaaacaaaaaattgaatatcatttgcatctcagtacatatggagattcccaccttaagagctgcaatcctatctgcatgcaatttttctaactcaggatcctgacatcaacattgtgtagaccagtta

SEQ ID NO: 820 - DNA, 396 bp, Glycine max
tgggagggagtcaaatggcattgaaccccaaaagaggcaggtttcagaatcagaagaagattaatacatgtttttttttctcattacaacaataaagtcttatccaactaagtgagatcaattacatggatcacatgacgtcatttgacatagttaattattggacaaaattaggttggctagtttttaatgaatgaatgtaatgatttgcacgtggtgcggagttttaattattagttctactaaagtttctagttttgtttatattcttgatttcctctcgctatacataggaaatagacatatttgatgtaaatactaattttcctagcagttgtcttgggagtatagtattatagtacatagttaggaccacgtttatgcttactgacctga

SEQ ID NO: 821 - DNA, 387 bp, Glycine max
tttaaactaggaaatgctaaaattcaaaaagatgcatattgtattttttgatacacccgagcaaagcccctaggaccaatatgctaccatgcagaaggagaattctacgtcccattggaggaaggccttcaccattggtgctgccatatttttcttcttctcttcttcaaatttatctcctgttctatcttcttttacttcctctatcgttggttcttcttgcaccaaagaacttgtccttattgtgtccactagttgttccaaacttgagaggcacaatttgaggaatgtatattaaatttccaggaaagtttcttttctcctttgggatttttcgcaactgcggcaaccagtatgcaacatactcaccttcagggtcatacgttt

SEQ ID NO: 822 - DNA, 441 bp, Glycine max
  misc_feature (273)..(275): n is a, c, g, or t
aaacagatgggttgggccatagcactacacggcggcgccggcgacatcccgctttcccttccaccggagcgccgccagcctcgcgaggaggccctccgccactgcctccaaatcggcgtggaagctctcaaggccaaactgcctcctctcgacgtggttgaacttgtcgtacgtatcatattcatatcaatcactactactccgtattatgtatgtatgtatgtatggtgattgattgatgtggatgatgtgcaggttcgggagttggagaannntccgcagtttaacgcgggaaggggatctgtgctgacttgcagaggcaccgtggaaatggaagcttccataatggacggcaccactatgaattgcggagctgtttccggcctcactaccgtcgtcaacgccatctctcttgctcgattggtcatggaaaacacgcct

SEQ ID NO: 823 - DNA, 353 bp, Glycine max
tcttatccatatactgattgagcggttcctgaagattagcggggaaaacttcaagagccagagacaatcgtttttccttcaccaaacagcgcctatgcaaattcttcacaatctcaagctccaattccctatcgtctcgaaccggaacttgctctgcttcacctaaatataccactcgagcattcatcaacttctcccatatttttcctttctctttccctatcgccaacggttctcctatcaccgtcgcgtcgtaaatcctcgacgttatcacttcctcctcttctttcttcttcggcggctcctccggcgccgccggagccggagccgattccgccgccttctcatccgct

SEQ ID NO: 824 - DNA, 362 bp, Glycine max
ccctcttcttcatcttccatttccatttccaacactgctcaatttggtggcagagcaattgaccgccacaaccccatcatcacagatcctagaagaaccccctcaagagacctcatttccccttgctcttcttctctgtcccccattgaccccaaacctttgcatgatcatctccaaaaggccaagaaaaactccacttccaagccaagtggccagaagaagaagaatgcttcaaagggtcatgatcagaagaagaaaagtgctgctggaaagttgactgaacacatcactaacaattactcctcaaaaccaattgatagcattctgaggaggagttgggctagaccaccttctgatttgat

SEQ ID NO: 825 - DNA, 243 bp, Glycine max
gagggaaggagtagatgggtatgtgtgagaatagaagaagaaaaaaagtcaatcacttcataccaatcaatcaacgcaacgtatctgaaactattttataccattatcgcggtgttgcgagatagaaaatgcaggtcacgacgttctcatgtggacacaaattaaattaaattatatggttcgctgctcccatcaatcaatcatcatgctttcaattcttacaccatttcgtctaggaaacga

SEQ ID NO: 826 - DNA, 590 bp, Glycine max
  misc_feature (25)..(27): n is a, c, g, or t
  misc_feature (38)..(40): n is a, c, g, or t
  misc_feature (44)..(45): n is a, c, g, or t
tgctcctaacattagattagacccnnnaccatgctccnnngccnntgaagtctgaacctcccacaggaatggcaatggagaagacaacattgtttgtgttgttgctgaatgtgcttgtgttcagtgcctctcttgtgtcctcagagcaaagtcatgtctcagctgtaggggacccaggaatgcagagagatggtctgagggtggcctttgaggcttggaacttctgcaatgaagttggtcaagaagctcctcacatgggtagtccaagagctgctgattgttttgatctttcaggtaagccatatcacctggtcctctaaaatttatattagtccagtttatcacatatttggtcctcaatgttgggtcacatattatatatgtaatatgttatgtccactccatattctataatttccttcgtatttttagcttttcaaaattgccaatgtgttttcttctgttgagagttgttgtgatggccaggttctctgactcacaaggtcacagaagctaaaaaaaacattaaatatgttatgtccacttcatattctataatttccaacatattttagtttttttttttaaaa

SEQ ID NO: 827 - DNA, 452 bp, Glycine max
  misc_feature (181)..(181): n is a, c, g, or t
ccctttttgtttcgttctaaagctgtcacctgatcagaaggacctcgttgaccgaagtgacaacactgctgagatgatcaagcacgttgcatttggctacttcagccagagaaatggtctattggtgcaccttgaggactcttaccttactagaatccaatcccctgggacacaccccacntattgggagaccactatgtcaacgaaaattgaggattacaaaatggtggatggtgtgatgattgcacatgctggccattcaaccgtgatcatcacaaggtttggggacaatcttaaaacaggacctgccatcacacggttggaagaatcatggaccattgatgatgttgcgttcaatgttcaaggcctttccatggactgcttcataccccctaaggaactccacaaggactacccacaagaagatctagattggagatcacccttgcata

SEQ ID NO: 828 - DNA, 365 bp, Glycine max
gcgcgatccctctcgccgctggtctgcttccaggttgctcgaacaccccttcattgctccgccgctgcccaaccacaatcagactcctccaaacctccatcagctactccctcctccgccaaggcctcttccctcctagtatgatggatccttctacatgcctattgcctattgcctagctagctagccctgtgtgccgctttattttcattttcattttcattttcatacagaatcaaatcttaatattggattttcagccatacattacagtgtttttcttcttaccataacatgccctgtttgttttttccattctttttctcttttagtattattatctttttcaagccccctcagcctca

SEQ ID NO: 829 - DNA, 650 bp, Glycine max
tttcattgcttccatatcacattttaatgttcttgttttgattcaaaatgtctgacaccattcccttattcatcaccgaaggacaaatttggagttagaccaattcatgacaatccagatgaaatgactgctgctttgtatctacaagtcagtatagttagccaggctttgatatttgtcacccgttcgcgcagctggtccttcatcgaacgccctggattgctgttagtgactgctttcgttattgctcagctggtaagaatgaggatatattccaccatttatgctagaattggatttatgtaactgaaatttgatcaaattaggatgttactattttcattataagaactaagagagaagggtggagtgatatttttgagcttatggtcatgcagattgctacagtaatagcagtgtatgccaactggggctttgcaaggatccaaggaattggttggggttgggcaggagtgatttggctctacagtattgtcttctatttcccacttgacatcatgaagttcgccatccgctacattttgagtggcaaagcatggaacaatctcctagaaaacaaggtatttgcatgatttattcactcttacttgttctggaatggtgaagtttcgatgaataggtttcggatt

SEQ ID NO: 830 - DNA, 177 bp, Glycine max
cgcgtcttcgtcttcgagcgtgttctcgacgcgcttcgtctcggactcaacgcgcgtgacatcgccgagctcgtaaatttctcgccggaagagttttcctgagaaacaaagcaaaaaagaaaatacgaaatccgttaattggcgagatcttttgctggttttgtttttttttttttt

SEQ ID NO: 831 - DNA, 999 bp, Glycine max
  misc_feature (936)..(936): n is a, c, g, or t
  misc_feature (968)..(970): n is a, c, g, or t
  misc_feature (989)..(993): n is a, c, g, or t
attgcgattccgtatttaccgccttaaccacctacttcagctacgggttgctcttcgcctttggccagttcagggatttcttccggaaaatcttcgactggtgcagcgccaacactctccaggttccaagaagattttacattttacatttaatcttataatgataataattattataataataacaacaacgcgttgatttgtttctcagggttacgcgccgatctgcttagggctcgaagatttctacattcgccgtttgtacctccgaattcaggtttctatttcacttttcgcttccttagtagtgaaaaaaacaaaattcgaacattgaattttcattggctcgttcaatcttgcagtgtaggatattttgaacatttttgtgtgactactagatcgcatcataatgtaattagcaatgcaggtatgtgattgtgacttatgaagttttttataattttttttttgtttgttttttcgcaggactgttttgggagaccaattgcaagtgctcctgatgcttggtttgatgttgtcgaacgctactcgaatgataacaacaagacactgaagtataaccctctgtttatttttcagacctataattatgttttattattttattttttctttgaaagggagatgggggaggatttattttctgaaatatcaatttttttattggtgaacagtgatggaaatgatgtttaaagttatgattatgatttcatgcaaactattcaaatccctcaaccactaaaccgacccttgtggattgaattattattattttatttaattttaagttagagctttagcatgagatatttatccgatgcctatttttcatactatttctcctaatgatgcctatttttcatactatttctcctaatgcagacgggctgataaaataagtagatgccttaaagnggatcatacaactatcttggttttgcggcagnnngatgaatactgcacacctnnnnngtagtg

SEQ ID NO: 832 - DNA, 754 bp, Glycine max
ctgtgtctctgaattaataaaatgagaggttttgactgctccacactcaacaggaagaaatgcatttacagtagtgtatccaattttttacccaaaccatagcacaacacaaaatcagttactagtgattcatcttttccttccagttatatgttataattatctagtattcaaaatcaggcagacaagcccatatagatttgtcaataaatatggcacctttctgcaatctctttctcatgattagccatagcagattgaagatcttgaagaactctatccctttcttctgttattgataatacttcattttccacctcctggagaaaattaaggatgcaattggtgattaatttatatacactactcaaacaacgtcttctacaaaatactgatcaaatatactctcagagtttcctctagagctttgagttgttcagaatctttagcagcagccagctcagcatccttcttttgaagaagtgcatgtgcacgaactttgtatgaagaaaattccttctcaagagagctgatctgcagtggtacaaaaacccatgtcaaacagcagacatgtattgtaaatgatgtgtctagtctttgtatgttttgttgccaagagactaatcaacaatcattcaaggatgtggattgaatacaagccatatttccgtaaacacttgtgcctatatgttgtaaatgatgttttgttatgaaatatagagataaaaatatcagattctcttaagtactaacc

SEQ ID NO: 833 - DNA, 356 bp, Glycine max
cgaaaaacactcatcatcatggattcagttgcattaaatggcaaaagcaatgataagcctcttcacgttgccatgctcccatggctggccatgggtcacatatacccttacttcgaagtcgccaagattcttgctcaaaagggtcactttgttaccttcataaacagccccaaaaacattgaccgcatgcccaaaaccccgaaacacttagaaccattcatcaaactcgtgaagctacccttgccaaaaatagagcatctcccagaaggcgcagagagcacaatggacattccgtccaaaaaaaactgtttcctcaagaaagcttacgagggcctacaatacgccgtttccaagtt

SEQ ID NO: 834 - DNA, 373 bp, Glycine max
tctgatctgctcaaggcatctgaatcattgaaaaaggttgtagcatcagtcctgggtggtcagaattgaacgctctacatctttctttttcatctaatgtaccaaaacataagttcgattccatgtgtttaggtgagcaattttgaaatccaggcgatagagaaagtcccgtagttcttaatttgtgtagtattttatgttccagtttagggtaacagtattttgtgcgtgttgctcattggttgtctaaagtagtagaataaggatttattgtttcttgtcatgagttggggaatatacctatgaattacattccgatatcaaaagtatcaatgttacatttttcattcattagccattcaacaataaagcc

SEQ ID NO: 835 - DNA, 351 bp, Glycine max
tcccccgacctcggatctacaccgacgtcaagttcaacgaccaccgcgtcgacccacccgttcccgtcaacgacccactcatgtcctgggcccaagaggcccactggtccatgggcggcctcagcttcaagcgcctccgtctccagggcaaaattgaaggcaatgtcgaaaggcttcgctcccagcgcgagaagttccaggctcaaagcccaagcccaagcccaccggcacgcgccgacctccgcagatccaaaagagctgcttcccctctgactccaccggctccggtcatggcgaaacggcgaagatacatggatcttatccaagaggaagaagaggaagaagaagaag

SEQ ID NO: 836 - DNA, 301 bp, Glycine max
tttacttttgcatcttaagcacaagcattgccacatttcaaaactgatctgaaatataattccttgcattaaccacagcaatcttaagactaaataagcaaagactgtaccataagaaaactgcaccgcagtctattgtttaatggtcaataaaaattaaaacctctggtaaaccccaaagattcactctcagaagataaaatcactcttcaacaacattcactaattcatattcaactaacgaaagattgttatcctctttaacttcaaattttgcagggtctgtaggctcaatacgcaa

SEQ ID NO: 837 - DNA, 365 bp, Glycine max
cgcgctggtaccacctttccccaaaccatcaattccaatcctcccaatttccacaatcttcaaccttcaaattctgcttcacctttcattcatttcacttcagagagagagagaacaaaacagaatgggcgtcgtggtgatcgacggcagcaccgtgcgcgacttcgtgaacgacgaaaccgccttcaccaagagcgtggacgagcagttcacggcgctggacctcaacaacgacggcgtcctctcgcgctcggagctccgcacggccttcgagtccatgcgcctcatcgagacgcacttcggcatcgacgtttccacgccgccggagcagctcgcgaagctctacgactccatcttcgacaagt

SEQ ID NO: 838 - DNA, 868 bp, Glycine max
  misc_feature (647)..(647): n is a, c, g, or t
  misc_feature (677)..(681): n is a, c, g, or t
  misc_feature (712)..(735): n is a, c, g, or t
  misc_feature (739)..(746): n is a, c, g, or t
  misc_feature (752)..(753): n is a, c, g, or t
  misc_feature (758)..(864): n is a, c, g, or t
caaataaacttggtatgaaaaatacctcaagctgtcatatatttcaactgcatttgatataacattatcatcatgtgtgatccatgtacaaaagcttactcctttcttattcaaacgctgcatccaatacagacatcataagttgcacccaacataattctgataggataaactagagaaacagagagaagtagtaggcttgtgtagcagcaataattcctactacagatccaataaaatgaataaattaatgtatttaccaagtatatattgccaaaccagacagaagcaagccacaagacgaggaaagagaggaaaaaacagcaagatcacagaatcatgaatatctattaaggcaagccctgtgaattaaggaaactttgacctccaaaagcaagtgtgattaactatgacttaatcttaggttattaagtgcagcttgattgagaagtgactgtgatagaaacaggaagagtagaaataagggagaccaagttcctcacaagcagaggtacccatttattaaagtgaaaacaaacagatattttgaaccgaaccctccagatcactgattccatattgataacctgcaattcttttcatgaatgtttagccctctataaccacctgccctacatttgccatgntagaatttgttcacagcaacccacttattnnnnnaaatttatcatctcccaatggatgaatgttnnnnnnnnnnnnnnnnnnnnnnnnctannnnnnnncaagtnntcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaa

SEQ ID NO: 839 - DNA, 627 bp, Glycine max
caaccagcgttatgtcaagtaagccatcaatcctgcatacttgataacttttcgtatggtaccattacaaagacggcacatttaggttgccccatatcttcttttaaacaagaaatgtctcttcgctggatctttcggcttgctcttgatctgtccttgttggcctttacgcacagtactgcacggggaagaaagcaatcatgaccaaagatctatttgtatatcaattaacagatcaaggttcttaagatctcaaaaaggaaattcaacagcttgagataaattgctacatagcatacggtattgtttcaggcaaacaaaggataacacacctgtactccatataaaccatcccttttgcacctgacattgcactcatggatccttgagagcgacgggcactctgaagggcaatttcatctgcatcttcatctagttgctctaatccaacttgatcatcaccagcactcaacacctgatagatacacattagttatttggcaatgagcaactcaatcctaagccaaaagggaatgaggatgcaaacctttccaagaagtgccaattgatcctcaagacgatgatagctcaaattaggcccttcatcaggaggaggcaagctagtaa

SEQ ID NO: 840 - DNA, 405 bp, Glycine max
atgacatggatgaattagactctgactttgagcttgatgtagatagcagtggggagatagtgtatgccatataatttaatcatcgtctgcattttagagacagcataatgaatggacagcatcttaatattcaacagggcaatctcccttaatttaatcaaggaaagagaaagtgtggagatcgtatttcctgtaagattggatgatacacaaagttcatcatgttaatttgtatgttgtatacttcgtgaactgccgagggaaggaacatgattcttagactcagaagggttggtggctgagaaatcataattaccctttcctcttttcctgttgaatacttgttttatatcatatatatacactagcctttttgttgtctcttgtcagttatattggtgtcag

SEQ ID NO: 841 - DNA, 362 bp, Glycine max
gatgatctccgccttcgcccctccgccgcaccttctggctccgccggggaccgtggtggtcccggcggcacctccctcgtgggtgtacgtgccaccacgtgccgcgcctcctcccttccacgtgtcagtgtcgcacggttgtgcgttcccgtcggcgcctggcaacagcaacaacaacggcttcagcagcagtagtagtaataatagtaataacgtgaccataacaacgggtgtgaaatctgcgggtgctgggatgtttccctatgttggcgttgtaggagattcttcgtcattagctttgtcaacggtgcaggttcaggcccgggcccaccacgctaggattgatgggccctctttgagta

SEQ ID NO: 842 - DNA, 814 bp, Glycine max
acaatgcctaaagatacaaaacatcagttgactaaatggaaaatccactgtgccatttcccaaattaaaaacaatagatccattcagaagctttactccctcatatttccagtgccaccataaagcaaggattcaactagctcaagctgatgaatcatgaatccaatttctagtattcttttgtcatgacatagtgaaaggaaatataatgttccataaaatgccaaaaaagaaaaacacctgttttaaatgtgtttagtatatgtagatatttcatgatcaccaaacaaaaatgtctgccggctatgatatatcaggaggcccaagagaaataaagttgtcatttcactaacttcctgactgttttcgcatttgacaatatttttatgataaaagaaaccaaggaatttcatagtggttgagatttaggagatatgaaacataccaaggtctacaagatctggtttacttgttgcatccctcacagatttgttacacaatctggtttctgattccagtactgatgaacttgtttcttcttctgacagatttacttcttccggttgttctgtttcatgcccatgttcttcatgcaattcaatgatctcaccggtaaataacttatcagataaatctcgaaataaattggaaatcccaaaaagctctccttgaaattccttgcagtcctgcaaggaagtaaagttaatgtttagagttattttaaaataaatatttagaaaaagcgaagaaaagcaaaacaaaatacgtagaatttggtacctggacaccttcaaaatatcgtttttccatcttc

SEQ ID NO: 843 - DNA, 1242 bp, Glycine max
  misc_feature (436)..(437): n is a, c, g, or t
  misc_feature (440)..(440): n is a, c, g, or t
  misc_feature (442)..(447): n is a, c, g, or t
  misc_feature (864)..(867): n is a, c, g, or t
  misc_feature (878)..(878): n is a, c, g, or t
  misc_feature (881)..(886): n is a, c, g, or t
  misc_feature (888)..(891): n is a, c, g, or t
  misc_feature (893)..(893): n is a, c, g, or t
  misc_feature (899)..(899): n is a, c, g, or t
  misc_feature (901)..(901): n is a, c, g, or t
  misc_feature (914)..(927): n is a, c, g, or t
  misc_feature (940)..(947): n is a, c, g, or t
  misc_feature (951)..(953): n is a, c, g, or t
  misc_feature (958)..(964): n is a, c, g, or t
  misc_feature (969)..(971): n is a, c, g, or t
  misc_feature (974)..(977): n is a, c, g, or t
  misc_feature (981)..(983): n is a, c, g, or t
  misc_feature (986)..(991): n is a, c, g, or t
  misc_feature (993)..(999): n is a, c, g, or t
  misc_feature (1001)..(1003): n is a, c, g, or t
  misc_feature (1005)..(1012): n is a, c, g, or t
  misc_feature (1014)..(1016): n is a, c, g, or t
  misc_feature (1019)..(1027): n is a, c, g, or t
  misc_feature (1029)..(1031): n is a, c, g, or t
  misc_feature (1033)..(1034): n is a, c, g, or t
  misc_feature (1036)..(1039): n is a, c, g, or t
  misc_feature (1044)..(1047): n is a, c, g, or t
  misc_feature (1049)..(1052): n is a, c, g, or t
  misc_feature (1062)..(1067): n is a, c, g, or t
  misc_feature (1099)..(1102): n is a, c, g, or t
  misc_feature (1124)..(1133): n is a, c, g, or t
  misc_feature (1146)..(1147): n is a, c, g, or t
  misc_feature (1164)..(1169): n is a, c, g, or t
  misc_feature (1173)..(1174): n is a, c, g, or t
  misc_feature (1178)..(1182): n is a, c, g, or t
  misc_feature (1184)..(1187): n is a, c, g, or t
  misc_feature (1195)..(1196): n is a, c, g, or t
  misc_feature (1199)..(1199): n is a, c, g, or t
  misc_feature (1203)..(1208): n is a, c, g, or t
  misc_feature (1212)..(1221): n is a, c, g, or t
  misc_feature (1224)..(1224): n is a, c, g, or t
  misc_feature (1226)..(1227): n is a, c, g, or t
  misc_feature (1232)..(1233): n is a, c, g, or t
  misc_feature (1237)..(1237): n is a, c, g, or t
agatgcagcaaggaataccaatgcaaaaacgatgggacctgtgccattaccaaccaagaagcgaatctactgtgttcttaaatccccacacgtacataaggatgctcggttccatttcgagatcagaacacaccagcgtctcattgatattctataccctacagctcaaacaatagattctctgatgcaattagatcttcctgctggtgttgatgtggaggtcaagctctagagatatttgcttttcaggttgctaaccattttgaatctgagtgaggttcaacttgttatatcaatggccaaaatatattggcagatatcatgtatttcactgcctaaacttgatttcaatgaacaatgttaaaatccttttgcttgcttcccccttttgtccccaacaaggtttcaattagtgtattcctgatttcctgttctnngcntnnnnnnaacaggaaatcaggaatacactaattgaaaccttgttggggacaaaaggggaaagcaagcaaaaggattttaacattgttcattgaaatacatgatatctgccaatatattttggccattgatataacaagttgaacctcactcagattcaaaatggttagcaacctgaaaagaaaatatctctagagcttgacctccacatcaacaccagcaggaagatctagttgcatcagagaatctattgtttgagctgtagggtatagaatatcaatgagacgctggtgtgttctgatctcgaaatggaaccgagcatccttatgtacgtgtggggatttaagaacacagtagattcgcttcttggttggtaatggcacaggtcccatcgtttttgcattggtattccttgctgcatctaannnnccttgctgtcnctnnnnnngnnnngncttttncntttttcccccccnnnnnnnnnnnnnnccttccctccccnnnnnnnnttcnnntcctnnnnnnnccctnnnacnnnncttnnnctnnnnnncnnnnnnntnnncnnnnnnnntnnnttnnnnnnnnntnnncnntnnnncccannnntnnnnttttacattnnnnnnattccacctcccttcccctttttttttttctnnnnctcccaccctctcccctttttnnnnnnnnnncctttttttttcnnctactttcccccattannnnnncccnnaccnnnnncnnnntacccccnncancctnnnnnncctnnnnnnnnnnccntnntcccnncttntccca

SEQ ID NO: 844 - DNA, 382 bp, Glycine max
tcattaaccctgatcctggcggggatgccactgatgaaagcaaccaacttcttcgatgtcttggctctcacgccaatgtgccaactctggtaatagccaggaacccgcaaagcccaacttagaaattccttggaatagttgaacctgaacatgttctcatcatcctcaacatagttattcttgagcagaacataaacttcatcacagatttcctcagagtccatgtcacatgttgtccactcataagcattaggaaggttgtaaggctcctgcttgacctcagataaaggagttgggggctcaatcgggccctcgggcaaactggagtccccaacatccttgtattgccccacaggctgagtttcccagaacttgtgtctca

SEQ ID NO: 845 - DNA, 732 bp, Glycine max
gcggcgccggccctaccgccgtcgccgtcattgacgacgagcaaactggacacttcattgccaaacacatgattgacgcttttctccatgttggcaatttgaaggcttctgcaaatgtcaagcagcttgatcgccttggtgctagacgcattccaaattgaaccttctcttctctatctctatggtacgcttcacttctctaccgcttgtgtttatacttttactttcctaaggctatgattttgcccaatcttcacttttctcctaccgagattcatacgacaaccaaggccttttctatttctaatcttctcagtttattgctacttttttaactagccttaggatttcacaaggtctacctttatatattcattattacttctttcttctcaactcgcccccattcatttcttttctaagcttcttgaaattgattgtgattttctaattaaatgcatctcacggccttttcttatttgtataaatgtttttaacaaacaacatggttggttgacaattttgtatcagctactgaattctaatttattatgcttgccagagaggcttgtagatttcaagaaccggatttcttccaacttgctcgtaacactctaagtgctgaccggtcacatgtattttgaaatttgatctgatcaatgaagcagcattctagtgtggaggtctgaataacaagagaaacattaaacccaagctgggagctctgtttgg

SEQ ID NO: 846 - DNA, 602 bp, Glycine max
  misc_feature (522)..(531): n is a, c, g, or t
  misc_feature (585)..(585): n is a, c, g, or t
ggtcccaaacaaggtccccctggtaaacaccttatctcctcctacagtgatctcagtgtcaccttggatttcccttcttccaatctgagcttcttccttgttaggggaagcccctatttgactgtgtctgtgactcaaccaactcctctttcaattaccaccatccattccattctctcattctcttcaaatgactccaacaccaagtacacctttcagttcaacaatggtcaaacatggcttctttatgctacctcccccatcaagttgaaccacaccctttctgagataacttctaatgcattttctggcataatccggatagctttgttgccggattcggattcgaaacacgaggctgttcttgacaagtatacttcaataccttagcctcacatcctgtatcaccctcactccttagaacatcctgaaaacatagggggggaaaacacataagagacaaccttaaaccaagacaaaacattgaattcattgaacagctagtacctgtagaataaaatnnnnnnnnnngtggtttaaggtgtggcaatttgaggacgtggaacttgtgggggatgttgattnggattctataaaatctt

SEQ ID NO: 847 - DNA, 376 bp, Glycine max
cagaagttgtagtctcttctcgactgtgttcatgttcattaaaaggcgtaaggtacagtgatgaatcttatacagcatcgctatcccctgtacaatcttatataaacaagtaacttatattcatcactttgatggctaatttatttaaatgcctacccgtcccttgaccctccagaaaattaaaatctaggaatgttgcatttgtaaatccaaaaactagaggaacatgttggcaaccaagaatatgtaatatccatgtcaattgcgagttgctaattccatcaattggtgcattgagaatttcattcaagattacaaaactatgaccaccttgtgaggggaaacaaatcaattacgaactgtcgaactcattgtg

SEQ ID NO: 848 - DNA, 405 bp, Glycine max
acgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcgccaacgcgagctccgccgcacccagcttgtcttttacaacgacgacgccacccccgcagccgtgtcacgtggcctcgacgccgccatccttgccacactccccgtcttcaccttcgacccggaaaaaaccgggccggagtgcgctgtttgcttgtcggagttcgaacccggtgaaacgggtcgggtcttgcccaaatgtaatcacagtttcc

SEQ ID NO: 849 - DNA, 714 bp, Glycine max
ttttcacataataagaaagacttgggtattaaatattattacttgtgcaggcaagaagggctttgagggcattgaagggagtggtgaggattcaagctcttgttcgggggagacaggtgaggaagcaggctgcggtgacattgaggtgcatgcaggccttggttcgtgttcaggcccgagttagagcccgtcgtgtcaggatgtccatagagggccaaactgtgcagaacttgctcaatgaaagacgcagtaagcttgatcttttgaagcaagctgaggtatcatccctcacttatgcaaatatgcaatgcaagcttgtgtttcagttacatacagtggcgtggcattatatatatctaacacaatctgcaggaaggatggtgtgacagcagaggaacgttggaagatgttaagacaaagatacaaatgaggcaagaaggagctttcaaaagggaaagagcaatggcttactctcttgctcacaaagtaactatatctgcttgcttctgttgtgattggggtgaccctttttgttgaagtggcatcaactttaactccaaattaattctagattcagaattatttctttaatgtaaagacatttgcttaaaatcatgttaattgacatttcaatgtcattctaaatcatatatataatttgaattcaaacaggctataacaaagtactataaactaagccactttttttctagt

SEQ ID NO: 850 - DNA, 360 bp, Glycine max
cgtaaagagaacttaaaattggtcagtttacctggcttgaaactaaatatcgtatacatcaattttgtaaaaacaaaattaaaaaggattgacaattggtggatataagcaaacattagactgcctcagtcactatgctttcagctttccgctcatgccacgtttagtgggccaaatacaagtgacagaatttttcttggctgcaactgaacactgatcactccgaccacttttattgctcagctctgtttgaagcttccgtcgcctcattctgtgctctaatcgtattcctcttaatgctcgggctctccgttcaatttccaaagcttccgtgaaattccagatcctgacaacaccttc

SEQ ID NO: 851 - DNA, 497 bp, Glycine max
ttacttgagaaagttaggcgtcatagagttaatattgatggcaatgtttgtactgtcatggtgacaaccttagttcttgaggtaattacttcattttatcatgtatgtgaccatacatacaaacaatagcttattaccttacaacaaaggataaaaaccttttttgtttaatttgtagggttggcagcgaaaacttgatcctgggtacaatgtgatgcagacattgcagacattgctacttagagctgattgggcaaagtctctttcgtacacaattgacggactcatggccccttagggaggaggaagtttctttctttgttgaggctctctcttgagaaacaattttgactaacataaaaacccaaaacaaaaacatctgtcctaagggctctctcacatttgtttttttatttaatttttttaaagatttatcccttgtatttatcttggttaatttccaagttatttttgtgagcgtcacagtttacaacaaa

SEQ ID NO: 852 - DNA, 391 bp, Glycine max
ggtgttgatgttcaatcctccggtaaagatttcatttgtaccattcatagcaacacaaagttgaaaaacataaagcacaatattgctgactgtggtgtttctttaacatcttttgctaagaagtactacgtgggtgcaaaacttgaggatactgtgtttgttgggaagagattaaaatttgttttgaatgctggccgcatggaaggtgcaggacaaatggcatatggtgggagttttgaagctaatttacgaggggatgattatcctgtaagaaatgacaatgtaagcttgacgatgacagtcctctctttcaataaagaaatggtgttgagtggaagtttacaatccgagttcaggttatctagaagctcgaaagcatctgtaagtgcta

SEQ ID NO: 853 - DNA, 793 bp, Glycine max
catcaatcacctttgattggcaaacagtttagccatgcaggaactacctgcaaacataacagaacattacaaaaatattaactatcatctcaacctaaaaacaacaaaacagactcaaagaattgatcataataatgacaaacataatgaagaatcaaaaccacaaaagcaagttataaacagggaaaatatgtactgacctgggcagaatcaatactgtcacgatgaaattggcaaatttttcccagagcggaaacggcattgtcatatgccattacattatctgaatgaagagcattaggatgctggatcacagcatttaacctcaaaagagcctctgcagtaagccaacaacttgttactcaatataatacagctttttcctagtttattaacggatcaagcagtacctccaaccagaggtttgaacacagatccaccaaactctgcacaaacaccgagaccatacacagctgcctgcagaaatatgaagcaataccaaaatcaacaatcaatcagcttaaacactgagatcatacacaggtgccctaatgcttacctgtctgacatcaggagtctcatcattacaagcctccaacaggaatgggagataggtatcataatacctgctcaattggtatataaaagaatgaagttgatgacatgccttcataataatcactgcacaataaaatggtaacctagcaaaacaaagagtgcttacttaatagcagcttcacgacactgctctgcaacatcatcaaaaatacaaattgcaattcttctctcttca

SEQ ID NO: 854 - DNA, 412 bp, Glycine max
gttggcgttcgccagcagtaagcctcaaagtttttctgagctaaactgattcatgttccaatcattcattattctgagcatagcctagaaacttaagaaaccttcatgcgaagcagaattttgacacgggggtataatggtatatccgcttgatatatgcatatcagataatttaagtacaaagaaatgatagtataggcacattactggatgtattcttatttttttgaactgtactttattagtatattgcagtgttgtatatttttaacaaataaaaggatggggggtgggcaccaaaaaatgtattgacgtgtttaaatccttgaaagtcaagaatcagttttcctccgccaactgttggggctctgctggtccttctgttgcaagattcaaccagaaagtgaccgta

SEQ ID NO: 855 - DNA, 733 bp, Glycine max
atcattcacctcgttaccaagatccccacagaagagccgataatcatctaatcatccaaaaatgaaaaaaagataaatcaattcatgattaattatctaacttcaaaatcacaatcacaaattccatatagactaaacacacatacaatccaactcactaatataaaactgatttaaattttgaagaataatagatgatctttaacaacacaagcaaattttcaatgtacataaaattaaatactgaataggaatgagtacatcataatcataatgatcataccttctggccactctgcaaggataggatcctcccaagcgtggccagcagctttgcgaggaaccgctttctttttggcatcggttttgtgctccacgtcgctgcttgcaatcgctgccttgacattctcgagagcctccggcgttattatctgcgcatccctctcaaataactgctgtgcctgttcaatcacacaacaaaattcaatcaacttaaatcccatttttattaatcaaaacaaaatccaatcaatttacgccactttctcgaaaagaagaaaaccacggacctgatattgcggcacggcggagtatacgccgggtacaggggcgggcgcaacggggccgacgactggaggagcggggatttgcacggagggggcggcgacgtagggcgcagcgtagtgagtggttgcgggttgctgaaggtgaaagggaacggggaagtaggagg

SEQ ID NO: 856 - DNA, 500 bp, Glycine max
  misc_feature (316)..(316): n is a, c, g, or t
  misc_feature (319)..(322): n is a, c, g, or t
  misc_feature (326)..(327): n is a, c, g, or t
  misc_feature (332)..(334): n is a, c, g, or t
  misc_feature (348)..(349): n is a, c, g, or t
  misc_feature (387)..(388): n is a, c, g, or t
  misc_feature (409)..(414): n is a, c, g, or t
  misc_feature (416)..(416): n is a, c, g, or t
  misc_feature (450)..(451): n is a, c, g, or t
  misc_feature (466)..(468): n is a, c, g, or t
  misc_feature (471)..(472): n is a, c, g, or t
  misc_feature (474)..(476): n is a, c, g, or t
  misc_feature (480)..(480): n is a, c, g, or t
ccagatgctatagtgacttacgagggtgagcaccgtcacgttcttccgttaactgccgctgccggcgttagtttcggccattaatagagttgagtaatcgacgtcgtcgtttcggaaacctgacgggggacgttagatgaccgtcggatcgtgacggtaacggcggatgcgaacgaggttcggttcgtggacggaaaaaagagggaatgaaactatgaaagccaacatttgcgttgtggtctttgacggagtctcttatgttgacgaggacttttgtgtaaatttgacccaaagtaaagttagtacaggtctcganaannnnagannctccnnnaaagaccgcaacgnnagtgttggctttcatagtttcattccctcttttttccnnccacgaaccgagcctcgttcnnnnnngncgttaccgtcacgatccgacggtcatctaacgtnncccgtcaggtttccnnnacnncnnngtcnattactcaactctattaatg

SEQ ID NO: 857 - DNA, 439 bp, Glycine max
ttgtgcttatgataactggtggacaatttctttcctatctcataaatcttgctttcacacaggttattttgccatgctttgctttttcatcacttttcattaaacagcaataatatcaattatccagcattgttttgtatcccattaaacaagcctgctccataaaaggtagaattcagtttcttccaagtgggcgtgcatgtgttcattgttccacctgtgatttgaacttcatcactcctccttttgctccaatttcacatgattagtgtttctttttattgcccacatccattttctaatagaatcaacaattcaacacttcaagtcgtgaacatctctaaccccctcaatataaagatttaagaaaaagaaaataggcaaagcagagttcattatgaggagaaatgttatcatcttcctgtttcaaagttgaggg

SEQ ID NO: 858 - DNA, 729 bp, Glycine max
  misc_feature (387)..(387): n is a, c, g, or t
  misc_feature (393)..(398): n is a, c, g, or t
  misc_feature (400)..(419): n is a, c, g, or t
  misc_feature (423)..(427): n is a, c, g, or t
  misc_feature (429)..(435): n is a, c, g, or t
  misc_feature (447)..(454): n is a, c, g, or t
  misc_feature (456)..(463): n is a, c, g, or t
  misc_feature (465)..(495): n is a, c, g, or t
  misc_feature (497)..(506): n is a, c, g, or t
  misc_feature (508)..(508): n is a, c, g, or t
  misc_feature (511)..(531): n is a, c, g, or t
  misc_feature (536)..(547): n is a, c, g, or t
  misc_feature (549)..(552): n is a, c, g, or t
  misc_feature (554)..(559): n is a, c, g, or t
  misc_feature (563)..(577): n is a, c, g, or t
  misc_feature (581)..(583): n is a, c, g, or t
  misc_feature (585)..(605): n is a, c, g, or t
  misc_feature (607)..(616): n is a, c, g, or t
  misc_feature (627)..(644): n is a, c, g, or t
  misc_feature (649)..(652): n is a, c, g, or t
  misc_feature (656)..(663): n is a, c, g, or t
  misc_feature (679)..(683): n is a, c, g, or t
  misc_feature (687)..(689): n is a, c, g, or t
  misc_feature (699)..(701): n is a, c, g, or t
  misc_feature (703)..(721): n is a, c, g, or t
cttgatctgaggggaaatcagttaacactattgcctgcttcttttagcaggttggtgcgtctagaggagctcgatttgagttcaaatcagctttcagcgcttcctgactctatagggtcgcttgttagactaaaaatattgaatgtggaaacaaatgatatagaggaacttccacattctgttggtagttgttcttcccttagggagcttcgcgttgactataaccggcttaaggccctgcctgaagccgttggaaagattcagagcctggagattttgtctgtgcggtacaataacatcaaacaactacctacaacaatgtcatctctaacaaacctcaaggaacttaatgtgagtttcaatgagctcgagataaagcagactacnaagatnnnnnnannnnnnnnnnnnnnnnnnnncctnnnnnannnnnnngggggggggggnnnnnnnntnnnnnnnntnnnnnnnnnnnnnnnnnnnnnnnnnnnnnnntnnnnnnnnnntntcnnnnnnnnnnnnnnnnnnnnntgccnnnnnnnnnnnnannnncnnnnnnatannnnnnnnnnnnnnncccnnncnnnnnnnnnnnnnnnnnnnnntnnnnnnnnnnacttcttttannnnnnnnnnnnnnnnnnactannnncctnnnnnnnntattttttttttattnnnnntccnnntcctcttctnnntnnnnnnnnnnnnnnnnnnncattctac

SEQ ID NO: 859 - DNA, 804 bp, Glycine max
  misc_feature (734)..(736): n is a, c, g, or t
tttgggctgcaggctgtatatttgctgaacttcttcttcgtcgaccttttttgcaggtaaaaatgatttacatgattgatattctgaagtagatgggttttgacatcaactgtggttcatttattgggacatgttatccatttaactttatcaactagttgaaattaatttcttgcagtctgaaaatcctaaaccattcaaagctgttttaaccgagcttgaattagctctgaagcaataggctatggtatttttatgcattgatgacggtttattgggcttctatttattcccactctatattttgtgaatagctggttttaatataatttccaagatttaaatgcaattcattgcattggctgcttttcttcatttttattttatacttggattattaagcatgtttcttatgggtttttcatcagtttgttattatcacttgtagggtacaagtgacattgatcaattaggaaagattttttcagcatttggcactccaacggcttctcagtggcctgatatggtatacctgcctgattatgtcgaataccaatatgttcctgccccccctctgcgttctttatttccgatggtaactgatgatgctttagatctgttgtcaaagatgtttacatatgatccaaaagctagaatttcagtgcagcaggcactagagcataggtacctgccttcagcatcccattaatacaccaatatttattttttctccnnnaattaatctctcctcttccactttaggtacttttcttctgctcctctgccttcggatccagacaagct

SEQ ID NO: 860 - DNA, 370 bp, Glycine max
tttatgcaagcacttaaccatcaatgttgggggaacaccagcaaagcccttcccatcaccaaataatgagtggcgctggcacccactcaatggatggtctagaacataggctgctacttccctgaatgctccttgaccaactcttgtacccttttttaagccttcaccatctaatgacaaaggaagacctcgagggttattcacagccattggttcttcatcaataggcttaaaaacagacacatacttttgctctgctgaatcaagcataaagtaagctcctcctgtaccctctgcagatctgattggatattttccactgccaagtccctcatatgtagagttcaccatattccaaatagctggagaa

SEQ ID NO: 861 - DNA, 779 bp, Glycine max
ctctctgccacccggctgccaaggagacgaagaagtacagaggcaagcatgtatctcatgctccttgcagaagactccctgcaaaattgaacatctagctaaactacctctacaacagcctacatttgatacactaatgtggcatacattaaaacaagcatattccttcatagcaccaatatccatatttcacttctgaaaaggacaagcaaaattgatttccagcactcaatgaactatgttcaatgcaagtagttggaaaccatgataaaacagcagatggtagataactgtattgttgaaaatgttcatattgcaactatatccatttttatgcatttcaagaaaactgaaaatggtgtagtcttttacccccacaattgttaactatataaacatgtttcaagaaaatctcatacaacttatccaatgaaaaaagacaacttcagtgcagcaacaacccaggaaggaaggagaaagtatctcagaatggcatagtgaataattagaaggttagaagaaatatagttcttaattacccgtctgagcaaagaataggaagaaatctcatgagtaactgcacacgtaaagatattgatgctcgcaaagcagcaggagaaagtggagaagaatctggtgcaggtgttggtcgtctggctaacccagggctgccacctcttatagttttgcggctatttactttatttgtctgaccttcagtcacaggagtacttgctgttggcttacttggtcctcgagtaactaaagttatttgtgct

SEQ ID NO: 862 - DNA, 1121 bp, Glycine max
  misc_feature (506)..(512): n is a, c, g, or t
  misc_feature (525)..(526): n is a, c, g, or t
  misc_feature (548)..(551): n is a, c, g, or t
ttattatgcattagcaattcttccaataaattcaaacctgcatatttacttgctgacggaagattaaagagggcagggagggctaaaaggccatctacttcaactggtggacaaattcctgcagagagcaatggcctgactagccaggattcatataaaaacagcatgctcacagcatcaatcattgctgtgggagatgagattctgtaagtacctcgatatcacatggatagtaggattttgtgaaatttattggaaaactctatcttgcatgaactagcattagtatgccctgctttataattttccattgggagattttcacaattttatcagactatttacccaggtttctagctttggtgtatcaatttgctatggcttaactattgttgaatttcttgattgtgtgattgatgacttgttgtcgttttgctgttcttcctatatgttgacatagacactctttcattaatcttgaacaaacaatatcctttttttatgtnnnnnnngtaaacatctcannaatcaaatttaatttttctatnnnnatttgatgaaagaaaagatttaatgaaaataaatttaatttcttaaaaagctatcatgtcatgttgtgtagtgaactcattaattttttatgatcctttaactgtcttggtgatgttctctttttctttactctgttccatagctcaggtttggcaatcttgaggatctgttgggaccttatttgtgtaggaagctgcattcaattggttggtctgtgttacaacattattctgtgcacaacaatgtgagttcttttttgcagaagtcctacatatgtttattcaaactgttctgctttgctgccatcagcaactgaaggtgttattatgagtctgttgatagtgacccccatgaaaactctaatttaggcattgttctcctaatattataatttcatggtttgtgacttctgtaccagatagattctgtggccgaagaagatgagagacaaaaatctaaaagtgatatggtaagatacacgcttagattgtattctagccatgaattcttgatgataaagtgatggttcaggatatttacctggcctactttttgtaggtatttatata

SEQ ID NO: 863 - DNA, 479 bp, Glycine max
  misc_feature (57)..(60): n is a, c, g, or t
actgcctccttttccctattaattctaccattaccagtctacatctctgactataannnntttgcaggtagatgattaaaaccggccttacatgcatgccctgttaatcatagctcatcatgaccttcagattgctcagtaaccgtctctttgcttgtgccttctgaactgttgacggatgaatcacttgaagaggaactatcagctgagttagaatcagaattctctgtattctgctcactgctgctctcagtttctttctttacaggcttctgaaccttagggttgggcttgggaattctattaatactggcaacctgtaaatgtacatcaacaaaaaatgacactgctttcttagacctgtaaaatcacatgcaattacactgtcttgtgatttagacaagtagaagagacgagtaccttggtttgcagatcaagcaccttcagatatacttcttcagatgtaaatgctggcttac

SEQ ID NO: 864 - DNA, 258 bp, Glycine max
  misc_feature (11)..(11): n is a, c, g, or t
ttcttttgtanaaccctcatattataagctgatccaggattagctatttggaatcaccaaatatataggatcattccaacatgggtttttcctcaaaagaagagaagtccaaaagaatattgaggggcttgaagactctgttcttcttgatcactatggttatatcgcttcttcttttctctgccccggttctccttgttattgccgatgcacttgttccttctgctttgctctccacgctatctccttcttctttct

SEQ ID NO: 865 - DNA, 626 bp, Glycine max
  misc_feature (293)..(294): n is a, c, g, or t
  misc_feature (431)..(432): n is a, c, g, or t
  misc_feature (459)..(460): n is a, c, g, or t
  misc_feature (470)..(470): n is a, c, g, or t
  misc_feature (477)..(478): n is a, c, g, or t
  misc_feature (480)..(480): n is a, c, g, or t
  misc_feature (486)..(488): n is a, c, g, or t
  misc_feature (490)..(492): n is a, c, g, or t
  misc_feature (495)..(495): n is a, c, g, or t
  misc_feature (511)..(515): n is a, c, g, or t
  misc_feature (523)..(535): n is a, c, g, or t
  misc_feature (538)..(543): n is a, c, g, or t
  misc_feature (546)..(548): n is a, c, g, or t
  misc_feature (550)..(550): n is a, c, g, or t
  misc_feature (561)..(563): n is a, c, g, or t
  misc_feature (570)..(572): n is a, c, g, or t
  misc_feature (589)..(593): n is a, c, g, or t
  misc_feature (595)..(598): n is a, c, g, or t
  misc_feature (603)..(605): n is a, c, g, or t
gaattcaacaacctttctttcaaaacaccagcaacattcttttttcccacctttgtcattgccaaataacaactaggcatgcaagttcctcatttcataactacaatctctataaagattgagagcaaattagcataattttggtcattataaaaatggtgtttctagccaaccaacattcagtcaggatatgtacacaaatccattggatctttcttcttcccaaaagaagtgcttgttgtgtataactgtaattaattagtaacactctttagtcagcatcacctcccaannctgattgatcagagtatggacagctgggttatgaatgttgttcctattagtggtccaaacaccttgcctgtcatatatgaccgtgggctgattggagttatgcatgactggtattttattgaacttatttaatattnnattaaacacatacttaatgacctgtannaatattttgncaatgtnncngtgtcnnnannntgnaaaatttctcttaagnnnnnaaattcannnnnnnnnnnnngannnnnnccnnngnacctatgattnnntgcatgnnnccaacctgctttctgtnnnnnannnnccccnnntcccataccctctttaccccc

SEQ ID NO: 866 - DNA, 423 bp, Glycine max
gatagagcatttaaggccgttaaggaagatgggaaagttgtgacaatagtaccacctggacatccaccagctatgtttttcgtgctcacctcaaagggatctatcttagagaatttaagaccttactttgagagtggtaagttgaagcctatactcgatgccaagactccagtgccattttctcaggttattgaagccatttcctacttagaaacttcaagagccacaggaaaagtggtcgtttatcccataccctaaccacaatatattattaactcatcatataattataattaataatgaacattaattttaaagtgtgtactaagataattgatcaattaattaaggtttgtgtcaaacaaagtcccttgtactactatgctttatgtttatgtatacaaagaaaccttgctgctgaaa

SEQ ID NO: 867 - DNA, 922 bp, Glycine max
  misc_feature (24)..(25): n is a, c, g, or t
  misc_feature (65)..(65): n is a, c, g, or t
gtcctcgctaggggtcatgcatannggaccttaagcctgagaatttcttgtttgataccattgtngaggatgctaagcttaaggccaccgatttcggcttgtctgttttttacaagcctggtgggtttcttttctttttatttctaattaatcatctgtagggagatagatgtcagcccttaaatcacaattttttacctctcacccaagggattttctagattaggcttggtgttgtgtgagaatgaactggattagtttatctgtgcagggttaaaatgggtaaaataaaaaacaaggaaagggagctctaatggataactttttaattccaacattttcttccattgttttggtgtcttaacgcatgactcttttccttttctatctgctatacaatagctatatatgtgccactgattatcatgtggaacctatactcggctatttaaaatttaagtacaagttatgcagtctcatcttactgttacaactctatttttctacctttgttggatcaactggaaatgcttacatgctagctgtatatgcccctacgcctaacaccttaagatacttttcaggtgaatccttttgtgatgttgtcgggagcccatactatgtcgcaccagaggtcttgcgcaagctctatggacctgaatcagatgtttggagtgcaggggttattctgtacatcttattaagtggggtgccaccattttgggccggtaattatttgctatttatatgttcaattatcatcatatttgtggtttcttcattgatattactgatctgcatattattaccttcagaatctgaaccggggatcttccgacagattttactaggaaaacttgattttcattctgagccttggcctagcatttcagacagtgccaaggatctaatcggaaaatgc

SEQ ID NO: 868 - DNA, 703 bp, Glycine max
ccaaaggccaataaattaaatcatggtcctatttagatacacttctcaataaatatttataaggaaagaaagaaaggtaaaataagtttctcctataagttatgctaagcacttatgcataagctaatttatagaagttgtcatttagcttctctaaaagcaaattttaaatttaaccaatgcataagctataattttaacttatgaaagaagcttaactcattttaccttctcactttcttctcatattagtacttgttgaaaagcttaacaaaacaggacctaagaaaagtttaaccaaacaggacctaagtacacaaaaatatacaattgcaaactgaaaccacaacctaccattttttttctttttatcatttaaacttggggaggggaatcaggctctgaaccacaaagggaagcatatgacattgtatcttccttagatatagccacaaagttcagaggtgcagtagacaatcttctcatttccttaaaatatccattctgacggccagagtaggaccgcggtgtcagtagttcagatgtcgttccaccacttaaagagttacggcgaggtgtaggaggcatagatccatttccatttgcacggtaactattagtctttctaaagctgttattttttcttggactaggtttagaaccatacatggcttccttttgatttaggagtagatcttgcatc

SEQ ID NO: 869 - DNA, 951 bp, Glycine max
ttttgtttctcttatcagtcaattgtttgcaatttcgtctgcatattcatgtccaaggaatgacccttttcatctatagatagaaactgttcctttccattattttgctgaattccatacttattatgatctatacttcttcagctaagttttaggtgcaaatgcaatgtacatatcccttttgtatcttcttgtgcaactcttggcaattctgtattaagttctctttcctttgctatcaaacactttgtctgcttttactaccctagatatacggggttaagttagctacccctatttgtaaagagagttaacaaccaagacaaagccagtgtgaaaaaagagaggcaatattgcaaagtcctcctctatgttaatattagaagctgcataaacttgataggggctttttatgcgtttgaaatttgagacagcaaggctattgccctttagctggaacacagcttaaagggttgagtgtctaatttttcattaaatcattgcttacatttctcctgccaaaagttttgaaaattcaaccagcaaaggtataaaatgttgttataccgtatatagcaactacgtatattaacttaagccttaagagcacatatcttacattcttaccatagagatcttttgtagcttaactattatgttataggttttgttttatattttttaaattcttgttattatgcatttttaatttaatttaatatattggtaatacattattcatttgcttcagtcactgggtgatccgctggataagagcgcatatattgaagctggagatacatgatgtggtatcaaccttttgcatccttcgcctatacgctgctgctggtgttttcattacattacttttagcgtgctgtataattgtatatggatcacacatccttgtaaattatggttgactacagaccacttgcatttttattaacg

SEQ ID NO: 870 - DNA, 318 bp, Glycine max
gcagcagatgcttctactaatggtcctgtaaatgaggtatctccagcaccagcaccagcaccagctcaagggaacacagcatcagcattattcccaatttcagctatctccttgtttgttgccatattggtagccacattctcaggcttctgagaggagtttcgttccattttaaagtgtagagagatgacatgagggattattattattttgatgttttctttgggttttaccattggagagctcttcttcattctatgtttgacttaaaacttaaaaagtagataacattcattctgggagtgactcgaatatata

SEQ ID NO: 871 - DNA, 725 bp, Glycine max
gtgtgtttgagcaaattaactatggcttcgttttgttctagattgacaatttgtttggctctgtttgtcctcatatgggggagtgccaatgcacaactttctacaaacttttactaccattcatgtccaaacctcttctcctctgtgaaatccacagtgcaatctgccatatctaaggagacccgcatgggtgcttctctccttcgcttgttcttccacgattgctttgtcaatgtaatttatttgcaccttctcccacttacatacaaatatgctaagcttacatatagctcctctttctaccacttgcatgcatcatctaattttgtttgaaacaacacttgttccttttattatacacatcatctttgataaaattttgtcgtgtgcaacttttttttagtgtgttaatcagttctatgatgatactattagttaagaaattttaatgcacttaataaaccattttaagtactttaaccgttcaatgatattatatatttaaagataataaatatttctgcttttgtttctatattagtgtagttaagaaccttcttacttcttagctagctaaatattaatgagtaaacattaacaaatgcagggatgtgatggttcaattctattggatgacacatcaagcttcaccggagagaagaacgcaaaccccaacaggaactctgctcgtggattcgaggttattgacaacattaaatcagccg

SEQ ID NO: 872 - DNA, 860 bp, Glycine max
ttctcttttgcttatacaaatagtagagacttgagagcaaaccaacaacaaaaaaattaggcagagcctgtgttctcagacttttcagtctccattggttcggtagatgctggtgcagcctgactactgctattcccagcattctcattactgttgacatcagaatccccctggggttgctgttgctcatcactctgagaagatggggttgctggtcctgctggagtaactgcctttgttggcttctgtgttgtcataatcggcttgcagaacctattcaaaaaatatgtatttttttaaacaggaaaaaggaataatgaagagaactcaagatgttcttaaaaggttcacaagtgacagctaatccttccccaactagactgatttataagaatacattaagcaatgccacagtaaagggataaccaacaaagtctaagataaatgtgtttttaattctgtaaatataacttcattttactccttaaaaaaattactgattttggtcctcacaaattttataaatttttaaaacagttcttcactacttggcgatctgcatcatgtcacctataaataattactgatgtgacatcataaataagaactatttttaaaaaaattaaaatttatgagaatcaaaaccaattgaaaaatatgtaaaaatgactaaaaccaaatgcatcagacatatagacactaaatatatacttaagccaaatgatgtctaaataacccaaaaactacatatccaaagcaagaatttaaacaaatacctatcgacatcttcagctttctttctcatttcagctgacaagagtacagggttggcatatttggaagtgagctctgctgctgct

SEQ ID NO: 873 - DNA, 564 bp, Glycine max
  misc_feature (446)..(448): n is a, c, g, or t
  misc_feature (508)..(509): n is a, c, g, or t
  misc_feature (511)..(513): n is a, c, g, or t
  misc_feature (522)..(522): n is a, c, g, or t
  misc_feature (528)..(528): n is a, c, g, or t
  misc_feature (537)..(538): n is a, c, g, or t
  misc_feature (548)..(550): n is a, c, g, or t
  misc_feature (552)..(554): n is a, c, g, or t
  misc_feature (556)..(559): n is a, c, g, or t
atctcttgttttttggagttattgatgtacttttaattcgatcacacttttggctaaaaaataaagaagaaaagatgataacacacttccttgtgttgtgtattctgtgcccatcagtggagcttttaaatttaggggagcctgcaatgctgtgttttctctcaatgatgaagatgcttctaaaggggttgtaacacacagcaggtttactatgtgcagtaattctagatgttatttttttaatcagattctgtaaagctcttctgattgttttctacaaaatcagtggaaaccatgccgcagcattggctttggctgcaaaactacgggggatcccttcgtatattgttattccaaaaaatgccccaacttgcaaaattgaaaatgtaaagcggtatggtggtcaggttgtctggtctgaagcctctgttcaatcaagggaagannntgccaacaaagtgtggcaagaaagtggtgctatctttatacatccatataatgatggacnnannntaaggtacnatgccnaatgttgannattgtttaannngnnncnnnntaaat

SEQ ID NO: 874 - DNA, 531 bp, Glycine max
ctcttccttatggttgtggttgtggttgttgttgttatcttcattgttttccctgcaagttcctgaccttgccagaccagtaggtgcaggaacatctccgttgtcgccattgtggacttggatacctgaactaggttgttccttggacttgatgacattggaagcactacacactttgtgcgaatccgagtccagaaagaggcaaaccacggcacagtcgtccactttggaggttggatacttgtacctccatgagcgaaccgctgactcgaccagcgcccgtgcggccgaggcacgccttggcgcggctgccacgatgtccaccacttctttgtttgagagaacatcccaaatctgccattaacaaataacaaacttgagatgagagtgaaaaaggcgagtagaaaatgaaaatcttggtaggcaagtgcaatggcaatgtaagataggtcttgtaccccatctgttgccaagacaacaaattcgtccttctcagtgagtcgtctgtatgacacttcgggaacagatatc

SEQ ID NO: 875 - DNA, 728 bp, Glycine max
  misc_feature (59)..(59): n is a, c, g, or t
gctggtttactgctcccctggtcgtcgtatgggtcatgctggaggtaagattatttccnctttctggaactgatggcttttgatagaaaatatcattccagcgttgttgcttaattcatcatgaattgggttgtaccacttattcatcgaactgtgtttgatatgattgaatgcatcttgggcttttgcaaaatattttaagcttaacgtgtgtcatgattagactaaatccattcaggcactcatccaccctcaattagatttggggaaaaatttggcagtaggattaatcatctaggatggattacttgagtaattaattatctttgtgttcctcttgtgtaaaatatcatttaccctcaattgtaattttagtgacacaacaataaagcaatatcagtttctaatttagttagattttcatttttatgtgatattaatccttcttgcttgtgcagctattgtgtcgggtggcaagggcactgcacaagacaaaattaaaaccctcagggaagctggggtcacagttgtggagtcccctgccaaaattggagctgccatgctagatgttttcaagcagaggggcttggttcaatagtttgggttcatttaacttcaaatcattttggtttcgattgtttacatgctcaaaatttcttgattcccattggtaatgatgggctatttttccattttctttttggagttacgagaggtgcattaaaata

SEQ ID NO: 876 - DNA, 356 bp, Glycine max
gagtggggcccatggctgaggctgcggtgacttgcaacccaacacagttgactccttgtcttccggcaattaattcaggttctgcaccttcgagtgcttgttgccagaagctgaaggagcaaaagccatgcttctgtggctacctcaaaaaccctagcttgaagcagtatgttaactctcctaatgccaaaaaaaccgttagttcttgtggtattgcctatccaacttgttaagcacctcttatatatatatatatatataaaatgtgtgaacaatatatatatattgattaaaaaatatagtttaatttatatacacactttgatcctataaaaacatcttgacacaagcattca

SEQ ID NO: 877 - DNA, 815 bp, Glycine max
  misc_feature (721)..(721): n is a, c, g, or t
  misc_feature (796)..(809): n is a, c, g, or t
tggaaccattgaattcgatgagttcttgagcttgatggccaagaaagtgaaagtaaattatgttccttattttattttccattcattgttattatacatacataacataacatgccaataagtcctaatttgtttatttaacatgccaataagagcttcatatgccttttcatcatacaataaccaaaggctaagtttagttctgtgttcttttttcacttaggacaccgatgcagaggaggagctcaaagaggctttcaaggtttttgacaaagatcaaaatggctacatatcagctagtgaggtatacattttatttttcttttcggtggctttagttttctttctttgatgtcaacgtcatttctaatattcattaacatacaaaaaaattgataaagtcagggtttctgctaacgtgaacaatgcaggtagggccaacaggccagtatatgttgcaaattagtttacagctattttttctttttcttgaaagtgtcagagctctagccacttttctttttaccttaataacataacgaatgcaatttgcaattatatatcagtagttaaagctcatgacatttttttaccaaataattatttacagagttttttattttccacattttaaaattatttaattttaagtattatttagacttaggcatccaaaattttgcaatttttatatgtaaaaattaacaactaggacagtagnccgtacatttccgcatgcaatgaatattattagctgcttgattagaaaatgcattgggtttgtttgacatttgannnnnnnnnnnnnncttacg

SEQ ID NO: 878 - DNA, 650 bp, Glycine max
  misc_feature (403)..(410): n is a, c, g, or t
  misc_feature (439)..(443): n is a, c, g, or t
  misc_feature (468)..(471): n is a, c, g, or t
  misc_feature (473)..(473): n is a, c, g, or t
  misc_feature (475)..(479): n is a, c, g, or t
  misc_feature (493)..(495): n is a, c, g, or t
  misc_feature (529)..(534): n is a, c, g, or t
  misc_feature (551)..(555): n is a, c, g, or t
  misc_feature (584)..(585): n is a, c, g, or t
tctgatatcaacatcttcaataaaactttttaacttgtaaatcacagcatgaagcctgacagggacttgatctttaaattggctaagttgctccaaaacatgatggaattgttgcttgacttcatcatcagaagagagaatttcaagggaggtctccaaaagggtctccaatttttcaaggatagctgccacatttggaccatggacttcaatttctgaaacagttgctgagtgagtggacatggaagacatattataactatcagataagatgctatcaagttcagcaatcggatcccaatctggttcaagatgcagattgtcaatctccataagtgtatgaaatctctccaacatgactggctcagaaaatgtatccacttgattgtcagctgagtccttnnnnnnnnctcacatcctgtatcaccctcactccttnnnnnatcctgaaaacatagggggggaaannnnanannnnncaaccttaaaccannncaaaacattgaattcattgaacagctagtacctnnnnnntaaaatattgggttcgnnnnnttaaggtgtggcaatttgaggacgtggannttgtgggggatgttgattcggattctataaaatcttgcaccatttgtactaactcgtcttcctct

SEQ ID NO: 879 - DNA, 400 bp, Glycine max
tccctccagtaactgtgcctgacctaccaattcctgaagtacctaaagtaccaattcctgaactccctaaagtaccagtaccaattcccaacctaatagttaataacgccaaaataatcccttgagtacctatgatctatccagtcactactacttattttgctctagtcacttgctaaaatgtattttttataatttgctgttgctatttcagggtggttcttttggggtttaatttgtacatgatgtgtcattcagttaaatgttatgttcagtttatatgttgtttcagtcggttggacttcagcatattatttattttgatctgtaatgtatcaacttttcatcttctagttcaataactttttgaatttctgaatactgtgatcatggaggcaga

SEQ ID NO: 880 - DNA, 399 bp, Glycine max
tgccacctacaaacaaaaactcaaaatagtcacaaagccaaaaacctgttgactcacgttgacctctatctcttatctcttaagtcttaactgaaatttcacaaaagcaattctttattgaaaatccaactgaacttaacgccatgatgcttcttcatcttacgcgctcgctcatcagcgcgctcttgcaacctcctaatcctcggcgccaacccacacacgaaatcctgcgcccgcttcccctcagccatcaatccttcaagcttctccaatctccaccgttcaacgagaaactccaagatgtctgcgtagtcgttggcggtgtacacgcctatgcgctgcgccacagcggagtagtgctcgaatagcctggggtcatccccatcgtacataaggtgc

SEQ ID NO: 881 - DNA, 370 bp, Glycine max
attatcagcacttgcacatgttaggacttaataatggtggataactaatttcttgggacaatatctaatttgtggtgagatgatatcattacattgaaatttttgttaagggaacatagtatatctgtaactatttttctaaaatatcttccacaactgaaattttttattatgttggagagtctcgcatcatctacttcaatacttcagatgcaacttatatactggatttgttggatttgatcatttggaaaaatcaatatgacctttgttcaactactaccttcattcaatcatcttcagatgattctgttttgactttggtttggtagttgtaaacttttggctcactttcattgcacatgttgct

SEQ ID NO: 882 - DNA, 674 bp, Glycine max
cttttaactctccacatttataaggccaaggtattctccatcatattattttccagtattcttatatgcctatgaacaatggtttctttgactgtattactaaattgctccaaatgcaggcttgtttaaaggaaattcatgctaaattgctacgtaagcatttgcaatctcttgagagaccattggaggatgaagataaattagagaatgctcatgttatggtacctgaggaggaagatactgaggatgatattaaaggtatgtataagctttttgttatcatggacatttagttgttcatgaaacaatttttattggctttatttctcttaatgttgaaatttgctttatctctttttcttgctagtccgatctgcagatgaatcattctcaccagagcccattagagaggatcaagaagctgatgatgaggctggatcattttcaccacaattgttgcacagtgatgaaaatgaggaagctattgacccagaagaagatagagctatgctggtaatctttcgaagcgtgacttttaatgatgatctcatacttaatttatagattttaacttgaccctgttattacatttgtaggagcggaatcgtaaggctgtattagaagagcagcaaagacgagttcaggaagcaatggcatcaaagccagctccttct

SEQ ID NO: 883 - DNA, 1219 bp, Glycine max
  misc_feature (61)..(62): n is a, c, g, or t
  misc_feature (500)..(504): n is a, c, g, or t
  misc_feature (526)..(527): n is a, c, g, or t
  misc_feature (529)..(529): n is a, c, g, or t
  misc_feature (544)..(546): n is a, c, g, or t
  misc_feature (548)..(548): n is a, c, g, or t
  misc_feature (550)..(552): n is a, c, g, or t
  misc_feature (560)..(561): n is a, c, g, or t
  misc_feature (568)..(570): n is a, c, g, or t
  misc_feature (575)..(575): n is a, c, g, or t
  misc_feature (577)..(581): n is a, c, g, or t
  misc_feature (611)..(613): n is a, c, g, or t
  misc_feature (1211)..(1213): n is a, c, g, or t
tggatgtgctcataaccctactggtatcgatccaacacctgaacagtgggaaaaaataccnnatgtaattcaagaaaaaaaccacattcccttttttgatgttgcttaccaggtaccaatctttgggtaaatgagaattttctggctagcctatattaaaaaccattagcatattaagaattatgacttaaagtgtgtttggatagctaccagaattgattgacccataaaatcatggtgaaaaattgaaaaagtggaagcaactattttttgctatgagtttcaacgtggaattggagttgattctataaaaattaaatctaatccaaacaccctatagagacctggaacctatttagcaacatgatgaactcctcattaattttaggggtttgctagtggaagccttgatgaagatgcagcttctgtgagactgtttgtggcacgtggcatggaggttcttgtagctcaatcttacagtaaaaatctcggtctctatnnnnnaaggattggagcaatcaatgtnntntcatcatcgccccgnnncngnnncaaggtanngtaaatnnnatctncnnnnntttctgatatctgaagttgacaaggcatgnnnaagaaaaagattgaatctgtctacttcattcccgtgcatttttattccttttctagaaaggtgaagggatcaatttatcaattaagtgcatgtagtatgaagtagttgcaattaagtacatagaagatattctgtgtgtttcgaagatattatttacattttatttgaacatatgatataagcacttaagtatgttttggggagcttatgaaactagttcatgatatgtccataagtggcttttagtttatttcatagaactcttcaaggtagcttgtaaaaatagcttacagcttatatgaaaacagtttaaccctttttcttcaattatagaaacatcttattcttaagcgtttacatggtaagtgttgattcaacaagtgcttaattaagttgtttacccaaatgcactaatattgtcttaaccaacatcatgacaaaatgccctagttgactatttctgttttaactagaaagatgacatcttagattcaacttgattgtgacaatgtatgcctcagtagaagttctttcttgatcgacaatgtgtttcagggtaaaaagccagtgaaaaggattgcccgaccaatgtactctnnnctccag

SEQ ID NO: 884 - DNA, 1113 bp, Glycine max
  misc_feature (1066)..(1074): n is a, c, g, or t
tcattagtttctttttcataattcactaattgctctgcttcctttcttgttttgcgtgtctgttattcagggcgttttgtctcattttgttattcaagaatcaattaaaaaaaatgactcatatcctttgatatggaacattttcattttctgtattcttctttttcattctttcttttttaatggattgtaatggaagttatatagtttaacactttgccttcattccaaacgagggatatgtaaataatttattttgccgcgttttttctcttttatttttttattttttttgggtgtgtttgtttgggttttggttctttgtgatgtggaatccgttgtttggacttaactgaagccaacgcggtaaccagagggaacgagatcgtgaaagggctcaggcaagagctggtggaaagacaaagcagcctaagaatgatgggttgacccctgaacagcgaagggaaaggttgttatttttctcaccttttctcgttaagttttttccaattgcataattaatgttttaaattgcggtagctatcgcgctatgattaattaattacctatcaaagtcgataaacttgcctgcaaatgccagccattcttgcagccgcaactgtggttgcattgcagcagcagtaattagcaaagctgaggtataacatgtttggtttcactttttggatgtgattctcagaagctaatggttatagcttcggcatcccagacaagattcctgcatcctcaacgagtttccaaacacactaataattaccaaagttgataaaatgctgtgaccaattgcgtctgccatgtggttgtagaaacaaaattaccgtaatattgtgggatgcagaggcttgctcaatgctcacgatcttaattgtgcctaattttgtgtgttcttctttgtgtgcagggatgcaaaagcattgcaggagaaaacggcaaagaaagcagctcaggctgcaggagggaataatgcaggtggtggaggcaaaaaataggcaaaaatcattgacttgaggaatgtaaatggagtgtagacatgggaaaaattatnnnnnnnnntatttgtgatatgggtttttggtttagagtcatctgctt

SEQ ID NO: 885 - DNA, 374 bp, Glycine max
accgtttatccttatatttcaaggtattgttaaaactccagataaaggttgagcaatttggtgaattccactcaggcttcactgtatttctatgtaaagcatgtgtactctgtatcttcgtgaacattaaaatataaagtcaacgatttttttcctcctagatttttctataaattgattcttgtcaatgtaatagtctgtctcctttcattaatttaaacactaacgtattgtacaagtataaaattacccaggaaaaacccttaaatggaatgaaactgcatgcatatgaatatgattgagattcctgtttgataggtaccatggtacacaattacacatacttccaaagacagaaagattgtcagcaaaaa

SEQ ID NO: 886 - DNA, 575 bp, Glycine max
ctcatgtacttgttcaaatcaccgaaccgcgagaatcacactcctcctgaagctcacagatggcatacacaataccatcctccccacaaagaccactcaagatctcactattctcctcaattgccaacacaatgtctttaaacaaattggtcaaacacctaacaaaattcacattctgctgatccatcatctctaccaactgctcaaactccattctcgacctcattgcaaccaccttcttcaagtacccaacatacacctgcaaaccctcctcctccacacccagtggtgtgaagagccgaatgaatctgaagaatgatggatcaaggttgagcattgtggcacaagctttttttaactcttcaatatataccaagtttaatacatatgcactttcagtttgtaaattttttttacattgtcatccaattagtaaaatcaaggtatgcattatgactagtaaactcatagtgcatatactatttattcttatagatccatgagtgaacctgagaatggcggggtggtcgcgctgatcgacggcggcggagagcttcttccttacaattccttcc

SEQ ID NO: 887 - DNA, 528 bp, Glycine max
aagcaataaacctcaaaaaattgccttcaactagaacattagttaaacttaagatgggggtagaaaactttagtaacagcaaatagacaataagcaacatataaaattgtacggcatgcaacaaagttttggcaagaaaataacaaaaaatcaaaatctaccatcaagggtgtcaacagaagctcactacaaaacataaataactctcccatatattggatctactcatcctcctggctacgtagtctggccgtcttgttcgtcaagacaacatcaagctgagcagctctctcaactatgtctttcctcttccttgtggatacattgtgagcaatctcagcacagtatgtcctggattagcataaacaaagacgataaacacattcagcaaccattagcagtaaattaaatcttaaaaaaataggaatgaattaatccaaaatcttcacctgttatgcatcatgagaagttccaggtctttcacattgtgcacgacaaatttcttgaaaccatttggtagataatggc

SEQ ID NO: 888 - DNA, 337 bp, Glycine max
gtctcttctttctgtcacgctttactttctccaagagttcttcatcatcatctgcctcgagtattgctgcatttgcattcttcttaccagccaatgaaagcacaaagctggtgatgaagctgatggacaagcctctctttgtcacaacaattggagagtgtggtgttgctttgcaaagagttaattccctcttcaaagtgcttttgattatcggattggagcaaacatgtattggttttacaaatgatgatgaggatgaggatggtgatgaactaggtagtaggatggggtttgaggttgagagaatattttttgccatttctctttccaatctttc

SEQ ID NO: 889 - DNA, 498 bp, Glycine max
cagagtgacataggtgggtcaactttctcagggaggggtggtggagatggaagccgttctcttgctactggtgggggttttgacaatggtggtggaggtgggagaatgactggaactggatgctgctccctgtgcagatggggggaaggctctggctgtgagaaggggggagcaggaggaactgctcgatcagtgctgtccgatgcagcctgagtaggaggaggttctaacttcattttcacttcttcaggatcaacatactctgcaactaagagacgcccaccatttggtggccattgcaaattatatacagcattccgtgtctcaatagcttcttccacagatgagtactatatcaccaagaaatcaacaaaagattacttaaatgtcagaaccatgtcattatataacaacatcacatgggaatttacagttgcagcaagacggggataagaattgtcttacagtaacatagcaatgggtctttatttggtccat

SEQ ID NO: 890 - DNA, 804 bp, Glycine max
  misc_feature (766)..(767): n is a, c, g, or t
  misc_feature (799)..(801): n is a, c, g, or t
cgaggagaatttggaatgggaatcaacgatgaaaaagtgtttcgcgcgcatggacgaagaggttttaaggtggagtcagaacaacgagactccaagttgcaggtgcgagcttcagaccccgcactgcgacgctgtgggctccaccgcagttgtggccgtcgtcacgccggagaaaatcatcgtggcaaactgcggagactcacgcgccgtgctttgccgcaacaacgtagccgtcccactctccgacgatcacaaggtaaataaccaaccaatactaataatgaagagttttctttatcatgtgtttattggtttgggatctgaattgatatggttggcacgttccccacacgcgcgagtcatttgggttgattgtcgtggctccactgttgtatagtggaggataaaaagttggtgcgtttgtgtgtgtgtgtgtgtgtgttgggcatgtgcactaatgactaacctttttggtttggatttgggttcggtttttattttgagcagccggaccgacccgacgagttgcttcggatccaagtagcgggagggcgcgtgatatattgggacggacctagagtgcttggggtgttggctatgtccagagccataggtgagtaatcaataaatacacgcgcggcgcattatagcagattggagggttcttatttattttattttattggcgaatgttggttgtttgttgggatgggattccaacccataacctatgtccttccctttttccttcttttctttctttacnntttagaccaaccttgtatctctatcattctgnnntat

SEQ ID NO: 891 - DNA, 374 bp, Glycine max
ctgtcaacgaatgccctgatctgcgatcggggcactggcatcatagtgccagttctaacttgttctatgtgcagtgtgtttatattgagtttgggggaggtttaaagatggtagcacgtagtaaaggtccaattgagtttggtgaatttgcttttatagtgttggttaaggtttggttagatattcaccaaatctgtctatactactattatatggggttatatttgctgataaaaaaaaatatggggttatatttaagcttgcaataacagttttgatatgtttttggtattttctgcgaggaaggtaatgttaatggtttgtacccagattgtgaggcagataaataactacttcaatgcgtctatgggtga

SEQ ID NO: 892 - DNA, 308 bp, Glycine max
atttctcctaaggaatttgaagaaatttggaatagtctattttggttgttttgacagaagatgaaattgaagaatgtgtttgggctagtgtttaggttcaaataaaacatctagtttttctagggagaaaaaaaggttgcattgcagcttttgggacctggttttagtggaaggaaatagtgagaggatagtagttttaggcaaggcttctttttcctttttttaccctttttatagtaatattataagttgttgtaagaagataggataagcgggtcgttttcatttgccttatggttatggtgatg

SEQ ID NO: 893 - DNA, 363 bp, Glycine max
aagcttcccctagttcaaattcaggtaaatgttctggcttaattttgttgaggaaaatccaagtagacacaaaagtgtcaagtgggttcctacatatataaattattctactattggactccttgatggacttggccaatgcatggaatggaatatgtgtaccaaaaagtcttggctcagtcatgttggataggtttggaacatggctaggggcattaccataaacggtgtattctatgaaaggcacaagttcatgaggattagaagtaagcaaaggatgtgatgacattgatgtagtgatactatgagtatggcgattgacaatggcaaaggtgagagctttcagccaagtggtacctgatt

SEQ ID NO: 894 - DNA, 862 bp, Glycine max
  misc_feature (43)..(46): n is a, c, g, or t
  misc_feature (824)..(825): n is a, c, g, or t
  misc_feature (828)..(836): n is a, c, g, or t
  misc_feature (844)..(845): n is a, c, g, or t
ggttttttcattgttgtccatcctatcatgtaaagattaaaannnnaatactaatttgaaaaaaaagcaagaaaatgtatttaaatgtttacccatgtttgttatttttttcatgtgctggggcataatgcttgcttagctattgctcattacttctgtatttttggggtcattctatggtagtaatgtttggccataacccctaaatcctaccatattttctacagtgcaatggggtcattctgatgatttttataattgatttttcatcctggaaggctggaacaaagaatatgtacttagttagataagcaaatgatttagtatggatgatcattattatgcaccaactttatagtttgggtagaagttctgatgagactgactatctgcattcctattctttaatgatcgttattattaatattgggactgtcctcagtttgaatatagctatgctatgagttcttgctttattgaaaaactaatttctgataacaattagttgatttttcctttttactgaccatgtaattatgtacagatcaaacgcagcttgactttgagtcaaagagactacagagcattgtgaaggaaaaatcttacattatatcagaggcaggtgttcttgcagacaagataagtcctggagtgctcaaatcacttgtatccttaaacgacaagccaaagtaagatgctttgagctgactatttagtgagaaaccttgtggtggcagtatcaactgggtggaaaatggcaagtgttttctggaagtctttcttgaggtatttaggctgaggcttatctattctgttgctgtganngtnnnnnnnnntcccatgnntatactatggctgctac

SEQ ID NO: 895 - DNA, 325 bp, Glycine max
tcgcttctccaaatctccattccaagagtacacagatctactggcaaaaccaacaggaaagactctaatcttggaggaggaaagggtggatgcttgatttgctagttttgctttatggatgttttaggaacttcattactttacatactttgttggttctgtgctttacttttggttttgatagacggtatgtctctgtatgcattttgattgtttccaagttttaattgactgcagttgagtaccatagatttctacctgtttaatttggttgtgtcatccaaatgacagaactgcattaccccgtctagcttctcagtggaaa

SEQ ID NO: 896 - DNA, 575 bp, Glycine max
ttcgctttcccacagcagccaatggaagcggcggcgacggcaacggcaacagttctcgcaccaccgtcggctttcctcggaagaccctccgtactcgccttccgttccaatcttcgcttctccactaaggtattcaatcatttatttatttattgatttgtaatcgccagaattgcatagccagtttgataataaactgcatttcaattcatttcttaccgcttaggcttgttttttgttgctttgcttttattgatgctgctagcttgaattcttgccataggggaagagaatacacgagttgaatttcgctacaaagtgtgctttttttcttgtgatcgtgatatttaggtcctatttggattaatttctcgataagcacttacaggagaggcaaaaaataagaagataaaatgaatttaggttcttccataagcttattttaacttatgcgtaagctaattttagcttgtgcaaaagttcaattcatttttccttcttgttttcttctcttgtaagtgcttgttaagaagtttatccaaatggggccttaataattgcttcttttttttttt

SEQ ID NO: 897 - DNA, 785 bp, Glycine max
  misc_feature (377)..(379): n is a, c, g, or t
  misc_feature (390)..(390): n is a, c, g, or t
gaaatatgactattaacatcatgattcaatggtcccaggggaaaaaatccttcaaatataaactttaaaaatacaaaaagaaaatggaggaaaaagagatcatcacaatcactcccttgctacaaacaacctactaagaagatatagatgaaccacggatagccaaacgcaagaaatggctttctaactgtctggcccccccacaaaatatgatgcatcaagctaagaataaaccctctcctttaatgatgcttcctcacctctttatccatgggaatattgttaacatgacacgacacagacccataaaaacacccggagggaaaataattcaccattgaagcatattttgtacttagaagttagaagcacttccnnntggacaaaaanaaaagcttcaagggggaattattttccctccgggtgtttttatgggtctgtgtcgtgtcatgttaacaatattgccatggataaagaggtgaggaagcatcattaaaggagagggtctattcttagcttgatgcatcatattttgtgtgggggccaaacagttaaaaaggcatttcttgcgtttggctatccgtggttcatctatatcttcttaataagttgtttgtagcaagggagagattgtgatgatctctttttccccccttttctttttgtatttttaaagtttatatttgaaagattttttccccttggaacattgaatcattgatgttaatagtcatatgtatcaagaaatcttatattattgttattaccccctcttgctcgaaaaa

SEQ ID NO: 898 - DNA, 420 bp, Glycine max
ggagtttgtgtcttcaaagctgagattagacaaattcaatgaaacctaacatcagtacatgctaatgagcaattagagaagttgaaggatcacagatattgttttgaaaccgttgacaactcaactagaagaagctgcttccttataatcttctgtcacactagtttcaccttcatgtaagcttggagcttttgggagaagtccaagaactttaaacatgagttgatcagcatcaaaatcattgttaggagtagtgagaagcttttcaccagtgaatatagaatttgcaccagcaagaaagcacaatgcctgctcaggcatggagaatcgaactctgccagctgataacctgaccattgcttttggcattacgatacgtgcagttgctatcatgcgaatcatctcagctttgaagacaca

SEQ ID NO: 899 - DNA, 1157 bp, Glycine max
  misc_feature (1065)..(1070): n is a, c, g, or t
  misc_feature (1077)..(1086): n is a, c, g, or t
  misc_feature (1100)..(1113): n is a, c, g, or t
attgaatgtgacttggaaactgcattccaggggttgtttgcggtggcaccatggcggatggcgtgtaaggattgttatgcatctgttgcatagactgaggtggacctgtcccccatccagcctgagaatgagacatcagagtttgctcagtaactggtgcgtactgagctccattgtaatgttgaggaggagggcccgtcatcggaactggatgttgccctaaaattgagggctgagcattcactacaggtggaggtacattaggaatggtatagtctctacttctctcattattcacctgtaatcacacaaatcccaaaacatttgaacctccaaacacataacagaagtgcatttctttaaaagtaaaataaccatatatggactcatactagctgaaagcttggaaaaagatttcataatatccaataatcaatatgttaggatataaggagaaggaaaagttagttaagatggttagactattaatagttagttactacagttaggattgattagttggttaaggagctagttagttagttaaatggatttattagatataaataggggaagaaggataggagagagagggatcttatcatttgtagattgagcattagctcttggtgaaaggaaaaatcatttgtgaaggagaaacccaaggaggagagttttctctcttattttctgttcttttcttactagtcaaaaaaatcttttcttttctttctcatttcaattcttggttcctatcacaataccaatagaataaggaattcccctcacctgccaagcataattaacagaaaatatgaattcaatatttggaataggatacttgacattaatgcattcaagaaattccataacaagggaaatcgggaaagatccagtggaagtcttttcagcatatattgacacagctacatgcttacttcaacctgaaaaccggtccaaaactagaggtctcatgttgagttcagtaaactgtatatcccaaaacaaataggtctagatatgatttgcttgtataacggatggaccattgtctgatcatagttnnnnnngatttgnnnnnnnnnntttctggtcttcannnnnnnnnnnnnncttacaaacattactcatgaaatcctcatctatactgtgtaggt

SEQ ID NO: 900 - DNA, 726 bp, Glycine max
gtgatgaggacgagtgctctgtttactaggttcctggttccctccgcaccaatgtgtaaacttaacctttcctgatactcgtggaatagcttcagttgcttctgaatgtggataatgttcaactgccaaaccaatcatacacaccacactagttaacatgaattgattttatgtatgtaaccgatatatgcactctaaattgcactatgttctcaacatataaagcttggattgcaatagaattaacaattattactactatttatgcttacaaattgaattccagtatcattgagaatgccaattccagcggaggcaaaattggcaccaattaagagcttctctccaactagtagcgggctcaaatagggtagtgtaggctctaagccaagctccaaacctgtaataaacatgaattgcacaaccccgtacatgaataaattaatactcaagagccaatgcaagcctagttatggccatgcatgcaaattatatatagaaaaaaatatataggcacggatgaaaaaagtatatatcatcattcattagtaaaaagatgttgattttatttggcaatatatgacaaaggaactcatactaattaagtcagggatgtttaggccattagagaagcgtccagtgggtctgtgtgttgggtagtcaatgccatagggtggagcgtctgctctggctgtggttaccaagaaatcattgttaccactgtcc

SEQ ID NO: 901 - DNA, 387 bp, Glycine max
catcaatgatctcataggttgtgattctccttcctatgctagtgtatcatccaataggagtcctttttctccacaagcttctcattcagaccagcatcagtcatcagacaacacctatggatcaccaacaagtgcacactctagatatgatgatgacggctacgaattgaagaacaagcttagagaactcgagatttcgttgttggggcctgattcagacattgttgatagttggcactgctcctacaagggtggccgccacagagcatcatctccaacggctaaacacaattgggatcagattgtggaaatgattccaaaattagacttgaaagaagtcctcattcggtgtgcacaagccgtggcagatgatgatattgaaacagc

SEQ ID NO: 902 - DNA, 371 bp, Glycine max
tcgagtggtaccaagcaaggtactctcatcaaacttaccaaaaacctttctctcaacaactctggatttagatagcaagattgggagaggagaaaaagagagcccgatatttatttctacacgtatgtaggcatttaagagttgcagacgcaattgcagtttggtttgtttagagcttctgaagcacacgcacgcttcctttttgatttgtgtgatatgccgataagatgaccacgacaacacattttaagtttgaccaattatttttatattactcaatgagttgatgtttgccattggcaaatgaggaggtatttgatagtatggttcgatgtctccaatatttccgtataactcattggctttggtca

SEQ ID NO: 903 - DNA, 612 bp, Glycine max
tgatctaaagcaagtttcacccaaggttcctacaggcaactatccagtggcccatatttcatatgaattgaatgtgctaggctcaaggtaagctttacgtattgcagttgttggcagattttcgtgcatgaaattaactgatagttcattgttgtttacaataattttctttgcataaaacttacctgtcatccatagtttcctttggtggacattactgctttgactttgagcagccaaagcgtttgctgaaaatatattagcttactatgcatttttttatattcctaccatgctatacttacaatctatacaactagcaggggtcctaggagaatgcattgtgtcatggattccattcctgccactgcaattgaacctggaggtgtagcacctacacagactgagttttctcttaacaacatagacatgtttccttcattccccttttttcgatcaaaatcaaatcgtgcggaaaattccatgtctggaccattggttgatcaaaaggatgggatgctagtgttgaaaaacaaggcccctaggtggcatgagcagctgcaatgttggtgcctgaactttcatggacgggtgacaattgcctcagttaaa

SEQ ID NO: 904 - DNA, 657 bp, Glycine max
tgtaaggtattggatgagattacttgccaacccttggtaagcaaatctctcagcaaattccacaactgcccacaaaacaaaaacataatcttcgcatcatcacatcacatatacatgatcaaatcaagatcaaactcgtcatgatgcaaaagagagaaaaaaaaaatcatggtttaggtctatgggattaatgtgtgttcggattgtaatctaagtacacccttaatctattgaaactaggtaaatcaatgtttgaattctcattattagagatgtttatatttatatttagtgtctgaaagtgcctcgaatcatgtggggaatcaaaaaattaagaaaggggaaatgggtgatggagagaaagagagagaggttttgatttggactcacatatgatgaagatggcagcattccaaccacccttcaagtttgtggggtgatggaggatcagggaattgctcttggtgttgctactactgccatcagccatggcgagcacttgaaattttttgaggtgattttggagaatgttgtggggaatcaagtttggggaggctccatggggggaattgggctttatataggctgaattttgagactcttgtgttgttgttgttgttgttggggttgtgggtgtgagtgaacacaagcactcaa

SEQ ID NO: 905 - DNA, 485 bp, Glycine max
gatttaatccactctcccacgtcaaccagcgtccgagtctatattttgatggtcaaaaaatacaaaacaaactcaactttcccttgaataataaccattttacttctcacgtgtattttgttttttcctcaaacaataaccatttcacttctcacgtgtattttgttttttcctcaaacaataaccatttcacttcttcagtgccggatagttctcaacatggctctcatcacaatataatttcaaggtatactcaatgagctcaatgtggtcaaacccctcagtcttcaaactttattttctttggtgcaggttggatgttgcccacctgcaacagcaattatatatttcagaatgagcaaccaaaccgcagattgagaacaaaagtcaagatgcagactttctaattttatgaaaaaatacagattgataaaagcaagagtctcacaatctcagggcattcataatcaatgccagcagcctat

SEQ ID NO: 906 - DNA, 230 bp, Glycine max
  misc_feature (17)..(17): n is a, c, g, or t
tagatgccgtgataaangagaagctagatgacccggatatgactcaaacaaagcttagtttggatattattatgttgactatgaatggaagagagagaacggaaaaagaatggaaacaactcttcatcgaagcaggattcaaacactacaaaatatttcccatctttggttttagatctctgattgaggtctatccttgaacatttttatgatgtgtgtgtcacacttaa

SEQ ID NO: 907 - DNA, 478 bp, Glycine max
  misc_feature (383)..(385): n is a, c, g, or t
  misc_feature (389)..(389): n is a, c, g, or t
acgcacagatgatagcaagattgtctcagcttggccggtttcaaagcctcactcatccaaattgaacaatgatcatgtgctcgaccaagttgacaaggagagcaaagttgagactgctacaagttatcggttgtttggaattgaccttattgatccttctaggaactctccttctgtagagaaggcatctgcacaagcaggaaatgcacccaaagttactactgaaggctgtaccagcaccttgtcccgaaccgatgctggccataagtcagatgtatcaatggcttcttccatggagaggaaacaagaacagctgcaagtatcaccaaaggatactcagagcaagcaaatttgtagaagtcgaaccaaggttcaaattgggnnngtgnggctttgaaacaggccaggctgagacaatcttgctatcatctgttgcgtcctgaaacaaatgagagggacaactagaatgcggagaaga

SEQ ID NO: 908 - DNA, 681 bp, Glycine max
caacaatatgttccgaacaaaggttgaaaaccctaccaattaatcaaagagactgaatcccatatcctgcaaagcaaaacaaacagaaaatgaaacaatcagatacttttcacaataatccaagccattgcagtacacaacattgtgttcaatccaaatctaacgaactacaattattataatagagttaaaaagcattagaggaaaaaaaaacttacgtcatccgattcctccttctcttccaccttttcctccttcttagattcggcggcagccggtgcagcagcgccaccaccgggagcagcggccacggaaaccgcggcgccaccgccagaaggcacggaggccaacttttccctaccggcggcgataagctccgcaatgtctttgcccttaacttcagacaagaagttgctgatgttgtcatcattcgcgtcagctccaactgaacatcgaaaattcaaagccaaatcaaatcaatcaatgtaaaatttaaattcgcgtcgtggaacaaataaatttttaaaaaataaagaagaggaaaaaaacggtgtaccggagccaaggatggtccttaagtcatcagcggaaggggctgcattgcctcccaatacggcgagcaagtaggcggcgatgaccttcattttgcaccggaatgtgagtgtgtgacagaaagagcga

SEQ ID NO: 909 - DNA, 563 bp, Glycine max
  misc_feature (314)..(350): n is a, c, g, or t
  misc_feature (353)..(381): n is a, c, g, or t
  misc_feature (547)..(547): n is a, c, g, or t
atcatctgagaaagaaaacattgtgatatgaattgatgaaacaaagcatgtaattaagttggtatctttattcatgaactatataggcaaatgattactacttaatttgcttcttttgcagccttgtttttgttgagataattcttggcaagttcagcaatggttgccactggctggatagtaacaagtgaggcattggccgcgttctcttccttgacttcatactcgattgtagatttgattatgctggactcttcacctttctctatcacttccaaacgaactctaaatagagtgaatcctaactccaagtnnnnnnnnnnnnnnnnnnnnnnnnnnnnnnnnnnnnnctnnnnnnnnnnnnnnnnnnnnnnnnnnnnnagggtacctcaagaaggctttctatggatcaagaggaccaacttttggcaccaaggttgccaactaccctccatgccccaacccagagctggtgaagggtcttcgtccccacaccgatgccggtggaattatccttctcttccaggatgacaaggtcagtggactncagcttctcaaagatg

SEQ ID NO: 910 - DNA, 363 bp, Glycine max
tggcttcttcaatgatggggcttcttgggagtccacatatggggacttcttcctctcttggtattccaatcagctcatagctcatggagattgcctcctttcattggcatcttcaacttttggtgactctggggtgacaatctatggaaaactcccacttatgcactcttggtatgggactcgatcccatccttcagagctaactgcagggttctataacacagctaacagggatggctatgaaccagttgcacagatgtttgctcggaactcgtgcaaaattatattacccggcatggacctttcggatgcaaaccaaccagaggaaaaccattcaagccctgagttgctacttgcacaagt

SEQ ID NO: 911 - DNA, 901 bp, Glycine max
  misc_feature (522)..(522): n is a, c, g, or t
  misc_feature (843)..(846): n is a, c, g, or t
tgctctttctggaagtccctaggcctagttatgaaaacagggcttatcaccgggattttgtccctcactgtaagtttaaattttttctttcccctctttctttttattttttttttcaaacttttttttaattttatttatttccgcccgggagtaaacatacaagcatctaaaataaaattttgataaaaaaaatattattaaaattcattttaaccccctatgtagggagaatatctagtttagttagattgaacaaaaggcgggagttattgtaaactcttcggtatggccatactatcttctattcctatgaatgaaaaaaaaccctatgggaaattcatggggagcccattaagtaaggctgaccctcatcctctaattaaggatgattcccattcatatttaggggggctcacctaaatttcccctcataataaatcatgggttacaaagtatattattaacattccccgggttagtatatatgatatttacccacacataattggtttcattagngtcaatggataagtgttttttttttctttttgacaggaaggtattgcagtaggaaggacatttgcagctctcaaaaactacaaagtggatggaaataaggaaatgatggcaattgggtttatgaatgtggttggctccttcacttcctgctatgttacaacaggtttttgttttttacctaaaaacctgtttcaaaaggctttcttgaagtctaataaagcataagacttacacatttaaactatgaaattcaggtgctttctctcgatcagctgttaacaataacgcaggagcaaaaacagctgtgtcgaatgtagtgannnntgtgacagtcatggtaacactcctttttctcatgccatgtttcaatacacaccta

SEQ ID NO: 912 - DNA, 397 bp, Glycine max
tccttggagcatttatcagctgccaagaggaattcagagccattctgttgaataacaaagagcaggtcacgaaacccccctttgatcgcatgatttctgaattctttgagaggtcggtgaaggcacttgacatttgtaatgctagccgagatgggattgagaagattcgcacatggcaaaagcatctggaaattgtgttttgtgccttgggttcgagtaagagagcattaactgaaggccatttccggagggcaagaaaggcactgatggatttagcattggcaacgcttgatgaaaaagaatctggatcagttttttctcagcgtaataggtcttttgggcgacataactcaagcaaggatcatcactcctcatcagggcattcaagatcgcattc

SEQ ID NO: 913 - DNA, 422 bp, Glycine max
  misc_feature (406)..(406): n is a, c, g, or t
  misc_feature (408)..(409): n is a, c, g, or t
  misc_feature (411)..(412): n is a, c, g, or t
agattctgtgagggtactaacctctctgaggacacgagagagcctgatttgctggagctgttccgtcctttcggtcctgtcagcagagtctatgttgccattgatcagaagactggcatgagcagagggtttggctttgttaactttgtcaacagggaagatgcacaaagagctattaacaaactcaatgggtatggctatgacaatctcatccttagagttgaatgggcaaccccaagggcaaattaaatgttgaatgtttttgcctctttctttaaaacggtattttgaaggtctttctatttttgtagtctgagtcctgtactatctgtttcctttgagatgatttattatttaaaagtatacattcattctagatctcatgttggtcattgataatcaggangnncnnagagtacaaa

SEQ ID NO: 914 - DNA, 418 bp, Glycine max
cttggtgctgcacagtttctaaatgcaatcggggaactagcaaggggactcgaaaaactcagcattgagccagtgtggaacagagacttctttccatctcctcaaacaccccaagaaactgcattgccaccaacaccacctacaatgccagattacaagctagaacctgccaacatagatatgcccatggatcgaatcaacagtgtgaagcgagaatttcaactagcaactggactcaattgctcagccttcgagattgtagctgcagcatgttggaccactagaacaaaggccattgatcaattcgaggccaacactgaattgaagttagtgttctttgcaaattgtcgccacctcttggaccctcccctacccaatggtttctacggcaattgtttcttcccagtgacaatcacag

SEQ ID NO: 915 - DNA, 565 bp, Glycine max
aagcttttgtggtttgtacaaaatgggaaagttgatggatgggatgatgcacgatttcctacagtgcaaggaattgtgcgtagaggtttgaaaattgaagccctgatacagtttattgttgagcaggtatgcaaaaggttttgcttttgtttattaaaaaaatggaaaaagaaagatgcattctctaacaaatttgaaatgacaagtagaatgtgtttagcaattgttatgtttttattattgtattttcattcctgtattaattactcatatgctgaagaatgttgatgactcttctctgatactcgtacagggggcgtccaaaaatctcaatctcatggaatgggacaagctctggaccattaataagaagattattgaccctgtctgtcctagacacactgctgtcattgcagacagacgtgttttgttgactctcactgatggtcctgagaaaccttttgtccgcatcatacctcggcacaagaaatatgaagctgccggagataaagctacaacatatactaaaaggatatggcttgaccttgctgatgcagtgtcttta

SEQ ID NO: 916 - DNA, 399 bp, Glycine max
aaaagcaatatttctacacagcaaaacgtgtctgctaatatgtagggaacttagggtccacattgtgggcccaagactctaggccaccaacaatatccttggcagaaatgaaacccattttgtgaagatactgaacagccctttgagaatcatttccccttctgcatactacatacaactgtgcacttgatccagaaactacaccaccttcctcttcctctttcttcaaagctgatgatacttcaggcagcctagcctctaatgttgagagtggaatgttcagagactttggtagagatacaatcttgaaatggtgagctggtctaacatcaaccagcacgtgtggttccttcttaagaattacttcactgtactccttgctgctgattcttgattaac

SEQ ID NO: 917 - DNA, 355 bp, Glycine max
ttccacccgattccatccacgaagcttttctgaaggccgccgccgccgtcaaatcacgcgccgcctccattttctcctccaccgacgacgacaacgacggaggttgcgtcagcgacccgtggcccagcgccaaggacgcctccgatgcagtcatcggagtcgaatcggaaaacgaactgccgggatcctgcatcgtagagaggggagtcgagcccgtcgccgacgaagtcaaagttgctggtgaaggaggcgacgcctccgccgacgtggtggtggagggaggagacaaattaggagaggatgtggaagcgtgcgttgatgagttgcaagggttggatatcaaggatgtgaagaa

SEQ ID NO: 918 - DNA, 360 bp, Glycine max
acatgttgttaactatggaatacctgttgcaaaccagtaccctaggggaaaagctcagaatcgctggggtaggcccatcaaattttaaacacttatggtagcttaaatattgttattataaagttatcttccagtgagtctctcgggtccatgcatataggtaggttatttactgagtctagcaatgatggaatcaagactctaagtcaatgggaataaattataaaaaataaaattaatgagttcaattatataaatataaatgaaataaaatataagattttatttataacttttaattttaaaaaaaaaattattggtaaattttaaaaaatgagaaaatgtaagtgcacatcctca

SEQ ID NO: 919 - DNA, 476 bp, Glycine max
cgtattgaaccgggaccagctccggagctatatatctgtaaggtgggatgagaatgttagtggagaaagggtatagatgagagagagagagagagagagagagactagacctgaaaagggtatcagcagatttggaagggccagcaaaaacaaatttactcttggtcctctgtgtgaagaagggactgatcatcctagaaaaggcaaggtaccaccaggggacattgatgaatatctgcttggcaacgaactcagggtagttgtcctgaagcagttgaagggcctgattggtggcctgcctcagttccctcttgcccagtccgggagagttcttaaggtcgttcacctgaactattgtcgatatcccattcggagagaagtcaaggcttctaacgctcttctccaacgactgaatcctccaccttatgaacttgttcctcttttcctcgtccaaaaacgtcttgctgtacaactcc

SEQ ID NO: 920 - DNA, 496 bp, Glycine max
aataataaagcaaatgaagaaaagaagaaccccgtatgaaagaattaagtccctcgccccacccacgaatgttgttgtggttgtaatgatgaatataacagtaacagtaacatccttattcaagttactctgcaatgggtttggtcttggacctgtagaggagtttcttcttcttggatgtttggttgtctatggtgagtacaatcttgccaggttcaccaattttgaaaccgttggtaagaacggtctcatcggcgggagcaattttcctgctcttgtgtactatgacagtgtatccatcctcagcgctgggcacaaattcagctccatagctgacatcccaacccaccactcggatttcccaaacaagatggcttttctgcaacaacaaaagaagaaaagattgatcggtacaaaacaactatgtcatgaatgtacggacgtgtaggggagaccagaggatgacagacctcagaaacagggaactcaacagaaa

SEQ ID NO: 921 - DNA, 382 bp, Glycine max
atatctcacaagaagaaaaacaaatagaaacttgatcaggatactacatatataaaaccaaacccatacatacacatacgtacttcccaaaagacaacccaaaaagacataataaattggcttccattgggtcctttcaaaatccatgatctcatattctcatgctattgcttttcatatttttataacaaaacgagtaaaagttgacacaccccgtcaattgttatcctccaagaaaatcttttcacaatcgtaatccgggggacaaggatacttgctgaaatgatgatgatcatgaggagaagacggtttacaaacacgcttggcgaggtaattagcgactcgattagctttcctaggaacataatccaacctcgctaga

SEQ ID NO: 922 - DNA, 396 bp, Glycine max
agagagttttcaagcgtatgaaagatagccagtgtcagccagatgacacaacatacacgatcatgatcgaggcatatagaaaagagggtatgaatgacaagatatactatttggagcaggaaaagcagacgatgatgactgatgataaaaaagttagccagtttgagaatgaaatcttgatttgatttttgatttatagttcagactgctaatgcatctgtattctatacctccattttccgggagcggctgttaatttttgttttgacatgaagtgaccagttgctgagttgtgctatcgaacttcatttttcacgatgaatgacagctagtcctgcctaacttctgtatgttgtacaggttaaatttatgttttagcatccatttgattcgcag

SEQ ID NO: 923 - DNA, 470 bp, Glycine max
  misc_feature (416)..(416): n is a, c, g, or t
  misc_feature (418)..(418): n is a, c, g, or t
  misc_feature (430)..(434): n is a, c, g, or t
ctttggtagttccttaaccatacctgttttatggttttcacatcatgagattaagaaactgatttgatgatgatgatgaaagagaatcaatatcaacattaaaattaaaacacccattaaattcttaccactcaacatttgctctgttatatccattaagtcgttgtagtccttataagccatatagaactcacaggtagtaaactcaggattatgggtcaaatctatgccctcattcctaaattgtttaccaatttcataaacacgatccagtccaccaacaaccaactccttaagatacagttctggagcaatcctcatgaataacctcatgttaagatcattgtgatgagttacaaatggacgggctgcagctccaccagcaatcatgttcatcattggtgtttcaacctganantgatgcaaaaannnnntgaatggaagtacataaaccacagaatccagcatca

SEQ ID NO: 924 - DNA, 521 bp, Glycine max
attcgtcaggtagatgatgcattttctcacatattatatcaactcgttctcttgcaatgtcctgaagactaattttgtctgcactagaaacacagcgaataactgactgatcagggcaatccatttctgcttttccattttccatcttctttgcagcaattgcatcagcagtaggccaagtttctcgagaactggcactttcagtaggagattcacggagattgtcagagtttgatctaggctcctcgggagaaaggcggggatctgaagaaactagagatagagaggtttgtagtcctccaacccgtgactgctgttgtggagggagcattctcttctctcttttttcacaaaggcttctgttttatgttagagcctggtgacctacccaaaaaatatttactttgtcagtaactagcggaggtgattatatgcattatatatttgctgagtttcgaccaagcacagtttgttttcagggtgctttgggtcataaattatgtaggttctgtgattggcgt

SEQ ID NO: 925 - DNA, 474 bp, Glycine max
  misc_feature (415)..(415): n is a, c, g, or t
  misc_feature (447)..(447): n is a, c, g, or t
  misc_feature (461)..(461): n is a, c, g, or t
  misc_feature (464)..(465): n is a, c, g, or t
  misc_feature (467)..(467): n is a, c, g, or t
aaacgacacccacttcgcatgaccaacacttccaattctctttctttctccctctctagggtttcaaagatgttttcgggatcccaattcgacgtcaccaccgccttctccggcggcggtttcacgtcctcccagccgtctaccctcaacgattcttctcccgcgccgtcaaacgtatgcaatctctctctctctcctcttttgttttccgtttctccgcaaaaagaaactgccaaaaaacgaataacataaatacacttgggagaatttattttataggagataattatttgttttaaaaaaattaagttgaattaagactttctctagaaattacatgtgttggtgataacctaattagggcaattagaaataaattttattttattttatttgttttgaaagctaaacgcantacaccgtgctcgactaactgtgttttgtgtnttggttgttgaagngcnncnaaactcc

SEQ ID NO: 926 - DNA, 866 bp, Glycine max
  misc_feature (820)..(822): n is a, c, g, or t
  misc_feature (841)..(841): n is a, c, g, or t
  misc_feature (845)..(860): n is a, c, g, or t
aatgcaaactcttctatcttgttcttggcaaaacacaacaaaaccgtttaatatgtaaacttgcagtaataagggattctcacctctacaaaggagacttgagttccaatcccagatgaaaaagaaaaaagtttgtcagaacataggtgaaaaagatacaataacagtataaatttgctggtcaagaaaaagaatgattaaattgaattgccaaatcatttggtttagcatcggctcgttgagctgatttctaatttgctttggtgaataaatgtatgatttgtggtattatatgctatagattcttgattccagagaaaaagaaaatgaacaaggtgagtgagacagagtagggagataggaatatgctcggcatacccggaaaaaaagttgtatcaacagaatagtttgacaatggaatgacaaatgatttgattcttgatgtgcaatatttagtccttgatgcaatccttgaattattctgccagaattgatggaagaaaattgagtaggctagaaacacagcatagcatgaaaaattcagcaaacatgaaaaatagtaatttgtatgtttgattccatatttccaacagaagaaacgacagagtcaatttaagtaaacagaacgtggtatcttcctttacaggttattattattattattaactgctatactaatataagatctattttaaaattcccctatctttcattagaaatgactttggcacttagctaatacaggtagctactgtccctaatcaaattgttaaaaaaatacgatctgggcagctagataggttgatcatacaaatgtatnnnacataacgatcaatttgtngtcnnnnnnnnnnnnnnnnatcaat

SEQ ID NO: 927 - DNA, 359 bp, Glycine max
gggtctccttgaccacccctctatcgacacctacatacaccgaatctccatctctcacccttcaatcttcttccaccgcctcccccacacatcactctccaccaccaccaccgtgagcatggccgccaaagccttcaacttcatcaacataaacacccccaacgtagccaccaccctcacccaaatcaccaaatccaccaatatcaaagccttcataatcgatctcttctgcacctccgcaatggaaccggcttcttcattgggaatccccgtctactacttcttcacctccggcgccgccgttctctcgcttttctcttactttccaaaactccaccaagagacccacgtgtcgttta

SEQ ID NO: 928 - DNA, 347 bp, Glycine max
actccttagccttttgcctctgaaactccaacgtaatgacgttcttatcatctccaacaacagtagctggcttctgtgggggtgaaggggatggtggaggctgagaaggaagtgttggcttctgaagctgaggggcacttgatgatgatgatgatgatgatggttctcttattgggggtgccactggccttcttataggcccttcagcttgagaattccttatagtgacactgtgaggcttggaagaagaaaacctcaaagaataggatgaagttgatgatgaagtgcaagatggggaagaagaacatgttgggattttgatgcatgggattgaacatgccattgac

SEQ ID NO: 929 - DNA, 391 bp, Glycine max
cagcatgtgacttttgccccaactcaggctggccatggcacctttgcgggcatgtatcaccctgcacaagcagtgacggcggcagcagttcatccactgctacaacaatcccagacattggctggagcagttgatatggtaggacctggaggcaatgtttatcagcagcctcagcactcacaaatcaattggccgagcaactactgaggccaggagtcttcctgacagctaaaattagataattgagtcctatctggggaaattttttgagaaatgccaaaatatggttggatttctgaagacaaacaacatggcaattggctacatttgagtgtaagaagctggacaatttgccaatatgatcttctgattgcttggtttgaggacatat

SEQ ID NO: 930 - DNA, 404 bp, Glycine max
  misc_feature (375)..(375): n is a, c, g, or t
  misc_feature (377)..(377): n is a, c, g, or t
  misc_feature (387)..(388): n is a, c, g, or t
atcatttaaacaatccagcaacaatgtaggagtatttgaacacagaagtcgtcatgctaatataaaaatacacttctctctgtttttcccataaagacggtgttctgcactctacagtgttcattgtgtaaacagagtcttaacaatgttaagatttcattttattttattctcactttatttggctgcaaatggaacatgacatcaaagatctgttaggtatgagttgtgcttagctgggatgctttaaggggacatttagcttttcatgtgaagctatgcatcaaacttttggtcttcctttgttttgcaatctgaaaaatgaggtaagggagggggagggatggtggtatatttaaggcaaaaaatgtggtnanactcatatannaatgaaatctttagat

SEQ ID NO: 931 - DNA, 716 bp, Glycine max
  misc_feature (61)..(63): n is a, c, g, or t
  misc_feature (637)..(637): n is a, c, g, or t
  misc_feature (657)..(659): n is a, c, g, or t
  misc_feature (669)..(671): n is a, c, g, or t
  misc_feature (673)..(673): n is a, c, g, or t
  misc_feature (679)..(679): n is a, c, g, or t
  misc_feature (681)..(683): n is a, c, g, or t
  misc_feature (685)..(685): n is a, c, g, or t
ttatttttcggttgctaaaattccttttgaacgtatacaactgcatgtttgataatttatnnngtaaaaaaagtcataaacaaggtattcttcacggttcagatacaaagtttgcttcttgtttgttgtcccaagattctttcttccatcagcctatatttttggagggtctgtgcctcggtggagttaagagtataatgtaaagaacatagcacttattcggcgctcgtatcttcaacagatttcttgtactcaggcttcagctcgtaagttccttgattggcacctcttttattgtaaacacaaagttcgttcagaatctctttcaagaattgctgcgaaagaaaaggtcacaagttcattcaggatctttttcaaagaattgctgcaaaaggaaaagggggtggagtgtgaggggatggccgccaggcagtgagtggagtgtgtgccaggcaggcagtgtgtggagcgcgtgtgtgcacacatgccatggtgtgtgtgcacgtgtgctacaaccacaaaatcaagctaagaagtcaaagaagacacacaccaagataaacccaagatagtaaagagaggagtgttaacaactcactcttaacacttttagcacacattacactattgattaaantattaaaaactattatgagnnnaactccttannnangtgagncnnntnaaaatgtgattttcaattaatttcaatcata

SEQ ID NO: 932 - DNA, 326 bp, Glycine max
gaagaaggaagattctgtagtgagcacctacagagatcatgttcatgcattgagtaagggggtcccatctcggcaagtgatgagtgaactgtttgggaaggcgacagggtgctgccgaggtcaaggtggttcaatgcatatgttctcaaaagagcacaacttgcttggtggatttgccttcattggtgaaggaattccggtggccaccggggctgcattttcgagcaagtacagaagagaggtgttgaagcaggcagattgtgatcatgtgacattggcattttttggagatgggacttgtaataatgggcagttctatgaatgcc

SEQ ID NO: 933 - DNA, 326 bp, Glycine max
ttggtggtggcatgtttgagatggaaaaggtgaaaggtggttccccatatggtgcaggaacttatgctggagatggctcaaggcagcctagtgagttagaattggctcaagctttccatcagggtaaatactttgccggcattgcaaaaaagctcaagggatctcaatgatttttatcctccatatatctcccacaccatactctttgtccagttaccatattttcaaacaaaatgagatgtcagacgcaaaaataaaatatataagtgtgagagaatagagtaatacttcatctacaatacaattgttgtcagcacttgtcatcg

SEQ ID NO: 934 - DNA, 369 bp, Glycine max
cagatctaatggtgactaatggaagatgcttgtttaccaccgtgagatcttttattgtgtcagatttgagacattttggtttcaaacaaattgattttgggtggggtagggcattatatggtggagtggccaaaggtggggctggaccctttcctgcagtattctatctgatggcacataagaatgcaaaaggagaagaaggcatattattaccaatttggttgcccgccaaagctatggacaagtttgcaaacgagttagatcacatgctaattgggaaccaaaaccaacctacggatccacatccaattttttacgcgtctaccttggaaaatattaagtggacacccaaaaagttgattggcaccc

SEQ ID NO: 935 - DNA, 658 bp, Glycine max
catatactcgtactcacctgttaataatattaacccaaacaaaaaagctcaatttcacttcatagtaccttgtgcaccacattaattttgacatcaaaggacaatttcaaaattttaacataagatccacaccaaaaggaccatcatgtctaattcaaattttcgtatctccttggtagcatacaagccaaataatccaaaaattgaattagaggttgagaaaaggcagagaaataaagacccaccagcaggacaacccaaagaggtggcccaagaggtgtggcatacagaagcatcaaggccatccattttcatcctcataacaagccatttactgagacttgtcttagtcttctccgcaccctttctacctctcatatggttcaatacacacttcaataccttagcctcacatcctgtatcaccctcactccttagaacatcctgaaaacatagggggggaaaacacataagagacaaccttaaaccaagacaaaacattgaattcattgaacagctagtacctgtagaataaaatattgggttcggtggtttaaggtgtggcaatttgaggacgtggaacttgtgggggatgttgattcggattctataaaatcttgcaccatttgtactaactcgtcttcctctaaacttccca

SEQ ID NO: 936 - DNA, 343 bp, Glycine max
gatactttgatgcacagtatgaagccattgccaatgatgacaccgtgtttacatttttaactaataaagatgctccaaaatataaaatagtccgagtagatttgaaagaaccaactgcttgggctgatgttctccaagagtctgaaaaagatgtactggagtcagcatgtgctgtaaatggcaaccaactgatagtaagttacttgagtgatgtgaagtatcttctacaagtaagagacttaaaaacaggatccttgctgcatcaattaccaattgagattggcagtgtttctgaaatttctgcacgacgtgaagatagtgtggttttcattggctttacaag

SEQ ID NO: 937 - DNA, 444 bp, Glycine max
caaacaagcaaggtttaacattcctctataaggcgaatgaagtaaagtcgttacaaataaaagcttaacaaatagcagaggcgaaatgtgattattgaagttcaaaaaatgctacaaaagtgggtttttcttcttcttcttcttctttttttttgaaacgagagacgaaaaaaaaggattattttttgttgtagcgagctacctcatcatcgttggggaagaaacccatgagtctaccagcggagttctggtaagcatacatgaacccacccatcactccgatcaagccccctgtaaccatcgacggacccctaattccaggcttaatccctaacaaacacaaattcaattttcaatttcaatttcccaattcaattcgattagatttagaatgacacgtggaaagaaaagaggtgagggtactgaccggagagatagccgacg

SEQ ID NO: 938 - DNA, 854 bp, Glycine max
  misc_feature (802)..(810): n is a, c, g, or t
tcatgggcagcacagcttggaatatcagactcaacaacacgcaccaaccaacctcagcactctctttcctcatgtttgggttcttctctatctgtctctcattttcctcattctggcgggtactcattaatccctcttacattccctcttaacatcatacatgttcatcatagttaatgtaaagtttgcgttggatttatcacacgaacaattttattacacggtgattatttcccgcttactcttgacatgtgttttcttgggtaattaatcaaagctgatgataataatgcaaagcttgatgcttttgacttgtttctgttaacgagtttttgacccattttcgtgtattgtttggtgaatgctgcaggagaggtttgggtgctgtgagagaccttaggaggggagagattgttctcagagttccaaaatctgctttaatgacaagagagactgttatggaagataaaaagctctgtgatgctgtcaatagacactcttctctctcctcagctcaggtttctttcttaacggtgctacttaagtgtgattgttctattgctggttttgtttattgttgctgtaatttaatttaatttgtgacaatgtgctaaagccattggtttttattatctttattttgttatgagaccaaactaaataccttttgttaaaattattgtgttcatggttgaacttggctctgaacacacctaattagatatggtttcatcattattgttttattattgttatgtattcttgcttttaattgaatctcttatacttacttatgtgcttnnnnnnnnncagatattgattgtttgcttgttgtatgaaatgggtaaaggaaa

SEQ ID NO: 939 - DNA, 726 bp, Glycine max
gagatgatttatttaaaataaatgctggaattgtgaggaccctttgtgaaggaattgccaagagctgccccaatgcaattgtcaacttgattagtaatccagtgaattccacagttgctattgctgcagaggttttcaagaaagccggtacatatgatccaaagcgactactgggtgttacgacccttgatgttgtgagggcaaatacttttgtggtaagcattgctttgctgttcttattcaagcagtttataactccttgaaatttccttccagctgtgtttcataaataaaatatcttggggactacaagctaaaactataatcaaatgataactgtttgatcaaattagtttgtttatatagtagtattacagtgggttgaacagagcagatatttctacattgtgagatttttatagtatatgctggaattgtatgaatagaggctggtgtatgtcctgccatgttttcttctttcaggcagaggtacttggagttgatccaagagaggttgatgttccagtggttggaggtcatgctggtgtcacaattttgcctcttttgtcacaggtcttgtagaggatactccctcacttcaaaaaaatattataaaacaggtcactgaaacttcttcaaacttggtttttgcaggttaagcctcgcagtagcttcactgcagaagaaactgaatacctgacaaatcgcatccaaaatggtggaact

SEQ ID NO: 940 - DNA, 729 bp, Glycine max
atagccaaaatttccatcatgccattctctgctaggtaatttgattattgcatgtttttgatactgtgtctagctggtgttctaattattattcttatttcctaaaattccatttgttttataatagggctttggaagagaaaagagctcgacttggtttggtggaatgcgtcaaccatgagctcttgcagccatatcctgttttgcatgaaaagcctggtaaaaaacttttgcccagtaggcataattaaatcctgtgttgtcatttatgtgcgccttcatgtcatgcattacattggttgcattacaggtgattttgttgcacatatcaaattcacagtcttgttgatgccaaatggatcggatcgaatcacaactcatccactccaagaattgcagcccacaaaaacaatagatgatcctgatattaaggcctggctagccttgggcacaaagacaaagaagaaaggtggtggaaagaagaaaaaaggtaggctggaagagcatgttgctattgttctattattccttgtgttgcatcatgcttctgtattattgcacagaactgcatcatttgcacatgcaaagtttcaacgttacttatatcgaatggctcaacaaataatgcttcttggttgtttgcacaggtaagaaaggggagaaggcagatgagtcagctgaagctgagcctatggactcaacaaacgaggccactcctcaagagtgact

SEQ ID NO: 941 - DNA, 920 bp, Glycine max
  misc_feature (8)..(8): n is a, c, g, or t
  misc_feature (61)..(62): n is a, c, g, or t
cgtctacncggaactcgttcgagcctcaccccatggttgccgatgcctgggaatccctcanntatctctagtctattttagaggccaaccggttggcacaattgcagctgttgatcatcaatcagaggaagttctgaactatgatcaggtgaattcctcaaacaatactgaaatgtcatattccaattttaggggtgtgttcaattttttttgaaaaatgcaagccatggaaacttaatggtctagagctatgatgaactaagttgtccttaacatgcttctttattactttaatttgaaaataatggcactctagaatacttgaaattgaattctagtacatgtatcacgtgtgacaagtttacatttaattgcgtggcaatttgaacttgaaacatcatacaatttacagattgctgcaaattttgcaggacatatgatatgtgataatgtaacatgataacatatgtttagacttcataattacccaaaagcttgaatttaatgaatctaatagtactacaataaagtgaacaaaaataaacggatgctctatcatatatttgactgaacatttaagttggaaatattctgaaagcccctttattcctgaatattacccaagcctcaggttttgtgataatggatcccccgcaaacctaaaagcaccatgaactaaatctttttactgttgtgggggtcttctaagaaagagtttgatatttattttataggtttttgttcgagattttgtgcccagtgctctagcctttttgatgaatggtgaaccagagatagtcaggaacttcttgttgaagacactgcatcttcagggttgggaaaaaagagtagatcggtttaagcttggtgaaggtgtgatgccagctagtttcaaagttcttcatgatcctattaggaaa

SEQ ID NO: 942 - DNA, 375 bp, Glycine max
gacacagatggaaataaatttgtggattgcctccgcgatcagaacattgtgcccgacatcaaagttgataagggtctggtccctctgccagggtcaaacaatgagtcttggtgctaagggctagatgggttggcttctaggtctgctgaatactacaagcaaggtgctcgatttgccaagtggaggacagttgttagcattccatgtggtccttctgcattagctgtcaaggaagcagcgtgggggcttgcacgttatgctgctatctctcaggacaatggtcttgtgccaatcgtagagcctgaaattcttcttgatggagatcacccaattgagaggacactggaagtggccgagaaggtctggtcagaagtc

SEQ ID NO: 943 - DNA, 331 bp, Glycine max
aggagaaattgatggtggaacaaccaaggtagcaattaaacgtgggaatccactatctgagcagggggtgcatgagttccaaactgagattgaaatgctctcaaaacttcgtcaccgccaccttgtttcactgattggctactgtgaagaaaacactgaaatgatccttgtctatgactgtatggcctatggaacactcagggagcatctgtacaagacccagaaacctccacgtccatggaagcagaggcttgagatatgcattggagctgcccggggtttacactatctacacactggtgctaaacacactattatccaccgtgatgtg

SEQ ID NO: 944 - DNA, 387 bp, Glycine max
ctcacctcaaccctcttctctttcaacatctgagaattccaagttctgttctgagaagaattcacaacaaccacccttctctgttttattttattccttcactctgtgaaaacaaaacatcatgtctcagaaccagaatggcaagtgggcgcgaattgccccagaacaagttcgaggctcctccaatggacacgtggaagtgggaggttccaacaggctctgcataaaccctcagaaagatcacaagtccgaaagctatgaggaccttcaattggagttcaaccctcttgtgttcagctctctggagcagtatttgcctcctcacatgttgaacctctcacgtgaggttaaggttcagtatatgaggaacattctgcttcgctattt

SEQ ID NO: 945 - DNA, 713 bp, Glycine max
  misc_feature (61)..(62): n is a, c, g, or t
  misc_feature (638)..(638): n is a, c, g, or t
ctggtttggctagcatcttcctctaattgttatgataggtctgcaaattcattatgcagcnnttgccatattcacaagagccgctctcttagatgggttgagtacaacggtgtttgtagtatacaggcaaggcatagccactttggctttggcgcctatatttttctctcctaagaggtaataattaaaccactttctcctctttttatagcttagtctcatcttctttcactaactcacatatacatgcttacttttgataacaggagacaatcagtgaaagattctttgggattcaggagcttctttttgatgtttgtgaccgctcttgttgggtacactactctgccaaactcacttgtaacatgctgttgaatttataccaaagagaaaattttaaaacttacccttaattttttttattttttccttgcagagtcacggcaaatcagaatgcatacttcaaaggattattttatgcatcttctactgcagctaccgctatgagtaatctgataccggcattaacgtttgtaattgcagcaattgcggggtaatgactctaaggatatacatgcaattacaaagtacgacaagaaaaaaaggaatcaaaacataattacttaagctaaaatagnatataattaattaacagtataaaaataaatcatattcttttgctgatacgggtttccttaaaattaaatgagtca

SEQ ID NO: 946 - DNA, 799 bp, Glycine max
  misc_feature (38)..(43): n is a, c, g, or t
cctttgcactcttctcaatggccttagtgtcaacctcnnnnnnaatggtgaagaaggatttggggcgccactcgtgctggatgagagcgtttgccttgccaaagttgttgacacgagccttcatggtggtcaatggatccaatgcatgctgggtgccaagtgtgagggtgttctcattggttgagaatctgtgagttacctcagcaccaacagccgtgttggtcaagcgattgactgcatggtagtatgaagcattcaaggcatcccctttgtcattcctgcacacaagaattcatcgtaccaccaaacatgtaagctcgtactatcaatcatcaaaacacaacaggcctgagaagagtttatacagaatattcaaatagggaaatattacaacaaagccttgtctaatagggtaagatcaatacatgtaaacagacgatgacaacaacaacaacaataaccttatccaaaagagaaaagggaaaaaagatcttctatataatggaacctcagctagagttaagcattagaaaactacaaagtacttcactagcagaagaaaagaacaaacaagctcaagattaatttaaaaattccatagttcccacatgtaaaagactaaatctaaatgaggcaaatgaaataaatgctgaaactccaattagaagcatcctctcaaaagaggacaataattactcacacagtcaatgaggcaaccaaatcgtctttggtgaagttcagtccagcattgaatttagttaactccccaattttggtgtcaaaagaaacatcagtacca

SEQ ID NO: 947 - DNA, 668 bp, Glycine max
ttggggagcttaaaatatccatctcattctggagtgaaacattttcagggtaggaaagtttaacttttaaacctcaatcctgtcatatcatgcagtgatgaaatgttggaaggacaaatactagttctttttaaattatctatctactgtctggcccattatttgtatttgatttctgtattaacctacagtaaagacaccataaacgaagtgcagaaattttggacataaaaacctgtagtttactaatttctaaccaaaatatttataattttggacaagtgggtatggtcaacttataaaccacttgttaaattgtttctaagtgaactcttttcattccaagcattgcaatctcccgtgaaaatttccgttttatttttctatgatttacttatgttcgttcataattccaaaatttcagtctggctttttcctggtgcaatatggtcacttgtggcaagaacatcttgacagactatttaatctttactcttcgggaaagctaaaggtaagttatacacattccattcatatctatggatcaataaagctatcttcattaacagtatatttatttgatttttgctagttgctatacttagcagttgctatgctagtttgtgatccttaactttctcgtttcttcatacaggttgctattgatc

SEQ ID NO: 948 - DNA, 543 bp, Glycine max
  misc_feature (393)..(402): n is a, c, g, or t
ctatggaagtcatgtccactttctttggccttccccaaccaaaatcagtgccataaacctcaaacaatggcgatccagcaatactgaataatcgaggcacactctcccctctttcaagcattaacgaaacccaagtttctgctccactcagcactccctcacccttcactatattcaaagcctcgcttatcccttccaaagcactgataaaaccatcgcttattccaaccaagttctttgtcacagccacaaccttttgccccgcgacgcagttcccaaaatacgttgcaggaatcggaggattcaagcgggatctacagtccacagaaaatacgaaacccacatcatcttcctctggttgttttgctttgaccaagcaagtcaacacataannnnnnnnnntccgacaatttatcagtacctgcataagataaattaagttaaaaaaaacctctgggtttgcctctgaaaccatcaaagagtacatatcataaaaatgaacacacctgagtattatttttaacactcatcatgagtacagat

SEQ ID NO: 949 - DNA, 377 bp, Glycine max
ttccaacaggactcactccttgcctatgagtttggtgtctcccaccaaccaaagtttcacctttctctcttcctttaaagaaccaacacatgcacgccccttcaccactgctgttgcatctgttgattctgaccagcttgattcatctgatcctcccaccaaggtttgttcctctcttaaactccaaccccacattgaatttgtgttcaattttagttttttattcttattttttccattttggtgttggttctacgttatgttatcctaagttgttatctgtgaagggggtctagctcagttggttcagcagggtgtgtgaataattgtaaacccctgacactttctttgatttccacggataaaaaaaaaaaaaa

SEQ ID NO: 950 - DNA, 998 bp, Glycine max
  misc_feature (35)..(47): n is a, c, g, or t
  misc_feature (57)..(65): n is a, c, g, or t
  misc_feature (82)..(87): n is a, c, g, or t
  misc_feature (859)..(861): n is a, c, g, or t
  misc_feature (912)..(916): n is a, c, g, or t
  misc_feature (945)..(947): n is a, c, g, or t
  misc_feature (950)..(961): n is a, c, g, or t
  misc_feature (981)..(982): n is a, c, g, or t
acctacacctactccatatcgactagtggagccannnnnnnnnnnnnaggtgacgtnnnnnnnnnaagaccctgaggaggannnnnnggagctacctcctgagcctgctgtggatgctctgtacatttcccatgtcatgcaaggccagaggcgctgaccttagagtgcatttcaaggtacttagatttgttaccatttgatgatctcgggttatgatgtactagaccattatatgccatatgcctaaccctaatttttagaattgaatgtaatgttatttttgtatgcatttttgcattatgattgtatgtccataatttgggaaacctgatgaaaaaagcaggggtttgtttttgattgtgtggacttgcctctcgtaaacttcagggatataatttccattgttattgggtgaacctctgttctcttttgatgtgactgaatgttcagtaaatgatggaacacgcttttccgcatatgctattaatgatggttaacttggttaactcggttaactcgatttcgtgttaaaaaaatatacattgcttttattctaatccatttggggtatagccaccattgtttgtaggttaatatgttttccacttatgttgatttaagtttcataaggatggttattggtcagtgatgagctttcaaataatttgtttgtctgtccacttcacagaacactagggagactgcctttgccatcaggaagttgcccctggttaaagctaaaagatacctggaggatgttttggcccacaaacaggccatccctttccgacgcttctgtggtggtgttgggaggacagcccaggctaagagcagacactccaatggtcaaggacgctgnnncgtcaaatcagctaagttcatcctagatttgctgaagaacgctgagagtannnnngaggtatgtgtcctgtatatgcatttgannngannnnnnnnnnnnattattttaagtcaactttnnaagtaataaaactttt

SEQ ID NO: 951 - DNA, 352 bp, Glycine max
gtataataaaccagtttctctaataagtccacaaaagtagagtagaggattatccttttgaaaacaaaatgaagaaatgggaaaatgcattttgagaaaccaggatccctttaaattaaatggataataactctgctgtaaattggcattgcctggcatttgtaaaggaaggggaaactatgtgtcttaagcaacttaaggagcaaacaaactcaacattgtggttaatctcacagctacttggatgtggatatagaatggtctgattaacccccgtattgacaacttgtgtttaatacttcttttaagagttgcccattatatctcagaattgactatatgcattgccaac

SEQ ID NO: 952 - DNA, 559 bp, Glycine max
  misc_feature (407)..(412): n is a, c, g, or t
  misc_feature (424)..(426): n is a, c, g, or t
tctggtggggcattggtgaaattttgcgattatctttgttaaggagtacctttcacttaaaatggccggacactgtctgcaagtgctatattgtatcaaatatgggatttgcagaaccgtgcctcttcctcacacttgtatttctccttcgtgcacctttactgaatttggagactggaattatgagcagaaaatggaatgtgaaaacatcgggatatattcttctttactgccttccaatgtttgttcttcagctttttgttattttggttggacctcagttagacaagaataagggttctggaaaaatgttgcctcattatttttcaagtgcagtggttgcccctggggagaatgataccatcctctgtacttaccctttactcagcactattctccttggcaannnnnnccataaataaannnaggactgctgaatgaagttgcttgagtggaactcaagcttggttggataatattcttttaaagttcagacattgtttccatttttcttatatttaagtattttgaatttttgggaggatggttttgctctcat

SEQ ID NO: 953 - DNA, 404 bp, Glycine max
ggtattacatgaaagtaaagagtaaacaaaagataaaataaaaaggtttggcattaatatgtacttaaggagcccttcacaaattaattacaaagtaatcaatgttctcttctgtttccttatacaatactacgtatataaattaattcagaacactgcatcacttggtccttgtgccaaataatgattttctctatattgttgatccaagaatgctccataacacaattgaagatcatcaacaccatttccagcttcatattccatttctacatgttccatcatcccatatccataagggatccatgcattcatctcatcaaagggcaaggaagagatcaattccaagtcaacccaatgatcagggacaccgactgacgcggagcgatcttgatcatccacgt

SEQ ID NO: 954 - DNA, 446 bp, Glycine max
cctacacacacacccttttacttctttaacctacaactaagattttaatttgtaattggtctaattttgcttactttccttttccaagttttcaactctttgcatcttttgataaagttttgatcactttctaattttgtgtttttttctcattttattgggtgcagaagagagggttgtgcttcttttctagttgcttgttaccaacttgcatcgcttgaaaatcagagaatgtgttgatgccaatgtacatatacctgaaatagaggaatagatacttcaattggatgatgctcaagtaaaagcagcatattttgagtccaagaagactattattatagtcatgacattggaatggtcttcttgccaacttagagggttcttttttgtttcactttttccttttagtctttcatgtactatgggctgagttattgttatgacta

SEQ ID NO: 955 - DNA, 462 bp, Glycine max
  misc_feature (381)..(393): n is a, c, g, or t
  misc_feature (406)..(408): n is a, c, g, or t
  misc_feature (441)..(442): n is a, c, g, or t
ttaaactttcatcttttgaactctcttcttcttcttcccgttgttgccatgttttgccgccacagttgtccggcagaacacgcgccttactgccggacaatcttttggcggcagagttggcggccaagaagagtactgccatgtcaggggcggtgacaagagagttcactctcctcatcgggaagaagatatacacgttgccaaactccaactcttcatcagcaccgagagcagagaatcttcttcctatatgcaaagaacgagaattgaccaaaaaatagttggggtgttcgagcatgagttccgcagccttcacgatctctttgaattgcttgacttcaccggtggggatgataaccctcgtggccttggaattcttcnnnnnnnnnnnnnacgatgttgaggnnnccttaattactatggacacccctgaggaggatnnctcttccgccaaatatgtgg

SEQ ID NO: 956 - DNA, 468 bp, Glycine max
  misc_feature (342)..(349): n is a, c, g, or t
  misc_feature (356)..(378): n is a, c, g, or t
  misc_feature (382)..(386): n is a, c, g, or t
  misc_feature (400)..(409): n is a, c, g, or t
  misc_feature (415)..(416): n is a, c, g, or t
  misc_feature (432)..(435): n is a, c, g, or t
cgtctgttctcatgggaccggcagaactcggggccgaagaatgtatttcctcagcctaaggctgatgagatgaagcaggtgtttgacaagtttgattccaataaagatgggaaaatttctcaacaggagtacaaagccaccatgaaggctctaggcatgggggactcggttcatgaagtgccgaatattttcagggtggttgatttgaatggagatggattcatcaacttcaaggaatttatggaagctcagagtaagggtggcggggttaggatgatggatatacagagtgcatttcggacatttgataagaatggcgacggtagaataagtgctgaagannnnnnnncttcttnnnnnnnnnnnnnnnnnnnnnnntacnnnnntttaaactgctttnnnnnnnnnntgaccnnaaacgaatcattagtnnnnaaatcaagcgttttcgttttttctcaagaatca

SEQ ID NO: 957 - DNA, 579 bp, Glycine max
ctggatccttcataatttgcaagcaccacagtctcagatatggcctgataaaacaatattaagaagtatagaaacattactagctacacgttccatagtggtcataagagtagactgagaaggtttaaaatcatcatcatcatcatcatgtgatccattagtaacagaaataacgccaaaatacctgtaaaaactggccatttggtgctctaatgcgaaccctgttagggtcatcatcattcctcagaatctcaaatgtttccaagtcgctaggtgaatctgaatcagccactaaattgcttcctccatctcgatttgtcaatcttataaattgcttattagaaactctaaaattgaaggtggattcattgatcctccacaactgcgttgttgatggtcacaaaaaatgccactaattaaatatataaaattataaatgtgtaacagatacattaaataaataaaactcttgaaaagtatatatatctgttaaggaaccaaccctgaaagtttcccaaccagaagctttggtgcggttggcaacaacaacacttcctcctccatgttctgcacagagat

SEQ ID NO: 958 - DNA, 631 bp, Glycine max
  misc_feature (57)..(58): n is a, c, g, or t
tgagatgatagctgctgcaaaactacccaatccagaattcatatccataatgttgcnntaccttcccgagtccaacagtctattagttttcttgtaagcttttacgtgttttttccactttttgttatcatcctggtatgtctcagaggaaactccaggaactaagccactagcaattctgggaggaatggcatatagcctgcttggaaatggtttaagattcccgccagtaactttaggagtgggagtaatgcaggcctccattttcttatacctatagccacagaacaaagccattccaactcagtacactacttatttctgaacaaagtcaagcgttgctcacatttataggattttcaaaattaagatagacaataacaaaatatgtaagatgtgttaatatcaactagacaatatcatctctttatcccaccactatagttttcatgtatacaattatacaaacatgaacatgtatgtttgttgtatgactagtagaaacaaataaaggaaatatcaataatgaaccattaaaatgtaaaattatataactaataagggagcatacataccagacatcatcggcatctgaggactggcaaaattccacactagaatcatcttttct

SEQ ID NO: 959 - DNA, 465 bp, Glycine max
tttttttattgcttattttgaagggatcaatacaatataatggttcaaacatgctaacggtgtatgctcctagagctattctgaagtgtcatttacaccaagattcagcttctgctcaacaagcatatccatgcaagatcaataataatgctaatttggtgaattgtaatcctaaaccttttggcactccttgtagtaatatattgtttcatagttcctcctctgggaaatgtgataagctacaaaagagccttcatctattccatcatgtcgccacacataaatggctggtaactgtgcttgctggatcattgacttgtgtctagtttagttgatttatcaattatcattgctcttgctgattcatatgctttttctcccttgctacagtgtgggttacaggattccatttcatctgatgatgagtatcgttcttcccgcaacatagccatcagcttgttcagg

SEQ ID NO: 960 - DNA, 745 bp, Glycine max
attatgtccacaatatggtaccaaagtcttcagttttccattactaatgatcacaaattgttccaaatttgtagtggagctacagagtataatcctaacctcctcaaatactcttgccagattgaatgcaggttagaatttaatcttatatattgtaagtgtaaaatttttttactatcaattaataagaataagaaattatgttagtatgacttttaagataattatcataaaaaaatcaacaaacttattatatatgatagtttatgattacatgacagtataaaaaccctttactttggatacacgatttactctttcttttaaacttaaaaggcacaaagaaattaatcaatattatgttttttgacatatgagcctgaaagtagtctaaagtatcttatcaatctaaatattgaatagggtgcaagcattgaagcccttgaaggtttcaggagcattcccttcaacaaatgatgacactgaactgtcattagaagattatggaagcagtagccatgtagctaaagatcacaaaaatgatgcacagaatttcagcacttgtgtgatgttatcaaaacccatattagcgctcaagtttaatcaaatgatgatgcaggttgaagctccccttgtgctttcccaatgctcaaattctttagaaactacagttagttctgttccataggcaatatttgttaggggataagtgtgtatgctgaatacttaatccatcatgtaatca

SEQ ID NO: 961 - DNA, 357 bp, Glycine max
atactgcaattgaagtatgccaacccaaaacccaacacagctcgttcggccaaaaattatctgagataactagcaaggctttcaaagggcgtcatggcagcaaccaaaatcaacttcaatactatagccaaactcaggttgagtcccaaggccacaatggcaccaaaacagaggctcactactatggccaaactcagacccaaaatgacaaaaaacatggggtctccaaaacccagatcacagttactgtcgtccaagcacaaattacccacaccgagaagaaggacccttatccttatgataccactacaacatgctttggggctcatgcaaagaagaatggagagctcaacaaca

SEQ ID NO: 962 - DNA, 736 bp, Glycine max
  misc_feature (311)..(312): n is a, c, g, or t
  misc_feature (321)..(330): n is a, c, g, or t
  misc_feature (332)..(344): n is a, c, g, or t
  misc_feature (355)..(359): n is a, c, g, or t
  misc_feature (362)..(374): n is a, c, g, or t
  misc_feature (376)..(381): n is a, c, g, or t
  misc_feature (394)..(412): n is a, c, g, or t
  misc_feature (420)..(426): n is a, c, g, or t
  misc_feature (434)..(440): n is a, c, g, or t
  misc_feature (443)..(458): n is a, c, g, or t
  misc_feature (461)..(462): n is a, c, g, or t
  misc_feature (465)..(468): n is a, c, g, or t
  misc_feature (473)..(480): n is a, c, g, or t
  misc_feature (483)..(488): n is a, c, g, or t
  misc_feature (496)..(501): n is a, c, g, or t
  misc_feature (512)..(517): n is a, c, g, or t
  misc_feature (519)..(528): n is a, c, g, or t
  misc_feature (531)..(533): n is a, c, g, or t
  misc_feature (535)..(549): n is a, c, g, or t
  misc_feature (556)..(561): n is a, c, g, or t
  misc_feature (563)..(568): n is a, c, g, or t
  misc_feature (570)..(572): n is a, c, g, or t
  misc_feature (574)..(580): n is a, c, g, or t
  misc_feature (582)..(585): n is a, c, g, or t
  misc_feature (587)..(590): n is a, c, g, or t
  misc_feature (597)..(599): n is a, c, g, or t
  misc_feature (603)..(604): n is a, c, g, or t
  misc_feature (611)..(621): n is a, c, g, or t
  misc_feature (626)..(638): n is a, c, g, or t
  misc_feature (641)..(644): n is a, c, g, or t
  misc_feature (646)..(658): n is a, c, g, or t
  misc_feature (660)..(660): n is a, c, g, or t
  misc_feature (662)..(682): n is a, c, g, or t
  misc_feature (685)..(715): n is a, c, g, or t
  misc_feature (717)..(725): n is a, c, g, or t
  misc_feature (727)..(733): n is a, c, g, or t
gtggagtagagggcgcgaccaagagacgagggttttggggtgccgttttcgtcaaccttattgagttgtaactttcccgaggaggtcacaatagcgtctccttggaggatcatgtttggttgcttcggcacgaacttgttccagctgaaagaaacagtttccgctgagtttgccttgctggtcagtagcaccagtaccaaggttaaggttagggagagagatacaaccacattctgggttttcaactttgaagtagccattgctttgcttcagagaggataatgttgcttactcttgtgacattagggaannaaggaagtnnnnnnnnnngnnnnnnnnnnnnntccgacctggnnnnngtnnnnnnnnnnnnngnnnnnntgagtgcccaggnnnnnnnnnnnnnnnnnnntgttggtnnnnnnntgacaaannnnnnntannnnnnnnnnnnnnnnaannaannnntaatnnnnnnnnttnnnnnnaaaaaaannnnnnaaggctgtatnnnnnntnnnnnnnnnnaannntnnnnnnnnnnnnnnnaaagaannnnnntnnnnnnannntnnnnnnnannnntnnnntattaannngatnngtaatannnnnnnnnnnttggnnnnnnnnnnnnnacnnnntnnnnnnnnnnnnnangnnnnnnnnnnnnnnnnnnnnntannnnnnnnnnnnnnnnnnnnnnnnnnnnnnntnnnnnnnnnannnnnnnata

SEQ ID NO: 963 - DNA, 499 bp, Glycine max
taaatatgattaaactgttttcataagttgtaattgttttcataaattatactggagaacaaattgaattaagctaagagcaacttatggacaaaataataggctattttcataaatacttatgccacaagataaactgtaataaattcttcccaacgcaccttaagagtgttatagatatattatatatataatgaatggcagcattaaaaccgaggaaaaatgttattatcacttatcagaatttaaaacttctaacttgaatccatatttttgtccctgtaagctgtttctctttctcctatgtatggttcatttcaattaataagaattttgtctttatgtagctactgttattctgatatttttctcttttgtgattgtgactacatacttatctcgacatgttgttttatgcagctactacctaacgtggttaattatgagaattggacaactgtgttcggtgaccactttgaagttccagctgatatcagga

SEQ ID NO: 964 - DNA, 306 bp, Glycine max
tgagtctcatcaaaagtagcacatacagactatgaactcttcactatggtcagtagaatgcatttgcgtttgaggtctcacccttcttcgagggtgcacttcctaaattatcacatttctgaatactgttagcttttgtttttgttttctttttcttcaaacaattttcctgatctccttaaacaaggtcaccttaagttatacttggccatagacatgtaatactttgtctcctcccccaataccttttcctgtggatcatgtttgtatttcaatgaaaaattgattctcgtgttcttgcagggt

SEQ ID NO: 965 - DNA, 593 bp, Glycine max
  misc_feature (517)..(519): n is a, c, g, or t
ttttcatagatattgctcgagtagatgaaccaatccggaggcaggagtttggagagattcttgagtctaatgagaaaattaaatatcttctgaaagaactatgcaagattcctgaaactatcattagtacaaacaacataattcttcaaaaccaggacacattaattttgcgtattacaaataaatgtgcagaaggcaatgctttgtttgaaataatttgtgaaggtcagtctactgttacaggggatcagaaggctactaaccatcagttgagaggttcctttggcttcccaaggtggcttgaggtgatattctttatttaaaataaatttcttttttgtacaatatttatggctatggaaggaacttgaaaactagagagatttgaaagtcaaactaaaaagtaatttttatttctaatatgatggtgacaatggatgaaatcactcctatatatactttatcacatttcattcaggaacctcaagagtctaaaaactttataattctctagagnnnaagaatctgtacaggctaattaaagataaaaaataaattgtattaattactataaatataacctcaagtgtggt

SEQ ID NO: 966 - DNA, 387 bp, Glycine max
ctcagattccaacatctatcttacaatctctttacctgcaactgccactcgtttgttgccaataatttgaacaagttgggttttctgactggtggatggaatgtggtgaatctggcaattttcattttattcaatggacgttgggtcagcaaagcatctatgcttcgatctatcttaccatttgtggttgtattttttcttggagtcacattctggggcttcaccttcctaaagttttggttcttcttcacttccattcttattgggtggttccttcttggtacttattgtttcaagaacctgattcagttgtagtatctgtttctcttgttctactttgtataaaactgtaatacgttcgaagtgatggaagtgacccaattaacc

SEQ ID NO: 967 - DNA, 399 bp, Glycine max
tgacttgtaactcaggaacagcagctcgttacaactgatctcacatcaatcattattcaattgatctctaccgcaggtagtctcctcccttctgctaggcataaccttgtaaacactagttcattggttggacagattgaccagcttcgtgggacgaccattcctcctgggaccggtgcaagtaacggctgtattcaaccacagaataatggtggaaaaatattgtctgatcagtccatgcagactgatctacctaatagtggtgaaatggagcaaaagtacaatatggtagaacatgacttgaaagatgaagaagatgtagaggatggagaaaaccttgcccctggttcatatgagattctacaattagaaaaagaagaaatccttgctcctcatacc

SEQ ID NO: 968 - DNA, 991 bp, Glycine max
  misc_feature (47)..(51): n is a, c, g, or t
  misc_feature (935)..(943): n is a, c, g, or t
  misc_feature (977)..(978): n is a, c, g, or t
tgcttgagtcgcctttcagatctagtgaattctgtatttccaatgtnnnnncgtggtagtgttccctccaaggaacaaatatcaagaattatatcacgcattcaggaagagatagaaactgttcagatggatgcacgcttaactcttcttgttttgcgtgaaattggcaaggttttaattcttcttgcagaacgagctgaataccaggtaaacagaaatgacgttattgtatctaaggcgttgtatgctgcttattagatgttttaagcgctacatttattggcttagaaatgaaatcaatgctatctagatcatgggttttcaggaataactacttatatttttggaataaagaatattttattacaaggaaagaatggattcacagaaaaaggaaagtcttgttgactgtactgtaaatcatggcattgttaactgcatgcataaagaatatcatgtgttctttcattgaggagtttatacttcatatgcgtattgtattattggacttgtactgtatcacattgtagtgatcagcaaccattcaatcatttaacttgcttactcattttatttttcagtgtgttaagtaattaatatttttgctcgacttatataatatttttctgatattactacctgaagtgttgtcacttgtcatgatatggtgagatataatgaccggagatagataattatttcctaaagtgctgttgctgtatgttttctctggaacctaaaggctttgtttccccttcttctttgtgtatgagttttgcaatatatagaatcccaaagtccattttattcaagtgaagggaggacaactactatagaagcatagtttctaatcttttaattattcaatgtcattgttatgacagatatccactggtcctgaatcacgtcaagtaaatggtcctgcaacaccagcnnnnnnnnnagaactttacattgtgtcagcatctgcaagatgnncatacacggatat

SEQ ID NO: 969 - DNA, 369 bp, Glycine max
tcatcataatttggtcagtttagataattctgggttttgacaattgatttcaatacgacgttttcctttttccagattttatggcagttgtaagatgatgtataaactgcagtattggagttggagacaagcatgtttcagtgtttatcagtgataatgcaggaatagataatgtaatttgtttttaaaaaaaaaaccaactaactgtcatgttatttttctcaattaattactgtttccaaaagcgtcaatttcatattttgttaaattggtgaacacctgaccaaccatattgtccacttttgaacaaattgtaaatttctagttatagcatttgcatgtggattgggaaatagccttctgaaggga

SEQ ID NO: 970 - DNA, 357 bp, Glycine max
ataacttttccttccctcaaccttggtagtgttaaatcaggtccacagcagctcaatatgtttcatcctcattcaatttattgagattgagaatatactacatgttacatccagtaaaatatcacatgagactcaattcatacaaacttatagacttgtagtagtaatagtagagggtatatcaagaaatcaaaactaaactacttcacttgcgatcgacaaaggtaaagcgcaatgaaaacactacctgccgacccaaatttgaatatcaaacatggaacaagaaagtaaacaaaaagagacagcaaagatacctaactaaagaaagcaaaaaactgacaagagattgtgaccctt

SEQ ID NO: 971 - DNA, 408 bp, Glycine max
  misc_feature (27)..(27): n is a, c, g, or t
agcactgtactacagtaatttctctanactgatgtaaaattggaagaagaaaagatctagcaatgtttaatggtggctcagtttcattagttacagagtgaatcggagtcctaactcaatgagcgagtgtacttttgctgtgggcacatatcaggaagtggttcttcagtttggaatctaaagacaattgaaaacagtagctggaccagcccaagaacaaattgcttcaaaatctaacatgacaacatcaagggtatcagttatccagcatgtgaaaccttgatggcttcatacttctcacctaccgcaccgcctttttgtttttggaactctatataccgcatagtactggctaagaaagcaaaaaggcggtgcggtaggtgagaagtatgaagccatcaaggtttc

SEQ ID NO: 972 - DNA, 334 bp, Glycine max
ctgaggagacaacaactgcaacgatcactgatggaggagattcacaagaggagaatgttcaagacggttggtgccgttgagaacattgggtttcagaatccagaaggaggcggatgtttttcttattgaaactccaatctccataggttccaatgctctttttcttttttaacttgttatgctttggggtatttattaattattgtaatgccttatgaattaagatgtccgtgaatatttgtatcctatacggactcatccgaatattgcaaaataaaacttgtaatatagtttaatttatgcttttgttaggagatgtttgcttgtttgtaag

SEQ ID NO: 973 - DNA, 386 bp, Glycine max
atataatggtacaaagccatcactccgcaccaattatttcaatctgttctgtacatgtatgagaccattgaaatttaaaggaacataaaaacggctaaaatataaaataaaacatttttattttaatggacaagtgctctaccgaatcagcgaaagctaaaaccgaaaagaaaaacactagttaccacttacaagttactactactagctaacttctaagctatgagtatgaaccaaccattgatggataaattaccaagcaaatccgtatgatgaagtgaacacgaagagcaagaagaactccaatcactcgctacaaaaccaaaaacaaactataatcctcctcctccatgtgaccgcaactcctccatagctgccttgatctg

SEQ ID NO: 974 - DNA, 362 bp, Glycine max
tcccgacgcgcccacgtcatctctgagttccacgcgtcctacaaagacctcttccacgagctcgaagccaacctcgccgaagctggcaaagccagcttcggcgacgccaacgaccaagccgccttcaacttcttggcacgctccctcttcaactccaaccccgccgacaccaaacttggccgcgacggccctaaaatcgttcagaaatgggtcctatttcagctcggcccaatcctccgcttgggcctccctcaattcttggaagaatcaacaatccggagcttccgcctaccgttctctctgatccaaaaagattaccagagactctacgatttcttctaccagtcttctggatctgtgca

SEQ ID NO: 975 - DNA, 1105 bp, Glycine max
  misc_feature (955)..(957): n is a, c, g, or t
  misc_feature (1072)..(1079): n is a, c, g, or t
cgggtggaatagttgctgccttcatttcagtgttttggtcctttggctatattcgcctctctgagaagcttcgaaaaacttcaaatgaccctaccaaggtgtgtggattattgaatttgcttagggagctgaatgatgttaattgttgcaagttgcaattgtcttcacttagttatattaatgtgaaatcactgtgtgtatctatttagtgatttttttatgaggtggcttagcctttggttttacttgtgtatgcaggcacctcctcgtgctgatgtagtgaaaggcttgaaaaatggtatagtattgaacctgttggggatgggtgctgctattcttgggatgcaagccacggttggattgttagttgctaaggctctcacttcctcggcaaacccgtactatcagggaatttctcctggtagcaccccagtgctcgcattggatgtatttttggtgcaggtatgtcttcaatataatgtttccattctgcagatgaaaaacttctcatacagatgaaagttgagttttcatctctttataggccctgttatgaccgtcattttgccacctgaacaacaattctatctgttaggttctctggcatctgccattgcttttcttcattttaaaagtatataaatgagaaatttgggacaagtcttgactactgttaatttggggttgaagtatggattggtggagcttaacattacaatcggattgaaaacagaaacaattgaactctcataatgacaatgctttcaagtgtcaagaagcatatttagagggtatgaactgaatttgagtcctctaaagttacagtgcattcaagtgggaaaatttgcagagttatatagattgtgataaaatacatgcacatgtatacaagctatatatttgtaaaaatttacccccttgaatttccagtcaatgattataaattataagtctnnnacactttcacctctgaaatgcaccccatactttagaggcaacaaatttgaaataatgtaagtgacttctgaaaataggaaggctttgatggtatttagtatatttttttcccatnnnnnnnnaatagcaatatttgactgcttggtgc

SEQ ID NO: 976 - DNA, 695 bp, Glycine max
  misc_feature (685)..(688): n is a, c, g, or t
  misc_feature (690)..(691): n is a, c, g, or t
aggcatccacaggtataaatctaatactctataactagatgtagtatgatactgatgaattcggctatctacatgatttttgtggtcttgataacttggatcaataaatagtctgcttttgatgcagaactttctctcttctttggtaatgtgtctcttgtttttcttgatgcataagctaacttagttggagtaggaataccttactatctcaatattaagagtaatattatatcttctgaaaacaccctcctagttcatgttttatgcactgtaaccacttgccccatcatctgcttttactccagacatatttcttgcacttgacgtttgctctttcagatggttgggcaggttatctggtgtcttgctcatacgatttggattggaaattccgtggctgttgcagcttcaattggcttgattgcacatcatctatttggtgtctggaatggagacaggcgactggctataagatatggggaggattttgaattagttaagagtcgaacaagtgttgtcccttttgcagcaatcctcgatggccgacaagagttacctaaagatttctacaaggagtttattcgactgccatacttgacagttactgcaataacgttaggtgcttactttgcacacccgcttatgcaggctgctagtttcaaccttcattggtaggttgaannnncnnacac

SEQ ID NO: 977 - DNA, 383 bp, Glycine max
tggttttatcaacaatccaattaatgatacaaaaacggcaccctatagttgcaccatatcttccgctggattatagttggcacctaactatgtatgtattagttatgacgcttggaacttctgatgctatacatttttatttcagaacaccccgtcccatgtctcaggcatggtcccatatagaccatatatcagatccacaaaccttgtaagctacaaaatatagttcaatccatatggttgtggaacccggggagaagggaagtgataaatccaaagacaatcatctggatctccttcacaatgccccaccactgattaccaccattgacattgccatgttctgcaacattttcattctcgactgcctggtctgcatcatt

SEQ ID NO: 978 - DNA, 564 bp, Glycine max
caagtgctaggccacctcaagacatgccttgttctaggatttggctacacattactgcatgaccctttcaccggaaggaacattcttggaatactaattgccgtttttgggatgggtttgtactcttatttctgcactgaggacaacaaaaagaaacagttagctggtgatctcccattggcctctcaggtacctaattaattctcttctacctttgtttcttgcattttctttcctctgtctaaatggacaatttagctagaatttaatttaaatgcaaaatactatctgttaattagaaattatgatagatatggtttttcaaataattattataaaaattaatgaacttaatatacatgaaaataatttgttattagatgacccagtgtatagactaggactatttttatttcttcaatttttattctttgcaggtcaaagacaaagatagcttaccacttttggccgggaaaaacgtgggtaatcaaaatgaggaaaatcatgagactaataaattaagcaaggattctgttatttgaaaggacaggctcccatttcttt

SEQ ID NO: 979 - DNA, 558 bp, Glycine max
actttggcaagctttatgttaatgacatctaaaacattcccttccacaattttgtaaacatcaactatgcttctgcaactctcatcagctgcaacagatactccatatctctctcttgctatattaccgacataccgaagaccatcccaatcatctctatgaactggttgctcaaatagaacaggagtcaacctcatatctgtaatagaaaacaaatctaagttcaatgacaaattgcctaatatattgcaataaagtttcatgagcatattggtgcatgtgtgtgtacattttcttgcatggcaagacaatgacaattatttggatggagaaaaactttaactatatatgtagtgcttttaaccatgtagtttctcaagaacttccactgcttcctcagagttatacccctcattagcatcaagaataaactgacactcagggtgtgcaacacgtatagcttgaagcacttctatatctgcattcagattcttgcccactttcagctttaaagtcttaaatccttctttatagtacttagaagccaattcagctact

SEQ ID NO: 980 - DNA, 401 bp, Glycine max
atgaagccggtgcccgttttgccaaatggcgtgctgtgctcaagatcggcccaaacgaaccatccgagctggctatccatgaaaatgcctacggtcttgcccgatatgccgtcatatgccaggagaatggtctggtacctattgtagagccagagatcctggtggatggacctcatgacatcaacaagtgtgctgaggtgaccgagcgcgttcttgcagcatgctacaaggctctaaatgatcaccatgttctgcttgagggcactctgttgaagcccaacatggtcacccctggttcagagtctaagaaggtcaccccagaggtgattgctcaatacactgttacagctttgcagcgaactgttcccgctgctgttccggccattgtcttcttgtctggt

SEQ ID NO: 981 - DNA, 575 bp, Glycine max
  misc_feature (541)..(541): n is a, c, g, or t
  misc_feature (549)..(553): n is a, c, g, or t
  misc_feature (560)..(563): n is a, c, g, or t
  misc_feature (567)..(567): n is a, c, g, or t
aggggttcctctaagaattgaaattgggccaaaggatttagcaaataagcaggtcatcaactttgccagtgttttatcaattctcatatttgtcattttgcttccacactgttagtttttcagtgaacaccaaataaatctctttgaattttgcataggttcgcgctgttcgacgtgataatggtgcaaagatagacattgctagtgctgatttggttgtggaaataaaaaagttgctcgatactattcaacagaacctgtttgatgttgcaaaacaaaaacgagatgaatgcattcagatcatacacacttgggatgaatttgtgcaagctttgaaccaaagaaaaatgatcttagctccttggtgtgacgaggaggtatgaattgtgtattttctttcaaatataatgttcctgatgtcttgatatgttttgatttttaaggaacttcattgtttgagtagtacactactgttgtcactctttgaatgagatcaattgtgatttatctagctagggtgcatttttttatttcgcatagntgtgcatnnnnntatatcnnnnctanttcaaaac

SEQ ID NO: 982 - DNA, 442 bp, Glycine max
  misc_feature (435)..(439): n is a, c, g, or t
attgaaaactggtgcattatttatacagacataatcaactcttgacttgacctaaatataggaacattgatacatttggcagtgggtgtcattcaatgtgacaactatctatcccaacctgatggtctccgcctttctttaggtttagaactgcagccaaagaaaacaagaagaacatcagcaaccaaattatgtatgaagataagcatgcagcaagttcaacttagaaaactgacctgttcgtgctcttctgaccaggatttactccataaccttgactggtggaaattaccgctgatgtagcaggattgggtgaagcagtactctgataagtatttatgtcaccaccaattgatccaccggatacaaaaccagggagtgctgttctcttattagcagtcatgcttgtattgttaccaaagccttgattctgannnnntga

SEQ ID NO: 983 - DNA, 402 bp, Glycine max
ctgacttcggggtgggtcggattctgaatcagacgatggatccgtgcaattcatcggtggggacgatcgcctacatgagtccggagaggatcaatacggacataaacgacgggcaatacgacgcttacgcgggggacatatggagctttggggttagcatactggagttctacatgggaaggttccccttcgctgtagggaggcagggcgattgggccagtctaatgtgcgccatttgtatgtctcagcctccagaggctcctccttctgcttcacctcacttcaaggatttcatcctccgctgtttgcagcgcgatccctctcgccgctggtctgcttccaggctcctcgaacaccccttcattgctccaccgctgcccaaccataatcagactcctccca

SEQ ID NO: 984 - DNA, 567 bp, Glycine max
ttcaggttttcaatcaaagaatgagtatctctttgggaagattgacatgcagctcaagctcgtccctggaaactctgctggtaccgtcactgcctattatgtaagttcttcctttaacttcatcattatagaataacaacactagcaataacccattaaggggtttacttcttttcatccctttccctttattataaaacattgttattcaaagtaaacaataaaaagtatgccttttgtttgcagttatcttcaaaaggatctacttgggatgagatagactatgagtttcttggaaacttgagtggtgatccatacatccttcacacaaacgttttcagccaaggcaaaggggacagggaacaacaattctatctgtggtttgaccccactgctgatttccacacttactctatcacgtggaacccccagaggattatgtaagtcaaccatcattttttacactttgtttcttttttctctctatcctatctaatccttaacataattttctatactctttaattcagattctctgttgatggcactcccattagagagttcaag

SEQ ID NO: 985 - DNA, 763 bp, Glycine max
tttacaattgctgcttacaaaccatactttgatgttgacacttcagatgttctagagaggattatcgactcactatttccatttagaggatctttcaatgaaaaaactgctaccaaccctgatttgtgagcaactttgtcttttgctcatttcgttgactgagcatactaccaagatttggttctgatttctgaaattttcaaattatgaaatgcatgttgtttttaatttttatgaagaaaaggtgtatctaaattgttgtgaccagttttaatatgccaatatcttataaactaaagtcacgtatttaattatctgtttgttttgtttcatttcttatgtaagtttatcgaaatatcttctgttactagttaaatactggtgtctggagaagatgatgctcaccattttttattcttggagaacaaatacttttataattttgccataaaaaggcgggaattttgtgcatgtaattttgagttcatataaatatatgcaggtatggtccattctggatttgcactaccttgatatttgtagcggcatctattggcacctttgtgacatatatagcgcacaagctaaagagcaaagaatgggattatgacataaatctggtgacttggtctgctggtttgttttatggctatgttaccattgttcctctttgcctgtatgtaatcctcaaatatttctctgcaccggctggccttgtgcaactattctgtctgtatgggtattccctgtttgtctttattcc

SEQ ID NO: 986 - DNA, 1405 bp, Glycine max
  misc_feature (56)..(59): n is a, c, g, or t
  misc_feature (713)..(714): n is a, c, g, or t
  misc_feature (783)..(785): n is a, c, g, or t
  misc_feature (808)..(811): n is a, c, g, or t
  misc_feature (815)..(819): n is a, c, g, or t
  misc_feature (822)..(831): n is a, c, g, or t
  misc_feature (837)..(838): n is a, c, g, or t
  misc_feature (840)..(843): n is a, c, g, or t
  misc_feature (848)..(848): n is a, c, g, or t
  misc_feature (850)..(850): n is a, c, g, or t
  misc_feature (852)..(852): n is a, c, g, or t
  misc_feature (858)..(859): n is a, c, g, or t
  misc_feature (872)..(880): n is a, c, g, or t
  misc_feature (894)..(899): n is a, c, g, or t
  misc_feature (913)..(914): n is a, c, g, or t
  misc_feature (916)..(919): n is a, c, g, or t
  misc_feature (921)..(929): n is a, c, g, or t
  misc_feature (931)..(932): n is a, c, g, or t
  misc_feature (937)..(942): n is a, c, g, or t
  misc_feature (944)..(944): n is a, c, g, or t
  misc_feature (946)..(953): n is a, c, g, or t
  misc_feature (957)..(958): n is a, c, g, or t
  misc_feature (961)..(966): n is a, c, g, or t
  misc_feature (971)..(975): n is a, c, g, or t
  misc_feature (978)..(980): n is a, c, g, or t
  misc_feature (982)..(997): n is a, c, g, or t
  misc_feature (999)..(1000): n is a, c, g, or t
  misc_feature (1002)..(1009): n is a, c, g, or t
  misc_feature (1024)..(1035): n is a, c, g, or t
  misc_feature (1037)..(1043): n is a, c, g, or t
  misc_feature (1059)..(1072): n is a, c, g, or t
  misc_feature (1081)..(1087): n is a, c, g, or t
  misc_feature (1091)..(1097): n is a, c, g, or t
  misc_feature (1099)..(1099): n is a, c, g, or t
  misc_feature (1101)..(1106): n is a, c, g, or t
  misc_feature (1110)..(1114): n is a, c, g, or t
  misc_feature (1116)..(1116): n is a, c, g, or t
  misc_feature (1118)..(1127): n is a, c, g, or t
  misc_feature (1132)..(1142): n is a, c, g, or t
  misc_feature (1144)..(1149): n is a, c, g, or t
  misc_feature (1153)..(1154): n is a, c, g, or t
  misc_feature (1161)..(1164): n is a, c, g, or t
  misc_feature (1171)..(1173): n is a, c, g, or t
  misc_feature (1179)..(1181): n is a, c, g, or t
  misc_feature (1183)..(1198): n is a, c, g, or t
  misc_feature (1200)..(1205): n is a, c, g, or t
  misc_feature (1208)..(1208): n is a, c, g, or t
  misc_feature (1213)..(1214): n is a, c, g, or t
  misc_feature (1216)..(1216): n is a, c, g, or t
  misc_feature (1229)..(1237): n is a, c, g, or t
  misc_feature (1239)..(1267): n is a, c, g, or t
  misc_feature (1271)..(1276): n is a, c, g, or t
  misc_feature (1278)..(1278): n is a, c, g, or t
  misc_feature (1285)..(1289): n is a, c, g, or t
  misc_feature (1298)..(1309): n is a, c, g, or t
  misc_feature (1311)..(1317): n is a, c, g, or t
  misc_feature (1319)..(1319): n is a, c, g, or t
  misc_feature (1321)..(1321): n is a, c, g, or t
  misc_feature (1325)..(1327): n is a, c, g, or t
  misc_feature (1331)..(1333): n is a, c, g, or t
  misc_feature (1337)..(1348): n is a, c, g, or t
  misc_feature (1353)..(1355): n is a, c, g, or t
  misc_feature (1358)..(1364): n is a, c, g, or t
  misc_feature (1366)..(1381): n is a, c, g, or t
  misc_feature (1383)..(1399): n is a, c, g, or t
aggattctgtcgtgttcccattgtcagcctcctgataggaatgcttttgactggannnntcccataattccttggtgctcttaatggaggccgagaagaccggagaatcccagatgtcgaaggaggatcatgatctaccacagaaactaaattctgaacctctgataaagaatcaacttcattaacaggagaccccattaagaaatccttgatgagctgcaaaatccaaatcaacacactgaattactgagatgcactcattcaaaaggcacagaaacaaaacaaccacttacaaaatccccttctacaatttttcttactacaaaaaataaaataaaataacacaacaaaattatacaggttgaaataataaaattaaaatgatccataatgaaattcaaacagccagaataaagaaaaaacttaaaaaactttgcaagagacctatcttagatacaatcaccagaaaaccacccaactgaacagaaacaattagaaagaaaacgatgaactcaaacccaaagcatcaaaaaatcaaagtcagtcttttaacccaaatgaaagaaaaacatcaaggaaactcacaaaggctttcagatatcaaagtttcagtctttcacagattcaccaggaaattcagttcccttctaattaacaccactaaacaaaaccataacttgacaaaaccaacaccccctatgcttttgattccnnaaatgcatcagcttgtaacagcaaccaagttgaagttttgtttttttattctttagaagccacccttcnnntttttctttgattacactacagnnnnagtnnnnnaannnnnnnnnntaaagnnannnngcaanangntaagtnnagagccaagaaannnnnnnnntaattaaaataaannnnnnaaaaaaaaaaaaanntnnnntnnnnnnnnnannacctnnnnnnangnnnnnnnnattnncannnnnngaaannnnnttnnncnnnnnnnnnnnnnnnncnnannnnnnnnggggggggggggggnnnnnnnnnnnngnnnnnnnaaccccccccaaaaannnnnnnnnnnnnntgggggggnnnnnnncaannnnnnntncnnnnnncacnnnnncntnnnnnnnnnnttatnnnnnnnnnnntnnnnnntccnnctctccnnnnacttttnnnttttannnannnnnnnnnnnnnnnncnnnnnnccncttcnncnggttccccggccnnnnnnnnnannnnnnnnnnnnnnnnnnnnnnnnnnnnntctnnnnnntnatctccnnnnncctgacttnnnnnnnnnnnnannnnnnntngnttcnnngtannntttnnnnnnnnnnnnttatnnnatnnnnnnncnnnnnnnnnnnnnnnntnnnnnnnnnnnnnnnnntacact

SEQ ID NO: 987 - DNA, 392 bp, Glycine max
cgacggctccctccactccttctacgtcaaatccgtcaaggaaatgccctactacatctccgtcctccaaatcagcgccgccattagctccgccgacgccgaggcacccaccgccgccccctccgccatcgacctgatctccattatgtccaaacaaggctgcaaggccttcgcggaccttctaagaggctccaaggcccttccatctttcaaggaaaacgttgacggcggcttaacggttttctgccccaccgacagcgccgtcagcggtttcgcgccaaagtacaagaacctgaccgaagctcagaaggtttcacttctgttgtaccacgcgactcccgtgtacgagtcactgcagatgctcaagtccagcaacggaataatgaacactc

SEQ ID NO: 988 - DNA, 301 bp, Glycine max
acccataatggagttattggactctagggttgtgtctgtgcattttagccaggaattaccacattggacccctgaaaggaggaggtgaggttcttcgtatgtggcttattgggcttgagtcaaacatgtagatgtagattttatttgttgttttttttgctaaggttttgtattttttgggtagtgtgtaggactcatggtgagtctacatggagatgttgaattaggatgtctcttggttggattaattatgtatttcggttcgattaacttgtgtaaaagatgtgactttttttttttt

SEQ ID NO: 989 - DNA, 394 bp, Glycine max
gggtgctgctggaagttgatctcgtcatggagggcaaaatgggaaggaaagtgggtggtcggaaagtgcggttgggggtgaggggcaaaatagtctttgtgaagtggaggagggtgaggaacaaatgcctgtggctgtgaccggagaagatggtcgatctggtctctgatgaaactggccttgtgagagaggtctaaccctagtttggcctccagctgctgaacgacaccgttaaccgtagttatggagtttgggtcagagtgacgcagtagagactccacccctttcgctatatcctggtccgtcaccattctccttcttcttctctcttcaccaccttcatataccaacagaaaaaacggctgcttataccttctctcttcttcttctgtct

SEQ ID NO: 990 - DNA, 381 bp, Glycine max
tgcagcagagaaccattcaggatttgaatgctgagttggacgaggagaggaattcttcgtccacagcggccaatgaggccatgtcgatgatattgaggctgcagagggagaaggcggaggttcaaatggaggcgcgccaattcaagcgttttgcagaggagaagatgacacatgatcaggaggagcttctgtctttggaagatttgctctataagagagaacagataattcagtcacttacctgtgaagttcaggcttacaaacacaggttgatgagctttggtcttaccgaggacgaggctgagggtgatcaatatgaacttccaacctatgaatatcctcctttgaagtgtaatgtgatgcatgatgctatggatgctg

SEQ ID NO: 991 - DNA, 526 bp, Glycine max
ttgattatgcagctgttgagggataaccttactttatggacttctgatatccccgaagagggtggtaagatatagagatcacatgatacaatttctatttctttaaaattcataggatcttaagattccaatgacagctcatctcttgacttgtatgcctattcctcttcacatctgaaaatcattccttcagttttcatcatctctgttcccaagattcagttgctccttgtgtgttgtatgatatttgttggagcaaaaatagagtgaagctgcccaaaccaaatatcttagtttttagttaaagttccaattagatctgtccgcaaaaataaagtgaacaattcatcttatgaggtaaaataagtaatctcaaacatcgttgatgaaaaattcaatgatcaatattatgtgcacattcataacaaactgtggatgcgttagaaaatcaactgttgattttcttattaacaactgaggttacccactttggttgctcactttagaggagctaaatccagttcca

SEQ ID NO: 992 - DNA, 417 bp, Glycine max
gcaccatttgtctttgatttgtaaaacaaaaaatgcttgaggataaaatttagttgacataacaatagacagagacttgatgataccaaatcaagcaagttgttaaaccaatccgaacacctaaatttaccatctttaagggaagagacaggaacagagatgttctccatttcacatatgcaatcgaaagattataactcataaccacttgaatcaatttttattgttctgtcgacataataatcctatgcaagtttctcaaaacttgtataccgaagaaacaattgcaattgttattcaatctggatctcttgtggagcttcctcagttgttgactcttctgtattggcttcttcttcactaatacctgcagcttccacagtcctagtaacccattccttgaggggctcctcattc

SEQ ID NO: 993 - DNA, 379 bp, Glycine max
tcctcacactccctcacttaaaacagtttgttttggcttagctttggcttctctgatcaacaagggatgtgttctaacattctttcttgagtggcggaagcagatacacattctccgacggaggagaggcttggctacagcctggcaaaccggcaagtcacaaaaaaggcaatggactccattggggtctctatggctatgtattgctcatgtagttcttcttgctgtagaatgtaataataaacaaagttggtcttccttttgagaagttaccagcttttgctgtccaaaattactcaatttgcagctgactagaattcctttctctcttcagtttctgcagatgagtaggtaggcaatttgtgatcactcccttccc

SEQ ID NO: 994 - DNA, 817 bp, Glycine max
aaagataaggtcaatgtaatccctacaaagacacattggttatatcgctagttgatgtgaaatctcaacattaataatgaaagaaaataagaaagaacatacatgagagagttatttgtctcatccaaatttgattctgtgggagcaacattcacaaacatgagagttttggcattaccaccaagtgaatcactcattaacatggttaatttgtgattcctgtatggtgtgtgttgaccaccagaagacaaagagctaataacatctccaagtgctgataatgacttgttaatgctctgagcttccttaagctgactcccggtagaacctgactttttcactctttctgaaccagcaagatccacaaaacttagctgcatattgaatccaagataaaataagcacgcaccacgagctcaagaaacaatcaatgttccacattgttgcttaacaatgaagaaacatttttccctgattactagcttagttaatcaggaggtagaaattccagaatatgattatggagattaaggcatgtttgtttcctattttttaaaactaccctgtgtttttaaaaaacaaaacagaaaaacttatttcataagattagtttttgaaaattgttttaaaagtctcttttgtagtttttaaaataaaataaaaaaacaaaacatctcttggttgttttggttttcaactttcattcatttccatctcccctctcgatttagaataatggagaagtgtatttgaataaagttcatctctttccatctgtcttctactttttctagcccaattcttaaaagaggatata

SEQ ID NO: 995 - DNA, 1459 bp, Glycine max
  misc_feature (1406)..(1414): n is a, c, g, or t
  misc_feature (1446)..(1451): n is a, c, g, or t
aataaaaagactgttgaaacttctctatcctaccttaattcgacttgatgaatatcttctgaaggtatacgttgcttaccttaaaaagataccaataatatggttaaactgtcagatgcatgaattattaattcctccggtgttccaggcatctgtacaggctgatgacttaaaaagtgttgagagaaggttacctttgactggggagagcttagactctagaggcctttatatttatgatgatggtttccggttcattatatggtttggtcgggtgatttcacctgatatagccaagaatttacttggggcagactttgcagcagaactatcaaaggtattgtatattcttgctattcaaaaacaggttcataataggtatttttcaaggcagaggagagtttattataggttgtcacattgagcagatgcatcttttttttatttattttttgttttttctttctaacttttatctcttgttcaaattgatgttggttgctttttggttcttaatgaaataaaatcgcattgatcttgcatgcatgtagccaaatggcgtggtgtgatctctgtaaccaacctcacttaatgggataaggtttttaatctttgatatttttatattagaattgaaaagaaatattgtacgttacccatgtgatttcatttaactatacagtagttataattaactatgaaattctatgatgagcatcatcttcatgatagaacacttgattcaatggccagcttttgtgtgacgttcattgatagtgtggtatagtggtgtagtgcagccttgggctgctacaaagtttgcatgatggtgcatttttgaatggtgactgcagttgcaatcacagtgaaaataaccagctattatggtgctacagggaagcatttttgaaatcccattttgcctcaatgctgtgacattttgggggtttgttgggggcaaattagagattttcatcctcccttttcaaaactaaaaaaaaacaaaaagaaactacttggatacagttttccatgcttctctctcctgtgtgaccaaacacctgtctacccagactacccatctatgggttccgtctgacagtatttttggcaacacccaactaccattattttctctgttttaaactctgaagcacatcctgaaccacctctgttcttttctccatgcaatggccatgccattatctcagctgctacacgtcgctatctgagtttgataactatgatttatcctatacaaattttattcttaaggattgacatttagatgcactgatattgatagatattattcttaactcaattgaataacttcttgtatggcaattcatagcatcaaatcattgtagagtagatatgtttgtgtattcctcttgtatttatcnnnnnnnnnaaggtgctgtgtgtatgctttatttctttaannnnnnctactctc

SEQ ID NO: 996 - DNA, 360 bp, Glycine max
gatacaatacttgtcaccttagtggggccaaaagaccgtgtccacggccccaatcgcttcgggccagaccttcaacatcggcaactacgtcgtcagggtcaaattgggaacccctggtcaacttttgttcatggtcctcgacaccagcaccgacgaggccttcgttccatgctcgggctgcacgggctgctccgacaccactttctcgcccaaagcctccaccagctatggcccattggactgctctgttccccagtgcggtcaggtccgcgggctttcgtgccccgccacaggtaccggcgcgtgctccttcaaccaatcctacgcgggctcatctttctccgccaccctaaaccaaaa

SEQ ID NO: 997 - DNA, 346 bp, Glycine max
gatgtcgttggaaagggaattgagagtgccggaccagcggagcgagacggtaccggtgaacatggaccagaacgccagaagcaagatggccgctaacgcccagaatttgtacctgccttttccaaacagactcgaatccaagttttccttctttgtaaccgcggtcgtcgtcggaagcccgtcctcatccttcatttcgatctaattgatgatgggtcgattattccggtaacgcgatgatgatggtttggttcactgcggcttcaacttcatcggttcaggaattgagtccgatctggtaatatagcgaatcggtgttttgtttgtgtttctgatgaaagggaga

SEQ ID NO: 998 - DNA, 1157 bp, Glycine max
  misc_feature (1097)..(1106): n is a, c, g, or t
  misc_feature (1121)..(1126): n is a, c, g, or t
  misc_feature (1149)..(1151): n is a, c, g, or t
aagtaactaactcaaaaccccttatgcctctttcctcttaatatttcttctatttctcaaacggattttcaatttcatgtgctgttattgttgaaaacaggttcttcaaggaatctagtgaggaagaaagagagcacgctgaaaagctcatgaaatatcaggtaaaattaactctgcagttaactgtttaatttctaatctaatcaagcagctaaaagtaacttctctaaagttctaaaagtaatttctgaagttacaataacagtatattgatgtatatggttcttgttaaattgtttagaacactcgcgggggaagagttgtacttcaccccatcaagaatgtcccctcagaatttgagcatgtggaaaagggggatgcattgtatggtgagtttgctgaattcattactgtctcagacttatctgtttctcaatgctttcatcttttgctgttgtagaatgactctgaatagttctgaagctatggattgtagtttctcatatttgttcaaatcaatatatatgctgactttcctctattgctttgttcagcaatggaattagctttgtctttggagaagttagtgaatgagaaacttctgaatgtgcacagtgtaatgcctctttacttttctgcttttggttactattatttttgtatatctcttattttttatttcctgaggagctcacaatgtttattttagtctttagtagttaaggctaatcagttgatgatttgtggctgataggtggcagatcgcaacaatgaccctcaaatggccgacttcattgaaagcgagtttttgtctgaacaggtgaaactcatctaaaccgtagaatggttgtggatgcatagaacttctgtaatttataaaattttaactaagaaaaggaaagaaattgacaaagtatgaaaaaaataagaggaaatgtatgtggcttttgttaagaactaactttgaatttggccatgctattgtgtgtgttgaatgctatcctggaagaaaagaggaagacacaaactaaaaataaattgaaaagcattaaatgtgcatctatgctgtgaacattgaacttaaatttgcaaattgnnnnnnnnnntttgctgatattacnnnnnntttgttgaaacatcactttcttnnnacaggt

SEQ ID NO: 999 - DNA, 520 bp, Glycine max
agcttccgcttcttcttactcttgttgtcaccacccttctcctgattgtgtaaatagtgaataacagcaaagaaccaaaacgaaacagatagataaaacaaacttcacttacttgatcagttgaggtctttctaaaaggaagaagtgacttaaaccaccttcccgaagcacccattggagaaaagaaaccgttttgctgagcaaacggagcgagtaagaggagaggtagcttctgctgtgaagcactgtgaaagagagaaagtgttttttttcggcgttttagtttagtgtaagagagagcatggagcgtggtttgtgatgtgttggggttaattaaggcaaggttgagagagaagcaagttttgaaatttgaatttgtgttggtggaagaaaaagaccatcaaagtcaaatcataacggtaacctgatactcaaaaatcaaaatcaaaaactctcacctttttctttgtttatttcccacgcacgctccaatttgaccctatcactagctaaaccaccg

SEQ ID NO: 1000 - DNA, 1008 bp, Glycine max
ctgctgcagttttgttattcactatttcttgcctattggaatattgtagatacacagttttccctcgtacttgagcaggctccgacgatgaggcataatacgatatcattgcaatcgcctgatttaaatctgcctgcaggttacagtatatgatttataatgaataattaatagttcaatacccctataccagtagcttcatatgaaaggaaaaactcggaataaaaagaacccattaactcacaaattcaataaaagcttgattacgattagctccaacgttgcactttgtgttcacaactttcccaaatggcttcccaagctcaattagttcctcctctgtacactcccacggcaaatttctcaaatgaagaacctttgacggtggctgcgtgtaacggaactgttgctgactagacaccgatgccatttcagataataatgctaaacctgttgaacggaatcaccaaatacgcagtcccttggacttcaatatgacaatcaggtgttccatcatataagcataagtattctgcataatttatctttttatctaaaatgttttcaactggagacactcagttcctactaattcagacaccatgctttatataaactttcaattccaccagcatcccatcaagaaattaatagtatcagcattcaagaacataattgagtgcatatttatctcaaaaatcaagtcccctaaccaaatttttattttagtaaaattcgttcctatatagactaatttatactccattttgtcacaatagaaaagggataataatgtaaagatagtaatataaatttttcgcaggcctaatcgaaatatttgacggagatccgataagtgaaatctgaatgctgtttcaagttcaatttatcaaaatatgagccatttaaattccattcaacgaagacttagaagaacgcgtgaaaaaggggaaaaaaagagaacgacaattagggaaatggtgtaaattacctgagagtggtaaaaga

SEQ ID NO: 1001 - DNA, 514 bp, Glycine max
aaatccattcttgggtcaacaggtatgctatgacctaaaataggttgatcccttttacactgtaaacgttgctcttgaacaccaaaatatatgcctgaccatttcaaatgattgtaatgcagatgtcatcgcaaaaggattactccatggcaactgcggatgtagtggatgcggaagtgagggaactggtagagagagcatattctagggcaacacatattatctcaactcacattgatatccttcacaagcttgctcaacttctcatagaaaaagaaactgtggatggtgaagagttcatgagtctattcattgatggaaaagccgaattatatgttgcataatcatacacgcaagtcacagaattatgtttgtactataaaatacgctctgacttgtacactgtaagaatcaataattattttatcaaattcaaggagaaaaaacaattagcacagcagcttacgcaataaataaataaaaaatatggttctacggctgagttacactttcg

SEQ ID NO: 1002 - DNA, 485 bp, Glycine max
gggtcgattcgtggtggagaagaacagcctgagagtgacatcgccggagaaaataagagggacacacgacagtgccattggcaacttcggaatacctcaatacggtggtagcatggccgggaacgtaatttaccctaaggataacaaaaagggttgcaaagagttcgatgagttcgggatttccttcaaatcaacccccggtgctcttcccaccattgttctactcgatcgcggaagtaacatttctactttttctatttttcttttctcccaatttggaacaccaaatctaataccaatactattttcatctttatcatgtggaggcaggttgcttctttgctttgaaggtctggaatgcccagaaggctggtgcttctgctgttcttgttgccgacgatgttgaggagcccttaattactatggacacccctgaggaggatggctcttccgccaaatatgtggagaacataactataccctct

SEQ ID NO: 1003 - DNA, 364 bp, Glycine max
aggccggttcctccacaacgaagccttcgcgatcgccacgtcacgtgttgcatcgcgaagaaaccctaactctaacaacaataaccataatagcttcgcctcctccgcaaaccagaattgccgccggaagcggagtccggtcaccgatcgagagcgccgtcgatcgccgccgaatctcgtcacgggacacgttaagatcctgaagcgaggcgagaaattgagcctccagaataaaaaccaaagactcgctgtttccgcggagaacgttttggtgaagaacgatgtgggcctggatttgttattgggttccacggatcgattgggcccgggtccattaaccgtgaagaagcagattagggtttcg

SEQ ID NO: 1004 - DNA, 724 bp, Glycine max
  misc_feature (715)..(717): n is a, c, g, or t
cgaggttgaggattcttgttttcgatgaggctgatcaaatgcttgctgaccttttctattgggtatatacttgttgaactttagtgtgatttattggaggataggttagttcagaatataataggttacaattgaattgaattggaaattgtgattatgctagtagtggtagtaattactaattagtaaatcacatgtgttgacaacttatttgtgagtttaatgttgatacacagcgtaatactgtcaactaggtagaaatcaccctagacatgacttttaaagtgacttggtaattttatgtatcttagtaatttttagttaagttagtaatcttaccatacatgaccattcatgattggatatcctttaccttatcatgttttgcaatggaatttatgtgtacttgtgttgtatggtaagttgtcattcttcctgttgtgatggatagtagtaaatcagttgtcttgacaatttattcatttctgccttgtaaatacacaattttaggttcagggaatgctggtgtggtcatgtgtaggtcatgtgtatttgtcttgttcttttaaatagggtttgactggtagatatgctgtgtcttgattgttatgaattgtgctgttgcaggatggatttagagatgattccctgaggataatgaaagatatagaaaaagagaattctaagtgtcaggtttgttgaattctctctcgcnnngtaatta

SEQ ID NO: 1005 - DNA, 381 bp, Glycine max
tatcccttttgaaccctttatagttgccttcattaagattttgatgcattgatagcatcaaaatatggtggccacaagcacaaatgagttggaggcaggaactgtttctaggtatgacaggaaaagtgaaatcaaggtattcgatgaatcaaaaactggggtccaaggactggtagaaaatggtgtgacaaaggttccacggatgttctattgtgaacactctaatctcagtgatggattaaccacagaatcaaattcaaacttcactatcccctccatagacctcactggcatcaatgatgaccctattttgagagatgctgttgtgggaaaagttagatatgcatgtgaaaagtggggcttctttcaggttacaaaaca

SEQ ID NO: 1006 - DNA, 542 bp, Glycine max
  misc_feature (486)..(488): n is a, c, g, or t
agttatgtacggcttcgtccgggcacaactaccttttctctgcaccaaacaccaatgtcaatcccaaacaaacaataataaaatatgtattagctatccaacatgtatatattactattgcgcaaaaaaaaaaaagcgttaaaaacaattaactaacggcattttccgagcaatgcaaaaagaagctataattgtaattaatgaactttatatgaaaaatatttatctacttgtagcatccggcgttgatttgaataaggacattccttcggttgttgtcggggacggcattgacggcgtcttggacggaccggtagtggccaccgccgttaatgtcaacggtgattttacggtgaccaatgggtccgatccaatggtggctactctttgaggagttgctcgtagaagagaatatttttaaggtacggtcgcggtggtggggtttacatgtcactgttgctgcatggaatatgcaagcgaaaatcnnnagcgctacttgcagtgacaccaagagtgaagaagaagtcattagatagcatcga

SEQ ID NO: 1007 - DNA, 576 bp, Glycine max
accgtacctattggtaccctcccctccggttccgtcaccggacgcttagcctccgtctacagtgaggtccaaaagacgcgcgtggaccacgcgctccctctcccctccgtcctcaagcatcccttcaccattctcgacggtcctccaagctccgccgccggaaatccaggtcagtctctttcactcacttcgatccgttcattctccgtcactctccgtgacgcggttcgtgcgcgcgtgcagacgagatcgcgaagctgtttccgcatttgttcggacaaccttccgcggcattggcgccgagcggtgcggtgcagacgcagaagaagttgaagattggcgtggttctgtccggaggccaggctcccggaggtcacaatgtcatttctggaatattcggtaacgctctcgttttcgaatccgattcagttaaacgtgcttttcttcttcttcttcttcttcttttgagatttaactttttttttcttcgtcttagattacctgcaagagcgcgcaccaggaagcacgttgtacggtttcaaaggtggacctgctggcattatgaagtgcaaatac

SEQ ID NO: 1008 - DNA, 1400 bp, Glycine max
agttgccctactctattgctaaaagcatattgttcctttcctatcaacattgaatatgtggctaatacatattagttgcattaattgatttgctttagctaatacatatcagcttaaattgtcttaactcttatgttgtataatctctctcatttttttgtcctaaatctggcaatagtggtcccataggtatttcttcttttgaacaattatgggaagtcaaactacatttatgtatcaacctagtgtgaagcataatcttagtaaatttttattggaacatagtctagttttattatttgatatatgctatcctgaatttaatgtaattaatggtcctgagtcacaaggcgcattatgtgctgcttcatgccgcttgataagacaacagtcctaagtcttgagaatagctattatttgaatcaaagtaaatttaatcagtgtgacacttttgtaatatcaaactgatacaatgaaaactcaaagtgcattttgttttctcccaaatatcacatgtcaagaaactggcagattttaatatggtatacataaattatgaagtcacttgcatataaatattttctgttagaaactgttaattttttcatccattgtaattgaatttgaaagaaacccacttgcatataggtgcacttattatcgttgtatttgaaaccttaaaagtgtgatttgattggatttgatagtatgtcctttacattgaagtgactagattaatcgattcttcaattggagcttgttatgaaaaaataaataggaaattactattttaaaccttgaaattgtaaaagatagtcctcttagtttcaaattattaaaatttcaaaatagttcatgaaattgtagattgttagtcaagttggttcagtcaccaccctcagttaactagcagtgtcagagatgtggtaaaccaatcacagggaatattttgacaatgttttttgcaacattttgaaagtttatgaagtatatggttgttatttgtatatgtggttgttgtgttagattatcagttgagccaagtcagcaccttctcagttcctaactcaacagtcaacaccttgtcaaagttagtttgtgctgtctttctgttatgacagctggagtctaaaaaaatctaataaattcctattttataactacgctaacaaaatttatttatatattaaatcatttcctattattttattgttccaaacatactgtatgcaattctaagaaaatgatgttttggagttactaagttacatctttatcatgttttaaacagataatagtgtcactgggaagtggaccatgggatcagctatttggtggaggaaactccctaacctttgttgtggcagctatttcagcccttatcagtggactcataactg

SEQ ID NO: 1009 - DNA, 836 bp, Glycine max
  misc_feature (781)..(781): n is a, c, g, or t
aaactgaaatctgtgcatcataacgactattcaatggttttaaatcattagcatcaagcggttctgtagggagtgattccacagagtcaaagtagaaaaactgcaaaggtcagaggaggaactaaagttaaaaccacaaaaaggacaagtatttataacctcaaaaaagaatgctcaataaatagggaaagaaaaaatagaaacatggacaacatatagttgccaatagactcgaaggggtattgacttaagttttcttaaacctcgaagggttcaagtgtagttttccctaaacataagaacatgatccaggaatcaaaatctaagtcaagatcaaatttcatttataagaatcaaattctacaaagtgcctaactcaacagatggattttttttttgttattcaagatatgatagaggttgctttgtttaaatcatgaattatggctatgcggttatttttaaagaaaactatagaagatccagagtaataaaacatcaagtgaagcagcaaactgaacacacaatccaaatggctgactaactctagaaaaatacaagatgatacaatgattattgattaacaagaaaaaaaatattacttacttgaaaaagtggatgaaatttcccagagcatgcctttacaacctcttgtcctacaattccaccaaacatggctgccatagggttcaatactgccctagcgccaaaggcaaattgctgtagaagtttcggattcacatcttctaatcttccatcacccaagctaccgttaatattnctggcaatagatattagtttctgtgcatcatcctccgaaccagcaacagggaagc

SEQ ID NO: 1010 - DNA, 376 bp, Glycine max
ggctttctctttctccacggtttcgtctgtgatgagaattagggttgggcgttgattttggttttcagggaagagagatagggcttcgaggacgaggtcgcgtgaggcgcagtcgacgaagaccagcctggagttcgcgtggcggaggatgacggagacggtgcgggcgtcgaggcgggtgttgatgttgttgagaattgcgccggcgaaagggacggcgaagtggagctcgtacatggcggggacgttcggggcgaggacggagacgacgctgccgcggcggatgccgagggaggagagggaggaggcgagctggaggcatcggcggcgcgtgagggaccaggtgaaggtggtgtggttgtagactagggaaggg

SEQ ID NO: 1011 - DNA, 819 bp, Glycine max
  misc_feature (53)..(57): n is a, c, g, or t
  misc_feature (728)..(729): n is a, c, g, or t
  misc_feature (758)..(771): n is a, c, g, or t
tggatgttatggaaaaagttcttgaagtacggaatattaattcttctaaatannnnnttatcatgaaaaatttgcatttttctgtttctcctaactgtctgtggaaacttatttggtaggttagcagtgaagatgcagttaacatggctagggtgttggcattgaaggaaggactcatggtaatcttcaaaagacaatgttgtaaacttaaacaatgaatgcatgagaaatttcaagcttcattaatttaaccatgattttcaccctaggattcacatatgattcattagtaactgacaaagactgttcataaattggtaatcaaattctgaatttacaattatttttctttctaatttttccaggtagggatatcatctggagctaacacagttgcagctctcagattggctcagctgcctgagaacaaaggcaaacttattgtggtaagaacagttttctttaaaaacaacatcaagctaaatgcttagcctaatgtgtcatcagcctctatctaaattcacaagagacagcaacactatatcatttgcacatttttcttaatcatcttataattctgtaaataaaatgcttgggactataattttagcatcaaacttttctgtctttgttgctgatgttgtgataaccattgatgacttgaatctcagactgttcatccaagtttcggcgaacgatacctgtcatctgtcctgttccaagagaanngtcaagaagctgaaaacatgcagccagannnnnnnnnnnnnncatacataagtttgttgtggttacatggagcaacctagttttacaatc

SEQ ID NO: 1012 - DNA, 360 bp, Glycine max
attgattcaaggtgcggagaagaagataaccgatcaattacttaattgagttctaatcgaaattcactcaggagctgttgagtttgaagttagccaaccatttctatatctacaatgtgcacacgatacgcaatcagtggagacaattacaatatcaagactgaagaccaattatcaagatgattggtttagtagggacttgggagagattagggcttttaagcaacattgacacagacgtaagagccagacctgcctacaggctttcctggaatcaaacaaaccacactttactcataattctctcctagaagagaaagatgtaggatgcccctattactctcctctcttcaacaatga

SEQ ID NO: 1013 - DNA, 365 bp, Glycine max
ctaaataatcaaacccagtcaccatcattccattacctccaagaacaaaccaaactctccaatttctgcatagcccttgcaggggcaacccacaaaccccaatgacacatgaaaggatccacaagaagaaaaactatacaatgttggagtcatctcaaaaacttgagaaaacaatttggtgttgatagttttcataagaaagcaatatctatatgagcttcttcttccgaaagaatcgtttcagaaaccacagttgcaaccctgaaaccaaaatgcagatgccaagagaaaagatactgaaccaagcgactctagcattcgttgtttcactaacttccctcatctctgcttccctattcttcaaa

SEQ ID NO: 1014 - DNA, 366 bp, Glycine max
tggacaagactcataattataattataatatatatacacgcatataaatcttcaataaaaatagcaaaagacttcatccagtcaccaccacaaacagttattcttctatcacctcagcatgcccttaatcaaaaacttaaaagagaatcctatcttcatctgcctcctcagcaatctgcagtgatgaaactgcttgagctgcaatgagatcagcagagaaatttgcaggtccccatcctgcaccttcatataatggttcatgcacattcttttcaaaaggctctgatgagaatgaccattcaccattttcagcagcaccccacttgcaaccatatctgtatgcatcagagacccaacccactcttt

SEQ ID NO: 1015 - DNA, 397 bp, Glycine max
tattgagtttgccaaaattcgtaagcaaaaatgggctgctgcagctgcaaagtaaatgaaattaattgctagattacttgggcttgaaattgtgaagttttacttttcattttttttcccttgtagactatgtttgttctaactttatgttggcttaaaagttactttaaaaggtctaggttgtctctgctagcaactgagtctctctctcttgtttgtagttcatgtctcctgtttttttatttagcaaaaaggagtgctaagatgcagcacaaccaaatttattataaaggcaagaaaataaaaataaaaaacttggtggcataaacctcacccaggacaagttacttgaacctaaagaaatgcaatacatacctattgcgaagaaagtcctcca

SEQ ID NO: 1016 - DNA, 754 bp, Glycine max
  misc_feature (705)..(707): n is a, c, g, or t
tactgatagttaatgcatgtctattattaatcttgaatctcaacaaaaaaaaaagagatctcttttcatgtacaaacagcagagagactggtcccatctcaatgactaggtgaagaatactaagataaagaggaagatgaacagggccaacaaacccaatatcatcatgatctgaccctttgcactagccttcttcataaccattgccacttttttctgcaaacataatagaagagcaacatttcacctcttcaagatatataatatcacaatcaactttacaatatttttttcctttaaatattattaatcaataacagcaatcctagaggtgaaatttttgcctttcaaataataaatttcacaaaagaatgaaaagataaaatcaaactagaagatttgaaggagaaatgataaatagacacagaaacttacttggacaaaatcaagacgatttgttgtactgtccatctcagaaccaagctcatctagaatcttttcctgaagcattaagattttgacagtgttaagaatcagaaatttcagacaaataaaattgattgagttagaaaaaaaaacagaaaaagaaaaatacttttattcaagaaaattgaaggaaacacataaaagaccaaagtgctactacctagtcgtcaacatttttgaagcaaaatagcaagaatcatggaggtaaaacctctcaannnattacctgtgcagtgagttcatcatgtattgtgagtccaacacctcc

SEQ ID NO: 1017 - DNA, 636 bp, Glycine max
cattgagaaggaagaagaggtagcttttggaagtttaattcctgaagaggatctatctactgtaaatccaataattgaggaagctactcagacagatgtcacaacaatcgatttgaaaactgacgcacctgttgaaatagctaatgaaaatgtaatagaaactggagttgatcaaattgttgcagaagatgagaaacaatcacaaactcctaatgcaatggaagagtttgcagctgcagtactaacagacagtgatgtggtcgaacctagccctgataaaaatgatgcaattacagaatcagatattacatcgagtgcaccagctccccaagaaagtgcaggttctgtttaatctatctaccactctctctgctatacaaatctgtcagtctactgccagtctatttttctttctaatttatatttacatatagaaatatggattgtaagtctaaaatcaaaatattttgtgtaattagatgcatgcaccagagctttccaactaatttatcaaataatatttcctttgcatcacaagcaggtgatgatgttggagctattactgagaacattgacagcgatactagtttgagtggacaaagtgacgagttgtctcctgagggaagcttgactaca

SEQ ID NO: 1018 - DNA, 400 bp, Glycine max
atctggattaatatctcctctgcacagcccaatggcgtacactttgtcggggttttcgccggttgtgaaattgtagaaaccgtagtcaatatctgtattggaagtgagagtggacaaaagggtgttgaggttggtctgataggggctgttggctgcgtagtttcctctagcctgcttataatcacagcagtagtggaagtcttgtgaagttctgaccacttctggttctgttgcagtttgtgtgtcggcgctggcttcatatataaaaattattaggagaaggttaatgatagcacagcccatattaattggaagtaattaacaatatgatggttgaagcttttttagatcaaatgatccaatcagctttttattgcccaaggatgaagtgattctcgag

SEQ ID NO: 1019 - DNA, 463 bp, Glycine max
  misc_feature (44)..(46): n is a, c, g, or t
ctgatctcttgtggaatttctttgcagccttggaatgctttcannnctgatggagtaattatcttctcggacatccttacaccacttcctgcgtttggagttgattttgacatagaagaagtaaggggacctgttatacattcccccattctttctgaggaaggattaaaggttttacatccaattgacctggacaggcttaaatttgttggagattcacttaagatactgcgccaagaggtaaaatttagttgcatctcctcatttatgtcccggccattcttctaacctgtttccctttctaattctttttttatttaggtggggggccatgcacctgttttgggttttggggaaccccctggaacaaaaccaacatatatagggaaagggggtacaacacgcacatatacaaccattaaaagcatgtgccacactgccccacatgtattgagaactttgc

SEQ ID NO: 1020 - DNA, 316 bp, Glycine max
  misc_feature (261)..(261): n is a, c, g, or t
  misc_feature (264)..(265): n is a, c, g, or t
cccattttttgcagccaaaatcggacaatttaggatgatatccctctcctaacaaaatgttagaacatttcaaatcgcgatatattacaggaggcttcattttatcatgcagatactccaaacccctagctgcaccagctgctattttcattcttgtgttccaatcaagtggttttctacctggccgaatatctaggacaatgggaagaggaaatgagacaagccattgataaaaatgctgctgacaatatatgaaaattnganntgatagaatttacgaacctaatggtcctccaaagatccgaatggcatgtaa

SEQ ID NO: 1021 - DNA, 312 bp, Glycine max
  misc_feature (305)..(305): n is a, c, g, or t
  misc_feature (307)..(308): n is a, c, g, or t
atgagagtgtgagtggctatataagctgtcgtcgcatgcttcgctcttaaacacaacaactcatcatcctatattctcttcttggatcatcttggttaagctgcagatcagaatagaataataataaataaagataagatggagactcatttggttttcttgcttggtttgatcttcactctagttgccggcgttggagcccaagcccaaggcccatccacctctcctgcgcctcccacaccccaagcatctccacctcccgtccagtcttctccgccacctgttcaaaagggcgttgagtgagngnngggt

SEQ ID NO: 1022 - DNA, 389 bp, Glycine max
ctgaaggacatcaaagagctctactacaagagaaacagtgttcaccttgaggatgaagtgtccaaggaaacttctggggactacaagaagttcctcctcactctcttggggaaataagactaagttaagaacttgctctaagggcatcttagtaatgggtttttgttaattatgtcattggtttctggtttgtgcgatttcattatgttagttttccagtaagagtttgttatatctggttaagtttttgagacaacaagaactcgtgtcttgtttgagggcatgcgtgtcatttcttagggttgtgttggtacttggcatgctcttattagaggacctctatgctgcgtgtttcctttggattatgctattacctcacctggtttgct

SEQ ID NO: 1023 - DNA, 398 bp, Glycine max
ttatattggtgccaaaaattcagtgcacttagtttccactacaaatagccaaaccagatatatcatgagcctcagcaacagagtgcagatcagtccaggaatatgacctccaaggaggatttcgtgcggttgaagaagacggttgaggcagcgatgacctattaataacgcgcggatgaagaggaggaagagggcatggaggagatattgaagtggagctactaccctcttcactacagctcagagtgagacaagatgttcctcctcgacctatgtttgtgggtcgctttgatattccaccaatatttgcgcaactgcgactcctctcaattgaggagttacgagctattaagttcttgcgtttcttggcataaggatcctctggcttcacaatctct

SEQ ID NO: 1024 - DNA, 718 bp, Glycine max
atgttggagctgtaagccctttgacatggaacatacggatgaacattatattagggaacagcaagagggtaccgtatttgtgattaatcttcatacagtggaatctatgatgatgcttgattgttttgatcactgtactttttgtttgtcttttcagattggcctatcttcatgagggtcttgaaccaaaagttgtccaccgagatgtgaaatcaagtaacatactcattgatcgccaatggaactccaaggtttctgattttgggcttgctaagcttttatgttctgagaatagttatgtcacaactcgagtgatgggaacatttgggttagtatgattaagctaagcattatcctatctctctcttaccaaattataattagttttaagttcctgtatgattgcaatgtgtaagtggttccaaatttttaaaggtaaaatgatattgattctctcctttttctttttctgtagttatgttgcaccagaatatgcatgcaccggaatgctaactgagaagagtgatatttatagctttgggatacttatcatggagataattaccggaagaagccctgttgattatagtagaccacaaggagaggttagaggccctcgccaataaaagaccatagttaacatttatgctatcttctctcttttttgggctaactatgcatgttggaacaattacaggttaatttaatagaatggttg

SEQ ID NO: 1025 - DNA, 797 bp, Glycine max
  misc_feature (791)..(792): n is a, c, g, or t
tgggccatttcccaaatatctacttggagcaaccaaatcaagtcagagcagaactatggacagcttccattggtaagcaataaatttgcacccttgtgtttccacattcaatttgatatcagattttcattttagcatcaaaatctcaatatattcatttttttcattttatttagcatttattttagttattggttgcaagttcctggtagtggggttcaacatcccctcatggaacatcacctaggccataattggttctagttctagttccaatgtctgtgtaaaggagttactcattatatatacatcatatagattatagaacacttattgcaaaaaacaaaaagagaattataaatcttaattattaaatcgtattatctgttaaaataaatattatatcgtatttgaatagtgaagattaaaaaataagattacatgattctttttttaagtagtcatgtaactattaacttctaatcttgatcatttgtgtaccattatatgatcaataattattgttctcacattcttaaagtgagaattattcttattatacgtacccatgaatatacatacacgtattctcatcttataacatttgaaatggttcaaaattttgcaggaggtttaactatgaatgattttattgttgctgcaaagatagatgagataaagacatcagatcttgtcccaaggaaaagggtttgggcgtaatgccctcacgaactccataaaacattttgccacttgattttcttcaacattgaattaccactagtttgtgnnatttg

SEQ ID NO: 1026 - DNA, 394 bp, Glycine max
tggcagagttatcagattctgaggatcccacgagacattggttgtggccgtcaaccggcgaagtattctggcaaggtgtatttgaaagagagagaagcttaaggcacaaggagaaggaaaagaggaagcagaagagtatagaaaaacaaaacagaataaggaagcgtcatcgccaacaagtgatagggaaatatattaagcccccaccagacgaagaaagctctaattcatctattgcagtaacagcatcatgatgattttaaaaccattgttttgagtagttcctcgtataaaattcttttcttcttttgtaatttttatttgattttgcttagcatatgtgattttcgttagaaaggatgcacatttctgtggagggtcacgtatgtagaat

SEQ ID NO: 1027 - DNA, 806 bp, Glycine max
  misc_feature (786)..(795): n is a, c, g, or t
agaacaagttctatagcatgacacaaattgagagaaaaatgtagtatatatgaagcagcagcagcagaaagtaaggagacaaagtaaaataaacaagcaagttgtgatcaaagcttggtcgatagaattataatgacaattttcctttggaacttattgaggatgagatgaggtgtatcatcgaggccccataaactataacatggttaatttgggcaaaatggtaaaccactgagttgtctttgttaaattaaccataattgcatttgtagtcaatggatccttgacattgaggataaatatatggacaagttgtactcagtccttggtatcagtttttcctaaagttctaggctatttctacataaaactgaagataacaatttacgttgaaaagcgaaatagaagataaaaaggagcaatatgatatgataccatgggcttatcatagaaggggaaaccttgcatttgccttagggcgttggaagcagaagaggcatcttcaaagaccacccaagcttgacctttgtgctttagggttttgaaagctaacacctcaagtatcttcccgaactgagtgaaaacagcgttcagagacttcttcaactctgcatccaacaacatacgacaactcagaaaacgtataatccatcggaaattgaagtcgcggaaacacgaaacaaatagcgtaccatcaatcttaatcttctcgttgaggttgttgatgtagatggtgttgctttgaggaatttcaggggtcgcattcacttcagacattttgcggtnnnnnnnnnnaagttttgctc

SEQ ID NO: 1028 - DNA, 885 bp, Glycine max
gcgaattgatgatggaggtcaccaaagacgaagctgcaacgccaggatcaggaggtgctcaacctcccaatccaatttctaacggtaaccctaatccaaatccaaaccctaacccgaacacgcctcacacccccagaggatccaaaggaaaatcgtgtaagggatgcacctactacacatcgcttcataaggccaagtccaaaaaccccacatgcgttggtttctccagagcactccagcaaggtatctctctctttgttttactattcatatctttgatgaatcttgaaaacttgtatattggtaaaatcatgaaatggaattttgtgggtgaatgttttgaaccttgttataatgttattgaatataaaatattgtattctgagcatggaaaatttatcaattatttccgagctatgtactggattggttgttgatttttgcggagtacctatgcctttaccttgtagtttgattcagagcaacgtatctaagatgactttgcatttcttgttttgacttgagcctgcagctggattctaatttgcttatgctgagtgttagcctgtactcaaactcattagaaattgagtatgagggctgttgagcaaggttttaaaaagattgtttctcataaaagaaactatagtttaatcttttggattggttttatattctatcatttgctttacttatgagtgtttaatctttatttcattatcattataagcctttgatatcgttgttcttatgcatataaccagtacccccttttgttgttggagaaactgagttggaagcttcaaaagagggccgcagccttgcaaatttcaagtatgcatgtattggatactctgtctacttagacaacaaagattcttctgc

SEQ ID NO: 1029 - DNA, 341 bp, Glycine max
agaagcaatacctactgtcaacaaacatgtgaattcataaatacattactgaataatgttcaacattaattaggctggttgaatcataagccttgtatggatccacccaaaacatcgaggatttccatgtatcaataacagtgaatctgttttttctttccacttttggctgaatattctccagcatctcaattttggtagtacaattgtgatctaattaatttcctaccttccaagcagaaatgtaactaagaagtgaaaataacaataaagagtaaaggagaagtatattttattggcagcaggtttaacctgaactgaatacatatcatatattaaga

SEQ ID NO: 1030 - DNA, 1082 bp, Glycine max
  misc_feature (1023)..(1031): n is a, c, g, or t
gggcgctttattcagaggatgcgggagaaagccgcctccattcccaagtattgatttcttcctttgcggctttatactttatagaatatgcttactagttcttgtagttgtttgtcatatataaaaaaacagataagagattagagattgcttgttacagagttacaactagttacaactacctttaggattctatttttgtaataaatgtaaaatttgacctcagtttatgtgtttaaccttgatgccattttagttgatttggtttgatattctagtcatgttacatgaaccaaagtaatttgattgaaagttgttctgccattagcttctgtttcctaatagtatttgatcatatcatcatacgggcagccaattgatataattatcataatgctatcagaattcagaataagaaccagaatgccaacagtagtagtgatgatatgagaattacaaatgtgattttagttgttcaattgagctagagatatttacttgtaaagtcatatttacatggtgttttttctttttaaatattctgcagtgtacgattggagcaaggaacagtcacttccctaattgaagagaaggggacaattaaaggtgtgcaatataagaccaaagatggtcaggaattggcaacatatgcacctcttaccattgtttgtgatggctgcttttcaaacttaccccgttttttttgtaatcctaaggtgagaattcctttcagcttaattttgtgatagagtttccccgaatcccgatcaaatcagtcaactttttcctataaactaacccgccatccccctagaaaaaactttttgctataatttttttggagttttttttttgttttacattattcaaacttttttttttctactaaaggttttcttcgtgtttgtaagaataaatatgtagaacttgaattactaattttttataatgctgtgtttgcaggtggatattccctcatgctttgttggtttagttttagagaactgtgaacttccatgtgcnnnnnnnnnccacgtcatactgggagacccttcgccaatcttatctaccctataagcagt

SEQ ID NO: 1031 - DNA, 943 bp, Glycine max
  misc_feature (936)..(936): n is a, c, g, or t
tgctgagacgtcttcggttttggattagtcggagtgggcattcacctacctcacatgatgcctttgatggtagcatccaacaattttcttttaattacttacttaccagtactcatggatgtatcaatcaagtattgtgctaattggtttgaaagaaaatgttcaattaaggtgtcaaacattaacatatttcttgagtcgatgctttgctgctgatcacctttaatcatggaagacatagttgaataacaccttaaaggaccagagtcttctttgttattggagacttacaggagcgtgtttatgttatgtctgacttgtattagccacttcaaaaagcatccatgcgcttggaatttttatgtattgcagttcccgcgttctgcctaggggtgcattagggttacagttcatgtcatataccatgtgccaaaaacatagataacggttccttctctctgcttcctttttccatacccatttacctagggatgctaaattagtttgcatatccgacttttctcctattttgctagtcttctcataaaacacataatagatatgctttaattttgccccagttgacaatgactttaagtaggtttagggatgaattcttgcttagtattcttgagaaaatttggattcagttacttatgtggatttttcaaattccagttgagcaaggactttctgagctgaggaagttggggattgaacatcgactttgggaagcatccagaaaggaagttgatcaggactctactattgcacgaaagctgacttgacctgaaatttgtgcttaatttccttgcaaggtttgctgatttatacatatgaattgtgaatttcgtcttccttctggagactgtcaccttcacgctttatgttcaaacgaggttactcttaactgttagctctaggtatagtaactgntatgatg

SEQ ID NO: 1032 - DNA, 352 bp, Glycine max
atgttaaggtaaccaatgaagggccaacactgattaagagatgcctgcgacttgatgaagcttccaggcgaggcagtgcaatattagatctggattgcagtttatctattatgttgcagaagttgtcaataaatgaaggacctactattacttggtgtatcaattatcatgctgttgtccactctcaaattagatatgatattgttattgattcgactttctgtttccttgactagaataagtcgtcatcatctcaaaataaccaatcagaaaagaatcatgtaatccctttagtatgacaaatagtgatacaggaacctcaaggaatatgaaaacagcaaatatactagag

SEQ ID NO: 1033 - DNA, 384 bp, Glycine max
atttggatcacaggcagcaagggggtatgctcagggatcatcacctcctggatggctgcatatgcagataggaggtggtttcgagagaacaacataattcagagaagcctcattgggaatgacagatgaatcgataggattgattttctattaaaaaaaacaaaaaaatagtgggttgattacagtgtgcttttttaacaacctagtcaactgttgtcgaatgttgtaggtttgcatttcccattgttatagtatgaaattatttatagaaagtgcatcttaatcgcatgtgcttcattgtattagcaattagcaagtagaaaacaatcttagtgtggttttcgtttttaatcctgttgtgataggactcctgcatcctgattt

SEQ ID NO: 1034 - DNA, 1054 bp, Glycine max
  misc_feature (957)..(961): n is a, c, g, or t
  misc_feature (997)..(1005): n is a, c, g, or t
  misc_feature (1016)..(1018): n is a, c, g, or t
  misc_feature (1040)..(1042): n is a, c, g, or t
ttttcatctttggtttttaatattggaccctgatgcatgacccattatgtggttttctttattacagattcccggtgttccaataatgtacatcaccaaacgcaagtactcaattgagcgattgcctgaagcaacaattggtggaggtagatactcttatttagtgaaatttatagtgattaatatgaatttgaacttagtttattggacaacacaacattgcatagctctttttataaactagataaattaagcttcattgactttgtcccaagctgctccgtaaatatataacacactatattacacatgagcatgactttgccacctgtatagagacatacaacttgaattcatgtgcaaatggataataacagtgtttttattttattttttatgtatataaccctggtcagtatgatccattacaatcatagaagaaatttacagatcccatgttgtctcacgtttgttataatactatgtttcgggtatgtttaaagtcaattctgtagtaaaagcttaacatttttgcaccttaatttagttaattgcattgacccttccaaataaaatgtaatttttagttgttgataatgaagtgtcatcaattcatcattgggcagtcatgactggacatgagttatttattccattagcgattagcagtgccaaaactgtactgttatactcttgctctttctttacctgagtcttttactatatatatctggcactcaaactgacgcacttgtgattctcaatgcagcaccaagaatttgatgcagtaaaactaaaacaggtagagctggctataccaataatattgatactaatttcttggtcgaaaagtatgaaatcctgctacagtaacttgcatgtttggtttttggctggctgggctgaattctaacggaagcttgggactgaacaaaagaaagacttaaatggtttatnnnnnaaattttcttagtgtaagttggtagatttaggttcnnnnnnnnnttgttttcctnnntattgcctatctaatgtatcannnaaaccccggaga

SEQ ID NO: 1035 - DNA, 366 bp, Glycine max
ttgttctcgacgctgcaatcaagaatgaccttgtagcatcccatatcccgcgcatgctccgttaggaactcgatcattctcttccccaaatgcttcccgcgtatgctagaatccacaacaacatcctcaatgtgcccaactttgccgcaattcctcaaaaacttcttctcgataaacacgctccccgtcgcaatgatctttccggaagcctcgtcttcgatcacgccgatcacgtgctcgtcgccgagaacactgaggtctcggaatcgatcctcgaattccttgtcggagacggaatcgcatacgctgagttgctgcagtaactcgatgaagccttttcccttgtctgagatctctaatctccgg

SEQ ID NO: 1036 - DNA, 362 bp, Glycine max
gccgctactcctttagacctcctccagataataacagaagctaatgagacatcgaaaaatgctttggaagcctgatgaagaaatgaaggccggttcacctgctgtggactgggagagagaatgcttcaaaaccttgtagagcagaaatgttaaacgaggatagtaaacagataaagaatgatagatgacggtgcaaaggatgcaataggcttgagaaatcaaaatgaagataatgaaaaatacactctttcacgactctttcattttcttagcctggcaaagatattctatagtgcccttttggtgttataaatggatcgaagggatccacagcttttcggtttttgttgtataattttcag

SEQ ID NO: 1037 - DNA, 786 bp, Glycine max
ttctatgatcttatactaaagcctacataattaagcatgctacacaagcagcaccatgacctcagttacacactatataatatatatatatataaccacagacataatacaagagcactagtacaagagccttaaaaaagcaatttctagccattcccttttcgtgtcacgtggcctcttattctaacactgctaacataaacatcatgcaccaacctcactgcaccctgcatcagaaaaataaaagactcatcacacacattgaaaagatgcaaataaaaaaataattggttatattgattattcacttattgtctttatagttgtttcattttaaattttaatcttatacctgaaaaccgtcaatttagtccctacatgaaaaaattgtaaactttagtttaatttctaaacttacataagagttaagttttgattctttttaataccacaaaactttctgatggtgtgtaaaactgatataaaaactttctgacagcttttttttcctgttataaaaactttctggcaatgataatctgtcacaaaaaactgtatagaaacaaacattagtacctgaaaaaacttaaaactgcacaagatttaatagaaaataaaacttaaaatataaaagttaagttttggttcctgatgttaaccccagaaaaaaaaaccacgatagtttaagcaaaatactaatttgagcatatactataattataacattataacaagtacctggtgcagtctgtgtcggggctgatctggtagggaatgttaacccca

SEQ ID NO: 1038 - DNA, 362 bp, Glycine max
tcgtgctcgacactgatgatgatcctcttcaaaacggtggcacatactatatgttgccagttatgagaggaaagggcggtggaatagaagtagattcaactggaaaagaaatatgccctctcactgttgtgcaatcacccaatgagctcgataaggggattggactagtctttacatctccattacatgccctttttatcgccgaaggctatcctttgagcattaagtttggttcatttgcagttataacgctgtgtgccggcatgcctactgagtgggctattgtggagagagagggtctacaagctgttaaacttgctgcacgcgatacagtagatggttggtttaatattgagagagtt

SEQ ID NO: 1039 - DNA, 617 bp, Glycine max
  misc_feature (406)..(409): n is a, c, g, or t
  misc_feature (415)..(421): n is a, c, g, or t
  misc_feature (426)..(429): n is a, c, g, or t
  misc_feature (431)..(436): n is a, c, g, or t
  misc_feature (444)..(445): n is a, c, g, or t
  misc_feature (448)..(453): n is a, c, g, or t
  misc_feature (455)..(458): n is a, c, g, or t
  misc_feature (460)..(465): n is a, c, g, or t
  misc_feature (470)..(470): n is a, c, g, or t
  misc_feature (481)..(485): n is a, c, g, or t
  misc_feature (490)..(505): n is a, c, g, or t
  misc_feature (507)..(513): n is a, c, g, or t
  misc_feature (515)..(517): n is a, c, g, or t
  misc_feature (519)..(530): n is a, c, g, or t
  misc_feature (535)..(540): n is a, c, g, or t
  misc_feature (546)..(552): n is a, c, g, or t
  misc_feature (554)..(557): n is a, c, g, or t
  misc_feature (559)..(559): n is a, c, g, or t
  misc_feature (563)..(563): n is a, c, g, or t
  misc_feature (579)..(583): n is a, c, g, or t
  misc_feature (585)..(585): n is a, c, g, or t
  misc_feature (592)..(592): n is a, c, g, or t
  misc_feature (596)..(597): n is a, c, g, or t
  misc_feature (605)..(605): n is a, c, g, or t
  misc_feature (609)..(610): n is a, c, g, or t
tgtgaggaggagtgaggcagagctgatagctccggcgaagcccacccctcgtgaagtgaagctactctcagacatagatgaccaagatgggttacgtttccaaattccggtgatacagttctatcgccacgacccatcaatggcagggaaagaccctgtcgatgtgataagaaaggctgtggccaaaacgcttgtgttttactatccttttgcaggtaggcttagggaaggacttggtcggaaactgatggtggattgtactggggaaggtgttttgttcattgaggctgatgcagatgtcactcttaagcaatttggtgatgctcttcaacctcctttcccgtgctgggaggaactcctttatgatgtacctggttctcaaggagtgcttaacaaaaagggaaannnngttgcnnnnnnnccccnnnntnnnnnnggggtccnnttnnnnnncnnnntnnnnnnccctnttccccttttnnnnnccctnnnnnnnnnnnnnnnntnnnnnnncnnncnnnnnnnnnnnntttcnnnnnncccctnnnnnnncnnnncncccnttccctccctttcctnnnnncnccccccncctnncccttttnatcnnttcttcc

SEQ ID NO: 1040 - DNA, 589 bp, Glycine max
  misc_feature (580)..(580): n is a, c, g, or t
acgttacgttggaaggatcatattcatagggttgcaattccaggtctttcacctcatccttctcgctatcctttattgcctccatgaccgtgccttcaacttcaacaacgtctatcttattcatctctttgttctttccccacagaacaaaatacagccccaacactatcagcagagaccctatgacactgcaccaaaccaaattgaaataaaacataatgtacaacttttatttatcatcaggcacaaaaataaaatcatatatagatgggtgagtattgattattgagtaaagtccatatcatatagtaatttcttacgtgccaacgtataattgctcgtgaagaaaagcccagctagcaacagcaatgatgacaagcagcaaaggggagaacacagacacatagagaggacctttcctctcaatggtccacgcaaggagcacatacgctagcgcagtagaaatagtcccctgaaaccaacattataaaatgcaatataattatgactattatataattatataaatgtaccactcatcatagaaaatgggaactatatgtaccgcataaagagcagnggttagtca

SEQ ID NO: 1041 - DNA, 731 bp, Glycine max
tcccttattcataccaaatcaaattattccttctcaatcgattctcttcggccatgtttgcttacccttttttgtcccgttcctctgccaccctttctcgaagcttcacccttttctctgtttcacgaaattcccaacctttctccaccaacctctccaataacttcaattccctccttcacccatctcccaacaaggtaaccccacttcgaaaacgttatcaaaatttgatttttcgctatttttagtagtgggggtttatctggggttttagggtttattgaaaactttccagttatggcattttttatgccgtgtgtgagtttagtttattctgttatgattttctggctatgaattattatgtcaaatttattattgttccattttgtgccttgtaattctgtgttgagtaaatttagttttagttagaaattctcgttaagtttcatgtgcgttttcttatgttccagctgattccagttcaaaccaattttctgaattcaatgaatccatcattgacttcgagatttggattttcttcaacggcctcacatgaacatgcaagtgaaggagcaaaggtatctgatcagtctgaacaagccgaagctgcggatcaaaccaaagaatcaggttctattttggaatctcagtctcaaccttgactggttataaataaagatcaaaagttttttaatgaaatgcgttttctgattcagatgtagagattg

SEQ ID NO: 1042 - DNA, 377 bp, Glycine max
  misc_feature (357)..(363): n is a, c, g, or t
agactcagaaatgcactttgtccgcttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaagtaagttgagaaatttgtattttttcagcattgttctagtcaaagcttctgatatcctgcttcctatggccattttaaaacatgtagggaagaattcttgtttttgctgttgaagatggaaaactacagctaattgccgagaaagagacaaaaggagctgtttattgcttgannnnnnntaatggtaaattgc

SEQ ID NO: 1043 - DNA, 436 bp, Glycine max
  misc_feature (68)..(70): n is a, c, g, or t
  misc_feature (85)..(88): n is a, c, g, or t
  misc_feature (279)..(281): n is a, c, g, or t
  misc_feature (311)..(313): n is a, c, g, or t
  misc_feature (331)..(337): n is a, c, g, or t
  misc_feature (354)..(366): n is a, c, g, or t
accctttaggtttctttatccaataataataactccattttccctctgtcttcccccccccctctacnnnaaaaaatattaattnnnntggagctggttctgcaatacttgaagcgcaaggtcttctcctgccctttgccagcctctatcattcctgagcttcatgtttgcaagtctgatccttgggatttgccaggttcctttctattttccattcacacccatcatcccctttctctttctctaatttcaattccatgcccccatttttaggtgatnnnagcaagagagatacttctttaccaccaaannngccaaatatcccaacggnnnnnnntccaacagagccacaannnnnnnnnnnnncttctttagcaccaaagtggccaaatatcccaacggaaatcgctccaacagagccacaaattcgggttat

SEQ ID NO: 1044 - DNA, 389 bp, Glycine max
aaagcacaaaaagacataaaaaagggaaaataaaacattttgaagtcatatttgcacacttgattaaaggctgtcgtcccttgtgacggatgcgtggggtgctaataccttccctgtgcgtaaaaacaactcccgaactattcacacttaaagttcgtagaccacaccttttcaattttcccgacgctttcctcaaataaaagttggtggcgactccgcgcattttcctttcatggaagacgcactcgtgagtcccgcatcgccctcccgtcaaagggtaggttgcgacagtacttgccctcccgccgaagggtaggttccttaattgaattaactaataacaaaagtgaaactaaggctaaaataaactcacaaatcaagctttgtcc

SEQ ID NO: 1045 - DNA, 383 bp, Glycine max
  misc_feature (364)..(364): n is a, c, g, or t
accacacggcggctcttagcgtcggcggagaaagctccgccgccgcacccggaggagaaccgtcgtcggtgttggccctcagtttcacatagtccccattgccatcatcggattggattgtgagggtaacgtccggcacgacctcttctctccgaccaccaccatcagtctcgtaatacgtcatcgggaaatgcaaaaaacaaaacaatccaaaaaaaaaaaacccccccccaaaaaaaaattttttttttttttttttttttctctctttgtttatgagggggggagcatggtttgtggccccattttatagcccaatcattccccccccaacacccgaaacgaaataatcgattaaggcacnaaaatgacgatgatgagaa

SEQ ID NO: 1046 - DNA, 408 bp, Glycine max
gaagttccaaaagcaccatgaggatgaacttgatcatgagcaattggttgctcgggtggggttgagattgatttcaagggtggtaaacatgtccaaattgagaaaagaacagctaatatggtgtaatgagaagttactccgaatcaagtttttgagcaggaagattgttcaggtggaaccttccttcttgctttttccatgttgacaatttgttctcaattttagaggaagagaaatgctagaggaatagagatagggataccttttcacagaaaatgatatcctagcttacacagaaattgagacacacgccacagaattctcagtgtatatatataagttatatatataagcttgttgcttatacatcatggtaatataataaatggcaagcttggttagttcaag

SEQ ID NO: 1047 - DNA, 396 bp, Glycine max
aaagtgatcatcatcaacactcaaatgatgatgagtcttcaaaaccatgctgtgatcaatgcgcatgcacaaagtcaaaccctcctcaatgccgctgttcagatatgaggctgaattcgtgccattcagcttgcaaatcttgtatttgcgcattatcgtatcctgcacagtgtttttgtgttgacataaccgatttctgctatgaaccttgcaaacccagtgaggatgacaaggaaaactactaatgaacaagtgttatgcatgtaagctctctctccaacggacaaagccccctttatgctttgtttgttatgtaaggaatgactaaataaacttggaataaaacttcctctcttttcgtggcccataatttgctttctgcaaatctgggtcttc

SEQ ID NO: 1048 - DNA, 390 bp, Glycine max
ctaaacaagggcaagaagcaatgaattcctcaaattcaaatatctaatgcaaccaatgctgccaatcaaccagagttaatacacttgattaggagcggacgatatttagcaaaacaaaacttcagattggagacaaagtgacacggattccagtagctgaagatgacacacaattccatacagaagcatgcaaaagttaatcagccacatgaggaaactgtggacacagaccaaagagcagcaagtggagaatgaaaaacatttggcgagtactcaattggttaaatggaatcactctttctagtcccagtcctcagagatcatagatcaacaggtgattttgccgaaggaggatacacaatacagtgtcctacacaaccaagatgatga

SEQ ID NO: 1049 - DNA, 605 bp, Glycine max
tactaattccagagaatattcaataccaaagcatatatagaaataaatttttttaaaaaaaaatcccaaaaggaaaagtttgacaacacaaattgtaaaatcatatctcaacaagttaacaaaaagggtctccaaaccaaaaaccaacacaaatgttttcatcctctactcttccaatattgttcccttctcgcttacataaataccatcaagaaacttccggatatccttgttcttaacatgacatttctgtggcaaacaagcaaacaaacaattagttaaagcctaaaacaatagcaattgagaaaagattaaaagggaacatgtgcatagagaaagagggtacctggttaatgagagcacatgacctagaaacaagttcaatgtcgtttccatccaagaccaattcatctttgaccttttcagatctaacaaccgacacgccctcaagcatgtccactttcctcacctaatcataaacgtaataaccaaataaatcacttaacctaacaccacaatttattcctgataacatatgacacagaaactaaataaaaaaattgaaaacaaaaaacaacagtgttgagcaccttcttctcgccgag

SEQ ID NO: 1050 - DNA, 409 bp, Glycine max
ctctcccatgaccgacgaccgcccctctcccgcggcggaagacgctctccattataacgacgcttccaccgccgacgtcgtcctccgcctcttcatcgacgctccctctccgctcgattccgtttccaactccgaccaccacgtctacctccactccgacgtcctccgccgctccaaatacttctccgcgctcctctccgaccggtggatcggccacgtcgcgccggagctctcgtcctcctcctcctgcaaccgcgaccgcgacctcgacctcttccgcctcaacctcggtgtggctcccaccggcggctcgatccaatcgcatctcaccgtcctggagcttctctacacgaacgacttcgccgcggcggtggactgcgcgtcgacggcgctggatctgttaccggtg

SEQ ID NO: 1051 - DNA, 393 bp, Glycine max
gcatgacctacaaatttgacagtcctagcttacatgctcatgctactggttctcaagattttgagaagaacaaagtcaatcaaatggaaagagaattgtcatctgcttttgaagaagatcctaatgacattgatgcattgttgagcataggagcggatgaactagaagactttgacgaggaagaagtcagcacagcaaggactcgtgaaaaatatgaaagtttatccgatacttgctccagttattgctcaaaatcaaggaagaagaggtcatcatcatcatcttctgtacagaagtcttctggggctgggggttactgccacaatgaagggaagcaccaggagataaagaggatggtgaggatgttgagaaagattgtgcctgatggaggta

SEQ ID NO: 1052 - DNA, 958 bp, Glycine max
  misc_feature (949)..(954): n is a, c, g, or t
gcagcttagtttgagtgaagactcttttgtttaactctataaataaatcatttaaaatccactaccaccagcaacgcaccatgctagatcaaaatgtcaaaagatgggtcttctatgctgccacagatcctgaagcagccttcctttcctctataagacttgtcagtgcactatcaatttgagcaaatacttcctcctttgagacatttccgttaatctgaagacaagaaaagcaccttagctgggcttgacccaattatatgaagcagaacctgtccaaatcctaactatatttttcctatagaggtatatcttagcttttgcattagtaggatcttattgaacacaataaactgacagataccagctacaaaaaacacttgaagaaacacaacattcaagttcgaagcagttaagcagccaatataaatgttccattgtctgaatacatcaaatgttttatattattaatcattgtttagttcaaatgtataaagtccatttttttcttattgttcatgctgaggagacagtgatacacttggcatcttgtctacaagaacaaggtatgaacttgtggatatccatattttatactgttgtggcaaggattattcactctaaattggtaaggtaaaagtgctttataaatgatgtccactcctcaggattgcttgtgccatgtaagagggagagattatagagcataccttaacagttatgtctttgtacatggaaaggactgactccacattttgatgatgggtattcaatcgcaatttcacctaagtcaaaagcaaacaacaaaggaaaagaaatgagatatcttagtggaaagaagggattgtagtttcatatagggatatattgatgaatgccttttcttctgtatcatcaaagcgttgggtaagccttgcggctatttcttgtgtctctggaggagaatacnnnnnngtga

SEQ ID NO: 1053 - DNA, 394 bp, Glycine max
agtctagagacatagtacttgtcctggcgacaaacaggcctggtgatcttgatagtgcagttactgatcgcattgatgaagtaattgaattcccacttccaggagaggaagagcgtctaaagttgttgaagctctatttgaacaaatatttatgtgatgacaataatggctccaaggggggtttcttcctgaagaagcaacctcagaagattaccataaaagatttatctgaagatgttttcagagaggctgccaagaaaacagagggattttctggccgcgagatcgccaaactcatggccagcgtccaagctgctgtttatgggcgcccagactgcatcttggatgcccagttgtttagagaaattgtagattacaaggtcgtggaacatca

SEQ ID NO: 1054 - DNA, 1151 bp, Glycine max
  misc_feature (1095)..(1106): n is a, c, g, or t
ttgttgtttctgttgctagttttctacatatatttatgctatgctgatcattatcaatttgtcaatttgaatttcctgtttgtcatggatgcttccaaatatattttagtggtcttcatgaccatatgaaggtgactacatgaataactttcatattatgaatgccgtaatttgtagaaatgaatcagttcagctattatttatcacagaataatagaagagcatagttggctctttgggttaattgattaggaaatgttcttttttggacaagcttctaaatctaacaaggtaaaccatgtgcgatgtgtcagagggttcaaatccacaatatactgtgtaatttacctatatgggaaagaagatctgtattttgtctgacatattccatttcctttggatttggatgtatattgtagttattttcctcttcagaatgaatattgatcatgttcttaacaaatgcagcttttccttttacctagtgacaccaaacccaataaaattattgttctaactcttggtctcacattcagatattgaatcataatgttggatctggatatgatgcacctgaagttgccttgtctggtcagtatactttgaaaagtgatgtctacagctttggagtcgtcatgttggaacttctcagtggacggaacccttttgataggtgaattaatggttttctttatgtctgctctcacgtttttgagcaatattctgcagattttgaaattatgcacaaataataatgttgtctcctgattgcaaaacattccatgacagctcaaggccaagatctgagcagtctttggttcgatgggcaacacctcaactccatgatattgatgcattggctaaaatggttgatcctgcaatgaaagggttatatcctgttaagtctctttctcgatttgccgatgttattgctctttgcgttcaggtactgtcagacacgttttgattcacccaaaatttattgattttgtaaatatggatggatttgggaaaccacgggggtggatgggaaatatttgtgcatggcttgttcatgtgattttttgtttatattatttggggcagccggagccnnnnnnnnnnnnccgatgtcagaagtggttcaagcactggtgcgactagtgcagcga

SEQ ID NO: 1055 - DNA, 1138 bp, Glycine max
  misc_feature (33)..(33): n is a, c, g, or t
  misc_feature (37)..(39): n is a, c, g, or t
  misc_feature (827)..(827): n is a, c, g, or t
  misc_feature (833)..(833): n is a, c, g, or t
  misc_feature (896)..(896): n is a, c, g, or t
  misc_feature (898)..(898): n is a, c, g, or t
  misc_feature (959)..(960): n is a, c, g, or t
  misc_feature (963)..(969): n is a, c, g, or t
  misc_feature (1030)..(1044): n is a, c, g, or t
  misc_feature (1059)..(1088): n is a, c, g, or t
  misc_feature (1110)..(1112): n is a, c, g, or t
  misc_feature (1115)..(1115): n is a, c, g, or t
  misc_feature (1117)..(1117): n is a, c, g, or t
  misc_feature (1120)..(1121): n is a, c, g, or t
  misc_feature (1125)..(1129): n is a, c, g, or t
aaatggttaataaacacttatctcctttgtttncctnnncttgttttaatgctttatatgaactagatcatcttaatctgagaaaaacattccttgattctcagatcattagcactgagtggggtgctttctcaaatggtctccctttaaccaagatcgatagggaaatggatgctgctagcatcaatccgggtgagcaggtgaattttggtagcaacattcttcataatttagttgttctgaaatagtagcaagtagaagaatcattctctgcatattacttggcagatatttgaaaagacaatctcgggaatgtatctaggcgaaattgttagacgagtgttgctggaaatggctgaagagggtggtttgtttggaaaatctgtcccgcagaaactatctacacctttcatactcgggtaagattttttattttcagttaaaatctatgctcaaatcatatacattaatagatcacattgctagtaaaatttggtaatatggcattcactctatacatgtagctctaatttcattttaccgtttctaagtttctccccgttattcctttttctttaaatggggaaaaaaggttctactcatattttgtaatcatatacactttacgtttaacactcttgagctatattcatatgcctttatataaatttaacaggaccccagatctatgtgccatgcagcaggacagttctggcgatttacatgcagttgggtccctcctctatgataaagcaggggtaaattaatttctagtcctaaagtctaaacttctgataattttaagcacctgttctataaagatggtnatttcncaagagaactattatataaataagcaccattttgttattttatattgcaaatataaaactcantntttcaacagtattttttaaaataattattcaaaatatattttatttaaaagcatactcctnntgnnnnnnntttttaagatgatgcagagttatgatcatattattgtcaaacaagagcaatgtgttttatnnnnnnnnnnnnnnnaatgcatataatacnnnnnnnnnnnnnnnnnnnnnnnnnnnnnntttgtttccattgggtcgtttnnnttntnggnngaannnnnatttaagga

SEQ ID NO: 1056 - DNA, 460 bp, Glycine max
ttgttgtcgtttattcggatccagatccggatctggaccgctccagctttcgctatgagcgaaatcaccgtcatgatcctgtgctgccaaatgctgcaactcgacgaaaccacgagaaactcagattttgagaatttcaatttttctttcaatgggagggggaagaagcggaaagtgtgtagtgtcgttttacttacgagtgagatttcggaggctaaggagtcgtggtcgtgcgcgtcggaggcgaaggagcagcggtcgacgctggcggaggcggaggagaagaggctcaagttggattcgagagtgaagatgacggagtcggggctggtgtcgccgcctctccgcctccacgaccttcgttcctgaaaccctaactctcgcattctcatcgagcttcttcgaatcacattcgcatttcgcagagagaacaacacactcacactcacactcacactcc

SEQ ID NO: 1057 - DNA, 271 bp, Glycine max
attacaactgccattggcggtcgagatggacaaccaaagcaggtgattactttattattgttgaatctccattggttccttaactcaacattttgtgcactttatttgcacaagtgcatgttaggttataaaccttaactgtggtttgttatgtaatattgaactttaataacttatatagttaaattttgttggtctcagacaatctcttacatggctgaacgtgtggttggtactggttcttttggtattgtttttcaggtatttatat

SEQ ID NO: 1058 - DNA, 1046 bp, Glycine max
  misc_feature (996)..(1005): n is a, c, g, or t
  misc_feature (1034)..(1040): n is a, c, g, or t
gagccattgagtcttgctgaggagccgtttattgttaagcaggtttgattttcattattcattttatcttttgggtgcttgaattgtatgtcgtgattaatttttctcaataataggaaaatttttaagaatggaaaagaatgagaagttcagtttgactgctgatcctataacaaaagagaaatcgtagcagagataaaatcaccaagcttaaaagctcccacacctctttttgagacggctaatgaaattctagaagaaatgagttaagatattttcacatagttgtacagaatgattaactggttccgaaacattagagtaggaaattctcaaaaaagtttcttgtgtgaaataactcaactcagttaatgcaaatgtttatatatctgatatgattctatgtgccaacgggaaattcatcatgcttttacagtttctttctcctgtgttaattaacatcctgaattttggaaaatttgtataattccttgctaaagcttgtcatgtctatccgatattttgtattgatgttgaaagtcctgatagatcttttatgtaacttttctgttttaataccattgcaatggtaggttctaactctttgctgaacatgtttttaggacttgcttggtgtgtgaaatctgattgacaatgctttgctaaacattagaaattttttatttctgatgattaatgaatttcttatgttttatcactataaatccatttgaaataaagaaatgtgagtgccttaacattcctttaataattgtgatgataggtgaggaagctagaaacttcatttgtaagtttctggtctagaagagggttggatccacttagccagaagttattgtcagatccaaagccatgtgtcaaagagccatatcattgacaagactaatatccaaacactgcacaattttttggccatcagaagtactgctttttagtaaagtaatgccctttagttaagtaatgcatacatgtcannnnnnnnnnttaaaagcctatctagtttattttttacnnnnnnnattaaa

SEQ ID NO: 1059 - DNA, 350 bp, Glycine max
  misc_feature (6)..(8): n is a, c, g, or t
atcttnnnttcatcaataaaccagaattcttccttcttgcattcaaaccaccaccaaaattcaatgatgatggtgacttaattgatgaagaggccaaggataagctgaagcaagttcttctgtccttgcgtgcatttactctaagacttcaaggcaaaaactaagcttgaagttactttaattccacgaattattgttgaaataagctgaggatttagaaataaaccaatgttattctgaacgtgcatgatgccactatgtataaggatggtttttaaaggtcgaaaatgtgttagttctctacttctcttggtacatttggagtaatgtttgcatttgttgtcctctac

SEQ ID NO: 1060 - DNA, 377 bp, Glycine max
tatgtgtgactgcagaaaaatttccaatgcaaaaacagtcataagtgacagttagcttccagagacaaaatctaaaccaaaccttatccctccctctctagcctctatcaaggataccaaaactttttatccttcaggagaatctatgattgttttaaatacttaaaaaaaaaggtacaataggaaaagcatattatccaacaagacaagctcagcagttccgtccagccccagacaaagcaaatcttaactgaatcagcttctttgtcttcctaagaaatttttccagttacctttgggcacttctcaaaacaattcggtatgtgcaagacagtgaggccggggatcacatggtgttggatcaccaaagaatgatg

SEQ ID NO: 1061 - DNA, 850 bp, Glycine max
  misc_feature (819)..(821): n is a, c, g, or t
  misc_feature (840)..(842): n is a, c, g, or t
actatatgtctgtgagtaatatgtacaagtatatttatcattttaccaccaaaatttaccagtgtttcctagaatatacagtaacaatcactctgccaattttacagccagagagaatcaatggaagccagcgaggctacaactacaaaagtgatatatggagtttgggactaatattacttgagtgtgctttgggtcggtttccatatgcaccgcctgatcaaagtgaaacatgggaaagcatttttgagcttattgaaaccattgtcgataaacctcctcctatccctccttctgaacaattttctacagaattttgctcatttatctcagcatggtaattgttatatgtgatactagttttaagcagtcaagagtcttaatccaccataagaaaatgaaaacacaaccaaacacacacacagagaacactaacataacggtagtagttttttaaaggtcatcctgaaattagtgcatggatgcttgagtgtttatgttgacaaaccattattttcattttttattcttatttttaaggtatctttcataatttcattaaacaaaccatttaaacatgtataaatattagcaccttccattactattctgctgcctgttttgccaaaaactctatttcactgtgtgctttttatgtgtctactgatcttcctttttcaatcttgttgtttagtctacagaaagacccaaaggatcgactgtcagctcaggaattaatggtatgcgtaaatcttgcttatgaacacacaccatgtagaatattgtccttctgatgctatatatttgattgaaactccnnngcacatcctttgtcaacannngagactga

SEQ ID NO: 1062 - DNA, 413 bp, Glycine max
tcatcttctcatcaatgatcatcaccatatgctctgaaactataacgttcttgatatggaccattgaaccataggtcagcttcaaaccactttgggtaccggaccaagtctccggccacaaattgcatgaaacgcttgcttccttcaggcacaactctcacttccccttcttctacgtacaccagttggtctacctgccagtcccaaggtaacctgcttttcccagtcttccacactgaccattttgaaactccaagctcggctagtctctcaggaggaacttttctttccaccttcacattgtacaattcctccaaggatttctctatcctcattgcttttatgcaacaccttcctttagaagcattaacagactttctgaaacccctggaaccattgttgacaggagaata

SEQ ID NO: 1063 - DNA, 1150 bp, Glycine max
  misc_feature (111)..(112): n is a, c, g, or t
  misc_feature (1021)..(1023): n is a, c, g, or t
  misc_feature (1093)..(1100): n is a, c, g, or t
  misc_feature (1131)..(1131): n is a, c, g, or t
  misc_feature (1136)..(1147): n is a, c, g, or t
atatttggatgaatgacttttattatatttttttttatcgataaatgttaaattgttagaatgttatagaagatcgaacagtaacctatatttgaatgaatgataatcgtnnaaatgtgcaaagttatttatacatggtgatggttatttgatgtggcaggtattgtttatctgtgaatattattggatttgcatactctgcattacaagcatgtgatttgacatgccaacttgccacggggaaacgcttaatcagtcaccaccttcgcaaccactttgatttcttcatggatcaggcaagttgtttgcactttgctttgcaccactctgtttctatgagtatgttactaaatagtcaaaacatgagattttgcgagcttaatcagtgatcttgagtttaaatttagatgtacaattaggttgaatactcaaggagaattttgtcacttataataattttacatgctcgagcaaaagatttctcgtaaagattgcataatgacataaatataatgtgcaatttgaattgtttaacaactaatattacaatctcagtacttgtcattgatatcttattcggtagtattgaaggtgtctttctgttctaccagtacccaaaagtactcaccaaaaaaaggcttaatatgactgatgcagcaattttaggtactgatttagttatttattcaattatttattatatgtaataatagatgacatttaggtcatgtttggttttccatttgaggaaattcaattttgtagaagcaagactagggtttgcatttaagtgaaatttaatgctttactctgatagttgtgtgtttatctggagattttgcactagaacaagactcaaacacccccgaagccttttttcttgttgaaaatcataacatctttgtgaaaaattgatgtacaggttctggcatatcttctgatatcgtcatcatcgtctgcagccacacgggttgaggattggatattgaattgggggaaagacgagttcacagaaatggcnnntgcttcaattggaatggccttcctcgctttcgttgcctttgctatcagctcactcatctctggttacacnnnnnnnnaccgaagctccatgtgaacctcacacttccnaattnnnnnnnnnnnnaca

SEQ ID NO: 1064 - DNA, 375 bp, Glycine max
ttttgtggtgtttaacatctaatgagtcataagtcatggcattgtttaagaatccctaattttatgcagtggtcatgaaaaatttggtttcatgttggaatttttattagatgttgtctggaaccatgaaatcagtgcactttgcatagcagcctccgtgtaaagcaatcaactgaaaatgttatagttacatggttccatttgtttaatgcctccactgatggttggtgtttataaatgatctcaattcccatttactttagcaattgtgatatgattctttttaatatttagccaaaattatttttgaatggcattgatcttcctttaactagagctgttttgatattacttgaatcttgatctgttgcagga

SEQ ID NO: 1065 - DNA, 675 bp, Glycine max
  misc_feature (7)..(7): n is a, c, g, or t
  misc_feature (407)..(409): n is a, c, g, or t
  misc_feature (612)..(612): n is a, c, g, or t
  misc_feature (658)..(660): n is a, c, g, or t
  misc_feature (663)..(666): n is a, c, g, or t
  misc_feature (668)..(670): n is a, c, g, or t
tcccccncgggaaaacgtttctgtatcaataggtaaataatatgcttaattacaaatcttactgctcaaattttattttgataaattttatcattaagtttttttcatgcacattttactaccacgggcagaatctttttatcaaactaagtggtttaaacaaactatataaaatatgaatgattttgacatcaattgtaattataaccgatataaaaataatattttacatcggttgaggacttgagtggtaaaatctcaaattataaaaattgggtgataaaatttataaaaattaaacttaaggggtaaagttcacaaaataatgaaagttcaatcataaaatttatcattaatcctaaatagtaatggcttcaactgtgtctccttttcaattttacatcttnnnctttttaagagtttatgttatttcttgtggaattcctgcagtgctgcccttaagctcaaaccaaagcagtagacagtgaaatacctacctatcactcggaagcagatggtataatattctaaatatgtgatatactttgtgctgtttttcctatttatggagaacaacaatgaatattgtcttgaactgttgatgtataaaanacaaattttatagaatctagaagctcaattactatagtgaagactnnnaannnnannnctaat

SEQ ID NO: 1066 - DNA, 407 bp, Glycine max
ctcaagagacaacaccgacaacatcaaaatcattaagaaatattgcaaacatattgtaactcgttgaatactataataaagtaaacacatacaatcaacttacacatgcacaacaatgacaaggaagaaaaagagttgaagaagtgtatatacacaattgcacaccacaacactcactcactacaccaaatttaagattttttaacattaggttcgactcctaattcctttctggttttccctacaaacaaatctcctgacttgatcatgccaggaagccttccaagcacagtcatgaatgggaactgtgcaaccgctattttccttcctagtgaaaccatagatattggtggttgtgccttgtatgttcccaacttatgctctttgcctcctccctctatcaataa

SEQ ID NO: 1067 - DNA, 478 bp, Glycine max
  misc_feature (396)..(397): n is a, c, g, or t
  misc_feature (411)..(415): n is a, c, g, or t
  misc_feature (430)..(430): n is a, c, g, or t
  misc_feature (440)..(445): n is a, c, g, or t
  misc_feature (452)..(467): n is a, c, g, or t
ccatgttctgtcagttagtgagtgtcgggtacgatctggttgtgttgggtgggttggacccgaattcgtgggaagcatcgaattcggtgtttgtttataatttcttgtcggcgaagtggcgccgcggggcggacatgccgggtgggcctcgcacattcttcgcttgcgcgtcggattccgaggagacagtttttgttgccggcggacacgacaacgagaagaacgcgctgcggtcagcgttggcctatgatgttacctcggacctgtgggtcatgcttccggacatggaggcggagcgcgacgagtgcaagggcgttttctgccgcgggaggttcgtcgctgttgggggttacccgacggagacgcagggaaggttcgtgaagagtgacccacagnnccgaggtaacatcnnnnnccaacgctgaccgcngcgcgttctnnnnnntgtcgtnnnnnnnnnnnnnnnnctgtctcctcg

SEQ ID NO: 1068 - DNA, 391 bp, Glycine max
aagtgggttgctgaaatccgagagccaaacagaggcaataggctttggctaggtactttccccactgccattggagctgcccttgcatatgatgaagcggccagggcaatgtacggttcctgtgcccgtctcaactttcccaatgtttcagtttccagtttctctgaagaatcttccaaagattctccggttgcgaatcattgtggttcgtcaatggcagtgtctgcaaacgagtccatgatttcaccaagtaactcgggggtaggtgcagaagatgatgttgatatggagcccatttccttatccttaactgtaaagcatgagaatggggaaggtgaatcggggataagttcttcccctccttccccatgatgtacattgggacatggct

SEQ ID NO: 1069 - DNA, 816 bp, Glycine max
ccatagcagccccagcaatccagggtggcaatctgaaccttgtagaagggaaaagagctccagcagcaattgggatgccaagcaagttataacccaaagcccaaaagtaattcaggcgtatacgggaaaatgtttttctggaaaggtcaatggcagttatgacatcctccaagttgctcttcatgaggacaatatcagcagcctcaatagcgatgtctgtaccagctcctattgccattcccacatccgctgccacaagtgcaggtgaatcattgatgccatcccccaccatagccacagtgtacccagaagcctgagagagaaaagaaaaaaaaagtcactcaatatgttacaatagagaatatactcctctgaaacagtacatacagatgtggaaatgagactcatgcttagttaagcagaattcaagcacacacattgaagtttatggtatataaactataaaaaccagcaatcaaaccagggagatagaaaaaataatggcagaaagacggaatttttaagtactgactactgaatgtaatcagaagatatacaagtatttcttaattactttacatgaaaaagaaattatagctatctagttctggtttcaaataaggtgatattgttttcaatttcaaggcctcaaagcaatcttatcggtcagtgtcatcttaaagattaataactaacttttttcttaaaattaagcagaaaagttgtaatcattatgcatttgtacctgcaagtctttcactttctctgctttttgatccggtttggcctcagcaataacattttcaattcctactt

SEQ ID NO: 1070 - DNA, 248 bp, Glycine max
  misc_feature (227)..(228): n is a, c, g, or t
  misc_feature (238)..(239): n is a, c, g, or t
tgcattcctgttgccttgttgatattgggccttgcctttgccctgcagtactatggccaaaataagcatgctagcacctcatgaaatatgaagttgagctagagccgaagtttcattaggtttgttaattcattgcctacttcaatgcagtattaaagtggtaatagactttagtcaatgttgtgtgtctgtgatttaaactcgttaccccacccttcaccatgcanncccttgagtnngctgtgggg

SEQ ID NO: 1071 - DNA, 386 bp, Glycine max
catcgaccacgacaacagcaacaacaacaacagcaacagtcccatgaacgaaaacaacaatagtaacagcttgttggggaggatcagagaagaggacttgatggaagagacgaaccctttggcgatcgtgccggataaccaccctctggacccggttccatcgtcgtcgtctcagggagtaaggggtggcggcgctgcacgtgaggagcacgtgtcggttcagcgggtgaagaaggaggaggttgatgccaagatatcggcgtggcagaacgctaaggttgcgaagattaacaacagattcaagagagaagacgctgtgatcaatgggtgggagagcgagcaggttcagaaagcttcctcctggatgaagaaagttgagaggaagc

SEQ ID NO: 1072 - DNA, 381 bp, Glycine max
tccctatccctatccctatccctgtccctatcacggtctctcctatccttatccttatccttatccttatccctcctctctctatccttatccctgtctttcctctctccgtctctctccctctcgctcctgtgacgaccagaggaacgttcgcggtcacggtctctctctctgtctctgtcgcgatctctcttggaaccgccgttctcgtcgtcgaccctagacctcttgctctttctgtcatcggcgtcgagatcgtcgtcgacgtcgcggggctttcggtaactcctctcgctcttgtcggtgacgtccttcttcttcttggaggaatctatgtcttcctccactgtcttctccaggtattcgtactcgtcgaagtcc

SEQ ID NO: 1073 - DNA, 350 bp, Glycine max
  misc_feature (323)..(323): n is a, c, g, or t
tgaactgtgcagcagaatgtttcagcagtggtaggtggcaacaaaacggggagaacaacttccctgcatagagtggctagcttggaacatcttcagaagaggattcgtggtggtgcagattcacgtggacctccttctaatggagaacaataacatagtagttaaatttacattatgctttttatgaggaaactattctaaaactcttgtttctgctagttgtaagtaagagcaaattcttattgatgtatgtgaatcttattgagcatattctgctggataatcctatttttctttttttttgtgtgtgtgtgtggactccnccaaatcttaattcatggctgatggga

SEQ ID NO: 1074 - DNA, 1129 bp, Glycine max
  misc_feature (1071)..(1079): n is a, c, g, or t
  misc_feature (1113)..(1122): n is a, c, g, or t
cttcgttttcctacatattttaattatgcactaacaaaattttaatcagaataaatatgatttttaagttagttatagtaaaagtcaacaaactgtacatacaaaaatggtaagtggatgtcagtgtagaatccgttacactgatttacttctcttctgtgttgacttttgctcaactaatttacttatcccgttctacgttatcaaagagttagagcttcgattcttaagtgttttaactggctatgatcattagtactgattactgaactgagatttttatttccaatagttctatgcttaattcatgattttctttttcgaatgatttagttttgtgatgcgggaactgaaattccatcatccaagctgttgatcaagggtggcacggttgtgaatgctcagcaccaccagattgctgatgtttacgtggaagatggcatcattgttgcagttaatcctaacatcatggtatttgatgaattgaaaccccctagcagtaacagagcttaatttgctttctaacaccttgtgtttttgttactttctgctttctaatgtatgattcatttccattcccaggttggtgatgacgtcactgtcattgatgccaccggcaaatatgtcatgccaggtttcaacctattcaattatatttcatcacctattattgttagattaaattagaatgcatgagttggtgtaaactccctcgtacctatctttgactccaatggataaaaataaataaattagaatgtgtggatagtatacatattttttatcctattgtctcaatctcaaatttaagatagcatcggaccaccctatatcggacttcataaatgtccaattttgtaaacttcatgccatgttgactaacaatatgacaaaaataatatatataagtggggagcaactcattgccatgtatgctaagtttaatgatttttataataactaatttaaaagatcataagtcgaatgatttctaattggtaaacaatgtaaaagtgcatgaaaattaatttatcatcgtcatcattattattattgttattattatgtgtnnnnnnnnntctatgaatgctccttttgttaactgatcaggtnnnnnnnnnntcacacc

SEQ ID NO: 1075 - DNA, 716 bp, Glycine max
agacctacaagacatacataacaatcctgcactgcataatgaagttgtcaccaaaattcgaagtgcatgccaggagtggggatttttccaagtgatcaatcatggaattccaattagtgttatggatcaaatgattgatggaatccgaaggtttcatgaacaagatactgatgtcaggaaacagttttactctagagatttgaagaagacaattctatacaattccaatactagcctgtacctagacaagtttgctaactggagagactcacttggatgttctatggctcctaatccacccaaaccagagaatttacctacagtatttaggtaatcagttaatattgtacttacattttacagttgttaataattttgatatattagtttccctttttctttgtattctatattatgtatctaggtgctttcctattatatgctggaaggagaacattttttcaagtagcttaagttattatcgaaccataaatttcatgttttaaatacagtttttcgaagaattggtcacttgtgcatgtcagtttcagaaattgttggagatataaagtttgttgggtggtaaagagagaagggaagtgggggaaagatggcgtgttcgattcctctattaacaaaaactaataattaacattttcccataaaaaaaagtttaaaaagttgttaaactattcgaattcttgatgaattgttta

SEQ ID NO: 1076 - DNA, 368 bp, Glycine max
tcttaaccatgggcttttttgatcctttgaaatattgctgctcttcaattcaaggcatgagctttaaacttttagttgtgaggtttataatttctcaaacgatgatatggtaactttccaagtacatgtctacatggcacaatataaagtttatgctggtgtgaatgagtttgcacaagtatagcacccagaaatgagttttgaagtagattaatcaacttgatttctagagtaataaacttctaaaattctaggagctggagtcgtgacattgacaaccatgttcaagaagtaataagttatagcctcaaacagtaatgcatagaggctagaaaggcctagagttgttaatcattgggttcggacta

SEQ ID NO: 1077 - DNA, 409 bp, Glycine max
ttgccactgtcaaacatcctgagacggagtctgaggttcttgccgacaagggtgtctccgatgtcgagaacggtggtcatgccaatgtcaaccctgcaatcgcttctgtggcggcggttgcggctgggaatggtggtagcaaggcggaagggaacgcgaagaagttggtgttttttgggaatgcggcgagggcgtttgatttggaagatttgctcagggcttcggcggaggttttggggaaagggactttcgggacggcgtacaaggcggtgttggaggcggggccggtggtggccgtgaagaggttgaaggatgtgacaatttccgagaaggaatttaaggagaagattgaggcggtgggagcgatggatcacgagagtttggtgcctctcagggcttactatttcag

SEQ ID NO: 1078 - DNA, 362 bp, Glycine max
tttttatttttatttttattttgcctactgcctaaactcgaagtggtaggttttgacatcatactgatacttgagatctacttaggcagtgtcaactgttaaaagaaagcacctccttggcccttaactaattattctgaaacatcacgaagcccttgttatggtgcatgtggacatcttgtttctatgaagctgtctgtggagataaacattagcagatggtgttattccccctcttgatgaattttcagagcttcaccttgctcacaatctcggaggttgggtgttaatgtagattaataccaactgacaaaatgttgatatttttgacgttgcctgctagtgtctgggtggtgtgttag

SEQ ID NO: 1079 - DNA, 633 bp, Glycine max
tatatgagagtttggatcaagaagaagaagaagaagaagaaggttggttgattggtcccattgattccgaagagaaaagaaaagatgtttgagccacaacagctatacactcgcgcgaagaccgaggaattcgacctcgaatcaggagaaaccctctacccagggctgagcgtcggcgagaaccagctccgatggggtttcatccgcaaggtctacggcatcctctccgcgcagatcgtcctcaccaccctcgtctccgtcaccaccgttttctatactccaatcaatgacctcctcaagggcaattccaccctcctcctcatcctcctcttccttcccttcatctgtacgtctccctcattccttattccagttattgtccgctttgatgcttgtgtcagaggagtatgtttataaattatccttgttcggagttgaaggtcgtgggtttctccgctaacaaaaaaattaaccattaacatttgccgataaaaaaataaataaactatgcttgttctcggttactaagcaatgttggaatttttagggtttggaacaattttatagatctctgattagggatctgaaattattttgcagttttgattcccctgttgaagtaccagcagaagc

SEQ ID NO: 1080 - DNA, 395 bp, Glycine max
tggagcttcatggttttctagtgcctttactgctatagcaaaggcagccgaggatgtcagcacgatgaccaaggaaaaggttgaacaggctgtggtggaaaggaacgagatcatttatggtgaaaggaaagggactgttgatgaatttgcaaagacgcacttagaggaggcttcagacattggccctgcagtagttcctgttaattcagatgatgacagaaagctggcaacaattttataactcaagttaattcagaatcccttattcccacgtacacagttggatttatttagttaacatagttattgtcagatttcagttcctgcaagtttgctgtacattgataagtcttcttgattgttatagtgatgtaaaggtttgtctgacagatgtg

SEQ ID NO: 1081 - DNA, 287 bp, Glycine max
ttttcttctcgtgattgatggaatagttatcaaaatgaaggggcacttcatttgacccgcagctctccttttcttccccagcagcatcaaaaaatcttgtcatgattgtgaatttgtgactaccattagaagggtcatactgcttcatggcatggctttcaactgatgatgtctccggaaggcgcgttgccatccaccgctcaagccaactccaactcatatttgactccatgctgttaaattttggagatcttctctttgaacagattcttagctgcaacaatcag

SEQ ID NO: 1082 - DNA, 920 bp, Glycine max
  misc_feature (48)..(52): n is a, c, g, or t
  misc_feature (905)..(906): n is a, c, g, or t
  misc_feature (911)..(915): n is a, c, g, or t
aaagaagagaagtctgtaacatatgagaatcacaaatagagctgctannnnncaccacttggaatggtttaattcaatgcctaacatgtgtgtgatgacgtattctccactcaattttgggtcaccaggtaacagaggatcaaactcaagcccaagcaagtcattcttgtaggaaccctgcaatgcattaattatatatatttcaaatcataaaatcaatataatgcatcatttggcaagtactatataacttgtcacaatttgttttctttaaatgttaaatcttaatatcatatatcaagttaaagatacccagctttctatcaataaagatcattagattttgatttcaatattttttaatttattttcatataataaaataatatgcattgttgataatgaaaatatctactatttttatttatttatttttgtttataaattttacttaaatataaatgttaataaaaattgattttaaaaatatgagcaaattacaataacaccattagagcaaattacatgtaatttttttttatttttctacactaacatccctttttaaatttgaaagtattaccctaacactttttgtatgtttaaaaacattacactaacatcaagtagaaaatgcatgtatgattaattagctaaaaaatattcatgaaaaaatagctaaaaaaaaatagatttgccaaattaattaattacctggattgcccaagaaccataactgatatatgaaattgggtagcgccaaaccggctttggaagatcagagagcaacctgaagaatccggaggtcatcatcatgattccctgccaataatacaaaattaatatatgtgggtaatttttcaagtacaattaaaggcctaaattgtaattgttcttactattannccagnnnnngtaat

SEQ ID NO: 1083 - DNA, 793 bp, Glycine max
  misc_feature (624)..(624): n is a, c, g, or t
  misc_feature (645)..(646): n is a, c, g, or t
  misc_feature (684)..(684): n is a, c, g, or t
  misc_feature (706)..(713): n is a, c, g, or t
  misc_feature (720)..(722): n is a, c, g, or t
  misc_feature (724)..(725): n is a, c, g, or t
  misc_feature (728)..(736): n is a, c, g, or t
  misc_feature (741)..(743): n is a, c, g, or t
  misc_feature (746)..(749): n is a, c, g, or t
  misc_feature (752)..(753): n is a, c, g, or t
  misc_feature (756)..(756): n is a, c, g, or t
  misc_feature (759)..(767): n is a, c, g, or t
  misc_feature (774)..(775): n is a, c, g, or t
  misc_feature (781)..(783): n is a, c, g, or t
ctttaatcccatattcagtgaacggagtgcggcacatttggctgccgtcagttcttattaccatgacatgtatggtcattcactgaagaaggtatcttgagcattttttatttctttatttaattttattctttcttggaggtacttttctggtgcttattcaatataaatttatcaggcagtaaagaatgaaacatctggggcctttgaacatgcacttttgacaataatccaatgtgctgttaatccaggaaagtattttgcaaaggtattccactacactgcaactgttggtaattgcttcttgtagtgttatgggaacaatttttttgttcaatgacaaaaataagatacttatgctaggcttattcttaaaaaaattaaattgacaaggatgttggaaaagtattttactatataaaataacagtgtgtttgtgttacaaggcagggaactattatgaaaggttttaggcctctttgatttccttctcatttttttatttattttaaaaatagttcactaaaacaatttcacattactcaactatcaatttctcatccaaaatctattaagttctgaaaattgtttccaaaacaagcgtttttaaaaacaaaaaaatanaaacaactgagtgatattttnncattttcttcttctgtttttcatcttaattcaacctcnatttcacactctattttgtgcnnnnnnnnaccctcnnncnnacnnnnnnnnnaaacnnngtnnnnttnnganttnnnnnnnnnaaaaaannctttgnnnaaaaaaaaaa

SEQ ID NO: 1084 - DNA, 526 bp, Glycine max
ctctctctttctcaaattccgattcctttttgtagcatacacaccgtactagcccaactaacaaaccaaacaaaaccgttaccatgggaaaacgtaagctcctcaattcctagggtttccgcgattatcgatccaactcaattgaattttctgtttgtttcattcattaattaattgttttttgtgctgtcatcaggtaattctcaacgtaaaagtgctgcgatgttcgatagtgatgacgatagtagcgtgacttcgtcgtcaactgctcgttctgatttgatgtcggtgtctggggctgaagatgttcaatttgttcaagattccttgctcgaccaagctctcgacgtattagatgagaaaaggtactttggtatagacattattcaaattaaattaacattgaggatggagcttaaggggttttcttatacgttttttttttaaaatttatgaaggggttccacgagggagaaagctttgtcatcgatcattgacgctttcaatagcaacatgcagcatgagt

SEQ ID NO: 1085 - DNA, 360 bp, Glycine max
tctatctctagaaaatgggaacaacaattcttcgttcccacgattgcctccaaggccggttcctccacaacgaagccttcgccatcgccgcatcacgtgtcgcatcgcgaagaaactctaatcctaacaataatagcttcgcctcctccgccaaaccaaaccgctgccggaagcggagtccggtcaccaatcgagaccgccgtcgatctccggcgaaggccaccttgccggcgaatctcgtcatgggacacgttaagatcctgaagcgaggcgagaaattgagcctccagaataataccaaccaaagactcgcggagaacgtttcgatgaagaacgatatgggcctggatttgttattga

SEQ ID NO: 1086 - DNA, 616 bp, Glycine max
tatgaaaaccgaaagggaaaaaaaaggggggggagggagtattattactgtaatcctaaagcaacttgtaaatacacgagtatacattgtcacgaaaattttgacaaactaagctgtttaggcctttcaaggggaagcttctccatctctacagaaacaaaggtaacttcatcattcaactctgccattttgagttgatttagagtccttttggcatagacagtgaaggcaatagtggtaactattgcaataatgaaagaaataatgttgtatacgatttccacagtagtcaagtggtgcttcccatactgtgcgtctgccaatgtctttattaaccgaccactgagagaaggaaaaaaagaaaaaacaaaagaaaagatgttagtttatttaaaagaattaaaaagaaaacaagttcgaagctgagccacatctatatgactatatccatcaaaagtcatatttggttctcaacttctcaattctcattttcatacatgtggtgctaaaaaaaactcgggtacggtagggaactcattaagccatgaaggaccataaatagaaagacaaactaacctgtagatatagatgaaagcttctggtaccattccagcta

SEQ ID NO: 1087 - DNA, 485 bp, Glycine max
catagttgatatctccagcggaacgatgaagtttgaagatttggcagaaggatgcatggcaaaaatactgtcctacaccactcctgcggatgtatgcaggctttctctggtttccaaagcctttcattccgcggctgaagccaacactgtgtgggattgctttctcccctctgatttgtcctctatcatctccctttcttcttccgttcctccctttcactctattaaggatctctatctctatctctccgatcgtcccaccatcatcgatcaaggtacaaaggtaactgagtatcattaacacactgcagttaattaatcaactattgcttcagatcagtgctttgatgaatccaatgaattaattaacgaatgcagagttttcaattggagaagcggactgggaacaagtgttacatgctttccgctagagatctgagcattatatggggtgacactactcattattgggagtggacaaccct

SEQ ID NO: 1088 - DNA, 750 bp, Glycine max
tctccatgctgatagataaataaattaacattattattaatagtgaaggctaagaagagctaataactttgacaaggtataagtctctttatccatgcttacgttcaacttgtatgctattttgtttcctggaccaattctttgctcactgtcaatccaataagaaggaattccacgttcctccgctatctcttgcaggtgtgatgtattgctagagttccatccaccaactactaacattagatccagatcttcctccaccaatttgtacatagcatcttgtctctcctgaaagaaaattcaatatagctgttgattagactgaaagcatacaaaactgaccagtaattatgtcataaataaattatgtatgctgctaacttgtaaccagcctggcataacaagtgttgcaatcacattttaaataatctaaattaagaaagcgtatcaaaggcaacaacggaggtgaaactacctgagtagcatcacaaattgtattgaagctcatgaagtgctcattgatgttctccacaccatatttgcgcatcatagtcctctccagtagtttccctgtgaaatgattggaaaaataaataccaataccacaagtactcataatttagagaggagtgagttaaacacccccgcccaactcccaaaacaaatacaaaccaatctcttctgtctctcccttgagcatcgttgtctgatttgcgatgccagctttaatcagatctctgtctggatcaa

SEQ ID NO: 1089 - DNA, 205 bp, Glycine max
  misc_feature (157)..(166): n is a, c, g, or t
  misc_feature (172)..(201): n is a, c, g, or t
aactccgccaaacgtgcttctcagcttaagttctacctggaagaccctctcaatttcgattcccttgccgtcgttttcaacaagtgagtttgttttcacttttaaggaattctgtatttttttaaggaaaaaaatgtgatcaaggtttttttttttnnnnnnnnnnaattcnnnnnnnnnnnnnnnnnnnnnnnnnnnnnntttt

SEQ ID NO: 1090 - DNA, 446 bp, Glycine max
aaccttgcaagagaagtgaaccattgccaacctgccaggccagaccttgatcatgagaagctaaaggagagcatattgaatgttcattgtatagagcctttacaccatcaaagacctcttcaattcgatttgcagacatgctgccaaaaatttgcggataataataatctaccaacttcatcttgaatcgagggtctaacattgcagcaacagccaaccctaagctacatttctcccaatactcatcaaacttgcttctcaatcttgacgccaaagaactgataaactcatctgaattcttggaccattcaatcaaatgcaacttaacatcacagagctcagggaaatatatatttgcagttggatacttgctcttagtgaaaacattgataacctcaacaaaaagcttcaagtagctggtaactgctgtgactctctcccactct

SEQ ID NO: 1091 - DNA, 366 bp, Glycine max
tggggtggttcagctcgtctacaacaatcagttccaaccagaaaagcatattggtgagaccctgaaaatacttcagagtctttgagacattctgattcttttgttggctatcttagctggcctgattcagagtcagacaagtatgtaactatgaattgtaagtttgtaaccactgtaattatgtagctgattttggagcctttgatcacattcacatgggggtgatgatatgtattctcctatagagagcaaacatttataacctctccggatggaataatgccttcatttgccacaaatacaatcagattatatctgtatcttttgcacattgtaagtttagcttcaattgacaaagtgaccatc

SEQ ID NO: 1092 - DNA, 1018 bp, Glycine max
actctttttctttaattcttcccacaaacatgtcacgcgccgccgcgtcgttcggaatcctcctttgtctgctgctcctcgtcgccgtcgtcaactgctccgatcagggaaactgcagcaccacatgcattgtggagcaatgcgacagtaagattaatctatcaattagtttaattagttgagttgatgcaaagattgatttaattaatttgggtatgtttgataaaatcagcgatcggaatcaaatacggcaagtattgcggggtagggtattggggttgtgctggcgagaaaccatgtgatgatcttgatgcttgctgcatggcccatgacaactgcgttgacaaattcggtatttcccgcactttcctatttgtccaaacccattttacacatcaaatttatttatttctattttctaattgctggtgtcatctattgaattctctggtgcttgttcgtgtttatgtcttaagtcttttgatgagtgcatggttttaaatttggtcacggttgcggtcgcgttaggatgagtcagaaaatctttatattgcggacaatttcgaaaaaaatgcaactaatgcgattacggagtgtcaaaatatcttgatgcagacaatttaaaaccatatgaatgcattatcaggaacaccaatcctacggtgacctctctaaatttcttttactctttggttcattttgtgttgatcatgaattgaatcaattctgtaaaattgattcaattgggaaaccaacttttggtgtgtactgagaatgcttaagaaagcttgttgggtatatttcattcttccgaaactttaattattatgtcaagaaatctatgattgaaaaggccattcagtcataattactaatttctacatttttctattagcttgttttgtttctcttcagaagattgcttaatttagactaaccaaatttggttttacgtacaggaatgactcatgtgaaatgccataagagattaaagaattgcctaaccagggaactgaaa

SEQ ID NO: 1093 - DNA, 450 bp, Glycine max
ctccacccttatgctcccatatattcaaatcgtgagaggcttttgatctatgtctctgatgttgctttgttttctgtgacttactctctctaccgtgttgcaactatgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatggaattctgaacaaggtgtttcatcacataactgatactcatgtggctcaccatcttttctctacaatgccacattaccatgcaacggaggcaaccaatgcaatcaagccaatattgggtgagtactaccaatttgatgacacaccattttacaaggcactgtggagagaagag

SEQ ID NO: 1094 - DNA, 619 bp, Glycine max
atctatgattagaagggtatctcactggcaaggctgcagatccttctgtttctgcagcatggttcctattttcttcttcctcattattcaatacctgataagctgtggggtttggctcatatacctgtacattcaaattgaaggtaactttcttcttcttgcttttaacactattctgctccttaacttcatctcttcctctgaaaaataaaataaatataaataaataaataacctatcttatctacacattcacataacacatcaaggtaaacgaagagagagtaataaatactaacctgaaatcagaatcagggatagtgaatttttcggttatggcaagagcttcataatttccatatttctgctagataatacaattatctttttaagttttaattgataagtggcaatctagatcaagtatgaacatctttttatacaaatattacaaattaagaacaaaggaatggggtgtgtacttacttggtgtccagctaggactttgtagatagtctttctacgctttcttttgttggatagaccaaaacatgccatgaaacaacccatgtctattgggaagaggaagaggataagggggaggaatgttgttgataag

SEQ ID NO: 1095 - DNA, 674 bp, Glycine max
aaccttaggatttttatttttataagataaatttgatttgatgtcacgtattttgtaggccatgtcttgcctttgaagcaatgctgtgaatgattatttgattttgagttactctatgttaattgttttttgaaaataaaataaaaatgcaggacttgctaaagttgccaaagaggaacatgctagggacctacctctcatgaatggtatcaaagaagtcataaaatctgttggagttttggactctggcagccctgattaccatgaggctttgtgcagcctttctactcgcctcaagtcattgcaggtatgttcagttcctataaacaattaacattcctttttctcatgctctaaattgggattttttagtttctatctgattaaaacccgttgagaaataagaaatcaagcctgaaacgtggaagctataactattagtgtatctggaaacagatttcagaagtgatatagtattttcattgtcaatttgagatctggatgtgtgcattatttttttttattgggggcttgcttttgttgttaatttgtttttaggggcaatgcaaacaacattttgcagaagaggaggtggaattacttccactaatgaaggcattggagttgagcaaagagcaagaagtgagtgcacttgagcagtgttttgaagtgat

SEQ ID NO: 1096 - DNA, 321 bp, Glycine max
gcggaggtccttgacgtggatcagaggggagaggatgttctggcagaacttgtcgtagatgaggatcttgtagacctcttcgttcgcggttccggcggcgtttaagggctggttcaggttcagcatgcgcgcgatgcattctgaaatgcagagatcattagttagttagtgtaaatatgcaaaacgacggtgcgttttgggaaatgcagagagagagagagagatcggagttgagtattacctgtttgcttctgacggagattcagagacatgatggctgttgtattgttggaggagcgatgaattgggattgtgatgacg

SEQ ID NO: 1097 - DNA, 762 bp, Glycine max
ctctgctcaccgtaacgaactcatttctctcctctccaggtaattctgcttcttcatcaactccatttttttctttattaattcataattaatattgttttcttcatatttgatgcacatgctcatgtgtatctatctctgtttcaccatgtctttctatgagtgtgttggtgaatgaatacctgttgtcttgtttgaaggtatgtggctcaggggaaagggattttgcaaccccataatttgattgatgaacttgacaacatccctggtgatgatgaagcaatagtggatcttaaaaacggtccctttggtgaaattgtcaagtctgcaaaggtcacttgccctaccataactgcggtttagtttatttatttattttttatcgacaaatgttagtctcttagttttattaaaaatttcagtcggagattcaaacaggtgacttctctcctatcctttcttctttcacccttcccaaaccaaccactggccaaccttatacctcctaacttcggtttagttagtgtttggtaaattctcatgtaggtcccatttttagaaagtgtgtccagtttatttatctgatttttaaaaaaataatcgaatagtttgttacttgtctacgtgattaattgaaaattttcatccaactttagccttattgtaactgtcatattctggaaaattacttcacaatcacattagaagatttaagatatgatatgaaaatgtgtagcattatttttgtgacaggaagccata

SEQ ID NO: 1098 - DNA, 819 bp, Glycine max
  misc_feature (762)..(767): n is a, c, g, or t
actataatgtcgaggggatctgatggatcacaaaaaaagcgtttagttgctgcgatctgcgttgtggcaatttttcttggttttctgtatgtgtatggcggatccatctttggttctcagaatagtggttcatctgctcttgaatatggcagatcattgaaaagacttggctcgtcatatttgggtgcagaggatgacactgatggcaagcaagatgaatcttcatcaagtttcagacagggagatggggaggataatattgttcctaagagtttccctgtatgttgctttgttagcttagacatacggcatgttcactatttcttcatggtttcttgcaacatccttttaattgctataatctttaatatttcatttctgctattgctatttggtttaattagttgtattaataataatgaactctcttatatgctgtttgatttgaatacaggttgccaaactcttatgttcaagtatattagtttggtaaataatacacattacatatgagttaaataagatgcttaaaatggattataaatgggaaagtaaacgttgaagaaaactaattccttatccacatccacagtaatatcctaatcaagcaacatgattcttgtttgcacaatgaaaataaacttcatagtttcatagatgaataagtgggcacaatcaagttcatgggcatcatctaaatatgactatacttttggctcatcagcagtctcatggtgtttgcaatgtttatgtttttgaagnnnnnngatgatcgtcattcagagttgattccctgcttagatagacaccttatctatc

SEQ ID NO: 1099 - DNA, 653 bp, Glycine max
  misc_feature (609)..(614): n is a, c, g, or t
aataaaatcctggctttgacggatggtggagatggatcgtgcttgagttcaacctccctcagccgaagttcaaggcccttaccccctccatttgccaatggatgaattccatgaactggccctgtcatatattctctcgcttttctttcttcctcatagtctatccccatgcgctctgcagaacctacatgcatggcatgtgtagcaaacacgcaaaggaacaaactcataattaaaacttgtcatcttccgatagtattctagctagtaaccctatactaggtctgtgcaaaaattggagtttttaaaaatccgaaacactttatttcaatctactttaaaaagtggtttgattaaccgaaacactaaataaagtagttttttttttcttcaaaaaagtttagtttttttaggtttggtttggtacgatttgattgaattgagttatccattttttaactatatatgaatcagattttctaaagaactgaatcgaattggacattgaaccaaatacatagaaagtagaagaatagacatactttggaggaggtgatcatagatctggccatctctagtgagagccatcatgagctgaggtatcccaannnnnnagagagtgacccttatcgacctgccagaaatgaaagact

SEQ ID NO: 1100 - DNA, 812 bp, Glycine max
tctgagagacaggagacatggtttgctgatgactctccccttatcgaggacaaggtatatgctcaatttagatttccgttgtcttaggatatagataagtagtttggaaccactacctgtctattgccttgaataatcttaattgacatgtactcgattttgttaatttacaagaaaaaattaataatacttaattaggtgtcatgtggagattaatagagaccatgatggtccaaaccatcttggagattaagacaacattgttagatttaagaaattataaggggaataaggggtaatgctccattatatttgtttagactcaactcttacaaaagactaatttgttttcttttgactgcaaactcaagtttgattagtccaatacgactttaatgccttggatgaaatattcataattcataattcattactcaagcttcatgccttcccccctattctgtttattggtctcagaaaataataatctattacgatgcagccaattgcagttgctgttggagactggtattttgatcgagaagttgtcaaagctattgactgtgcttacccatgtgacaacagctgccataatctggtgtttaactttaagtgaacaaaatttgttgtctcctcattacactttaatccttgtaattgcaatgagtattcaacaatcaacattcattaattattatggaaggacaattcttggttatcatcattttcactgatattaagttatgtcaataagattcattagtagtcatttatctactcttggttataaatatccaaaaatggacaatgaa

SEQ ID NO: 1101 - DNA, 377 bp, Glycine max
taatgcaggtaagagagatctatactgtaagttttgctgaccacttccagagttgttgaacatggctgcctgacaagttctttagggtcaattaaccgagaaaacacatggggtaatattctttccatgtaaccctcaaagggctttcggcatgctggaacaatatctgcaagtgttgaaagagcagcctgtgcaactttatgatggggatcatccaagtgctggaaaaacaacttcattaccttctcaaaattctgaacaacttctagagttcccttcggaccttgctgcaacaaagaatgaagataattaaaggcagcaaccctagcagaccaattggaacctgaactaagtccttcactcaaagcttcatgaaa

SEQ ID NO: 1102 - DNA, 658 bp, Glycine max
tttccttttctcttccccctatagaacccaattttgctcttgaaatacatgctctaatttaattactgttatatataattaattgattcatcttgttaactatgtgccgcgatgatttttattttatccatcatatattatatttgctctttctttaaatttgggattactaaaacttataagcaaaatgttttgttgggatattagcatgtataacccaatcaaattaagatctgtttgaagattttgaattagattggtcttagttatgtagcaagacttttgtatggctatgcagcattggtgttgtttctgggaaggcaatatttggacccccacttgatgagtattggaaaaagaagcaacaggaagaggcagctgctgcttctaaggagaatgactctacctcaacttagttcacaacacaatcatcatattttttctctttttctttggactttttagacgagaattgaaagaccacatttgaatttaatcttggacgggtcactgcactagcttttgctagcaatggtttttgaagcagagtgaagtctttactgttctagtatagggggttagttttggttctcttcccctgtcttttaaatcgagctagatttgtagaaaattcactgtacaaccgatttgttgccta

SEQ ID NO: 1103 - DNA, 409 bp, Glycine max
ctgagatgacgaagctgaacattgtaagacaatgaaggcttgtcaaacccatgggaacctccggtcacctcattcatatgcagaggatgatgacagctcagtctgtgctcttgaagcagattgtgaaggaatagtagactgtataaagaaatctgttgcttctaatccagctaaggtgaagtaagataagtggcccaatacatagtacattcatttaataagattgtaggcagggaataatgattggaggtagtaaatagttgaaatttggaaaaggttgctctccggtgtaattgtctttatagaaagtaaaggtgtattcacccttaaattttctaagatcaagatcatgaaatatcttatagtgacaaccttctgttaggttaaatgttcataccacactctgagg

SEQ ID NO: 1104 - DNA, 396 bp, Glycine max
  misc_feature (367)..(371): n is a, c, g, or t
gtggctcttgagctctattttgaggagatgatccatgaaggcggtggccatcttgggtggtctggagggcatggtgacgcggtgaggaaaatcggggatgacgaaagggcccgtgtcggaatggagttcggggtgtgatatgacgcacttcatggcggcgccggagaagagggggtatccgttgaaggcaagtcgtgggatgcggaggttgttggccacgtcatccgcccaggaatacatggtgtcggcgacgatgcaatcaggtgggtgctggtccatgaaatgggagatgggtctgcggaggagcatggcggcttggtagaactttgcagtgtcagcgaggtcggtgacagcggacttgatttcnnnnnggataccccctcttctccggcgccg

SEQ ID NO: 1105 - DNA, 330 bp, Glycine max
ccagagttggatttaatgctagttatcgttttcattgtcatggtctccgtagttaacaagttttatcagcatgttacattattactccattctactttaggttgttgacgaattgagttattctgtcatccgttgaaattgtgttgagagaataaccaaatcgtttgacaatctggtggaggggagatatcaatttggaaacgaaaattgtactttgattaggttgttggtgatgttcttttaccattcttcctccttctgtaaatattacatctgatgaaacgtttagcagtttgtgaatacaggttgctacctgtaatgtaaggtctg

SEQ ID NO: 1106 - DNA, 493 bp, Glycine max
gaaattacgaaaacgaagaaaccaaacaatagtagcttagttaattgaattgaatgaatctcaatggaacctcttctcttcaacgactccacattctcttcagctaacccttctttgtctgagatttggccctctcatttcccctccgatcacactcccaggaagaggcgcctctccccctcggttcgttcctttctctcttcacttccatttcctagtttttaatctctcaattctctcaccctctgttctgtttgagaattgaacagagtgattctgccagcaataaacatatcaagttatcagcaccagaatcccaggatcaaaacggtgcgttgaaggttggtgaagtagacgcgacttccgtggccggtaacaagctacctcaacaaaccccgaaacctagttcttcggagcaggcacctaagcaagactatatacacgtgcgagccagaagaggccaagccaccgataaccacagtctggctgagag

SEQ ID NO: 1107 - DNA, 388 bp, Glycine max
accaataccctcaccgataccctaatgatccatacgaacaacaaactagctactccactcaggtcgtcaaggcggccaccgccgtcaccgcgggcggctccctcttgatcctcgcctcgttgatccttgccggcaccatcatcgccctcaccatcgtcacaccaccgctcgtcatcttcagtccggttctcgtccccgcggtgatcaccgtcgcgctgctgagcctggggttccttgcctccggcgggttcggtgtggcggcgatcacggtgctggcgtggatctacaggtacgtcaccgggaagtacccacctggcgcggatcagttggacagcgcgcctcacaagatcatggacaaggcgcgtgagatcaaggactatggacagca

SEQ ID NO: 1108 - DNA, 385 bp, Glycine max
aactgagaaagaggctaccaacagacaccacctattttatgcctttcttcttcttctctcgacaatggtggataaaccaatgagcattcatcgaacccggttcccattctcgatcaccaagctcctcttctggtcgcttatcctactcagcttcattgtgctcttcttcttgggatctcccccgtcctccgcttccccttcccaccgccggcgctccctccgcggcggcgactgggagacctccgttcgcgaatccgccaagtccaaatccctccgcgtcctggtgaccggcgcagccggtttcgtggggacacacgtgtccatcgctctgaagcggcggggagacggcgtggtcggaatcgacaacttcaaccgctactacgag

SEQ ID NO: 1109 - DNA, 685 bp, Glycine max
  misc_feature (622)..(625): n is a, c, g, or t
  misc_feature (627)..(627): n is a, c, g, or t
agcatcgaaaacttgtttatctaaagctctggcatgcctcccaagaaattaaaacaaacatcaataattttttttaaaaaaaaaaacttaaattgcaaacaaatctagagaaattgaaacagattctatgtggcactcactgaatggcttcatgggttttctgcaattcgctcactgcatccttgggctgcatctgatggaaaaaaagcaaagagatttcaaaaaaccaaagcaaaaaataaaaaataaaaaattgaaacacttcgtgaaaaacaaaataggaaaataaagcaaacattaccttcttggttgcacaatcccctgaaatcacttgtagctgttgttggtcccgctgatgctgcgcagtaagcaacccgtttgattccggggggtcccacatcctgcacccaaaaaaaaattcccaggatcggaccacaatgttttaaattctctcaaaatcaaaacccataaacccaagtttccaacttcacagctcaaaaaaaaaaaacacaatagttgaagaagttaagatatagaggagagagagagacctgcttgtgacgagcataccaataatgaaggaaaagacagagaaaattggaatccacgttgcagagatttnnnnanaggtacgagtcttcatgtttgtggtggaggattggaagatgaaggtgtgcgtgaaaag

SEQ ID NO: 1110 - DNA, 1257 bp, Glycine max
  misc_feature (1122)..(1126): n is a, c, g, or t
  misc_feature (1183)..(1208): n is a, c, g, or t
  misc_feature (1217)..(1245): n is a, c, g, or t
  misc_feature (1248)..(1250): n is a, c, g, or t
attattacctcaaaccttttttccattttgaataaagaaaaatcataagacttgtgtacatccttagattattatttcttgtttatcactagtttttgaggatttcattttgggggtatttgcatgatattctcacactcaacaaaaagcaccggagatttttgctgtatcattgtttatttttgttggatctcttgtattgtctttgattttgttccactgactagttgcttggcctgtttaatgctttgtattcatgcccacaaactccttaaattctctaacttattgttttcttcctttttatgtctttgcttgatattaggtaatccccctcttgttttgtaactataatattttagtccaaattccaaaattatcacagattattatacaaagtatctatgtttgagaccaagaggggaaagagcactgtatgattggcaactgtcacgtttcccccatttctgttgtgatttttgcaataaatttattcacaaagttgttttcttaataaatatgtgtaattttctatctatgcttcagtgcacatctggagtggaaccttgatggtcttctggagaaaatttgggaatatctcaacttaactcgtatttatactaaacctaaagggatgaatcctgattatgaagaccctgtaatattatcctctaagaagaggacagttgaggacttctgcgatcgcattcacaaggacatgcttaaacagtttaagtagtgagcacttctcttaaaacatatctttagctttattgcttgataatgttagtgatttctccattgtgcgttaatgaggagcaatgaatatgaagattaacttggcttttcaactattaagtctgaattctagttagctttattaggaagcctttcatttgtatatatgaagcactcgttttggctattatctcttgtttctgtggcccgtactcacctgaatgaactttataaacatataaaatggatctttagtttgatgaatgaactagtttgaggggtgtcattttgttctttgagaaaaaagttgagtaaaaaaatctcacccctcggtcctccataaaaaatgtttttctttcctgacattcatttaattcacatttnnnnnaatgatgcagtgctttggtctggggttcaagtgcaaaacacaagcctcaaagagttnnnnnnnnnnnnnnnnnnnnnnnnnnctttatttnnnnnnnnnnnnnnnnnnnnnnnnnnnnntcnnnttttatt

SEQ ID NO: 1111 - DNA, 755 bp, Glycine max
gatggaaatatggccaaagtagtcgagggtcatcgcaggtaatgcttttgtctaatagaaatgttatttgtgatttactctccctgctccctcatacactctgattaaaaattctttgaatattaatttgtttctaccagtaaacttgttttggtatgcatcttttggctaatagaagattttttttgtgcacaacaaatctagaacactttcctaattaaacaaatttttatccacttctgatggatgatcgggctgtttttgataagagatgaggtgccaacttagaaattgcagtttctaccatagtttgatttaaacacaattctactttgatttttttccctccattgttatgaattttaagtacttaagcacctattgagttgacatgtgtcatccaattctactacagatatcttgggttcaagaagacgattttattgaacagaaagctcctagttgatttgatagatcgataccatgatggaatattgaactgggacgaattctcttcggctgtgaaggaagttcatgctgatcgcatgggtggtgcaactaagagattggtgatccctgacaggcccaaagaagaggattatttctatgccaatccagaggaatgttttgaactatcagatgttatgttgagtagtacgtgagtgatgcatttggaaataagagaatttacttgtgccctctcctagtgcgtgcacttggtcttctaccacagatacttaagataggtctctacg

SEQ ID NO: 1112 - DNA, 363 bp, Glycine max
agatagaagctgatgagatggcagatgttcgggatgatttgtctgagaaaatgcttgttactgagactgaagttgagtctgtgggtaatggtgatgatgataaaaaggaggaggctttggatgctggagctgagtgcgaggaggaaacaaagaagggtgcggatgtggataagcaggacaaggacaagaacaagggtgtagatctaggaaccggcgcggatgttgtcaaacctgagttaaatgatggagtatcaacaggaaatgaagttccaaaggaagtggatagagaaatgatgatggagagtgcggtcaatattgcaaaggataaaggcaaaggtgtctctgttgcacttgtaccaccta

SEQ ID NO: 1113 - DNA, 387 bp, Glycine max
ctcacatgatgtgagattcctccttcaccatgtccaagtgaaagatgcacttgagcacgtaaagtaaagacaaactagtggcagtcagcagtgacacacaccaaagaagtagaaatgcaatggaaggcatcaagttgaatccatgccagagactttgtgagtccttgttgtgtttactcaaactcttccagagcaaagcttgtgctccaaaggaaaggcatatgaaaaagtaaccagcatggagcctggtcaagattggtaattgtgatggctaggagatgtcgatggcgagggtgagggtgtgtgcgctattattattgttcttggtcatgcatacaactacttctactgatggtgaggtctcgatgtcacccatcccaatcataa

SEQ ID NO: 1114 - DNA, 393 bp, Glycine max
atcttgcggtcgctgcaatcgacgacgttggcgggggcttgcgtgttaacgagaacgatgcttttgcagagatggtggattgaggcggcggagagggcgtcgcgacgggcttcgaggggccagtcgtagtaatcggaagggactctcttgaaggagaaatcgggaacgccgttgctgcgcagaatggaggagaggcgagccacggtgtccgtggcagtgtcttcgacggtgtcgttttgggaagagggtgatggaagatgcgaacgctccagtttcgatatgcgttgcaggagctgggtttggactcgctccagttccgcaagggcttcctccattctcattcgcgctgggtgttctgcaatcactcgctcctgcttcaacaatggtcagttt

SEQ ID NO: 1115 - DNA, 454 bp, Glycine max
aagaaacaccaaaaaaaataccaacaagtattgctattacaacctacaatgacagttttatttttttgaatcggcgaaataaatgatatataactaataaatggtacaggggtaccaaaaacccttttacatcagattcaatagcgaagcatatgcctgcaacaaccccacatggttataatgtatttatattccaagaagccaatacaaaataaagtataaccttaactacccccactttatacccctgcaaaatagccctacaatgacaggttaacccttgtgcacagtacacaagtttttcaaacttatgcaccatttgattctccttccttcaaggaatttaatttttcctcgcagactatcttcttggctgtgtccttatgagaaccgccatccttcaaggaattcaaaatttccttgcagactatcttcttggctgtgtccttatgag

SEQ ID NO: 1116 - DNA, 833 bp, Glycine max
  misc_feature (820)..(820): n is a, c, g, or t
  misc_feature (826)..(830): n is a, c, g, or t
catgcaaaaaaaaagactcaactccaagggatatagttgtttgtgacgtgagacaaggattcacattcaatgtgcctcataaagtgtaatctagctaaaacaaattgtgacgtgagacaaggattcacattcaacgtgcctcagaaagtgtaatctagctaaaacaaacacaaccttagtagatggagataactagtaaaatgccattatgtcattttatgtcatatcatatgcaacccatatatataataaagtttaaaaaaaaaatattcactacctagcaacagcaatgacaatggccccacatgcttttccaatttgcacagcagcaagtcccacacctccagctgcacccaaaaccaacaacacctacaacacaattccacaacccacttaaccacacaaaaagacagaacaataagcattaccaattaccatacaaccatgcatattgtgggacttaatagatacatacacacatacctgaccggagctcaattgggccctatgaacaagtgccacgtgagaagtgccaaacgccacagcaagtgctccagcagcaacaagatcacaaccttgaggcactcgaaaccttaaaaagacaacaactttacattaagaaattctaaaaaaaccaacattaaaaggtagtagcaggagcaaacggaatctcacaactgggactggtcaacgacgatgaactgagcgaaggagccgagggcggcgaaggagcaaacggcgtctccgactcggaagttggaaactttggggccaacagcgtcgacgaaaccggaaaagtcggagcccgggatgaagggcnaagagnnnnnctc

SEQ ID NO: 1117 - DNA, 387 bp, Glycine max
ttctgaggactcatacagcagcaacagcgtccatggccttaagaaaaacttcaaagttcagagcttcacaccatccacaccacccccaacatcggttaattacagaacggccaagagaagaaagggaataccacaccgtgccccaatggttggactaatcatagaatattagatagttggtatttttaggttattggctacaatgcccttaggtataaaaataccatagtatactaaagcaagtgtttcgacgtcgtttcatcaaagtccaatactcgagctttcctagggccggtatttggaagtgtcaccgtccgtctttttatttttcttcttgtagtggtttctagcgttttgtatatatagcaaagtccaacagaactggaa

SEQ ID NO: 1118 - DNA, 1013 bp, Glycine max
  misc_feature (44)..(45): n is a, c, g, or t
  misc_feature (990)..(991): n is a, c, g, or t
acattcaacaaataaaagcaatgattagaaaactaaagaaatgnncaagttgaagacaaactataactcaaagcaaaggaaagcaaagcgacagaaatcacagaattatcacagaattagcattggttgatatggagtagaatgaagcaaaaaataactagctttacatttcctaacaggccaggtgagaactaaacatctctagagatcaaatttaagatttagtttatacaattatcatatagcaaattaatataatttcatctcctagaccaaaaacagctgaaccatgacaataatatagctttatgagtttcaaggatttaagaaagtaactcacccaacaatcagtaaaatggcagagacaatccatagaacatattggtaagccttgtatttggacttgaggtgaacaccagcatggagacgttgttgttctaaccacccaaattgaggacggagcagcaaaataaacccaaggagaaatcctgagaggaatcccccaatatgcgcaaagttatcaacatgtggcaacattccaatggcaagattgatgacaataataaacagaagtgtgaacaaagcagctgcctgcaaaatgcagatgaagagtgttagaaacttagaaatgaatgtcaaatatactatataagtatcatccatatgcaagtcatttaacctagttgatggaaagaataaaaaaagaaaagaaaagactcaaaagaccaaaagtgttttttcaaatcagcacaattagttcatgcaaattgataagaatattataattaactaaccaggatgttttgtaaattcagttttagtaattggacaagaaaaaaatcaacagtttatgatgatgcattcaagaatttgtcaatcttttcataacattaatcattttccttttcaaaagaactaacaaacacacagaaaacaaaaataggatgggaaccaatgactttatactcaccttattggtataaatactcnnagtttgtgataagttctgaaag

SEQ ID NO: 1119 - DNA, 677 bp, Glycine max
tttgtgcagcatggccatggtaggcggaaccatgatggctgcgtatttgcgtgtatccatgcccacttccccacagtcccccaccactacgaggaggagatgcagaaatctgaaaacttcttgctccgttaacagacccaaaattccaatgccccctctcaaccctaaagacccctttctctccaagctcgcttccgtcgctgcttcttcccctgaaacgctcctcaacactccgaaaaactccgacacccttccttatctcgacatcttcgactcccccaaactcatggcaactcccgctcaagtaattatatattttctcacttatggctcagtatttgatttgtgctaggatttctggtaacataacatgctacttagtacttacttcctggtacaaattataaattagaatttagtgtcccagcttctgtgcttagtatttttgaattaaacatgtgctgaaagagattggatggcctgttttttctggctgagtgacctatatagtgtatactatttgtaatttgtatttcctgtagtcatgcttatatgttggggtaactcaattaattgtgtggttgaattaggttgaaaggtctgtttcatacaacgaacaccggcccagaaggccgccacctgacctgccttcgctgcttctccatggtagaattgtt

SEQ ID NO: 1120 - DNA, 733 bp, Glycine max
  misc_feature (147)..(149): n is a, c, g, or t
  misc_feature (577)..(579): n is a, c, g, or t
ggacatagttgatgtgggtggggtcaattagttatgcaaatttagttggtttattgattctttattcttttggagaagccagcatcatcctaggaggaataatcaatcaccaaggggtagttggatgacatggacatggtgttattnnnacaaatggacatagttgatgtggggtcaattagttctgcaaatttagttggtttattgattttttattcttttggagaaggcagcatcatcctaggaggaataaataatcaccaaggggtagttggatgacatggacatgggtgttatgcaatggagttgcttcaaaatgacatggacaaggtggcaccactgatgctatcaagttaagtcgcttacaatgacaaaagtgtatgaaaagaaaggaaagataaaaagaaaaaactcactgcaagaacctaatttggttataggcatgatggcagtttttattttttattcttcaccttcatttttagcatttgcttttatttcataaacttatattagagattagagaatcacatatccttcaagctttgtatatttcagcaggaaggtcctattgtannnaactcagtttggttataggcatgatggcagtttttattttttattcttcaccttcactttttacacttgcttttatttcataaacttatattagagattagagaatcacatatccttcaagctttgtatatttcagcaggaaggtcctaatgta

SEQ ID NO: 1121 - DNA, 190 bp, Glycine max
ctcgcggatgctccctctcctcgctctccacaccttcagcgagtattaccgctccgaccacaaacctccggtcaccgccgccctcatcgccgccaacaccctcatctacctccgcccctccttcctcgatcccctcattccccccatcgaacaagtctggttcaaccctcacctcatcctcaaggtcact

SEQ ID NO: 1122 - DNA, 355 bp, Glycine max
aacatctcatactaaattaaatgcattgctcaagtttaatggcaagatcagaattaaagtttgccgaaagaaaaaccactttgtaacataaaacggtaataaaacagaacttattgagttggtccaagaccattattttagctgagtgttcgttccttcttctggggatttggggaaaacaactaggggaagggggtatcttatacaatttgaaacacttgcaaggggaagctaggtcatgtacatcccacagcagggtcaagaacactttcgtttattgcttcttcagtggtcttaaacggatacagagttagagattttgaagtccagatcccaaagctcaaatgtgccctta

SEQ ID NO: 1123 - DNA, 411 bp, Glycine max
ctactaatataaactgactggagctggttattgtttagctgtgtaagcagagttgtgtccataaacttagtcctgtatggagagaaacatgcgcgttccttgctttctaagttttgtcattgactacatcaggacagtgtccccgattcattagtatgcatgcagatatatgaaggggtataggccttgggaaggaaaagaaggattttgctcctctaaataagggaggaaaaatttgagaaaatcacattccttgttgtttgtttccttcttttggaatttaactatgtaggggctctaagctgattttgagagtgttgttaaatatctgctatagtggtattgcattgcagaattccttggatctgtaattgagactccgtccactactgcaactgctatgggtcttgt

SEQ ID NO: 1124 - DNA, 377 bp, Glycine max
agagagggtggttgatgtaaatcacaggcactacgaacctttgttgctcttctccttgaccaaccttaattgccatgcacccttttgggacccctctgaactcttgttgcttattcttcccttcacgatgatggtgatggtgcagattgaaactcttgcttggactcttctctccaatacccattttttttctgccaccaagaaagaaagaaagacaaaaggaaacaagaaaaaaggaggactttcgtatgtgtgtttgaaaggaagaaaaaggtcacaggaaaacgaagatgagaaaaaaggaccaaggttctgagcctgttgttgccatgtaggaacgggttagggaagagtaactcggagaccttagattgttg

SEQ ID NO: 1125 - DNA, 463 bp, Glycine max
  misc_feature (442)..(444): n is a, c, g, or t
  misc_feature (446)..(446): n is a, c, g, or t
tgttcccaagtccttggatagaaacttgaagagtaagaagagtgacaataacattgcactcccaacaaagggaaaacgcatggcatgttcattggacattgtctcctgcaaaatcgttagcaacatatcaacaatacgattcacagaaatcatatcttgaaccatgaaaaacacagcgcaaagaataggataagcaggatcactacttacagttggtggggttggtttaacggagcggtaacagcccacaaacacagtgagggaagcagtcaaaataacatttaaattcggatctactttcacaacaagaggcgctaaggttaaacctgtgattacaaataaaatgccatcaacattgagaaacaaaaaccccccctctcactcatacactgacattattaaacaatgcataaccaccaaaatccgatacaccttagtattnnngnatcaaatttcaaaaaac

SEQ ID NO: 1126 - DNA, 750 bp, Glycine max
gtatcataaaaaaacgagagaaagccatggagaatggtgaaacctctaatgaagatttattaagcatacttttggaatcaaatcacaaggaaatccagggacatggaaacagtagggctgttggaatgaccaagcaagaagtaattgaggaatgcaagctattttacctggcagggcaagagaccacttcatctctgctggtttggacaatggtcttattggctaggtatccagaatggcaagcacgagcaagggacgaagtttttcaagtttttggaaaccaaaatccaaacattgatgggttaagtaagcttaaaattgtacgtatcacatgcttttatttgactattattaatgattataataggttaattaaattaattgtaggttgttgaactatttaattttatttatttatttaggtctccaaattataaacaaaaagtaaaattgtaactgagtatttgattttataaaatatttgtatccgagttccttaggttcttaaaacctctacaaattgtcattttttgacagtttcaagctgacatttaaattattttcagggactcaattataaaattttatataattaaggaaccattatatgtcagctaactttaaaatattttaaagattaatttaatctcatcttaaatctttggtgctaactttttccatacccgtttcttccacaggtgaccatgattttatacgaggttctcaggctatatcctccaacaactttct

SEQ ID NO: 1127 - DNA, 511 bp, Glycine max
cttcaattcgtcttttctctacccttagattttgccaggtgaggaaagactgtcagaatgttttgggcaagtagatcttgcctggtcaagatcccaattactggggatatctgtgaggagatggcatcatttggtcagttatatatggtaattttaaaaaagaaattaagatcagcaatgaatttattttgctcctgaaatgctacaagaaaaaatggcaacatatctaattcatgtttcaatggtgttaatattaatgtgcttaataaactcaccccagaggcttgatacttgggtactacgagcagatgtcgaagtccaacttgcctgaagagggtcattgcttttgctactgacatgctctctagcactgtaaagggagttgtattggtaagaggatgtagatcaacaaacatttccatttcctcactggtcacagccacctcttcaatacttccttctctctcagccagctctacccaggtaaatttctctctcacttcccattcct

SEQ ID NO: 1128 - DNA, 471 bp, Glycine max
  misc_feature (398)..(401): n is a, c, g, or t
  misc_feature (414)..(417): n is a, c, g, or t
catcacaccaagatgctgctcggaaagagacctcgtcctccaatgaagagaaccacaagcatgtccgaaatgaccttggatctgaacaccgccgccgccgccgatgccgccgccaaccaacagagatcaggtgttggtcccggtgctgcagcagatcagactacgagggtgttggcaacacccaaaatcctcagaagacattcttcggatttcggagacacgcctcccttccttcgcgcctgctccctctgcaaacgttgtctggtgcccggtcacgacatctacatgtacaggtaccagtaccaccaataacacagttctgtattttgttaagtcatagaactcacgtaaataagtgttataatttttttttttttttaaaaaaaaaaatccgtttnnnngcacggactcggnnnncttttatttttttaggggatttgattaaaatttgaatgatttttttttccaggg

SEQ ID NO: 1129 - DNA, 483 bp, Glycine max
caccccattcccattcccaatccacctctttctcttttcttcgcaaaacgccccattctcaacccatcaatttcagtctctcttcctttcactttccacgcctatcccttatcacaaccaaacaaacccttaacctcactcccacacattcctccacttccgaacaacaaaccgaggagcctcttgtctctgaagaagaattttctcgcaccaggttgctcgctcagaacgtgccctggacaagcacccctgaagacattcgcaccctcttcgaaaaacatgggaaagtcctcgaagtcgaggtttcttttttcttccttctcttcttttcggttctgttcatttttaaagcttccgttttctgactagtgtttttaaaattgttgttgccgttaagctttctatgtataagaaaaacagaaaccggggtttggcctttgtcgaaatgggttccccagaagaggcactggaagctcctcaata

SEQ ID NO: 1130 - DNA, 277 bp, Glycine max
agatgcacatacactatagacgtgcttcatgatgaaatgtttgtcattttgagcagattgatgcggccgaaatgatagaagaggaggaagttgtagagcaaaagtatgtttaactgtcttcaatactactgtgtttcgttttcgtgtgttctattctcccatgtgtactaaaaatacccccatccctcgatgtcttttcatccctctacaggatacttaacgagaaagtggaaatgttgaagaagaggagattggagcttgcagctgctaatgctgc

SEQ ID NO: 1131 - DNA, 964 bp, Glycine max
  misc_feature (919)..(927): n is a, c, g, or t
  misc_feature (938)..(943): n is a, c, g, or t
tattgtaagagccacaaaatccacatttgtggtacaaccagtggaagcgtgaagtgcccttccgatcacagtcatggcagagtatgtcctgcattgccattacaaaacaggcttaacaaacattgatcttacaaattctttgctggtcaactaaaatgtcaaaattctctctttcataaggaatgaagtgaagagtcatgtaagagatcgacacaaaaagtactcacctgacaccggtccttgtactcttcaggaagttcctcagcagccaatagggcatcaagcataccaaagtaaacctgggtaggtacagaaaaaactaagaatagtatgtcgggtacctcttcaagctttcaattgatttgacatgaataatctaattatatccctcatcttttcaatgaatttctttatcaaagggaatgtattccttcttacactctttagttcaagttttattttttccaaactaagcaatatcaagctttacttttaactaaattatatgaacaaatgcaaactgttaacatcttttattttgcctcaacttctcactcaagtacatgttagaaagatagtagagcattattaaactaatgaccctgtttggttttcctttgcagatttttgtgcatctataaatattttgttctttttttatggagaattataaaggtggagaataaagtcttaatagattgcaaagtaaggatttaatgaaagaaaatcatcttaccgccatatctcccaatgacttgctgcagattggacatgtgtagtgactacacgtgtatgcctaacataatataacaaaatataagattgaatccacaacccttgagaataggttacccctggtttgggtagggaattgaaacctaaaacctaaaataggtgtgaaatagacctggaagcaagnnnnnnnnntatagtggccnnnnnngtagagctctgactgtggcac

SEQ ID NO: 1132 - DNA, 384 bp, Glycine max
gtgcgacgctggcttccagaacttgcaagattacccactgagtggatacatcatccttggaatgcaccagagtcagtgctacaagctgctggaattgagttaggatcgaactatcctcttccaattgtgggaatagatgcagcaaaaaccagattactagaagcgctatcaaaaatgtggcaacaagaggcagcttcaagagctgcaatggaaaatggaacggaggaaggacttggagactcttctgaatccgttcctgctgcttttcctcaagacacgcgaatggaggaaactcatgaacctgttaggaacaatccccttcccgttgctcggcgctaccaagatcagatggttccaagcatcacttcttccttgttgagagtg

SEQ ID NO: 1133 - DNA, 396 bp, Glycine max
gattcattgacggcattcgtgaatgccttacggtgatggtcaattgagtatcttgctcaatgttccgtcgtaccataccggcaataaatttcttcacagatttgggcaattcactgaaaatgggaatggcagtttttgatagcaaaacgaagattctcagctagcagtatccctgtatagatttagataaccttcctcacaaatataattgtagtagtcattctatgaggaggatgtgatttcctgttttgttagatgagtagagttatggttgtattatgttgtttcttcactatcataatctacttttttagattttgccaaatttacaagaacgaacgtctaacctactgtgaagtcttatgttccgtgtgcaataatgtccctgtcacgtat

SEQ ID NO: 1134 - DNA, 435 bp, Glycine max
tgtaacttaattcaacttatgtttttcctctgattttttactattcgccatcaccgtctacattgttttatttttgcactgttataggtttggagctctagtggctggatgggtctctggttcattgctggtacctaatattccatctatgttgctgcggccaacttggacacttgaactcttaacgtcattggtagtttatttgttcttgttcgttgcttgtacttttcttaagtgaagtggaaactattctttcaacgttatagtcggtgatgagtttataggtgatcaaacaatttttttgtttttgttgttgtagcgagccaaattgtttagtgtcgtctttttttatgaaaacaattgtctgagttgccaatattcagcagatatattattaccgagccttaactccttgcctaaatttccgttggttac

SEQ ID NO: 1135 - DNA, 346 bp, Glycine max
acatagtactctgtaacaaaatggcccaaatatttaatatggttgcatctaatataataattacaataacattgtattcactcattttgagagtaatttttttatactcttatcacatcatcatgtacgaaacacattcaacaagtttgaatatctcaatcatgataactattaaaaaaattgtaattctgcaataagattataagattatataatatgatttaaaaaatagtgctaaaatattttactggacaaaaataattaaattaaactcgtgaaaataactatatatatagatctctgctccaatgtcacgtgacaatgattggaggttgcgtcagcaatc

SEQ ID NO: 1136 - DNA, 745 bp, Glycine max
ttaatacttgcttcaagcattttgttttatttacttgggtaagtgagttataaagattaaaaaaagaagttcaatgatgcatttgtttcttcatcttttggttttgtattgggttggttgtgctagggtggagaaattattgcatgatctagaccaccactatgatcttgtcaatctccacgtgacacgtagtctagttttttaatttacaagagttaataaaattgtgttatgtgtcaagtgaagattagtcgggatcatgaacacatgatgatttcggactatacaataatttctcatgagggtgagccctggtgcaacagtaaggtcattttgccttgtgacctagatgttgccagttcaaatctcattcaaatgcaaatatgggaagtatgcttttctatccaacttgactgctgccatcttttttattttcttgctgatatgctgctatcttgtgttgcaggaattccgtttgatcgacaaagcagagttggcacctcttgaggaccttgttgaatctattgttcagttatagtgctgttggtgttttctttccctaatttttaggagagattaaacattggaaatgttggctatacatttttgtgaccccttgtaaaatacttgctaaatgaaaaatctttatcaaccccttatgtatttggctcttaattgttgtgatggttgctcaataacaataataatcgtgtgaatctagcgaaaacctccttgtgaggcaagg

SEQ ID NO: 1137 - DNA, 481 bp, Glycine max
tttgcctcccctgtcatttccttttacttttagttcctctattatggttttatggcttgttcctttgagtgatcatttctcggttgaacagcataatatccggtaaaaaaaaaccttggcaagttggcacggaatgctgaaattttggaatgaaaaagctatggcataggaggatatttccccttctcttacaaaaggaaaaggataaaatataacccaatgatggccacggcctaatcagtcaggaattgaagatgtagtccgtataaatccatgtccacaaaaccatataaaatttgtatatgatttatccacaggaaatttcgggcaaggttgactgactttgcttgatatgggtgctatggctagattggcacaatagcagttcgactgattgcagggagattcagtatatagaatgaatgactagtggatgaacatgttactcgttttttctccactgaagcttgacgaagtgttc

SEQ ID NO: 1138 - DNA, 585 bp, Glycine max
tgttccttaagatgattagccacactcattgcgactatcttaaattcctccaaaaatgtctcttgagaaacaggcttatccaaatcagagccatcttgagatagcagtgccggttccacaatgttgctcaatacctaaaccaaaaataaatgataagccaagagaggaaggaattaaatgaaacaagtttgagatttttatgtttcttggttaaagtataaaataaagcttcttagcaacaaatgaaaacttgttttaatttctcatgacttttttgataacataggtagcatctctaaagaaagtcaacgatattatttgtataaattggctacccaagaatctgatgtaggaggaattccttgctcaacagtgagcttgccaagagcttcaattatatggtcatgaagtgatctgtcaggggactcaatttgagagaatatggataccatttcagcttcataacctgaaccattaacaaactccagaagatcttccccatcaatgcgaagtatcacaatagggtcacgcttcagtccagcagccatacccaatagaatgtctgagagaacctctttgaactca

SEQ ID NO: 1139 - DNA, 417 bp, Glycine max
tctccttcttattctctgcatatatcatagtgccaaactctcatctttctctctctctctcacacacacacaatataagtccaccctaaacaatcaccatggcagttgaagctagttacatgaatctcttgccttctcagttactcactaacaggtaccaatataccaccatccttaccagaaaaaaaaaacatgaaaaaactctatttgttattgtctctatggttctattttttttaattttgttgcatgatttttccctatgtattcatatgaggtgtttattgttgcagagaactcatcaaatccaatcaacagctacagcatcaattaaactctgattacatgtacaacactactacccagatggattcttcttcagctttgcctcaaccagcaacaatgcctgaatcactc

SEQ ID NO: 1140 - DNA, 375 bp, Glycine max
ggcccttcaagaaagagtcaaaagcttgtgcatggagaaccaaatttggagggaattggcacaaacaaacgaatccacagccaactacctacgaagcaatttggaacaagtgctggcacatgtcggcgaggaacgcgccaccgtggccgatgatgctcaatctagctgtggcagcaatgatgcggcggaggccggaaacgacactgcggcgtccgcggcggcgaccggtcgtggtaggttgtgtaagaactgtgggctgagggagtcagtggtgctgttgttgccctgcaggcatctttgcctttgcacaatgtgtgggtccacagtaaggaattgtcctatttgtgactctgacatggatgctagcgtgcatgt

SEQ ID NO: 1141 - DNA, 399 bp, Glycine max
catcctcatagccgctctcgggattcatttctttcagcaggcttccggaatagacgccgtggttttgtacagccccgagattttcaagaaggctgggctggaatccgatggggaacagcttctggcaaccgtggccgttggattcgccaaaaccgtattcatcttagtggctacgtttttgttggatcgggtggggcgtcggccgctgttgttgacaagtgttggcggaatggtgttttctcttctgacgctggggttgagtctcaccgtcattgaccactcacgcgccgtcctcaagtgggccattgggttgagcataggcatggttttgtcctacgtgtccactttctccgttggagcgggtcccatcacgtgggtttatagctccgagatcttcaa

SEQ ID NO: 1142 - DNA, 366 bp, Glycine max
aaatatcataaaaatgggtgcaatgaggagagagcacaattagctttacaaaaaattatagcccaacaaagtatcaagtaattgcagagctcttcattaactgttgctttcacactttttgtgtatgcatttcatcctggagtcttccttccctattccttcaatcaaataaaatacaaactgatttccagaacctgtatatcatccctccataatcaatttccttgacagtgaaaaatctttcaaggtcctcgataactgcgaaaacataaacaaccctgaggctgatcatgagggatcatacctccaccctttgaagtgtcaatagcttccaacatggtcaccacttcatccatctctggcctc

SEQ ID NO: 1143 - DNA, 650 bp, Glycine max
gagtaattttgcatcgtcgtcacacatggagatctccggcaccgttctccgtcaggtcagctacgtctccggctatgggacccacacgcggtcccgcggcctggctcctcgttttggggtgaggatggggatgggttctggtttctgtgacgaggggcatttgcggtattaccaggacaccaaaaaggttctcaccccaaagaagaagttgaagctgctcaagggtttctccaaattagggcttgcatcggatcccgagaaactcgccatgttctatgatcttcaacaaaacctcacctcggtacaattttattttctttacttttttatattggttgctgttcagaattatgagtaatttcagggtcttgtttagataaattatatgtagagaaaatgagaagattaaaacaattgaacattttgatgaactaaaattaacttagttaggcacgttatcttctggagaaattttattagagaattctataaaagtttgttttgatgagagaagctaaagaaattatttattttcaatccaacaacaataatactgaagctaagtttgttgttgttttgcgtgcaggatgctggagatgtattactgagagagttagaagcagcaagagcaaaggagaaggaagtgaaaa

SEQ ID NO: 1144 - DNA, 360 bp, Glycine max
agtttcacctccacatatctaaatcaaattaaatagctcagcaacaccaccacagacaaacacattcatccagtacaaaatattggatgaaggaatattaattctagcagcaagaatcaacaatatgcaaatccaataccaagtttagtgccattgataattctcttagttctcataatctgtacaaaagtttatgcattaatttctcaaggtcctcctggtgtctttggatcatgccggttgtttgctcctgtccctggataatcattactctccaaatcaatccttctctctaccatgaactcttctgccatatcaaacatttcttctccatttttcaattcctcaacaccctgaaac

SEQ ID NO: 1145 - DNA, 391 bp, Glycine max
ccaaaagaatatcgtcgggatacgttcatgcatcgtgcaagagatgataggcatgataggcatggaatgggacgagatagaattggaggaatgtattagctgcggatgtttaatgtactttgcgaatgtattagcttcattagttgagatgaagaatttgagagattagttgctgaatcttcagaattggtcacaatgcattggaaaactttttgactttgtgcgcacacaaattgcgtggtttatgattttatcggtttgtttcattccacttaatcttcacttcagatttgtcaatatgtttagtacgtggttttttactccaaatctttgagggggaatattactaggcttttattcttttgtccctctgactgcgagatgaaattag

SEQ ID NO: 1146 - DNA, 306 bp, Glycine max
ccagaactctcactcccttcctttgcatcaacctcacaagttgcacctgacgatccacaagtgggtcaccgccacagccggtaaccagcacccaccatccacgccgtttgataatttccaatctcttaggaccattccctgccgttggattgcaatactcgtgatcacggtcaactccaacgggcaacgataactcccacaacgcgtcattaacacacagcgccaaatgaggttcgttctctagcctcagctcagaaccggttctttgggtcccactgaaaaatggttgaaccaaaataagccctt

SEQ ID NO: 1147 - DNA, 904 bp, Glycine max
  misc_feature (888)..(890): n is a, c, g, or t
ctctgctgcaaagctttgcctttagggtagtaagcggccagacattggaactagtcatttctcagttttggtcaagcggcatagggagtcatgagaccgcgagtgtggattttgaggtacttgaattcttatttagatgaactttcccccctcccaaatatttggaaagattttgccttttctttttgttaaatgcatctcaattcctttatatcaccttgcttgtattgtgtgataattgttgataatttgctatttttatatctatataacagatcaggaacttaaatagcaaatgttaaaaggtgaaggctgtagataaatctcatgaggaataaacatatgatttttttcttccgcttggtccagtaattttgtagttgtcctttcatatattgctgcctctgaagctataattggatcattttctctgaattttttttggcttaatgtatgatctcttttatgatgtgggatatgttgtgttatttcattctacattgaatatacaatcctgccgtctacataaaatttcaggttgtgtttcacgggataaaggtcaatcaagaagaggttttacttgatggtagtgacgcaccagtcaggattgatgctgaaactctactggcatctgaggaacttgcacctgtggcaattctaaacaaggttatctttttaaagctcctattttcccctaatttggaaaccaatgagatttacctgttctcctaatgtatattaaacttgcagattagggtcccatatcgaccaatagattctaagattattgcacttacagcagatcgtgacaaacttccttctggaaaacagattctggcactgactctgacgtgagttataaattttattgtgtcatttgtctttcgnnnaatttggatggcct

SEQ ID NO: 1148 - DNA, 538 bp, Glycine max
tcgttatcaatactacttgtttggatccacaagtaacacaggagaacccctactactccaagaggtatacagcccataaatttgaatgtaattctaaatccaaaataaacagccaaaaacaatttgatgcatccggatagataaaacaaatactctcattgatctacctacacaatcatcgtgttgtttgagcttgtgcatgttccagaagttgactaaccaacttgtaagtgcgtccgttaagggccttggtatggtctatcagttgctcatacctgcagatatagtataagattaatggtcatgaaaatgatgacacacaacataaacagaagaatgtggtctacatagtgagtcagaatggtacaatacagtaggaagctataaacgcccttatctattgagtcaataatcaatgttaacttacacatttagatgattaggttccatgataactgctccagtttcggagtcaattttggcatcaagctttgagctccggatgagattaacaatccatctctcagcctcctcataa

SEQ ID NO: 1149 - DNA, 727 bp, Glycine max
  misc_feature (360)..(365): n is a, c, g, or t
  misc_feature (432)..(438): n is a, c, g, or t
  misc_feature (475)..(483): n is a, c, g, or t
  misc_feature (596)..(598): n is a, c, g, or t
  misc_feature (605)..(606): n is a, c, g, or t
  misc_feature (622)..(624): n is a, c, g, or t
  misc_feature (710)..(712): n is a, c, g, or t
tcttcgagcacaggcacatcctcctcatctggcgcatccaacacccactccccatcctccctcttcaccatccccttattcttctccacccaccacgaccctggcacgccatattcctccttcagaaactcacaagacttattcaccaacgccacactcctcttcaccctcatctcaaactcctccttcttcccattccaccccgccaccacatgcaacatcgcttgcaagttatgccaatcacccgggttcctcgagtccttcaagctcggcgacttcctcgtgtctatcaccagctccgtgcccatgtactcataccctaacaacttccccgggtagtgtgggatcaaatcgatcacnnnnnntacccggggaagttgttagggtatgagtacatgggcacggagctggtgatagacacgaggaagtcgnnnnnnntgaaggactcgaggaaccggggtgattggcataactnnnnnnnnngttgcatgtggtggcggggtggaatgggaagaaggaggagtttgagatgagggtgaagaggagtgtggcgttggtgaataagtcgtgtgagtttctgaaggaggaatatggcnnnccagggnngtggtgggtggagaannntaaggggatggtgaagagggaggatggggagtgggtgttggatgcgccagatgaggaggatgtgcctgtgctcgaagagatttgannngctttaagcttggat

SEQ ID NO: 1150 - DNA, 387 bp, Glycine max
gcactcttgtaaggataaagtgaccaggaccacgttatatcttgaggcaattacatagcccatatctggtatggtcatccaactagcaacagatgcctgcttgccaacatacaaagattgcctcaattcagccactcggtcattgctaccaaagagtttggcataattatcttgccactgttgaagctctctaattaaatcctgacggactagagcccacgattcctcacccataccaagttgagctgcaacagcacgataaccacaatttgaatctcctttcacatcaataatgtcttcaataaatggatggatctcaaccggaaattggtccatcattggcagaactctcctgcgtttagactcatggactggtttctgagatga

SEQ ID NO: 1151 - DNA, 356 bp, Glycine max
tctctcttcttcctttttctcttcctttcttttagttctgttattgcaattttgcctggcctataatgcaaagttaaccaacatttgattccattctttctgtttccttcttcaaatatctttgtatcttgttttgcaagtaaaactagaacaaccttatttgtatatattttagaaacttcattatttgacagtatattcacccatagttgaatttcaatggggaaaggaggtggttgctttccaagcaaaacaaaggcaccaatttctggagcagaaaaggatccaattattgttgaaagtctaattccaacaaatgatcgaagtagcacaagccaagaggtggaagcaccagc

SEQ ID NO: 1152 - DNA, 782 bp, Glycine max
aggttgggtttggaaggcaagggcttgtgttgtcacaatccaaggtttgtttgtgtttgtgccactgtcctgtctttgtttatatatcttagtttcgtcggtgtttacttagatgtatgtgttgttgtagagagaagtaatggcgaacatagacatcgaagggatcttgaagcagcagcagccttatgatgggcgcgttccgaagacgaagatagtgtgtactttgggccctgcttctcgatccgtagaaatgaccgagaagcttctgagggcagggatgaacgttgctcgtttcaatttctctcatggcacccacgactatcaccaggaaaccctcaacaatctcaagactgccatgcacaacactggcatactctgtgccgtcatgcttgacactaaggtaggttcttctattcatgtagccaatgattttgatgataataagcatggtattggtctacatttcttgtctttttctgatctgttgtttccatataactattagcttcaaagtgaatgttgtatctcgttggtgttaatctctcttgaccttttagttttacatttaatcctactggattgtgcagtagttggacagcttgctgcttttcttttttcttcgtaaatatcttgttgaggaggatggctcgtcctgtttctcttgtatggttgtcaatttcttattccattaacgtttctgtctacatctgctttgtgcagggacctgagattcggactggttttctgaaagatggaaaacctattcaacttaaagaagggca

SEQ ID NO: 1153 - DNA, 300 bp, Glycine max
aattgtagctgtgcgctcaacactgccaacgctgcttctggccatgatttcttggccttgaaaaccagcgttttggaaatgaaatgagtcaaattcattttggaatctttcttccctaattaattagttgttaatggatgcaaatgattgcctgcccaatttcctcgtggagccctttctattattcctatgttcatgtacatgtgcgtaagactacaaactttcttgtttatacgattggttctttccaaatagaatacaactatatatttttgttatttctataacaaaagttcaatt

SEQ ID NO: 1154 - DNA, 315 bp, Glycine max
aacttatcaagaggacaaaatacatgtaaaaactatccctaggcactacaaagcttccagagttattgccgccttggtgaaaacagaaagtacaaacggtgcttcttcaccggggtgtatagtagtaggaactatagtatatccctttggctcaggttccaaaaccatttcacaggatatttctcgtgaattaacatagtctgtcccaccaactgattcatgtaggtatatattgaaagcagcacgtctgccccgagtttttagtatcctcattccaatgtaaaacatctgtgaatcatggctggattgataaaa

SEQ ID NO: 1155 - DNA, 1223 bp, Glycine max
  misc_feature (1126)..(1130): n is a, c, g, or t
  misc_feature (1165)..(1172): n is a, c, g, or t
agtggaacatttttttaaagacaattctattacctttcatttttctttcttcttcattttccaatactggatatgccaatggtgtgcttagttatagactattgttgtatattttacgtcccacttgatatgtatgtcccttctaaagctttataaaggcactgaatggttgagaccatgaaatcatgtatattgactcattacagagtgaatcccattgtgctgcaaccactacctgtttcccctccatctttcaagatgccttttatgtagtttggtgattgtgtgagttactaaatgcatctaattgctttggcattaatggcttgaactagtgactgatttctactgtgacgcttttgttacagaacatccgccaagacctttattggagaggcttgcaagagagctccgccatcgattggtattgttgtcatttcttattttcttccatttccagtcatttttcatttttagatgatatactaaaattaaattgtcactagggactctgcttgttcaacatagatatgattcgagaatatggaaccaaggatgtgttttacgtcattgacatcaactactttcctggcaagtataacttgttgcatttaagcacttcacattagtctatgattgtgttggtgcataactaatgtggtgtgctaattcttcatactctctcttgggagcttccagttttgtagaatttcccttataatgaaaaaaaaggtgtttcttgatttcgtgtaccgtatgttgcttaattatgcccaagtaagatattgaatttgaactgcattcctgaaatgaactagctctatattatattatagtcagtcatagtattatactaataagaaatagaacttatataaataaaaattcaagaagtcagaatattttaatcacgatgttttgtacgaaattggttattttgcatttgtccactggttatttggtttacatcaaagtttgttatacttttttgacttgttaatgaatttgatttgaccgactgcaggatatggaaaaatgccagactatgagcacgtatttacagattttctacttagcctagtgcagagcaattgtaagaagaaacttgctacctaaactagagcannnnntagtagatcagatccattgagcagggctgttcttnnnnnnnnctttcttaataatttatgcaaactactatggaatttcaatgaagccaccaa

SEQ ID NO: 1156 - DNA, 339 bp, Glycine max
attatttcaaaattgagaattctattaagtttatttaaggttcatgaatcggtggaaagagctcagatcttggttggtttatcctgcaattagttcaatgttgtttttcttgttaattgttagtaggagggatcgaatcctttatctcctaggtcaatgttgtttgcaaactcggcatatttgtttattttttcttttttattgatcgaatttattgatgttataacatatcagttgaattgcttcagaatgatcttacttgtttaaagaagctctaatcggtttattgggagcttattgaagaaattaaagggattccacccaacttaggaacaatct

SEQ ID NO: 1157 - DNA, 701 bp, Glycine max
  misc_feature (254)..(256): n is a, c, g, or t
  misc_feature (521)..(521): n is a, c, g, or t
  misc_feature (523)..(523): n is a, c, g, or t
  misc_feature (604)..(608): n is a, c, g, or t
  misc_feature (625)..(626): n is a, c, g, or t
  misc_feature (639)..(639): n is a, c, g, or t
  misc_feature (644)..(657): n is a, c, g, or t
  misc_feature (668)..(670): n is a, c, g, or t
  misc_feature (675)..(684): n is a, c, g, or t
  misc_feature (690)..(696): n is a, c, g, or t
aaccctttacatagcaaaccttggggattcccgggcagttttgggaagagcagtcaaggcaactggcgaggttttagccatgcaattatcagcagagcacaatgcatcgatagagtctgtaagacaggagctgcatgcttcgcatcctgatgacccaaatattgtggttttaaagcataatgtatggcgtgtgaagggtcttattcaagtaagtcacttttagctcataatgttgcttttctagttgctagagnnngatatttatcttttctataaacacttcacacctcttaatatcattttaaatttgtaatcttcccatgttggaagttaaattttcaggatatatagtatgttttcaggatatgaagaattacttcagaaagacagagctatgccgagcattagtaaaacagacctgggtgggggtggagagagagagagataaagtcaatttcaaatttatttgtggaaaggacttatttttctcaacttcactagagttttatgttattgaatancnttaataccccaatatacattatgactttatataaccagaaaactatcttttgcgatgaatagtggttgaagttgtcttagnnnnncaacataagacccagtnnatagatgctgggnaaatnnnnnnnnnnnnnncacaacaattnnnatatnnnnnnnnnnttgagnnnnnnnagagt

SEQ ID NO: 1158 - DNA, 727 bp, Glycine max
  misc_feature (422)..(424): n is a, c, g, or t
caggatctctaaggttgtagaggctgagggccatttcccaaatatctacttggagcaaccaaatcaagtgagagcagaactatggacagcttccattggtaagcaataaatttgcacccttcttgtgtttccgcattcaatttcatagaatattttcattttagttgcatcccataaagatatcaatatactcaatttctttgattttattttgtttagcatttatttcagttattggttacaagctcctggtagggtttcaacatcccctaatgaaacatcacctaggccatagtaggttctagtaccaatgtgtgtgcataagagttattcattatatatacatcatatataggagttgaatgagaacatttgttgtgaaaaatgacaaataaatattatcaagagttgcactaatattnnnaagatgagaactgtttttattatatgtgccccgtgtatatatattctcatcttattaacatttcatttgaaatggttcaaaattttgcaggaggtttaagtatgaatgattttattgttgctgcaaagatagatcagataaagacatcagatcttgtcccaaggaaaagggtttgggcgtaatgccttaatgaacttcataaaacattttgccgcttgattttcttcaatattgaattaccactaatttgtgctatttgattaaatctattattctttactttcattttttagtgttcactcc

SEQ ID NO: 1159 - DNA, 652 bp, Glycine max
  misc_feature (604)..(605): n is a, c, g, or t
  misc_feature (621)..(623): n is a, c, g, or t
  misc_feature (637)..(639): n is a, c, g, or t
  misc_feature (641)..(645): n is a, c, g, or t
agattattagttaggttctgtttaatttggtcctttactaatttcattttctctctcttgggttgaaaatgtgtatatctatatagacataaataaccatggcattattcttttacccttttcttatagttagttagttaagcattagcatttatgattgttataaaccaaataaattaaaggcttcaacaagtagatatttatgtgttgcttttatataatttatgttattaattggggtcgtacaattaagtacatgtttggataggttttggttgttaaacgttcttttatataaagaagaatattctttgtatgttttattttgaatacacttttttataaagggtataaagattatccaaacataatagtggtctcacacactagctacctttctcaccatgtcataatataattaagcttgtggctaatatattctaattgtgttttgtttttggtgtagatcatagggaaggatttgtttagggtactaaaggagaaattgggtgcaaattttaattcctttgtctcgaaaaagttgactctggtacccggggacatctctcgtgaagacttgggattggaggattccattctaagnnaagagatttatgatcnnncagatgtcattatnnncnnnnntgcaaca

SEQ ID NO: 1160 - DNA, 393 bp, Glycine max
ccaaagtagcatcactctcatcactcctaacaaaattcctttgctccaaatcagccagcatcggctggcggcaattcgatgcaaagccacgggaccttgcctttgccctcacaaagatcctatcactattagtactactacagctaccactagtgtcaaagctacaacttctaggaccaaaagcaatgcttctgctaaccccaaaaacatcagcataaacaagattatggagaaatcggaaagacaggtagctaccacgatcagaagaagcaagagaaggatactgagaaaaggccttgctcaagtgggaacaaggatcataaccaactaaataagccataatattgttgttatggtgaaggtgatgccgagtttgctgatacaagtagcgca

SEQ ID NO: 1161 - DNA, 360 bp, Glycine max
cttagcattatttagcacaccagaactgaaaatggtaacgtgaatgataaagtagtctcttctctctctctctatctatcctgtttggcattcctacccaaatcacttttctattttccattcattcatacatatccgcgtcaacatgtcattcattttttgttccttattgtcagaaccaaaatcatttctctgaccctcaatccaatcacaacaaccttatccaattgcctcgtttctaccaatacaacacaaccaactccttttatttatttctacccatttttctttttccttacattatttcatcggaaaaaacaaaagatacgatcttatgatgaggggaagaacaagacatga

SEQ ID NO: 1162 - DNA, 471 bp, Glycine max
aggatgaggagtactattgttttacgattgggaagacgtgcgcgtattccattccaacgagcattagcaacgcagagtaacaataataacactctggtgtttatccctctccctcgctgcctcagcgcaacgcggtcgtttcactttcagcgcaattcaccgtttggattctccagcgggcatgggcaacgcaggagcatgttcatccaaacgcagcccacgccaaatccctcgtctctcatgttttatcccggcaagcccgtcatggaagttggaagctccgacttcccaaaccctcgttctgcaatgaactctcccctcgccaaatcgctcttcgcaatcgacggtctctacttttttctttccttccttctctctctctctctctctctttttttagggtttcaatctgattcctctgtgcttgttcttgttgtgcaggcgttactcgcgttttctttggatctgatt

SEQ ID NO: 1163 - DNA, 521 bp, Glycine max
  misc_feature (465)..(477): n is a, c, g, or t
  misc_feature (479)..(487): n is a, c, g, or t
ggcatctcttttccgctgcgattgcgaatgcttctggcaagctgcactttccttctattatccacaccaactcccactccctccccctccaacatggcctgttcctttacccaacaactccaagaggagattcattgctttatatattagtcaacacatctttgcctccgatcctccacacgagatccttggccacacctatctcttcttgaaagatcagcttcaaccttctattatgcctcctcatagtggaatacttcacggaaccatcattggtatgtattcattgtttgttccatccactttattaagattttcgatgttaattttatttgagcagatcagttcattgcttgcggcaagtccagggacgttgctcacgaacttgcttctcggatttggcttgctgtcgtcgacaatttggaccaaaaccatcactccttctccttacttaaacgccttgcnnnnnnnnnnnnntnnnnnnnnnttctctctatcctatctaatccttaacataattt

SEQ ID NO: 1164 - DNA, 386 bp, Glycine max
gttggaggtgttgaagccatggactctctcattctcattcgggcgagcactgcaacaaagcacactcaagacatggggtggaaagaaggagaatgtcgccaaagctcaagaggcatttctggcaagatgcaaggccaattctgatgctactctgggaaagtatgttggtggaagcggaagtggcttgacttctgagagtttgtatgtcaagaactacaagtattaaacttctaaagagtgtgtttgtttctccttttgaaaacgtcaatccatgcttttggttcagtcacgttgaggtctataagaaagtatgacaatggagaaacaagcatactctaaatggacttggggactgattcggggtggtctggcatatgtatgataaa

SEQ ID NO: 1165 - DNA, 765 bp, Glycine max
ggtagacttgattcaagaaaatgtcgcaatcaatcagcatgaggcaatttcaaagtttatacaagtaagttttctttaaagagatttcttctacacaagtgaattcctttttgataacttaaatgacaatttccccccttttttgtgatttgccagggaactgttgctgatggtgcaccagtagtacctatttcagcacagttgaagtataatattgatgttgtgtgcgaatatattgtgaagaagatcccaatccctgaaaggaactttgtttctccacctaacatgattgttattcggtcatttgatgtcaataaacctggttatgaggttgatgaaattaaaggaggtgtagctggtggaagcattctgagggtaggttggttggtcaatttccaatatatcatgcttgatctgcactgataattccatgctacaatttcaaagtgattttacaaataatgccatggtgtccactatgaatacatgaatatgaaacaagcaccttactaatttgttgcattgcattgtcttttttgttttggaatatttttgtggttgcaattttccaaaatacctaggaagactgccattttattcccaaaccaaaataaaggaatgcaattgtgtggtatttttgcatccaaaccaattgatttgttattatgaactttcaagttgctggaagaccatgagcatcagactcatctgtcaatttgctctttgcagggtgttttgaaggtcaatcaattcattgaagttcgt

SEQ ID NO: 1166 - DNA, 555 bp, Glycine max
caatactataagcctaccgttacataatttttgaaggccagaatgtctacatattcgtttgtcaagaattcaagatataacgaaaaggcaaatactacagagccatttacttatacaagttgatgacagaatctcatttgggattcctaagaacaatgatgacagaatctccacggagaaacattttgctgatgaatctatccttgttgactggctgggactttttctttcctttaccagtctttggcacctgattgtacacacagagatcgcttagcagatgtaacaagtgcaagggaagtaaaaatctaaaagacaaaccatacctcagtccacatctccctgacattttcaagaaccatgttgcagtgcctgtcaaaagcccttacacgacccagaagctttttgttgttccgacaatttatcagtacctgcataagataaattaagttaaaaaaaaacctctgggtttgcctctgaaaccatcaaagagtacatatcataaaaatgaacacacctgagtattatttttaacactcatcatgagtacagata

SEQ ID NO: 1167 - DNA, 642 bp, Glycine max
agcaccctcgcatgttcactgggaggaggttagtgcaatggccgcatcggacagtgacggtcttgaacaagcttgtgcaaggaacacttacctgaaaattaagggggaaaagatcaatggacaaaattttacatacataatttggcgagtaacaaaaactaagaaataaacaattaatatttattcataaaaaattgggcgagtaataattaattaaataaaacaagaagaaaacattgagagagaaagaaagtgaaagaatttagagaagagggtggagtaggtagcattgaaaaaccctagaggtagaaaagtggggaatgaagtgttttggttcagttcatacagcgaggacggtgtcacaaatgttgcagtgaacataacaaagctgttcggaaggagggaggtggtccagtgataatgtgctggaagaggatgacattttgggtagcccccttttttcgttctcttatattcggttgatgattggtctcttgattgattggattgattgatagatggacagcttaaccaccacaccttggatatgctttttttgattatgagttgtgaaagaaaggtgcagagagacagagagagagaaagagagtgagagggaaagaggctgatctgatctggtct

SEQ ID NO: 1168 - DNA, 372 bp, Glycine max
ttatcgagcagttcaagctaaattgtgatgcctcgggtctgccagtcaaagtatttgtcagcatcggaggagatgaccccttcaaagttgctgctggtggtgccgatgattgggttctcaatgccacaaccacactccaccacatgatcaacgagtaccacatcgatggaatcgatgttaactacaccacaatccagtgcaacaaaacattgtttgttaactgcattaagggtctcataaagggcctaagggaagctctatgcaccactgggtttgtggcttccttagctccagatgctgccaccaatgagactttctacttgcccttgtaccgatctattgataattcttggattggaactgttgtgtttc

SEQ ID NO: 1169 - DNA, 420 bp, Glycine max
aaagggttgtaagttggaacaagcatttcatgcttgcgaaaaaaatgggtcataaagtaacaagccaaagttccctggaaaacaaccaagtcaccaaactgccaccaatccacccttgatagacatatcaaccaaaatgtatgccgaatgtgacctgtacagttctatctccttccctgatttagccagttttatttgtttctagttttgtaacatgattaagccagaatatcacatctccacaacttctccactagcaactccattgtgctgctgccaattgaattgcagttttgaagattcaatcccagcaaggtctggcccaattttgtcaggaaaggcgcactcttgtttgatacatcagaacaaccagacaacgaaagcacttgcaagctaggcagactggcccttgagagaaca

SEQ ID NO: 1170 - DNA, 659 bp, Glycine max
taaagcattgaatcaactttgtcatgaaaacaggattattaaggaaaccataagtcagccacctactgtttcacagttacttttaaatgctacaactgctctaatatagaggttatgtcaaaggcagtttaggaccatcaagtattccaacatgtaaaattaacagatgccaaaactaacaatttcagtgaagtactatcatagaaagtcagattaatcaagccaatatataaagtactatcataggcacaatgaagagacaaatcatactgcttattttcttgcttggattgctcgactggaccccaaaacaaatcatcatcccctctgtattttgacagagaagcttgggagtttatctggctagaaggtgcagtttttgatggagatgaagctgaaattgggcgtgaagaaccactactccgtgcagcttgggcagtttgtgatttttgaggagtaggcagttgatttgggagtactgcagaggacttcttctcctgctcctttagaatgtcccttaatgatgttggtttaggaatcctagcagaatcagtagtccatgctggaggaggagatgggcttgttggctctcctttccaaagaacaaaatctcccaaagagggtcctgaaggaatggaaggcagtagttctttctcctg

SEQ ID NO: 1171 - DNA, 332 bp, Glycine max
tgatcgtggagctgcaacccaccatcttgggctgtcttcagcttccaactcttcttgcagggtatcctctaccctttcagattggagttcccctaccgggaaactggattggggtgtaaacggagacaagctgaacaagctgaggaaatctacttcctttggattcagaaacagtggggtaactgcatcccccatagcacagcctgaatttggtgctgagccggatgtctcatgggttcattcattggttaaagatgttccctccgagaggtctgagatatttggtgctgagaagcaacaatatgatctcagtaaagagatgcttccaccat

SEQ ID NO: 1172 - DNA, 969 bp, Glycine max
  misc_feature (912)..(917): n is a, c, g, or t
  misc_feature (955)..(956): n is a, c, g, or t
ttttaagcccttcgttcatcagttgttacctgctcttctcataaccagatgtggataggtcacccttctcaagggccattctatcaggacgtagacgagagtcagatgccaacaacttcttgggagcagtgtcaaagctgttaatcttgtgtgcaaaatgcgtgtactggaacttgtccttcttcggggtatcagcaactctccaaatctgtgcagaatgaaacacaggtaacttaacaaaaaaacaattcaaattgctagaacaaaaggtgatgacaacccaatgaagcggaaatcatacagtgacactacatgctactgtctatcctgcaaatcgtactattgtatgtccagtgaaggataaggagttgaggactcaagtgatgaccggtattaaactacacctagaaaaatcagagattaaatgctccctaaacacacctttttataattcatttactaatttccacaactaagctttcaattgtatgaagttacagctgactaatgtcagaattagttgatgccgtataaccatgtgaaccaaaccaaaccaaacataattcaaatctagtcagctataaaagccatagttatgtaaagtggtatgctactaagtcgtaatatagaatatttataataatcaataaaatctgctgtaacagtgacgaaagtttgaataacaaacctctttcaactcagtgcctggaagtggttctccctctgagtcacaaacttgataattcatagcctcattccattttccagtcatcagtatcttaggctcgtcagcagaattatacacgtacccatccacttcatatctacccgctctgcaaaagcaaaaatctttaagtttgataatatataacagaagtactgagcaagaagtagtaagttacaagagaacannnnnngcaagagaaagtagccatacccaaaccagccacatggnnaaaatacagcacc

SEQ ID NO: 1173 - DNA, 1027 bp, Glycine max
  misc_feature (1016)..(1021): n is a, c, g, or t
tactatgcttggaggattatttgaattgggtatggtaaatggactttgattctttgagtaacaaatggctgttgtattcaggcttgtttccaaatcatatcccaaatcctgaggacaaaacagcaatgaaagctataacccaagcagtccttgataacaaagctgatcttggaattatctttgatactgatgtggacaggtaaggatcttattactaatcagtttcactgaggtgactactgtttttaaatttattaagcatcaatcactttcatctgtagatctgctgctgtggatttcactggccgtgaattcaacaggaatcgtttaattgccttaatggcagctattgttcttgaggaagtgaggctcatttttttagctatctcagacctagtttaacctcatacttctctgtatacttcctcttaattcttttcctcctcttgttttccatagcatcctggaacaactattgtcacagacagtgtgacttctgatgggcttaccacgtttattgagaagaaacttggtatggaggaatctaaactggcatgatctttagtctacccttctcaccttctttctttaagagttcactgtaaactaaaatcccttgcttttattgaatttgaatggaaaatttcttgaaatgagatagtgttaataacttgctaatgttatatgtcttaggtggaagacaccatcggttcaaaagaggttacaaaaatgtgattgatgaagctattcgtttggtatgatgagggcttccctataattcaataaattatacatcagattagttaaacaagaaaaacctttcgcctatgtgcttgactgtgccattatttcaaatttgacacttgtacattttggctaaattttttctaaatgggtcccagtggtagtacctggctaaattgcaaaacagaagcattctaaatcaaattatatatatagtttacttttgaatttcatatttttacaatataagtacatatttaacttttggaagnnnnnnttgctg

SEQ ID NO: 1174 - DNA, 738 bp, Glycine max
  misc_feature (682)..(683): n is a, c, g, or t
tttcagagaaggctcttcagcatgctttactttgtaagttattttgtttctcctcgtcagttcatttgtatttattttcctgtttctagattgtttagaaacctaattaacagtccccaaattctgtgggggcagctaagaactttatgtttctttttctaaatggttgcattccttaatatacattgtttctttttctaaatggttgcattccttaatatacatacgaaaaatatgaacataggtcttgaacattattggaatatgtgaaaattagaagtgttccttaaagcacacgcctagctttgggcacagtaattcaaggaaagaattgttttatttggcagttccagctgttgaaagaattgtttatagtacatgttcaatcaaccaaattgagaatgaagatgtcatcaaatctgttctgcccatagccgaatcaaatggatttcagttggcaaagccattccctgggtgggaatgccgtggtcttccagtgtttgaaggctgtaagtactattacgcatccccatttcctggtctatcttagtttaacattttggcaatttaacgctgtttgttttcttacctttcagctgaatgcttggttcggacagatcctgctaaacatggcgagggtttcttcattgctttgtttactaggaaagatgctaacttttcnnggcgatcaaataaaaatgaaactagaattccgacagcactgccgaaataaaaacg

SEQ ID NO: 1175 - DNA, 329 bp, Glycine max
attggagaaaagctgttatgtgtcatagactcaactttgaaaatgttgtgttttattgccaccaaatcaatgcaacaacaacttatatggttcctttggtagcatctgatggaactaaagctaaggcactaactatttgccaccatgatacaagaggcatggatcctattgtggtttatgaagttctcaaagttaagactggaaccgtgcctgtttgtcattttgttggcaacaaggctattgcttgggtacccaatctagtcactagtgaatcttgtgtggtctagttgctatatattttgttgtacactagttttcatttatgttta

SEQ ID NO: 1176 - DNA, 1137 bp, Glycine max
  misc_feature (1071)..(1073): n is a, c, g, or t
tgaggagctgaaaagccttgatagcaatgactacttggatttcccctatttctttattgccaaaattgcaaccatgccttaagaataagaatcctcgtatccgtgcaaaggcatcaatgtgcttttctcgaagtgtttcacgactggtatgagtacatttatgatttttgcctatattgatgactattaagacatgctcatattgattacttttgtcatgaagtgattttctcttgagcaaaataaaaataaacgtaaataaaaactttaggaagcagattaatgatgcagcataagaaccttcctcgctgatgactttgaaattccaaaaatgtctgccttattatggacatctggttgaattttgaatgggttctgtttcactctgaaatttgttcaacaaatcttcccatgtctatgatttgtggaatggtttatcatgaaccctataaatcatatttttttgttgatatatggccaaacatagcatcatcaaatagaaggatattttttttgctaatgagaaatacgccttaattgataatatatatggcatgccctaaaagattttctttgattattaggtaaatgttttatgtttctgggttaatgccaatctgcttgacctgctagtaacaatgaccttgtttctattttaagtcaaccatgcaatgctctgaaactgttggtaaaacaatcaatatatatgtattagtctgtctctctttctctagaatcttttctttgattcttgttatcaatagatccatccttcaacaaaattattgaagggtggggttttttttaaaaagatatctaagtttactacgctgcattatcttaattggaatttggttgaactagtaagggtcatgattcatgaatatgggcagcctacttttgcaactggatgcggagcattaacatttactgatttgtatccttgaacagggggaagaaggcataaagacatatgggattgacaaattgatccaagtagctgcatctcagttgagtgaccagctccctgagtccagggaagcagcccgaactctacttcttgagcttcannnatgtgtatgagaaatcttctcatgatctcatgccagctactcctgtcaatagtgatcataataa

SEQ ID NO: 1177 - DNA, 845 bp, Glycine max
acttagcagtatgaagctactacgagaagagaaagagcgctggcttatgcattcactcatcaggtttttctatttttctcaacaatttatacatgcgaggaaatgaatgaaaaatttaatatgaaccggaaaatcttttaaaaaaatatcatattataaactctaaaatgagaagtcaagcatccttattatactacatactcttcattgtttctttatctcttgaatctgttacacttttccatctgagacttagtcctgataagtgcatgagtccttctctatcttgtcactatcttcagagccatatcctctgcactctcctttttcaatgatcttttgcataatccaatgatatgctaatgctttgttaagttgcagcataagttcttcctcaattttgtcaatggcagtattagttactgaaataaagtggcatgctatattatgtgcctaacatattttgaatgaatagcattctgcctatgatataattttcaaccataagtgtaagttccttgatgctttgaacaaaatcagtgtttgacatttggcagcaaaattggaagaactcatctagatctgtaaatccaatgttcatggatccaaccaatccaagctggggttggagctggttggaacgatggatggcagcccgaccttgggagagccgtagccatatggataaagagttgaatgaccactcatccgtaagaagctcaagccgcagtattaccggtggagaaatcagcaagtcatttgctcgtttccagctcaatttggaaaagcactctccaacagcctgccagaatcctggctcacctagctttcagtccactccttcc

SEQ ID NO: 1178 - DNA, 1510 bp, Glycine max
  misc_feature (247)..(247): n is a, c, g, or t
  misc_feature (299)..(299): n is a, c, g, or t
  misc_feature (367)..(372): n is a, c, g, or t
  misc_feature (375)..(379): n is a, c, g, or t
  misc_feature (381)..(383): n is a, c, g, or t
  misc_feature (385)..(393): n is a, c, g, or t
  misc_feature (395)..(396): n is a, c, g, or t
  misc_feature (398)..(399): n is a, c, g, or t
  misc_feature (403)..(403): n is a, c, g, or t
  misc_feature (405)..(405): n is a, c, g, or t
  misc_feature (408)..(408): n is a, c, g, or t
  misc_feature (410)..(414): n is a, c, g, or t
  misc_feature (419)..(422): n is a, c, g, or t
  misc_feature (426)..(428): n is a, c, g, or t
  misc_feature (431)..(458): n is a, c, g, or t
  misc_feature (462)..(466): n is a, c, g, or t
  misc_feature (470)..(472): n is a, c, g, or t
  misc_feature (475)..(481): n is a, c, g, or t
  misc_feature (484)..(486): n is a, c, g, or t
  misc_feature (489)..(492): n is a, c, g, or t
  misc_feature (500)..(500): n is a, c, g, or t
  misc_feature (502)..(508): n is a, c, g, or t
  misc_feature (515)..(515): n is a, c, g, or t
  misc_feature (523)..(523): n is a, c, g, or t
  misc_feature (525)..(525): n is a, c, g, or t
  misc_feature (540)..(540): n is a, c, g, or t
  misc_feature (543)..(551): n is a, c, g, or t
  misc_feature (574)..(575): n is a, c, g, or t
  misc_feature (589)..(606): n is a, c, g, or t
  misc_feature (608)..(610): n is a, c, g, or t
  misc_feature (612)..(628): n is a, c, g, or t
  misc_feature (640)..(641): n is a, c, g, or t
  misc_feature (643)..(645): n is a, c, g, or t
  misc_feature (647)..(649): n is a, c, g, or t
  misc_feature (658)..(659): n is a, c, g, or t
  misc_feature (665)..(666): n is a, c, g, or t
  misc_feature (673)..(678): n is a, c, g, or t
  misc_feature (682)..(685): n is a, c, g, or t
  misc_feature (689)..(693): n is a, c, g, or t
  misc_feature (703)..(703): n is a, c, g, or t
  misc_feature (705)..(706): n is a, c, g, or t
  misc_feature (708)..(712): n is a, c, g, or t
  misc_feature (714)..(715): n is a, c, g, or t
  misc_feature (721)..(721): n is a, c, g, or t
  misc_feature (723)..(723): n is a, c, g, or t
  misc_feature (726)..(727): n is a, c, g, or t
  misc_feature (761)..(763): n is a, c, g, or t
  misc_feature (766)..(769): n is a, c, g, or t
  misc_feature (778)..(785): n is a, c, g, or t
  misc_feature (788)..(791): n is a, c, g, or t
  misc_feature (793)..(793): n is a, c, g, or t
  misc_feature (798)..(801): n is a, c, g, or t
  misc_feature (807)..(809): n is a, c, g, or t
  misc_feature (813)..(818): n is a, c, g, or t
  misc_feature (826)..(826): n is a, c, g, or t
  misc_feature (828)..(829): n is a, c, g, or t
  misc_feature (837)..(837): n is a, c, g, or t
  misc_feature (842)..(872): n is a, c, g, or t
  misc_feature (875)..(881): n is a, c, g, or t
  misc_feature (889)..(891): n is a, c, g, or t
  misc_feature (898)..(905): n is a, c, g, or t
  misc_feature (911)..(913): n is a, c, g, or t
  misc_feature (915)..(917): n is a, c, g, or t
  misc_feature (920)..(921): n is a, c, g, or t
  misc_feature (926)..(930): n is a, c, g, or t
  misc_feature (932)..(932): n is a, c, g, or t
  misc_feature (938)..(952): n is a, c, g, or t
  misc_feature (956)..(961): n is a, c, g, or t
  misc_feature (990)..(992): n is a, c, g, or t
  misc_feature (994)..(994): n is a, c, g, or t
  misc_feature (998)..(1000): n is a, c, g, or t
  misc_feature (1003)..(1004): n is a, c, g, or t
  misc_feature (1008)..(1023): n is a, c, g, or t
  misc_feature (1025)..(1031): n is a, c, g, or t
  misc_feature (1034)..(1036): n is a, c, g, or t
  misc_feature (1041)..(1041): n is a, c, g, or t
  misc_feature (1043)..(1048): n is a, c, g, or t
  misc_feature (1051)..(1058): n is a, c, g, or t
  misc_feature (1062)..(1076): n is a, c, g, or t
  misc_feature (1078)..(1081): n is a, c, g, or t
  misc_feature (1086)..(1086): n is a, c, g, or t
  misc_feature (1089)..(1093): n is a, c, g, or t
  misc_feature (1095)..(1095): n is a, c, g, or t
  misc_feature (1097)..(1104): n is a, c, g, or t
  misc_feature (1107)..(1107): n is a, c, g, or t
  misc_feature (1109)..(1109): n is a, c, g, or t
  misc_feature (1115)..(1120): n is a, c, g, or t
  misc_feature (1122)..(1129): n is a, c, g, or t
  misc_feature (1133)..(1135): n is a, c, g, or t
  misc_feature (1142)..(1145): n is a, c, g, or t
  misc_feature (1148)..(1164): n is a, c, g, or t
  misc_feature (1166)..(1168): n is a, c, g, or t
  misc_feature (1175)..(1175): n is a, c, g, or t
  misc_feature (1177)..(1188): n is a, c, g, or t
  misc_feature (1196)..(1197): n is a, c, g, or t
  misc_feature (1201)..(1206): n is a, c, g, or t
  misc_feature (1219)..(1220): n is a, c, g, or t
  misc_feature (1223)..(1224): n is a, c, g, or t
  misc_feature (1227)..(1233): n is a, c, g, or t
  misc_feature (1235)..(1239): n is a, c, g, or t
  misc_feature (1242)..(1248): n is a, c, g, or t
  misc_feature (1254)..(1280): n is a, c, g, or t
  misc_feature (1285)..(1287): n is a, c, g, or t
  misc_feature (1291)..(1296): n is a, c, g, or t
  misc_feature (1298)..(1305): n is a, c, g, or t
  misc_feature (1307)..(1313): n is a, c, g, or t
  misc_feature (1320)..(1325): n is a, c, g, or t
  misc_feature (1333)..(1372): n is a, c, g, or t
  misc_feature (1376)..(1377): n is a, c, g, or t
  misc_feature (1379)..(1381): n is a, c, g, or t
  misc_feature (1383)..(1387): n is a, c, g, or t
  misc_feature (1391)..(1407): n is a, c, g, or t
  misc_feature (1410)..(1412): n is a, c, g, or t
  misc_feature (1417)..(1420): n is a, c, g, or t
  misc_feature (1426)..(1442): n is a, c, g, or t
  misc_feature (1444)..(1447): n is a, c, g, or t
  misc_feature (1450)..(1458): n is a, c, g, or t
  misc_feature (1461)..(1461): n is a, c, g, or t
  misc_feature (1464)..(1466): n is a, c, g, or t
  misc_feature (1468)..(1469): n is a, c, g, or t
  misc_feature (1472)..(1475): n is a, c, g, or t
  misc_feature (1482)..(1485): n is a, c, g, or t
  misc_feature (1495)..(1498): n is a, c, g, or t
  misc_feature (1504)..(1507): n is a, c, g, or t
atctgattcagaggctgaaaccttccatgcatcagtcttacctccaaccaaaatttccttagctacagagaagccaaagagaagaaaaaggatccaaagagctgaagcttttgaataaccagccataatttcttataattttcctttgtgtctcagagtagagagagaggaagagaataagaaaaaatgacactgaagtgagtgagtgaattgggagggtcctgcttctttcctttctgttgtggtngttaacttgtgcactacttcctctagatccgaatcgcgttatgcttttagtngttgctcgtttgctcgttggtatagcacaaggcttcattttcccctccatccacacagttctagctgnnnnnnggnnnnngnnncnnnnnnnnncnntnnaccncnagncnnnnntaccnnnngtcnnnccnnnnnnnnnnnnnnnnnnnnnnnnnnnntacnnnnncgcnnnccnnnnnnnctnnntcnnnntccccccntnnnnnnnttatccnctccctcnanccccccctcctcctnttnnnnnnnnntttatcttccccattctttcctnntttcctttcccccnnnnnnnnnnnnnnnnnncnnnannnnnnnnnnnnnnnnnctcccctttccnntnnncnnntttctcccnnttcctnncccttcnnnnnnaccnnnntccnnnnnttttttcctncnncnnnnncnnccctcncnccnnctccttccccatccttttccccttttctcccctnnntcnnnntttttcttnnnnnnnntannnnanccccnnnntactcnnntttnnnnnnttcacccntnnttccccantttcnnnnnnnnnnnnnnnnnnnnnnnnnnnnnnnccnnnnnnncccacccnnntaccccnnnnnnnncttttnnncnnnttnnccccnnnnncnttttcnnnnnnnnnnnnnnncgcnnnnnntatttttttctcccccccgcccccccccnnncnttannnacnncctnnnnnnnnnnnnnnnnannnnnnnccnnnttatnannnnnnccnnnnnnnnaccnnnnnnnnnnnnnnntnnnntctcntcnnnnnancnnnnnnnnatncncccccnnnnnncnnnnnnnncctnnncccaccnnnnctnnnnnnnnnnnnnnnnncnnnccctccncnnnnnnnnnnnnccccctanntccnnnnnncccccccctcccnnganntcnnnnnnnannnnnttnnnnnnnatatcnnnnnnnnnnnnnnnnnnnnnnnnnnnccccnnncaannnnnntnnnnnnnntnnnnnnnccctgtnnnnnncctccccnnnnnnnnnnnnnnnnnnnnnnnnnnnnnnnnnnnnnnnntccnncnnntnnnnntctnnnnnnnnnnnnnnnnnctnnnctccnnnnccctcnnnnnnnnnnnnnnnnncnnnnccnnnnnnnnnccncannncnntcnnnntcaattnnnntattaacttnnnnattttnnnntat

SEQ ID NO: 1179 - DNA, 795 bp, Glycine max
  misc_feature (66)..(66): n is a, c, g, or t
ttctcatcactcaactgcatatcagcagagttttctcttgctggacttgactgcctttgccttttnggttcgtcatcatcagattctgataatgcttgccttccccgggctatgcttgaggaaggtgcaggctaaacaagaaaaataagcacggaaatatttcatctagccgaaaggtaaccaataaaattgaagtttcagagattgaatgtaaatcaaattgaattattggatgaaacaaagaggaagatggaaataaaattagtaaacgatattataatgaatcttatataacttaaaacatcaacacaagtggaaatgattttgcattgttattggattctactgtcatgagcttaggataaattggtttaaccaacaaccaactcacttgatgatgatgctattagacatttatcacaagacataaatccaaagagatgttctattaccaattagtccattgtaaggctaagatagagaaaaataatttccaatcagacaatagtgtgaggaaaacaaaataagttttcaaaagtcttaattccaattaaataataacttaccgcttcctcatctgcatcggaatcttcaagcccagctgctgcaagaagaccctgagcattttcctcagcatcatcattcatctgagtttggggctcctctctgtagtttatgtcagcttcttcatcctccatttcctgttcatccatcatatcattttcgggttcctatgtgtcatagcgcgattttgagtgcttatccttctttctccgctttccacctttttttctc

SEQ ID NO: 1180 - DNA, 448 bp, Glycine max
atcatcaagagtcttggtcacaaagcactgaaactgaatcatcggagaaagcaacctccagcgatgcaagtcatgggttcggtgatgcaacctccaccaacaccaacatgcatatgcaagtgcttcttaattatctcgatttattttatttttttcattaaacaagaaaatggtatatcgtgtattctatgctattttatgtgtgcgcaagtacgcataaatgttcattaatcttcttgggattttaatttgttgatatagagtaaattatggattcctttgacagaaagtgccaaaatagtgggattaagggaaagaatgcagaagtgagtcaaaggatcacgtttagaaccagatcgcaacttgaggttatggatgatggatataaatggaggaaatacgggaagaaaacagtgaagagcagtcccaacccacggaactactacaa

SEQ ID NO: 1181 - DNA, 397 bp, Glycine max
gataggtccttcatcagccaaaacagcacccctggtgccagcccgagttcgtttcaaaactttgagctttaaatttgtccttctgtcacagcccaaccaagaatcacacaaacaatagcaagtcaaattgtagttaccctctgatggggcctggaacttgcccaatactaatctagagccccctttcaccttctcaactgcttctgcaactgccttactggtctccttcacatttgctcctgacccctccatagactcctcaattgccttagatgcagcagttacagcagcagcttcatccatgaaactaaccttctgagaaaaccacacgttgtttgaaacagaatccgcaagcaaaaaccagtaattttcttccttatgaaatgggtagtaggga

SEQ ID NO: 1182 - DNA, 185 bp, Glycine max
tattcataagttgcagcaactttgaatggtgtagttctgcaaagaactttaagtttcttctgttctctcattatttgatataattctccacactgcggtttgcaaactggtcatacgaggtgaaataagaaaatcagcctcattgattcagttattcttttcttggtttgttctttgttaacccc

SEQ ID NO: 1183 - DNA, 382 bp, Glycine max
ctcttggataaacttttccagattgccacctggcaagtagttgtatatgagaaacatctcagtctcactggcatgataaccaatcagagtgacaagatttggatgacgaagccttccaagggtcttaatctctgcatggaattgttgagcaccttggaatcgtccaactgccagacgttttatagccaccaagtttcctggtactatctctgccttgtaggttgccccaaatcctccattcccaatgcagttgctagcattgaaatttcctgtggcccgaacaacattttcaaatgtcaatggaacaccaatatcagtgaacactgtaacttcttttcttgtagacccaacaaccctggacctaggattccacttccgtgta

SEQ ID NO: 1184 - DNA, 402 bp, Glycine max
gagaagcttccaaaaatcaccggcaaagaactcgtcttgggcaccgaatgcgccgtctgcctcgacgagatcgagagcgagcaaccggctagagtggtccccggttgcaaccatggatttcatgtccaatgcgctgacacctggctctctaagcaccctatttgccccgtttgtaggaccaagctggacccgcaaatcttcacttcccaaagcccctgctgaacaatgaagcattcattattcaaggaatgaataagggaagccaaattttcaattagtaatttcataattatctttattgttttctttgtcagttctttatagtttcttgaacttccgttactaattattattattattattatgtgtcgtgtagtggttcagtggttgtggtgtgttata

SEQ ID NO: 1185 - DNA, 927 bp, Glycine max
  misc_feature (909)..(922): n is a, c, g, or t
tcttttgcatgcgcttgatgtctaatgcggatatctttccctgaatagaccgcaagtaatgagaatcaagaagtataaatgatgtatatagcagtgaagaactttacatttttatcatgatcaataatatggaaagctttcatgagctcctctttagtgtccctttctcctattttggctgtcatcatgtactcaaattcttcataatcaattgctccacttccatccttgtccacatctgctatcatttgattgatttgctgaaatgacacggtaggttatctatctattagaaatgtgcaacagaactctaacaaaaggcataatgtacacaaaccactgcaacactaaattttattttggatttcattacaagaaattgactccctgaagctgaataagaagaagaataaccgcatcccacaggtaaatgttaaataaaacaataaaagaggaggggcagggggaagttagcttcagctatcatggacaagtaaagagacagatggctcccttccttgtgacaaagatctggaattcttggaggcaatcatcgaaacccattcattgcaaaattcaattaaatcataagaaatattggtataaggataatacctcttctgtcatctcaaatccaagggccctgccaagataaggtggacatcaaaaaaacaacacagccaaacaatacgacaaacattttaagactatgaacaacaacaatacctcatagcaacattcagctccttggcatcaatagtacctacaaatcatcaaagtaataacattaataaataaaaacagaaaactattggaccatagatttattttgatgataaagtgtatatacaaaacctgagccatcagtatcaaataactcaaaggcttccttaatctcttgcttcttcnnnnnnnnnnnnnnatgac

SEQ ID NO: 1186 - DNA, 344 bp, Glycine max
  misc_feature (266)..(266): n is a, c, g, or t
cacaggtgaaggtctaaagaatctcctcctttccctcttgatcttcctccacaatgctttccagcttcccatcttcaatctggtcaccaattcgttgacacacacaatgggatcgtagccaattctctcataacttgaccaactcaaattgctgttgcttcttatggtgctcagacagtgacaattttcaaggttcatggtgtatagaactagcacagagaaccttgggagcataaaatggtttaggggaccaaggtgtttgaagngcatgcaccctggctatttatataatgaaaacataacaattaacatacccctctttttatcaactcatcaccaccacc

SEQ ID NO: 1187 - DNA, 662 bp, Glycine max
tgagcagctgaagggtccctctcctcctcctcttcattgaatccaagatcatgttcaccatgtgttggtgaaccaccatcactccctttctcatcttgagacttcacctcatcattgcctaccatttatcattgaatcgatcagtttcactaccattaacaattcatcaaccaactgaattaaccccccaaaacataatcaatcattaaatcattcacagatacacagtaaaatctaatctttattgaatgaaaaagactagcaagctgcatattcccctcaaatgaaaaggtacccatctgcccaaaaagaccaaaaataaaaaataaaaattgaaaagggttaaagcttcgcatgcataaagttgagtagtgcacagtgaaagacagtaccttgagggttggtggttgaagggtggttggtgttaatttcagtttccttttccttctttttcttggcagctttcctcttcttagcacctgatggcatgattaaggctagggactaaaatagagggcagccacaaatggtgggatgttgtcctctctctctctctctctctctctctctcacttttttagagtgggcaacacaacacaaaggatatggaagtgttgttgtacaaggcaagttgcacaaaaggagaagtaggtagaagagga

SEQ ID NO: 1188 - DNA, 585 bp, Glycine max
  misc_feature (556)..(557): n is a, c, g, or t
  misc_feature (560)..(561): n is a, c, g, or t
  misc_feature (569)..(569): n is a, c, g, or t
acgaatgtgcctgggcctatggcatgaacatttttgatttggaggcttggaggaagaccaatataagcaatgtttaccattattgggttgaacaggtatttatatcttgattatcttccattctaccttaataatataatgacaaagaaaaaataagtcaaattactttagatatatttctaatttgtcattaaaattggttttccataagagtgatagttgatataatattgatgtttctggtttgctttatgtagaatatcaaatcagacctgagtttgtggcagctagggacattacctcctggattgatagcatttcatggttatgtccacgttattgatcctttctggcatatgctgggattgggatatcaggaaaatacaagttttgctgatgctgagagtgctggtgtcatccatttcaatggcagggcaaagccatggttagaaatagcttttccacaactaaggaaattgtggacaaagtatgttgacttctcagataagttcatcaagagttgtcacattagggcatcatagctaaaaaaaaaggnntcnnttgggggnggaaaggggttttttt

SEQ ID NO: 1189 - DNA, 676 bp, Glycine max
  misc_feature (612)..(612): n is a, c, g, or t
  misc_feature (626)..(626): n is a, c, g, or t
  misc_feature (635)..(637): n is a, c, g, or t
  misc_feature (656)..(657): n is a, c, g, or t
  misc_feature (668)..(670): n is a, c, g, or t
agtccaagatatttaaaaaacttttaagtaaaacttattatttggcatttaagtggctttcttctttagtagttctgtgattagttatgtttattaggaggaaaaagttatgcaaatcatttttccaatgacatttctttccctgaagaaagtattttttgtccatggaataaaggaacacttaaattgaaactgtaggtgtctacttcaagaaggcgctctttgtaccaagtttatctgtttttaataaagttggaccccaggcttttacaccgactgattccaaagttgatctgtcatggcagtttagtcttcaaagagtttgggaaaatctcatgcaaggcagcaaaggtagtgattattcaagattgttttgtagctatggaatatagttagaaccatagatgttgatggcaactaccaggtgcagattctagtctgtgtctttcaatggggttggctaaatgatcaatcaatggcactggggtttatcaaaaactcatacaactatcaagccttttccactagatgggattggttacatggatcaaatgacataataatgtttatagttttaactgaaccaaatttcaataaaccgtttgttgtctngtaagttaacgatnctcttgaannntacttcaatatttttctanncccttttttannngacaac

SEQ ID NO: 1190 - DNA, 647 bp, Glycine max
caatctcaaatctaactctactcaattccccatcatggaatgttcatccagtttacagcaggtaatcccacttcacttgtattcaagtcttataaaaaaatgtcattagatatactgatatagctactttactctcttattgtctttgaatattataataacaaatgatttgatactatgcagcaatattattgtgcaaggcatcaccatttatgctcctgtcacatctccaaacactgatggcatcaacccaggtcagtatttcatgatcaacttcagattcttcaaatatagaacaatggatagcaagcatttgatacaatgtaaccaaagaataaaagtttgatttgaattgctaatatttgctctacctatgtttctttcttttatctttttctcaacagattcttgcacaaatgtaagaattgaagattgctatatagtttctggggatgactgtgtggcggttaagagtggatgggatgagtatggcataaaatttgggtggcccaccaaacagctagtgataagaaggctaacatgcatctcaccatacagtgcaaccattgccttgggaagtgagatgtcaggtggaatccaagatgtgagagctgaggacatcacagcaatccaaacagaatcaggtg

SEQ ID NO: 1191 - DNA, 765 bp, Glycine max
ggtttgatctgggctaagttccctgaggtataattatgaatattatgcaataaactaacatgccatttattttcttaatggaaagttaacaggagtatgttagcatatttgttcaatcatacattgccatctacagcccaatgaatagtataattcttatgtggggagaaacgggacacccagaaaatactattgctgtaacttagtcttcctgaaaaactaaaaagatgttgatgcttgtgagtatagtcataactcataagtgagataaacctaggtgggttatggagttattgattctagtttaaaaaaattgcaaaatgaaactatttgacattctaaattgctgtaatctatatctgcttttcatttatttctgtattgtttcaattttttgcatcagtcaacatgcccttgatgttggtttcttattctatttcagttctacaatgcttcaaatactatcatgtttgatgaccttagaagaaattttgtaatgaacccacagaatggtttgacaattaaaccattcaggaaggctcatgccaaccgagatagtgatcaagagcttgtgaaacttacccagtacttactagccattgcagagcttgatgacttgagcaaccttgatcataataattgggagttattcacagaggacaatgctaaaagacgtaggcacagataaatgataattgaatgcaataactggaatctggtaagcaagatgcagcttctagacttgtaaaaaattgcagctttata

SEQ ID NO: 1192 - DNA, 644 bp, Glycine max
  misc_feature (432)..(439): n is a, c, g, or t
  misc_feature (538)..(538): n is a, c, g, or t
  misc_feature (540)..(540): n is a, c, g, or t
  misc_feature (546)..(546): n is a, c, g, or t
  misc_feature (551)..(558): n is a, c, g, or t
  misc_feature (563)..(563): n is a, c, g, or t
  misc_feature (565)..(565): n is a, c, g, or t
  misc_feature (641)..(641): n is a, c, g, or t
tcgccatctcctctcgtttcgccaacacgaccaaaagacaacaccagctcgtccgttctccttctttgctagaaaggcttgcgtcctttaacctttgttatcacaaacatgaaccaacaacaaggatgatgacgacgacaacaacaatgtttcacagagttgtggacccagtcgagcgtctggatgaattcagactcgaccaggtcccctcctcgtccttgttggacagggttaggtctttcaacctggggttttataagattgataatattgaaagacatggtccggtccataattctgacttgccccaactggcccagctggatcggcttccttcttcatctttgttggaccacgtcaagcctttaaatcttagtaactttcctggtacatccatgttgcaaaggaagatacaaaattaataattggtcnnnnnnnncaaatatcagtaaataaatatgctatcttataacaaaattttatacagagaagtactacacaagaaattttacctctattaaaagataaagtgaacaantntgggtntctgnnnnnnnnattantnacatttttgctggtgtaactttgttttcctccaagtgcaaaccagaaagttgaggtttctgttccttctttagcangtt

SEQ ID NO: 1193 - DNA, 367 bp, Glycine max
tacgattgggttcctaactctgatgaacatcaggtaaagagaaaagagatttcaatagatactagtatatactatgtatgtataatgttaaactaaatagccttatgttctattatgttgcaagttttaacaggtttttgtctcctccaagccaaataggagcgagagtacttgaagatatgctaggtgaaaaattggaaatgggttatcttgtaccagctttttcttattactgtttatgtctatttggtgtttacaaattacgggaggtggggtggggtggtacaactgttgttgtataatactatagtctagaagagaaagtagtttcagaatgctacaatttcccgtgatatgatttccttct

SEQ ID NO: 1194 - DNA, 366 bp, Glycine max
ggatcaggcaaaggccatggggcaagtgggccgcggagataagggacccacacaagggtgttcgtgtctggctcggcaccttccccaccgccgaagaagccgcccaagcctacgacgacgccgccatacgcatccgcggcgacaaggccaagctcaacttcccggccaccaccatttccgccgccgccgccgctccgccaccttccaaaaagcaacgctgcctcagccctgacatcatcactgaagaaagcagcagcagcagctcacattccaccactggatccaccggcgaaagcggcggaggaaacgacgaactcgacctgaaacaaattgaatggtttctaggtttggagaatgagctgcctg

SEQ ID NO: 1195 - DNA, 501 bp, Glycine max
ttctcgccttcctcctcggcttcttccttctcttctctctcttctctctcatcctctggtgtgccagccgacccatgaagcccaaaatcctcatcaaggttcatttcttcccaattttttttgtcttttttcttgttctataatgggtatttctctattctcatttttaccttctgggtgctaattgcagagtataaaatttgaccatctcagagttcaagctggttccgattccagcggagtagccaccgacatgatcaccatgaattccaccgtcaaattcacttatcgcaacactggaacattctttggggtccatgtcacatccacacctttcgatctctcctattcagatattgtaattgctacgggaaatgtaagtatatacacacaaattgatcacattattaatttaattatttgatttgatttgaattgatgtactacgcagttgaagaagttctatcagtcaaggaagagtcagagattagtgagtgtggc

SEQ ID NO: 1196 - DNA, 383 bp, Glycine max
atttgatgaaaaatggataccaaaattcatcaatggactccgctaccgttacccgccggtgaaaactctcttgtcgattggaggaggtggtagcaactcaaccgcattctccctcatggctagcaacaaacacacacgacaagtgttcataaactccaccatccacgtggcgcgccaatacgggttcaatggtctcgatttagattgggagttcccagatgatgaacacgatatgtcgaaccttggtgttttgtttcaagagtggcaccaagctttggtggtggaagcaaaaataagtagaaaaccgcggttgcttttgacagccgcagtttactatgcttccaccatcaaactcatcggtgatggaccaagatcatatccag

SEQ ID NO: 1197 - DNA, 808 bp, Glycine max
aaaagaaaaagaatctcagctgtggactcaatcactaagaaggagccgagaagctgaacctaaatccagttttcccacgatcatgctcattctgcttgagtatgtaatagaaattaccctgaaacaattagaagtgtgtcaatgaagaaatcataaagtcttgataaataacaattaaataccaaattagaagggaggtcaagtaagtgccacatcagaaaagagattggataattttgtcaaacattgccaaccttacaaccacaactggttgtttctctaaattatattattatcagtacatagttgaaagagtaaaataaataaataaattatattcaggtgatttgcaacaatatcaaaacttggatcaaatattgttgcagataatttataagattaagtgctaagttcagacccaaaattaaggaaaataaaaagaaaaattacacaactagcccaaagtccaaatttaagaaataagactacctatcccaattcccaaagtcttctacgtatccctccatcattaacatttcacttcaattattcccccaccccccaaaaaaaaattggttcctttgatcccctgctcaattaatataaactataaagaaactgaaacataaactaacctctaggcgaaaaagtctagtgggaacaacaaatccacatcccacagatgttcgaaaggattctaagaacttccgaggtgaaaagtgcttatattcattctgagttaatttagcagtattcccagcaccagcaaaaacatgaccatgaattccatgatctctcaaccacctaa

SEQ ID NO: 1198 - DNA, 368 bp, Glycine max
acatgcacagcacaattcaatgtatcttgctactgacatcaaattttagaacagtaattttgtatggcattcatgcccatataagacaagttacaacatcattattaaaatgccacccattaaatcctttaacctaaagttttaatgatattttgtttcgtgaaggaataaagctacccccaacatatatgcctcctccaaatctcagcataaaccccaaaaaaaaaaaaattggttccaaaaaaacaaccttgggattcgggggaaaaaaaaaaattttcctttcaaaatggaggaaatttcataagggaaacccccttgaaatttggtttgaatttcaactccacaaaattgggaaaaaaaaaaaa

SEQ ID NO: 1199 - DNA, 395 bp, Glycine max
tgatggactactctgggcataagaaacttgcatctgaagatatctgtgtgaaatttctcatggcggcagcatttgtagcaagtgatcacaattttgggctgcagagaaagtgctgcaacaacatggggcaaccttgatgtgaacacatgaatggttttatgctaccctgggggcatgttagaagcaacctatttaacagaaaggcgtaggaccataggaaagagagttcgtgattattttttcccatgtatgttttattctttcttgtcactcttcttgatttgataaacccaaatgatgtcttcaggtttgatatctacatttttcacgcgcattctgtatttttaaggaaatagtgaacataagagtgacttgtatacgcctttgatgcaatc

SEQ ID NO: 1200 - DNA, 805 bp, Glycine max
  misc_feature (723)..(724): n is a, c, g, or t
tgtgggaaaaagcactacacaacaataatttagaagcatcattaacaccgaagaagttacaaagctagaaggaaaaattacaaatttacaagtgacaaacttactagttctgggctgaattttgaagtgcaggatgagggcaaattctttgctgagccctataataatgattataaaaaaataaaaatcaatctctatctaaagaaagttttagtcaatagaaaataatcaaaagagaaaagacatgcaagtacatgagttgaaacaacttcactgtagaacttttcgatgaaatgtgttcctgagatatcctctctggtgtacaacaacacattaaatcattcaatgatctaaggaactataaaaactaagggaaaagagtgagtgaaagccaattagaggagcatacacattgacaaaataaccagcatctggaacacatttcacattagcttcagaaggcaacagatttttaaagcgatcacagtgtaatattgtagtcagtcctccagctgaacagccagagagaatagcctgcaaatacaagtttcagttagtactgaaagaaaaaaccaatcagaaggaagaaaaaaagtgtcaagtcatcaatgtctcgtacattttcagccttttccaatccttttgctagtaattcttccattacagctgaaaaaatccttgctcctctgaagtgcaaattggttgtctgatatatatacatcnnattatacaaatctcattagaaagaaaattggaaaaataaaatttacaaatgcttaatattttccttgtaacttaatttcga

SEQ ID NO: 1201 - DNA, 360 bp, Glycine max
tcagccctgttttcagctacagcgttgatcccatcttggcggtcataacctcctgcggctataaaagtgccattgaaggcctttctcataggcaccaggctatgagggcattcagttttttctccaacagtcttcattcttggttccaccatgtgacagtaaagaataccatacttattgagggcattcatcatgtaaagccccaattcttttggattagagtctccagactctgaatattctgcgaatggcgatagcctaattccaactctgtccgcccctatctcattaacaacagcttcaacaacttccaaagcaaatcggcagcggttctcaagggatccaccatattcgtctgtt

SEQ ID NO: 1202 - DNA, 374 bp, Glycine max
ccatacatatctttaagtttagcaagattactcgaagcagaagttctcttactctcctctctctgaggactagatcgtgattcataccaaccagtgccagcttgcaagctccgacttctactcctgctcctgctccgactcctgctcctacgatagtgcctactaccattgtcataatcccggctgctttctctctctgtgtacttagacctcttgtcataatcgtaaatcctctctctctctctttcccgctcattattcctcctgattctgtccctatcctgatctctttccgagtcatgatccctgtatctttcccggtctcgatctcgatctcgctcccactccctgttcctatctcggtcacggtatat

SEQ ID NO: 1203 - DNA, 511 bp, Glycine max
attgatgcccctcaaccaggtcatcatcatcttcatcttcttccattgatagcaacaaccacccttctaggactaggactccaccaccctcttccccttcatcaagtgcctgcagaaacagaactgatttgagcactgacctcagacttggtcttagcatctctccttcttctcaatctgaattacccttcaattcaacaccaaggtacatacacacctatccatttttctacaccaaaatttgctctctattgcacttttttttcaaagctaaagcctaagagctttaatttaattttattttttgttccttaatcttgatcctattgtttgtgttgaaaatgtacatgcatgcatgattaatagcattaacatgttaatctgttaattatctacccttcagggaggaaagttttgactggccaccaattaagtctatattgaggagcacccttgtggggaaacaaagccatctgagccaaagaccctccttgtttgtcaaagtctacat

SEQ ID NO: 1204 - DNA, 699 bp, Glycine max
tatctcattttgtctcattatggcttctttctcgatcactgatttctcttctttgttaattctcaaagaatcactctgcaataacaattttaagatttgttgacttttttttacccaatatatgtgattcttcatattattacttctgtggaagcctcctcttatgatttagaaacctgcatttttctaaaggatcttttattaaaatcatgagcgttgcatatttgttacaacttacaagtgaatgcatttccctctgtttctaactttaacgtggttgtgtctgtgtatgtgtatgaacctaatgaaatataaggttggcaacctggaattccagagggagcagctctttgggatgaagagtgggataaatttgaggatgaaggtagccataactgtttctcttttcttacaaaattattttcatgttttgcatgaattaacttgttttattaatttctttgtttatttctaggatttgctaatgatctcacttttgcatcttcaaaaccgaatcctgcatttattgatggagaacaaaatttatctgatgataattctgttcatggttcacctgtgaatgcaaatgggaagcaagaaaattctgctaatggtgattatacagttgaggatgaatcctatgcacacagtgaagatgacttggcaagaagcccccatagtctagctgggaggagtacg

SEQ ID NO: 1205 - DNA, 369 bp, Glycine max
ctgtatacataacaaagaaatgagaatgatactttggtagaaaacaaaactagtttaataatagctcacagaccattattattattattactattattttctgaatatgtctgcttttctatggaaacccttttgactttgccaaagtgtacaatcttgtacttcaggtttactatgttgctggagagaatcttaaacggatatagtgggcaaaagtttgaagttcaaatcccacagctcaaaattgccattaacgaaatcataatgtgctcctttcaaagccagagttttgttaacaacaccatctctaacaaatggatatgttaataggttaccaagtgatacattcacagcttccttctcacagac

SEQ ID NO: 1206 - DNA, 403 bp, Glycine max
tgctggtgctaacttcagggtcgtgttacagtggcttctgttaaaaactttcaacttgtgtctgctgttgatccatctcataatgtttctgctgcagagcaagaaaaggtaatcttgcagtttggaaagattggaaaagacatatttactatggattaccgttatccgctctctgccttccaagcctttgccatatgtttgagcagctttgataccaaaccagcctgtgaatgagaccaatggcactggatcatctgctggagcaccatcgataccaaaccagcctgtgaatgagaccaatggcactggatcgtctgctgctggtttgtatcatatatataatatgctaggcacagttaatcaggcctggtgggcatgcaactgagatcttggctatgaagta

SEQ ID NO: 1207 - DNA, 370 bp, Glycine max
aataaaacctgccaaatctcattacacacacagacacagtgcatgtgcatccataaacatcaagtaatgaggtaatctaaagtgggaaaaaatgggtgtgggtcggttcaaaccgacgctgaagaggaagagggttccgatgagggtctggttaagcttccaaaaatcaatgggtgtcctcgtgggtggaaaccatacttcctccaggttttgcactcgctaatccccctctcttccccccttcggcttccgatttttctctctcaatctttgttcatcaaagtgctgcatctctctcactctcttacttaactcgacaacttcagccacattattccatggatgccaaggtattcaaattccagatcca

SEQ ID NO: 1208 - DNA, 677 bp, Glycine max
gagcgttctcaaccgtaagtttctcttctctctcttcctatcacgtctttgcaacttcaaaattacttgattcaattttttttttcattcattaggtcgtcgaggaaaaaattcggcctgttagaaaagcacaaagactatgtccagcgcgctaaagcattccacaagaaagaaggcactttgcgggtacccttttactctttcctcttccttcaacttctcattccttccactgttaacaattttttacagaaacttagggaaaaagctgcaaatagaaatgaagatgagttttacttcaagatggttagaacaaaaaccgttgatggagttcataaaccagagtaagtgatggcttgctacatgcctatatgcccttttcgattttctgttatttgttgtctttcttactgtgttgtgttgaattgtgtaggagtgaagcgaataagtacactcagcaagagcttatgctgatgaagactcaggatatgggttacattctccagaagattcagagtgagagaaatgtgggaacttatgctttgaattgctttcttgtttttattggggttttgtgtgaatattgtaataatgtaggtttcattctgaatggtttgatctttgttgcagaaaattgaaaggcttactgcctcgctgcactctatcgataaacagcc

SEQ ID NO: 1209 - DNA, 292 bp, Glycine max
tgggaggagtgttatatgtagtttgtacccggtgacgatggaggagaagaggaggcggtggagggggtgtttggagacggtgatggtgacggcgaagtgatcggagggtagcaatccgagcatggtggagatggtctgcttcatggagtctctggcggcgggggacacgcctttggagatggcggagttgtcgaggggctcgatgcggcggagcatggcggcgatcacggtgaagccgcggtcgaagttgcgggtggagacggcgtcgtcggagaggcaggagggaaggaag

SEQ ID NO: 1210 - DNA, 423 bp, Glycine max
  misc_feature (385)..(385): n is a, c, g, or t
  misc_feature (387)..(387): n is a, c, g, or t
  misc_feature (407)..(408): n is a, c, g, or t
  misc_feature (415)..(416): n is a, c, g, or t
caccggagtggttacatatgcaggttggagatggttttgaaagagcaacgtagtctttgaaatcacatcacctgacaataaatgcatataggatctttaatctctctatcagagctcccataaatcatatactcaaggtgttgttgctaagtcctatagacacctcattcttgttttctacaagagaggcatggagctgttatttgtttccacgggatcacttcagttagtacgcaagtaacaacatttgttagtgtgttggaaaatggattcatttacccaatatgtagtttagtatgctgatactcttcataacctttaaaatgattgttattattcttgtaaaagaatgctgcttgtcctgaatacatatagggtaagtgantntattttggagcacgctaccnnatgttgnngcttggg

SEQ ID NO: 1211 - DNA, 549 bp, Glycine max
  misc_feature (62)..(62): n is a, c, g, or t
  misc_feature (478)..(482): n is a, c, g, or t
  misc_feature (538)..(538): n is a, c, g, or t
  misc_feature (540)..(542): n is a, c, g, or t
tgggtgtaagtctcccctaacaaacaaagcacatgtgattagagggaaggtcttatatttangaggagcaataaaatgaaatactaaaacaaataaaattaccattcacatagtgagaagaagattggacgaccagccatcattaaagcccgagtcataatagggtatctattcatatgaagacaattgttttaaaaaattatatataaagaacaaagtgttatgttaaaatattcaatttgatcaaataaaattaacactaagtcgcaaatatacttatgactacctatcagttggttttgatccatcattgttacagttatcatacttcaaataatcaataccctgtaaataaaccaaaatcaccatttgtttaattgcattaaatatgatgattccaaggaaaagcatgaataaatgagcacaatgtttcttacccatgatgcaaaagtcttggcatcttgaaactcatgaccannnnnaccaggcatctgtttgctacaagtaaaatacctgcaaaattgaccaacctaaagcntnnnttaaaaa

SEQ ID NO: 1212 - DNA, 376 bp, Glycine max
tagcaaaccaaattgcagccgaaaatagtgatcaaattagcatatgctgaacttgttggatctttagagagaacctatacatcatgacattgattacattacatactaaaaagtaagcaagaaacacagttggaacaacatgatgatgaaattaaatcagccaaagaatgcagggtcatagccattgctagtggtggccaagatgtagtaagcaacaacatggccaatggagccccaagccaagacatcaacaatgttgaatccaacagggtcattggatttgaggaggctgacatactccttggcacgtgtatcaccagcctcaaagtgtgtgaggccgttctgctcaggcacttgctttgccacgttctccctt

SEQ ID NO: 1213 - DNA, 547 bp, Glycine max
ccatgtcaacctcatcctcttcccaaagcctcaaaattggcattgttggattcggcaactttggccagtttctggccaagacaatgattaaacaaggccacactctcacagcaacttctcgatctgattactctcaactttgtctccaaatggggatccattttttcaggtaaatcaaaccaaaccaaaccataccatgcatgaatacatatatacttgatccatcacatacaatcgaccagtaatataataaaaaaaatgtatataagtaaagaacaagtctatcttgtgaagttatgtctaaaggcaaattcttagacattccatgatccatatttcaaacattgcacagggatgtcagcgcattcctcgccgcagacatagatgttatagtgttgtgcacatcgatattatcgctatccgaggttgtagggtcaatgccactcacttccctgaagcgaccaacgctctttgttgatgttctttctgtgaaagagcacccaagagagcttctactacgagagttgccagaggattcagacataac

SEQ ID NO: 1214 - DNA, 871 bp, Glycine max
  misc_feature (694)..(711): n is a, c, g, or t
  misc_feature (713)..(750): n is a, c, g, or t
  misc_feature (756)..(765): n is a, c, g, or t
  misc_feature (767)..(772): n is a, c, g, or t
  misc_feature (775)..(777): n is a, c, g, or t
  misc_feature (780)..(793): n is a, c, g, or t
  misc_feature (801)..(806): n is a, c, g, or t
  misc_feature (810)..(816): n is a, c, g, or t
  misc_feature (818)..(818): n is a, c, g, or t
  misc_feature (831)..(831): n is a, c, g, or t
  misc_feature (833)..(839): n is a, c, g, or t
  misc_feature (842)..(851): n is a, c, g, or t
  misc_feature (854)..(857): n is a, c, g, or t
  misc_feature (863)..(868): n is a, c, g, or t
gctgctaagagccaatttatcacacacacaattggcaggtatgcagcctccttaatatctaataaacgaatagaaaagcactaatgtaaatgctcactagatgcaacttttggctgcttcttgatcaggacattgggagaaatggatattcaatccacacctattgacactaagggctttgagacacttgttaaattggtaaagagttgtcaacatttcccccagttcctctaaaagttttcctttatatgtggttatgtaacatatggaaagttacttgcagaaggagactatgatgagaaatagttttgatttgtacagtggattattcgtgtataacagattcgccagacaagaggtaatggaactaccagcgaaatgcttatttacttttaaattcctttttaaagcattaaaccaagtacctcaagatagactcatgaattgtgaattgtgaaaaatatgcagttggaaaaccttgaacatgccttttacaaagtcaaagaaacgctgatgatacaaaggtcgaatggggagcagggtcataaaagaaccgaaagttgatgcatatatattttataagatattttctttaattatcaaattcctcctgtagttccaatcataaattactcacatttcggttttctagtaccaaattgaagttcaaacaacaaaccaaagagactggaannnnnnnnnnnnnnnnnnannnnnnnnnnnnnnnnnnnnnnnnnnnnnnnnnnnnnntaaatnnnnnnnnnnannnnnnttnnntannnnnnnnnnnnnnctctcttnnnnnncccnnnnnnncnatcttcttccttncnnnnnnnccnnnnnnnnnnttnnnntctttnnnnnnttt

SEQ ID NO: 1215 - DNA, 244 bp, Glycine max
  misc_feature (157)..(157): n is a, c, g, or t
  misc_feature (163)..(163): n is a, c, g, or t
gatcttttgctgattttcaacttcgcattgacacaagggaagtacaacggcagcaccatcacgttcactgggaggatgcccctctcggagaaggtgagggagttgcccattgttggtggaagtggggtcttcaaatttgccactgggtatatggagnccaggnctctcagttttgatccccaaacgaggaataacacggttcagttcgacgtgtatatttactattgatgaatgttgaatgtgt

SEQ ID NO: 1216 - DNA, 602 bp, Glycine max
  misc_feature (462)..(462): n is a, c, g, or t
  misc_feature (464)..(464): n is a, c, g, or t
  misc_feature (469)..(469): n is a, c, g, or t
  misc_feature (526)..(526): n is a, c, g, or t
  misc_feature (561)..(565): n is a, c, g, or t
  misc_feature (569)..(569): n is a, c, g, or t
  misc_feature (582)..(582): n is a, c, g, or t
  misc_feature (585)..(593): n is a, c, g, or t
  misc_feature (595)..(595): n is a, c, g, or t
  misc_feature (597)..(598): n is a, c, g, or t
cttcaataggactaggaacttcatccttctaattttcaaggtttgaattatcatcttatttcaatcatgagctaccttcctgtttatcatcccatcacagtatacgtgttttctccactgcagaggtattttggcaatggacgaatgtgttgagtgtgtggccagttctaagttgatgtgatcgataatcaaatattttttgggttacatctgaagctctcattagtagaaagttgcttcgcctttcagggtgctttagatatgtatgcgactttgctccaattatacaagtttgtgcatgacgaatgattaactaaattcttttgcgatattgatatcccttattaagtgcacttgtactggatagaagttaacggatactggatcacttgttcattctcccccgatttcccccatctcactctttgtagtatttctgcgtgtctttacctgagataaaangnaaagntaaacaggaaggtagctcatgattgaaataagatgataattcaaaccttgaaaattngaaggatgaagttcctagtcctattgacgagttcnnnnntctngtctttcctttanatnnnnnnnnnanannaaaa

SEQ ID NO: 1217 - DNA, 602 bp, Glycine max
attttacataaagaaatattagaatgcaatccatgtttttgttgttgctttaaatttaaggtcaattactaagcctggatgaatagaagatccttgatcctagactctcaacctttttaatgctaaggatattatcacctaggtatatcttttatttattttatgtacaaaaagtggggaaaaaaatttaactgattcctctggcttcaggccaagatgaggagttcatcctggtgggtcaagtttttcctccagattaacttagaggagaatgaagctgctgttaagaagtttgaacaggcttcaaccaagagttcatatgttccaaaatgccagatattccacttgaagtcactccattgactcgtgggatggttcagcattggagctctgattgctgcttctccgttttcatttaaaacactttcttctctataaaggcaatttaattctttgaaatatactcgccatagatggtgtatcgcttttgttgatagatttttattctttgaattccagcccctggctgtaaaagacaaatcaatttagtatttttactaaattattagttgaattaggcgatctataagttgcagtgattg

SEQ ID NO: 1218 - DNA, 376 bp, Glycine max
tattactacaacaagttatcgtacgaagatggatttgcattttgatgtatttgcacctgtacttcagaaggttcgtcttatggggcggttaaagaagttcccaaactgggttgccaagctccaaaatcttgttacgttgtccttgtcattcaccgagttgacacatgatccattgccactacttaaagatctaccaaatttgacgcaccttagtatactccttcatgcatacattagtgaagttttgcagtttccaaacagggggtttccgaacctaaagcaaatactactggcagatttgtttggattgaaatccatcgtaattgaagatggagcattgccttctctcgaaaagctcaagttattcaggattcgc

SEQ ID NO: 1219 - DNA, 598 bp, Glycine max
attgccacaatggttaaaggtcgccaaggagaacgtgtaaggtttgcgatcttactctttcctttcatttgctatgtttatggcatcgcttttaatctatgggtttagtgtctcctaataataatttgattttcacaaattttagcagttgttcgtacaacatgcgtaatgcacatatcatgaatatttgttaacgttatcgttgtttttcttgtttttaccagactctacgtcaggggttcaattcttggatacaagaggtgcgttttatttattattaattaatttaaaggttttctggagattgtacaataaacaacagtattaggtttattgattttctcataaatagtttcaatctgtgccgtgtattggatattgatattgattaatggtggtgttgttcaggtccaagtcaaatcaatacccaagcacctccctaatccagattgagaatgtaaactctaaggaagaagttgcgtggtactgtgggaagcgcatggcttacatctacaaagcgaaggtaaagaagaacggaagccactatcgctgcatttggggtaaggtcaccaggcctcatggtaacagtggtatagtt

SEQ ID NO: 1220 - DNA, 870 bp, Glycine max
catttcctagtatctctttggtttatcatatcttgcattctgatatttgatgtgttgtgtggaagaacaggtatatggtttagaaaaactgcactccgctttactgcaaagacctaaaggaaaacctcttcttacggtacgtgctcttccaagttgtggaatgtgaatctgtgtgtgtggatttaattatttgacggagtgattggttttgattattcatattcaggtcagcaatcatgttgcttccatggatgatcctcttgttattgcttcgctgcttcctccgagtgttcttttggacgctaggaatctcagatggacgctttgcgcaactgataggtgttttaaaaaccctgtgacttctgcattctttcgatcagtcaaagttttgccagtttctcggggtgatggcatttatcaggaggtatggatccacagacagtagctaataagtaataactagtaaaacattaacttttgtcatgtaatttgaggctttggactctgacaatagttaaactctggagagatttgtggcttttggtaaagatctcctcactgttcttagttcttaaagtttattactctcctatgacttgaatgattcaatttatcttctggtgctgtcccgttaacaatttttgcaagtccttcgtgtccttcctattctaggggtgctttttatttttttgtagtgttttcaattgactatatctgcctctatctgtttgtattgatatttttctctccttccctatgtctcttgctttgttcccctttgcctctccaaactggaacttatgtggtttgtgatgattgtaattccatctactttctctgctgtagggaatggacttggccatatcaaaa

SEQ ID NO: 1221 - DNA, 402 bp, Glycine max
gataagtgtgatatttacagttatggagtgattcttggtgtattggtcattggtaagcttccttctgatgatttctttcagcacactgaagagatgagtttggtcaagtggatgaggaagactttaagctccgagaatcccaaggaggcaattaattcaaagctgctggggaatgggtatgaggagcagatgcttcttgttttgaagattgcatgcttttgcactatggatgatcccaaggagaggcctaacagtaaggatgttaggtgcatgctgtcacagatcaaacactgaatctgctgtatgtttaagtatgtgaaatattgtgtaccatatttgtgccaaagtgtgcttgtttaagaatatagttgataactagaggatcaatgttggttcataggg

SEQ ID NO: 1222 - DNA, 615 bp, Glycine max
  misc_feature (450)..(452): n is a, c, g, or t
  misc_feature (585)..(587): n is a, c, g, or t
  misc_feature (594)..(594): n is a, c, g, or t
  misc_feature (604)..(605): n is a, c, g, or t
cttcactacccttgtctctatgggctttgacaggaattctgccagacaagccctagtgcaggccagaaatgatgtcaatgtggccaccaacatcctactggaggcacagtcgcactaattccataaatgtagcgcataaatgagagccggattgttctgaattgatagatggaatcctaatcaatgaaggattagaaattcactaatcatgatgtgaggatgtttgtgaacttcaggcattcctatatagtatcatcctcaaggactcctgctttctgaggatcatttttcccaccttaacttgaatctttagataaaatatcttgagtactggcattgatagacaaatgagttaggatcctgtacaaaatacttgcaacatatggaaaattatgcacatttttatgaagtgtgaatcagatatttgtagttgcaggttcttctgtgcannnggatcctaactcatttgtctatcaatgccagtactcaagatattttatctaaagattcaagttaaggtgggaaaaatgatcctcagaaaggaggagtccttgaggatgatactatataggaatgcctgaagtnnnccaactnccgattagtnnaatttaatct

SEQ ID NO: 1223 - DNA, 407 bp, Glycine max
atcttggagtgcttgatgtttacatacatcaggccagggacattcaaaacatttgcatataccacaagcaagatgtttatgctaagatttgcctgaccagtaatcctgagacaactgtgtctaccaaaaccatcaatggaggaggaaggaaccctgtgttcaacgagaatcttcgtattgatgttaggactgttgatgcttctctcaagtgtgagatatggatgcttagcagggtgaagaactatcttgaagaccagttgcttggttttgctttggtacccttgtctgaagtactagtccagaatgggaaacttgagaaagagttctctctttcttcaactgatctattccattctccttcgggttttgttcagttgtcgctttcttacactggtgcttcacctgat

SEQ ID NO: 1224 - DNA, 547 bp, Glycine max
tcttgtcaagttttgcaccgttgaccattcttagtatagtcttgttagtagtcggagtcattgtcactggggcgaaagctaggccaagagcattctttgtgtttggagattcacttgttgatagtggaaataacaattacttggctaccacggcacgtgccgatgcccctccttatgggattgattaccctccaagtcatagaccaaccggtcgtttttccaatggctacaacattcctgatcttatcagttaagtttagatatctctagtcacattttgaaccatttttggcttcaatattcatcttttaagcttctctttcatcatgcacatttgaagttttgaaccctttttggtcatgtagctttgcatataataataaacttaacgtagacacgtaaagtgtatgtctaactagctgggttgttttcaggtcagagacttggtgctgagtctacattgccatacttgagtccagaattaagaggagataagctcttagttggtgccaattttgcttcagctggaattggaatccttaatgac

SEQ ID NO: 1225 - DNA, 375 bp, Glycine max
ttgggaggaagatggggtagatcagaagaagaggagggagatgcttctgttgaagctactgattcaagcacaagtgaagaaagttcagagccagaagtttatgaaccttctgaagtcattgcagagagcgatccttggacaactgattaggcatactatgttctcatagaataagttaaatttttttgtcattataggggattatgcataccaaaaaggtgagaaaggaaagggagactcttttttccaataatttcatggcgttgaagcaaaatttctaatatcaatatagaactgggaatgaatgtcctaaggggcaaatcctatggatcctttccaaatgaaattgagatctattgttcgtaggtgggcaat

SEQ ID NO: 1226 - DNA, 368 bp, Glycine max
cgtggagaagatgctgcagcgggagaaggaggacaaagggttgctggggaagtgcgtggaggagttgaagaagaaagggttggagtttgatttgctgaaggaggttgatgcgttgaggagggccaagagtttgagggtggagaacaaagaggttaggaagtggtcttccagggactttgtttctttgttcttcttctctatggcttgcttctctcttgctctcatgagggtcatcttgtgcacttaggatttgggattggtactaatatgtacttaacttgttactatttgtttggttttggattgagatttttggtatgtatcaattattaattattactatttattgatgcagaatgtactgttct

SEQ ID NO: 1227 - DNA, 807 bp, Glycine max
atatcccatgctgcctctggatgctgctggcaaaagcgaactgcctcaaatccactggcacggggccatccaaacatgtaaatcatattgtatatggttccccataaattcatgcccagcataatatcccaagcacttgtttttggatacctggtaaggcaaaccaatagtttaaaataataaaattaatatcaatgaatctgcatttaagatctgataagtcaacattaaagagaagttcaaatatttgacatgtgaaagcaacaaaaggcaacggagttttcccaacaagcaacattacatgggaaagggaaacatgaaaaatcatatttagttttgtctacttgagtcttgactgttaaattagccaccagagacaatcttaaggaggaccaatattttcagctagcaagctaattatgtcagcctcagattgtaagccaatccattttggttcatttttttcagctaccagtattgaacttatctctaaaaaatgtgtttaattgaaatagttaataataaccacatttcattaaaaaaaaagaagacaaaatctccactaaagagagaaacaattccaagaactgtccattaagaaaatgttcttatttggttctctttattgagattgtttcttatctgtcgatctaaacataaaacattggagaagtgacttggttcaaaaaaaaagaaaaaaaggagggaacacaggaaggagtataagggggggtgaaaaagtaaagaggaaatcaaggaattgcatttgcaaatgtggtagtttgcatgacatcagacagacaggaa

SEQ ID NO: 1228 - DNA, 491 bp, Glycine max
  misc_feature (175)..(177): n is a, c, g, or t
  misc_feature (445)..(449): n is a, c, g, or t
  misc_feature (462)..(464): n is a, c, g, or t
  misc_feature (483)..(486): n is a, c, g, or t
gctctagccatggctaatcctggtgcatcatcaaaaggcaaccataccctatgaacttctggctcatcttgcaaagcaaataccctacctctgcacttcttaattctctctgcttcccctataaatattaacatccaaatttgaataagtttacatcaagcaaaaacatatattnnncatagaaaggatgaatgatgacagtatataacacacttggcaaatcaggcttcaaatcaatggtcaactgaattgccaccatggagtcattgccgtccttggatcccatgattgctcgggaatccccaatatttcccatgaacaaatttgaaccctgcaaagtgaagaaaataaaaaatgtgcaaaagaaaaggaaacatgaggatagatgctgctctttgagatacctgcttcactatagtgacagctgtgcttccactacagaagnnnnncaaatttggatgnnncctcaacactttatccatnnnnttgta

SEQ ID NO: 1229 - DNA, 442 bp, Glycine max
atcttcaactttataacaagctttatctttggatgataatataacttatgctctttgtcatttcttttttcacagaaatgtataggaaagccaagatgcacggttactgtatcaaacagtaactttgggcaagacccttgtcctaatgtgttgaagcggttatcagttgaagctgtttgctctccaaccaatcggaggggctgaatgattaaggaaggaagccacccttttacgtgtagtatgaagtgacttaacaagaaaaacgaaaggaccataatagtataggtaaagttaagtgtcatggttgtttttagggagaaagtaataatgtttatgatatgttggtgccgaaggcacgaggtttttagtttcatttagtgatgttgtgttgacgggaatgtataaaaattagtgattgtcggataggtgaatcttaatcagg

SEQ ID NO: 1230 - DNA, 448 bp, Glycine max
gctccctatgcttcataggtattgcgatacacatcagaaaatgtttttgtacccttaacagttgggggaggaattagagatttcacagattcaactgggaggtattattactgatcattatggagattatgctattgactttcttgcatttttttccctctattgaaattattcagtcttatagttctatcaattgtgttccctcagaattttcaaatctttttgatccgatcaattatattctctggtactattcaagtttggaagttgcttctgaatactttaggtctggggctgataagatttccattggaagtgatgcagtttatgctgcagaagaatatttaaaagccggagtattgaactcaacccatagcttgtttctagttacatgaactaatatatgtgtcacttctgatgtttctatggctgttatgtttgagtaaag

SEQ ID NO: 1231 - DNA, 751 bp, Glycine max
agctatcatttaaagatgaaagcatctaggttcattttcagtgaaataagccaaaagtttcccatcatgccattctcagcaaggttagcttgattcacctaaatgtttcaatacttagtttaaactcgaggttttgaatttgggttctctttgttacctgttaaattaaatgttaaccctttcataatagggctttggaagagaaaagagctcggttaggtttagtggaatgtgttaatcatgagctcctgcaaccttatcctgttctgcatgaaaagcctggtaatatatttgtgttgtgactttattagatccccattgtcatattttttacactttttatgtctcacattcttggttatttttcaggtgatgatgttgcacatatcaaattcactgtattgctaatgcccaatggatcagatcgtgtcacatctcacccactccaggaattgcagcccaccaaaacaatagacgatcctgaaatcaaggcatggctagcattgggtacgaagacaaagaagaagggtggtggaaagaagaagaaaggtaggctcgaatgtgtattctagcatgttatattaatttgtgtaattgggagcacccttggaccatgtataacttgttatctcattaattgcatcttttagatgttaaccttagtgattgtgaactaattgtcaaatgggttctcaagaaatggttttggttgtttgcaggtaagaagggggcagaagctgaaccaatggag

SEQ ID NO: 1232 - DNA, 637 bp, Glycine max
  misc_feature (631)..(632): n is a, c, g, or t
tttaggtgtgtccgatcctaagattggttcccagatatctgaagtgactaagattccttgccaaagtaatgagtttgtgagtgaacttcttcgtggtgtgcgattccattttgatacgtttgttggtgatctcaaggttagtgtttcctcatgcctccttttgtgtttctgtatccaggacacctgtatcctatttttatcactaatttatatattgtttttgtgctgcttgatttttcacagtctggagatttggaaaaggcacaacttggtctgggacatagttacagcagggcaaaggtgaagtttaatgttaaccgtgtagacaacatggttattcaagctatcttccttcttgatacacttgacaaggatattaattcattctccatgagagtcaggtagtatgtctcaaatttgaatgctcaattaattatagaattttcttattcaatataatttgttttctttgagaacattgtgaactggaagaattcatttctctatttgctttgtcaattatgtgcagagagtggtattcttggcattttcctgagctggtgaaaattgtaaatgataattatctgtatgccaaagttgcaaaatttattgaggataaggcaaagttggnntgaag

SEQ ID NO: 1233 - DNA, 500 bp, Glycine max
  misc_feature (21)..(22): n is a, c, g, or t
  misc_feature (61)..(61): n is a, c, g, or t
  misc_feature (64)..(64): n is a, c, g, or t
attaagtctatcaatcacatnntgcaaacaaaaaacaatccctcaaaatccacaaaccacnttngaaaacaacaaaaaacaacaccccctccctcccccacccaaataaggggaaaaaaaatgttttgtcttcaaattattcgatctacctctcaagtatagtccatctggtgaagaaagtgggacctccatgaaatgagggtgctctagctgccggtttcgacaaagatagtaaatcacgggtaccttcaaactctggtggtattttggtgacttctctgtccacactttggccctctcaggactcacttgccggttgtacttcttcttcatcctcgcttccattcccacatgcaaaaaaaaaacacacacccccacaaaccccccccccctaaaatttcattctttcacaattcctcaatttcaaaaccttgtaaaaaaaaaccccttttcccctttactttctttccgggaaaaaacgcaactgggtcggaaaaaaa

SEQ ID NO: 1234 - DNA, 307 bp, Glycine max
agtgagtatcttcattggaggaccaactacgcaatcttcaacaccagtctacctgcacatgaattatcattgatctgtaacaaccacaagttgtatttgatcagtgctattttgtgttgtctatagaaaaacattggaagagaaaaataaaagtgtttaagatttataaataataaaaagtagttggccatgcatatttatacaatgttttatggctttggatatttcatgacacttgcaccatgtattttaatgccagttaattataagatggagaagcttgtattgtgcttggttgagcaagtca

SEQ ID NO: 1235 - DNA, 418 bp, Glycine max
  misc_feature (191)..(201): n is a, c, g, or t
cttggcgtggcccaacctcgtcggtgttgttgaagtactccctcaccacctccttgtcgccgtcggagttgttgaagtactccctcaccacgaaaagagagggagtttgggcagtttgtgagagaatcaagtagaaatgacagttctgtttgggttcgcaacggagagggaagaccatagggacgatgagnnnnnnnnnnnagcatcgccgccagtgccgccatgaatccctcgctcaccaccacgatcgtggtcccgtcgatggcgcccgagacgtctgccgcagtggtcgtggagatcggcaggatggcgaacgccaacgagagagggagtttgggcggtttgtgagagaatcgagtggaaatggcgattctacttgggtttgcaatagagagggaagaccatagggacgatgaga

SEQ ID NO: 1236 - DNA, 834 bp, Glycine max
  misc_feature (64)..(65): n is a, c, g, or t
  misc_feature (753)..(753): n is a, c, g, or t
  misc_feature (768)..(770): n is a, c, g, or t
  misc_feature (773)..(775): n is a, c, g, or t
  misc_feature (804)..(804): n is a, c, g, or t
  misc_feature (806)..(807): n is a, c, g, or t
  misc_feature (810)..(810): n is a, c, g, or t
  misc_feature (828)..(828): n is a, c, g, or t
gcttcgcagggcttcctgggatcctgcagtgcaaggtattgtgtatataagatgtgtttcttanntgtatttgcattaggctttaaattgtatatatagtttctatttttttattagttatgtatggggaaaatgcattgtatatgaattttgttttagtcccccaaattaaaaaaaataaaaaagaaagtccttttattagtccctcaaattttaaaaaaaacaacacatttttattccctgatcactaaatttgaggcactgaaatgattttttcaaaactgttttagtccctagacagtaaatttgaaggactaaaaccgtgcattttcaaatttgagggattaaaatcatattttcaaaatttgggggactaaaaccaaattcacctcaaatttcagggactaaaaacataattaagcctattccaaaatagatgtccttttggaaggatttctaatatccaacacataataggcatatatgctataagtgactgtatttgtctatttacatttggttttatatataggtgtgtgtgtcttcctttaatcaggaaataacttaggtgttgcatctttcttccttgcagatattgaagaccttaaggaattctccaaaagtcagggagcattggaagctggtgatttgactcattgggacattaccttttggagtgagaggctacgtgagtcaaaatatgatattaaatgaggtttctctctcttttccctctcttttttattacttagnaaaaaccccttttannnaannntggtttaattaaactgttaccctggaacntnnaanaattttgaattgattagnaaaaaa

SEQ ID NO: 1237 - DNA, 393 bp, Glycine max
ttcccgggagtatgattattaggaattgggcatagtacttctcaactttaattggtaagatttcatcatttggtacatttacttttgaatcttgctcccccggtattggtagtttttgaatggattaaagcacggtgtgatcattacaaagaaaactgtagctgctaccatccatatggtccatatttgaaagcttgaatactgcatctttcgagacgtttgctgccttttgtcaacctggacttggacatctaatattggtattttatttggcatttgtgttgttttctgctgactttttatgaaattaaacataatgtttttctggttcattttttacgggaaacaattgtgcggggtccaagttttcgttggtctgttgatctctgtctt

SEQ ID NO: 1238 - DNA, 488 bp, Glycine max
tcttcaatgcagtaacctacaagtttaacaaggtttggatgaactaggtcaccaagaaaattcacttcagcctgccacatgatacaaacacgaaagatcattaaaaatatagatttcagtagttgacaatagaagaaaagaaggacttttgaaaatatacaaaccagccattctttatgaccctggagcccatcatggtttagggtttttacagcaaccgtaagtcctgtgccaggtttcactggagcagttccattttcttcaatccaccccttgaaaacacaaccaaacccaccttcaccaagaaaactttcaggtcggaaatttcttgttgctaacttgagttcattgaaagagaactttcgcagcctggaagcaattttaagctcttcttcaagcttggaagtggatgatgaattgctttcagcattactagtggttgtagaagagactgctggggctgttggttggtctctactagaaaaaaa

SEQ ID NO: 1239 - DNA, 436 bp, Glycine max
ttggagtgtttccagttccagtaaaatgattaacctgcttattcaacatccgaaggagcttgtcttctacaaacaaatgcttctcttgtagagaccaatccaactccttcggcatagaatctagtaagagattgtgggtatagggatcaattccataaacttcttgctcaacaacctcattttcaagctgttttctaggtttgtaatccttgacttcaggcagttccatgtcagactcatcaatgccattcttttgcgcactcagcttctctgcatagccatctggtaatgaaacccgcatcttccttcgcacatcctcttcatcagctacaatgatatattgatcaatgacatcatacttccgagtaacaggaggaaccaaacttgctttcgtcatgcgagccccccattcacgctcatcagtaatgaaatccaa

SEQ ID NO: 1240 - DNA, 404 bp, Glycine max
cccggcctaaatctttctggtcttagcctttactggtgagcataggtaaagcttacagttggttttgtttatttaaccttatctatctatatttacctgttatgtttatgctgtgcaggttaacaaataatatattgagcactgcacaacaagtatggcttcaaaagttaggaggtgctaaaaatcctgtgaggcaagtcccagatgatatcatgaagaatgacctaacacaggttcagaagtcaatgtctaaactaaattccacaacagcggaagaagccagactaagtgagaaaacatcagaggggccacaacctggtgaaaggttagtaattgtaggtagttacactcatttcatatgctatttagtttattttcatctgttgtaattgtgctcctgtttc

SEQ ID NO: 1241 - DNA, 617 bp, Glycine max
tgcatacattgtgggcaacaaattgatactgcagcaggatctatgttctcagaagcacgcctcagtgaagggattgttgtagtggacaaggtctttaacggcaacaaagactcgagcgaagtaccaagaataccattggtcccaagcctggtttacaagtaaaaaataaaatggtcacacaatgataataccaaatgccagggacagaataaccatgttccagatcagagcctaatcaagctaacagtgctaaggtagacaaaaagctaaatatcctcctgtcttataacactgtcaacagaaacagaaacatcacacgttctacattcaaaatgaaaatacgtgggagttcaagtaaacccagtggtgagaacaaaaacgaaaaaagaacagaagcaaaacagagttcacacatcagacaagattcatccaccaactgcaatctcaagtttaactgattccacgaagaatactatgccaattccataatttttaatgttaataatttaatttgatcttgcaacagaataaccagagaaataaataagattttgccaagactgaaataacaaaaaaaagggatgaaattcgatgaaagtccttgagtgatgaataag

SEQ ID NO: 1242 - DNA, 326 bp, Glycine max
tttttggataggccacacctggtcattaaaagagactatcctacctgagtcgactagttcagtagaactactaatattgtaggcaacaaacaaagttcttcgtccaactctgagactaggaatgataaaccacttaccaaaactcgaactcaaaattattatttaagctgaaacaaactcgattaattattagtgcaacaaataaactatatatatcaaaacccttaattaagcttctctgaatactatagcaactccggataaccgatccattcagtgcttctcaatgaactccttgatcctagaaatgagagcatcggtttgag

SEQ ID NO: 1243 - DNA, 625 bp, Glycine max
  misc_feature (220)..(226): n is a, c, g, or t
  misc_feature (232)..(236): n is a, c, g, or t
  misc_feature (248)..(251): n is a, c, g, or t
  misc_feature (258)..(259): n is a, c, g, or t
  misc_feature (275)..(279): n is a, c, g, or t
  misc_feature (283)..(286): n is a, c, g, or t
  misc_feature (293)..(304): n is a, c, g, or t
  misc_feature (306)..(308): n is a, c, g, or t
  misc_feature (310)..(320): n is a, c, g, or t
  misc_feature (327)..(338): n is a, c, g, or t
  misc_feature (366)..(366): n is a, c, g, or t
  misc_feature (371)..(372): n is a, c, g, or t
  misc_feature (402)..(402): n is a, c, g, or t
  misc_feature (404)..(404): n is a, c, g, or t
  misc_feature (437)..(448): n is a, c, g, or t
  misc_feature (465)..(467): n is a, c, g, or t
  misc_feature (476)..(480): n is a, c, g, or t
  misc_feature (487)..(492): n is a, c, g, or t
  misc_feature (495)..(507): n is a, c, g, or t
  misc_feature (512)..(513): n is a, c, g, or t
  misc_feature (517)..(521): n is a, c, g, or t
  misc_feature (523)..(523): n is a, c, g, or t
  misc_feature (540)..(544): n is a, c, g, or t
  misc_feature (551)..(551): n is a, c, g, or t
  misc_feature (553)..(560): n is a, c, g, or t
  misc_feature (567)..(570): n is a, c, g, or t
  misc_feature (576)..(578): n is a, c, g, or t
  misc_feature (582)..(588): n is a, c, g, or t
  misc_feature (606)..(606): n is a, c, g, or t
gaagaaacagggctagagggaatcattgtgtgtaatcggagtccattgaatggaaagctttatcctcttcgcttgcagcttcctccaaacactgtcaccatgcgggttgttttggttcttcccttgtcaaattgtgagttttcttttcccttttcttttctattccttcttgttgattttttttttcttctggatgctcacttgcttattacaagtttgnnnnnnnaaattnnnnnccccaaattttnnnntggaaannaaaactttgttttatnnnnntttnnnnaaatttnnnnnnnnnnnntnnnannnnnnnnnnnatgtttnnnnnnnnnnnnaaaaaagttactttttttggggaacaantcttnntttccaactacaattcaaacactaccttantnttgaaccttcatacataaaaaaaaaatgttttnnnnnnnnnnnnaccaattaaaaaaaaannnaaatttcgnnnnngaccaannnnnnaannnnnnnnnnnnnaatgnnatgnnnnnantaattaatatcttattnnnnnaaatttncnnnnnnnntgaatannnnttttgnnnctcnnnnnnntacaaaacatatcaagtnactaaaatttgaaaaaaat

SEQ ID NO: 1244 - DNA, 785 bp, Glycine max
  misc_feature (727)..(733): n is a, c, g, or t
ccactgttctgcgtcctgtctcttcactctcatctcctccactcttacagttgtagattgcagatatttctgtagcaatattcaaaacaatagttagctaactaatgttgcataaaattaacttttcaaatgttaggtgggcatgtaatcacgaaggagtcaactgtaatatagtaatctataaatgggggaatcttcggatgactatttaaatcaacatcagagataagaagttatatttatgttgcttctttggggcatgccccaacttctgaaaaactactgtttttttaaataaaaaaacattcttaaacttggttcctaaacagctacattatttctttttggcagacaatgaattacctgcatgtttccaataagtaatgagaataagaccaatccaaagatggcaatgaagattgcaaaagctatttctgagacatcagtactagtctttagattttgtccaagagaactgcaaaagatgacaatttttttaatattggtatgctttgggcaaccatctaataaattgcactaatttttccttgataagatgttacaaacactaataatagaaatattagaaacgaaattaaataaggatatgaaagttttatagttcataaaataagtatgttgcatttgcatatatgaaaacaagaatacagaagattatattgaccaaccttaaattgcgcaaaccccaccaaaagcagtagaagannnnnnnaggaaaatctgttgttgattctacaacacgtgaatctagagcatcaaaaaat

SEQ ID NO: 1245 - DNA, 601 bp, Glycine max
  misc_feature (358)..(385): n is a, c, g, or t
  misc_feature (394)..(398): n is a, c, g, or t
  misc_feature (422)..(425): n is a, c, g, or t
  misc_feature (431)..(446): n is a, c, g, or t
  misc_feature (451)..(455): n is a, c, g, or t
  misc_feature (470)..(470): n is a, c, g, or t
tggtacacctgacatgattgaagaattccgaaatcggaaaggtttttaagaaatttcggaatccgaaggaacctgcaaccttagcatatctctctactctacagcataatggctagaactacccaagaaaattttcccatatatatgactaccaatttcttttccattcataagaattagtagtcacaccaagaaacgttaatagtgcacccaacacgttttccataggttttctattggacagagccttcaaaatgctctcttggcctgtacattgttcagatttgtatccccaacacatatagtaagagagaaaggtcgtctcaactcattccacatagattgtcagtgcaagaannnnnnnnnnnnnnnnnnnnnnnnnnnncctttctannnnntattggatattgaacaatatattnnnnacagtnnnnnnnnnnnnnnnntaatnnnnntaacgtagacacgtnaagtgtatgtctaactagctgggttgttttcaggtcagagacttggtgctgagtctacattgccatacttgagtccagaattaagaggagataagctcttagttggtgccaattttgcttcagctggaatt

SEQ ID NO: 1246 - DNA, 520 bp, Glycine max
atcttggttttccaatcgcgcagcccgagcggccatctgaacaacagtatctacgtcaactcctttagcaaaaatctacagaaaacattgaaaacacttgtgtgagcatacgacaaggcaaataagaaaacaacacagtacaaaactgactacttctaacctcaataagattcttgtcaactgtcagtttattcaaagtcaaagttccagttttgtcgctacataatacatccattcctgccatctcttctattgctgtcattcttttagtaatagcaccctgcaatgattatataaagcataaactataaagactaacatctaattgattaaaacttgagacaactgcttttcaagaagcactaatgtctacctgctgagctaagcgatgggatccaattgccattgtcactgacaaaacagtaggcatggcaataggaattcctccgataagaagcacgagcagattgtcaatcccaggacgatattcccggtgttgaattgggtacatgacaatgat

SEQ ID NO: 1247 - DNA, 342 bp, Glycine max
  misc_feature (25)..(26): n is a, c, g, or t
taatcacgcataaatacacaacacnnggatccttaaaacaatcagttgatagcagctgtaaccaaaatcccccgcaataaaatatatatcccctaacagctacactaagactccaacaaaatgcgggaacccactcgggaattctatgtttatgacataaacatcaaggataaatggtccttcagaatttgcccgcaagcaactttatttcacggttcaacaaacagaaattcgattgtcgtcagttctgcaatccacacagtttgctgtagtacggggtgtcattggaaacgtttgactaaaagaggccattaccatggaatgcagaaggtagtgttcagg

SEQ ID NO: 1248 - DNA, 368 bp, Glycine max
tgagctccttagtgtatgtgcttttttgtcactcttacggaattgtgtaattttagtatttatcatattctttccagaagtcttctattattccctcattacatctggtggaagttttttcatgactttggggttggaacagaaggaatattggaagggaccaaagaaagcatgttgttagttattgtgttctctactttgatcctaatgaatcatcatcaatcttttttccggtaattattttgtacttttagggtttgtaaaggaggaaccgttgcacttttatcagccataacaacaatccaaggaaaaggagcaagaaggatgtcaaatttttttttttttgttaaagggatttggaaaagaaa

SEQ ID NO: 1249 - DNA, 395 bp, Glycine max
atttttctgtttgtgggaatggggttgacaacactgttttgcaagatgtgacagatacaggtggtgacttccctcttgatgaatcatatggacaagatcctgataatgatattggaggatatccaaacaccagtgaaagccatctgccttgtactttaacagaagatactaaatttgtcaatggattgaattctttagacacaccatgttcagacatcaatgttgaaaaaatagagtctgttaaaaatgacacatcaagcaacaatttctgtcaaaatgatgatcatttggagactcaatatgggagtgctgtgtgggacatattccggaggcaggatgtacccaagctaacagagtacctaaagaaacaccacagagagtttcgccacataaat

SEQ ID NO: 1250 - DNA, 614 bp, Glycine max
  misc_feature (426)..(426): n is a, c, g, or t
  misc_feature (462)..(463): n is a, c, g, or t
  misc_feature (558)..(558): n is a, c, g, or t
  misc_feature (588)..(589): n is a, c, g, or t
  misc_feature (599)..(599): n is a, c, g, or t
ttgctgttattgtgaacagaccagatgaattgcaggagtctgatgttggtactggtgctgggttatttgaggttaacaaaattggagatgagtacttcgcatatattgttgattgcaaagaacccaaggcttgtactgttctactaaggggtgctagtaaggatctattcaatgaagttgaaagaaacccacaggatgccatgtctgttgcaaggaacattataaaaaatcctaaacttgttcctggaggtggtgctacagagttgacggtgtcggctggcttgaaacaaaagatttcatctattgagggcatagagaagtgcccttatgaagctgctgccgtagcttttgaagccataccacgaactttggctcaaaattgtggagtaaatgtcatccggactatgactgctctacaaggaaacngtactacttttgatggattctagatctatctcttgnnggcagtagcagtttacactgaattcttacttaagattgttgttgactgacagtggccttatgaagctgctgccctagcttttgaagccataccangaactttggctcaaaattgtggagtaaatnncatccggacnatgactgctctacaa

SEQ ID NO: 1251 - DNA, 787 bp, Glycine max
  misc_feature (744)..(745): n is a, c, g, or t
atgttcaaatcagaattgaatcagatagttgatccataatcagtttcaataggtagtatctctctgtcgaaaactaaagcctgtgtgtgtatgtgtgtaatagaaaatctagtcattgcgtactgtaaggtgaaaactaactaactaactaactaaccgattccccactgaaattcatgtatgtttggggctttgccagcaaaatcggtacttcaccaatagaacctgtacaaaccacagaagaaaatataagttaatgatagaattacaatgaaatctgtaactggtaggggaaaaaaatcaattttttttagaggaggatgcacctattccaatgagggcctttgactgtattgtgttcatctgaatcccttctgctcgagaaaggctatcaattatttcaaatccaacctaataatagagagaaaataataagattaaggttcagtacaaaatacaaataggaagtgtattcaagaacggaaaaaatacattgtgcctggtgccatggtatttgttaccaggattgcccaagccaacaatgagccaaggagtatattccacttttgctccattttttgtctgtgaaaccgaacaacgaacagaaaaacatgttttttgaactgaagaaggaggataatgaaggttcccgggatagcttaaacaaaagctaggggcagatactgcatgcaacattgatctgtcgaaaaaattcaaagggcatataagaggtgtcaggaaacnnaattttttcagtaaaaccacgacatactcataaacagagatt

SEQ ID NO: 1252 - DNA, 998 bp, Glycine max
cccttctgagatgttctctatattcaggttactgtgttttgcaactttcgtttctttgcaagttagctactgtgaatgcataagtttattatcttttgtcttcttataaggacacggacactctgatttgttggaatgttctgtatagttaaactataagattttgactttaatccatcgatcgtgctagagattttacacaatcagcgaattatatgatgccacctgtttgaaaaacaattaaatgctttagcaagcagtgtaatatatttattagttacgacaattatgcagcatattgttgtttccttacagtgaaaatctgttacattgacagttaatcaaatttaagatcagatctatgttgttgttcttcctatttgtaaggttattggtatgattttggtgttaatcccatgccaggccatgaagttagataagggattttgttcagggcaggctattgatttgagattttctagacttcatttttttattctttgttgtatgtgtatatgatgattgaataagtctgattactctttttcctttttatgttcagccacttcagcctttttcttttggtgtattaggactatcgagccttcaagtttaacaacctttttttagttaaaccttttctaacttgttccatgtattcaaatcattgtggcaggtgggtgatcctgttgcagatcacaagtgttgggaaaaaccagaagccattactgaggaacgaccactcatacaagtgaatgcatcttgtcctggatcagacgttgcagctgaaactgcagcagccatggcctcagcatctttggtctttaaaaagactgatcctacatattcaagcactctactcaagcatgcaaaacagttgtttacttttgctgacaagaatagaggttcctatagtgagaatatacccgaagtccaaacatattataactcaactggatatggtgatgagcttttatgggcagctagttggctctatc

SEQ ID NO: 1253 - DNA, 439 bp, Glycine max
gagcttattatacagtgatgatgaccgtgaagcaaggtttcttctctctgcgaggctcactcctcttcttcgcaatcctcacccttctctccttcacctacctttctctcaaatactccaccccaacaccccaggtacccctttttctctttttcctccaaccccattttgaaatttctcatttttcaccgttttctcgattacccttttgctctaggttgccaagctctcggtcgagaacctcaacgatgcgccggtaagcgagaaagaagagaaagaagaggttccggacacgtaccactcgccgcgcgtgttcaagctgaactatgaggaaatggagaagaagttcaaggtttatatatacccagatggggatcctaacacgttctaccagacgccgaggaagctcaccggaaagtacgccagcgaaggctatttc

SEQ ID NO: 1254 - DNA, 398 bp, Glycine max
aattgggccacatccggtggaaaatacaaagtgaactataagtatgcaccttttgtgaccgaattcaaggacctagtcctaaagggttgctccgccgatcccattcaagaggttaccggcaccaagtcttgctccgaccaacacgccgatctcgaggctcaagactatgccggcgtgacccccatgcgccgcctcaccatgcggcggttccgtcagcgttacatgtactattcatattgctatgatactttaaggtaccctgtgccacaacccgagtgtgtcattgtaccctccgagaaacaaaggtttaaggagaccggaaggttgaaatttggcggcagtcaccaccggcaatctcgacggaggggccgtacaacaactccggtggatcatacaaa

SEQ ID NO: 1255 - DNA, 421 bp, Glycine max
ccataaccaagttgaatcattgcatttttcatggtaaatgcctaaacgaattcttccatacacaacatgcacacaatctcaatcaataactaagcaaccactacctaccccctacccctatacatcacaaatttgattcattgattcatggaaaccccttttattacaatgattcaaggaaaccagtttttgagagaacagcattcctcacttcgctaagatctctacccttgagggtccttccaacaccttcaaaaactgaaaatgaggatatctgactccttgcaagccttcttgcaataaactcatgagggggtagttttgtatcatattcattctcttcctcttcctcatcatcactataccctccaccataattgacaacaccaacaccatcaccatcaccctcatcattaacaga

SEQ ID NO: 1256 - DNA, 371 bp, Glycine max
ggctttgaggaccaacctaatgctgtaattgacatgtcggttttatggctgtttcctgagtttgttttgcttggaataggcgaggcttttaactcggttgcgcaggttgagtttttctacacttgtatccccaagaccatgtctagttttgcaatggctcttttcactcttgaactagctgctgctaatgtagtggggagtgtgttagtgagcattgtggacaaggtcactagtgtaggagggaacgagagctggatagcaactaacattaacaggggacatctgaattactattatgcactgctcacttgcttaggtttaattaactacctctactttcttgctattagtttggcttatggtcctcctca

SEQ ID NO: 1257 - DNA, 589 bp, Glycine max
  misc_feature (43)..(46): n is a, c, g, or t
agacggcggagagaatgggtttatcactcttacggtgggttcnnnngctgactctgttgctcacctgcgcgctaggtttccaatcggacgagcttctcctcgacgacgaagagttcggcatcgaaggaggacgaacctccttcgattccgattcgcatccaccttccaccgcctccacctcgaggaagaggctttccgactcctcctccgattccaagatccagttccctctccaacacgctttcggcgactccgatttctccgacgccggcaacttctccgctcgcctcaagacttggagccacggcgcccaggttcccttcctcctctctctgtttatgttataatttaggagctgatatgcgatttatgaattgaatttgtgtcgattcgaatctacttctgttcgattccactaatattttgtcgcgttagttccttccatcttattgcactgagttatggtggatataatatatgcgagatttgtgatgttgtgctgagaagtggttttgatttgttgtgatagacgctgacgaagctgcggtttaagcgtgatcttttgactgacgttgagcagaggaaattt

SEQ ID NO: 1258 - DNA, 395 bp, Glycine max
ttttatgggtgggtgatgccgcatagtcctaaaaacccgcttgatccctttacaattttactccccaaaataaaaatccctatggttttatgtttccttatttaatatcaacccccgctttccccaaccaaaaaaaaccataatattttatgtgccaaactatgatttttatgaaatgtgggtgagttgcggagcacacatgatgatttcagcatcttaatgaggatggtagggaggggaaatgatttttttggagatctaaaccattgattattttgggttggagcttgagggtatggttaatgattgatttggtgctccagtaaggattgtttaacttgatttttgtctttgttcttaacttgaggccatatccaaagccaagtcaagagttg

SEQ ID NO: 1259 - DNA, 490 bp, Glycine max
gatgttcgggaacaagctcgtgctctttaatgttaaccagcagctccgcctcctgaaacaacaaataatcataaaaatcacattggaaaagcatagagagagaaagaatgagtaattaaaccataagaaaaataaggggaaaaaggaacctggaagacttctaagtggaatttggaggagatttcgctgatgcaggttctggcgaagggggtgaggttggtctgggtgacgaggatggctctgtagacgttttcggagttcatgcggttggtgtaggtcttcatggtcttgacgccgaccttgggttcgtcggggaagaaaacgtagatctggtcgccggagttgtccttcttggatttgttgatgacgaggtcctcgcgcttcatgtgttcgccgtacttggacttgaactcgtgcttggacatgttgatctcgaagtcaccaaccagaaaatttctgtccctcagcatctgcatcaccgtcttcctta

SEQ ID NO: 1260 - DNA, 474 bp, Glycine max
taacgatttttatgtcattatggtagagttgtgttgagaaaccgttttaatgtcctgagaaggcattaccgttctataaatatcctccttggcaaagaagggtttagttgggataagacacaacacaaggttgttgctgatgaacaagtatggcaaaaatgcatcagggtataaagtgttcttgccttgtggttattttcatttttctttttgattctttttcattttctactaccatcacctattcgtgattacaggtacatcacagcttccggctctataaaattaaaaacatgcctttttatttgggcatgtgcatagtatgtcgcaatgaagttactgtgggttgcaagtcaaatcttgaaaaggaatcttctgggggaaataactccgtcccagatactcagccactacctaatgcagataaaggagcatcaaatcttgaaaaggaatcttcttcgggcaataactctg

SEQ ID NO: 1261 - DNA, 363 bp, Glycine max
ggaagctgtcaaaatgttgagagatctcccaaaagaagttagagacattacagatgaacttgaaagctttcaagatttcatcaatgatgctgataaagtgactgaagccgaagaagatgatggaaggcgtcatagaataaaagaaagggtgatgcggctgagagaagcagcttttcgcatggaagatgtcatcgatgaatatgaatataacatctcctgtgaggataagcaacctgatgatcctcgatgtgcagctttactatgtgaggctgttgccttcatcaaaactcaaatccttctccttcaaagtgcgtataagattcaggatgttaaatcccttgttcgtgctgaaagagatggttt

SEQ ID NO: 1262 - DNA, 386 bp, Glycine max
actatctgatcagcaatacaacgaaaatgctctccagattattgttagagagcaaacagatgatgttcatgtaagtcctgacaatttccaaaagaaagtaagtactcaaatgaaagagtcttcgtcccagcatcaggtttcaagtttgtctcagagtacctctgccagatctgaaggaaggcgcagcaggtcgggtaaaaaggccaaaaaaaggcatacccgtcagaagtcccaacaaaaacctgaagatccttctgcaccggagaaagaaggcacgtctcggagagatgatactgctatgagtggcactgaccaagctttgagctctagctctgaagattcacgaagtagaaaaactccaatagaatctatgcaagaacccactg

SEQ ID NO: 1263 - DNA, 584 bp, Glycine max
tagagcattgtttgttactcgtggaacacaaattgtttcttgtggtatgaggctatctgtagctgattttgttctttataacattttggtcgtggaaaaagcaagaattcgaagaataattgaagccgaaggaattccatacacttacctatgttgtcatgcctttactggtcataatggacaattcattcaggaatttttttataacatttacctttatcttagtgacattggagtatttcaagcaaaaagcattacctgttccatatgtgtaattttaggattttcttatatactcttatcttccaaatcacaagtgccctttgtgttaaaaatgttgtaatgtctaatgttgatacaggaagagggagttgtgaaaggtcaagagctagagaatgctgtctcagatgctgactatactaaagcaatccaaatcgcatttgaactgcgcaggcctcataggctttttgagctatttgcagaactttgcaggttagtgataatttattttgttgcctgcatctttttggcatacacttaactaatatttttgcaggaagagagaggctgaagatcatatggac

SEQ ID NO: 1264 - DNA, 1051 bp, Glycine max
  misc_feature (643)..(648): n is a, c, g, or t
  misc_feature (661)..(662): n is a, c, g, or t
  misc_feature (665)..(665): n is a, c, g, or t
  misc_feature (684)..(689): n is a, c, g, or t
  misc_feature (697)..(698): n is a, c, g, or t
  misc_feature (709)..(709): n is a, c, g, or t
  misc_feature (711)..(714): n is a, c, g, or t
  misc_feature (721)..(850): n is a, c, g, or t
  misc_feature (852)..(1047): n is a, c, g, or t
agcaaggtcccttacaagactgttatgaaaggtaatccctcttgttctaatttatggttcctcccccacctgttccaattccaaaatgcatcaccagatctgaacaatgcctcgactgtgacaatattaaatcatacattttgcagctcaaagtgcagttttgttaaaggctgagagtatggcagataaggttgagtggatcaacaagttaagaagtgttgcacaggctaaaggaggtcaagccattggtgaacctagttttcctatgcgacaaagcctttctgatggttctcttgtaagtttctatttgttctcttttttgtgattctcttagcatttgggcttcgggcctaacttaattccacaaaatcagcttgtaagaggagaaatgcccaagctatataaggatttcatttgttttcatttgtcatatctctagttgatgtgagatatcaatttcttaagagtcaatgtcctggcgtctacactctgcgacgttttacatagcctttttggtcaacccctccataggtagccctttctaagacactaatatccaactttgattggtctcaattaaggtaactttccaacacgcccctcatgcctagggctatggaccaagagcttggcaatgcaagtnnnnnnatgatgaatctannatnagctatgatatcatttcannnnnngagctttnngcctgactcantnnnncaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaa

SEQ ID NO: 1265 - DNA, 885 bp, Glycine max
  misc_feature (796)..(797): n is a, c, g, or t
  misc_feature (835)..(843): n is a, c, g, or t
cccacaaaacgcagcaacctttgcaggttcaccctttccagatctctttattattatgcctcaagattttaatgtctgaatgttaattgggcgcatagtgtctgtgtatcttagcttttgtttctgctgactacctatttcctttttattttattaattatattcatattcccttctgaattacttagttgcttggtgaaggttgtattttttgctactacaaaaatgacatttggacacccaaaatgctcattgacacctagtgtgagagataaatgagaaaaatataggaatgataggttgtaagatgtactaggaggggagagataaagagaaagagttttaactgggtgttttgaaaaatggggtgctcaaatgtcattgctcttcctacaatttagtttcaattcttttgtggatattaacctgtttattttgtaaaactaaaacctactgcaaggacctaaaatcatatcttgcccagtagaattgggagggttttgggagtgaagggagtttggttctgttttgtatctggcaatggcatcttcagaccaaaataatgccaaaaaaatatggattttgttttggttctgttctgtacctggcattgggttgttcactgtttgattcttgttgatcgtcatttgtttgtcagattgcaaagcgcttagagaaatttcagacaacaatcttcactcaaatgagcttgcttgccatcaaacatggggccataaaccttggtcaaggctttcccaactttgatggtccagaatttgtaaaggaagcagcgatnnaggcaatcagggatgggaaaaatcagtatgcccggggnnnnnnnnntccagacctgaacattgccattgctgagagattaagaaagat

SEQ ID NO: 1266 - DNA, 296 bp, Glycine max
  misc_feature (280)..(283): n is a, c, g, or t
aagcaaaggtagttgctgcaagcacttactgaccccacaactcaggtgattgaactggaaggcaattcattattttcttagtgaaaaagaaatttttggagggaaatgaaggggccttgttgtggggactgaactctgcctataggctaactcactggggcatctttgtccatttgtattttggtcattttgaaaagaaaaagccattggaccgttgcattgggaactgcccttttctttggattttttttttaattttatgccaaatttatcaaaaaannnnccccccaaaattt

SEQ ID NO: 1267 - DNA, 391 bp, Glycine max
tgaactgtgctcgagcctgcccaaaggggttaaacccaggaaagcaaatctcacatatcaagtcacttcagcctaaagcataaaatcctattgttagaggcatgatgatgtttgcatttgatcatttatgttgcaactttgtattttcttcatagttggggatgatttagctatattcttaataaaacctgagccccttttgtaaaacttgggttttaagtttttattgacttgtgtttctctgaaataaatgttaatagcaaacagaaccccatctcataaaattggctgtagctatgttggatttagatatacaagctaaatactccctggatttttccccccaaaagatttgcactggaaactgggaggcacgcatgtttctttatat

SEQ ID NO: 1268 - DNA, 462 bp, Glycine max
taggattgacaccagatatgcaggtagctgaatatcatttatttctaaaacgcttgtattttaagtaaacctcattagactagtatttggtaaatcaaaattttcctaatctcttgtctgtaattgatttggccagcaacaacacctgaacattgatataaatgctttggtaacaaagttggaaaagctggagaaggaagtgatcttccagaaggggaacaaatttgatccatccaagaaattgaatgtgatgaagatagaaatggccaaacttgagtggtacaagaagtattccaaaaataataagattggctactatgacagcttcaagaggggtatctcaacaagcgacctagatgttgttcagtgccagaaaaccctcagaaattactggattgacatggttgcagaggcagagctgaaacctcagacagaaggtgcagcttttcgtactcgctggct

SEQ ID NO: 1269 - DNA, 364 bp, Glycine max
tcagtgatgatggtggttatgcaaaacctgccatggagacaaaggttgaaagcaaatatgaggcatatgctggaacaagttcagccaagccgcgcctttcagacggcggaattctgatgagtggctgtcaaacagaccaaacttctgctgatgcaagtccagcaggtaactctgccagtgcttatggagcttttagcaatgcaatacaggctgtgattgaggagagtgatggtgctgtcacaaatcaagagattgttttgaaggcaagggagaagctgaagaggggaggtttcaaacaacggccaggactttactgcagtgatgaccatgttgatggtccttttgtgtgctgatgagtgatgag

SEQ ID NO: 1270 - DNA, 303 bp, Glycine max
cgtatctcaccttgactaatttccttctcttttgccttgcatatatcttccgcccttttgataaatttctttgtcaaatcatcaacctgtaagaagaaaatatcagaaatcagacaccctaagctatggattacagttatcttatcagctgcaattagcatgtgttagatacttctttctccaatctttttatgtcatctttggggagacttgaatacaacttctttatcgcatccattgcctgtaaaattaacaacttccatcagagtctgcagaaaattatggtataatccgaaaaaataa

SEQ ID NO: 1271 - DNA, 466 bp, Glycine max
  misc_feature (387)..(390): n is a, c, g, or t
  misc_feature (394)..(400): n is a, c, g, or t
  misc_feature (408)..(410): n is a, c, g, or t
  misc_feature (423)..(427): n is a, c, g, or t
  misc_feature (439)..(441): n is a, c, g, or t
gtgtcccacgattgctcgtgctgtttcggctgacatcgacaacctctgaagggatattgtggccttttccttccccaccgtgctgccagattcaacaagccttataagaggtggcagaactccttcagaaactagccaattttcgcagctaccggattctgcaagcgagcttataacagtaactgttttctctcttatcctgggagaggtagctgtaagcaattgaaccaaagcagcaatattgctccgaccaagaacagataaaacactcttctcatcctccttcatggcctcaacgacgctgtctaaagctcggtgcttcgcttccaagtgcccgatctgaaggcgtgccagcaactcccttatgttgttgtatgttgcaaactnnnngtannnnnnngatgaccnnnaacgaatcattannnnnaaaatcaagcgnnntcgttttttctcaagaatcacggca

SEQ ID NO: 1272 - DNA, 672 bp, Glycine max
  misc_feature (314)..(390): n is a, c, g, or t
  misc_feature (399)..(437): n is a, c, g, or t
  misc_feature (441)..(462): n is a, c, g, or t
  misc_feature (476)..(478): n is a, c, g, or t
  misc_feature (480)..(480): n is a, c, g, or t
  misc_feature (482)..(482): n is a, c, g, or t
  misc_feature (484)..(484): n is a, c, g, or t
  misc_feature (486)..(489): n is a, c, g, or t
  misc_feature (665)..(665): n is a, c, g, or t
  misc_feature (667)..(667): n is a, c, g, or t
gtacgtagagatcaaatgagtgatgggcaccttcccattgaaaggaacaattactgaataatggttccgttccaaattcgtcattatattcaggagaaaacttccactcatagtaatcagtggggccgagaaggtgtggatgattatcaatcttgcaggaaacagttaagtttcgacttcccaaattatttgtaaccccaataagtgccttctctgccatagtattgttcaacgttggtaataacaatataagcaccagtagtgtggaaacacttctagcaaataaagacattgttatcttcgatctgctactnnnnnnnnnnnnnnnnnnnnnnnnnnnnnnnnnnnnnnnnnnnnnnnnnnnnnnnnnnnnnnnnnnnnnnnnnnnnnacctttttnnnnnnnnnnnnnnnnnnnnnnnnnnnnnnnnnnnnnnntttnnnnnnnnnnnnnnnnnnnnnnttaatttagttttnnntncntnannnntttgctaacttggtaacagaatgatggtgatgtgaaaatagtagttggtaataattttgatgaaattgtcttggatgagtcaaaggatgttctcctcgaggtaaaatttaaccctttacttttagttatatttgcatctgcacattgatcatgttatttaatgctcggttgaatcngntttat

SEQ ID NO: 1273 - DNA, 389 bp, Glycine max
tccgtgccataaaacgaatccaccaaagccttcttcagcttctccgtttccgtttccgtctccgtcggtttctcctccaccgccactcctccgccgtatgcctcctcctccttctccgggccccactcgtcgtcgctcgtcaccgctcggacacgccccaccggcctcgcgaaatcggcgaccatcctcggccttccgacagatttggtcgaaactccgacgctgctgcgcggtggcgaagtagagggtgaagagttgagcggcggcatgcagaggagtttgttgaggtgagagagagacgccattgttcagagaacagaaccgaacgcaacagagaagggaagaggtggattttataacgacacgtgagctttgagaaattcactgta

SEQ ID NO: 1274 - DNA, 696 bp, Glycine max
  misc_feature (620)..(620): n is a, c, g, or t
  misc_feature (646)..(660): n is a, c, g, or t
  misc_feature (677)..(684): n is a, c, g, or t
atcttatggatgctgtaagataatttgtttatgtttcaggattaatccatttttgttatttgtactgctttgccttcaatttttaaactattgaacaagatttataatcttgcatgttacaggcagatattgataatagtgggacaatagactatggtgaattcattgctgctacggtccacttaaataagctggagagagaggaaaatttggtgtcagctttctcctattttgataaagatggaagtggttatataaccattgatgagatacaacaggcttgtaaggagttcggtttggatgatgtccatatcgatgaaattgtcaaggaaattgatcaagacgatgtaagtattcttttgtcttgctatcaagagcttgtttgtactggccataagtgtctgcaactcatcttttgattataattttatggcagtattagcttgatttatatttcatagaagaactatagtcctatacttgcctacttgttcataaggattaatggaaaatttgtgctgcaggatggacagattgattatggggaatttgctgccatgatgagaaagggtaatggaggaattggcaggcgaaccatgaggagcacgctcaatttcagngatactctgggaattaaaggccatgnnnnnnnnnnnnnnnatccaaaccctttatannnnnnnnttataaaaaaat

SEQ ID NO: 1275 - DNA, 597 bp, Glycine max
  misc_feature (212)..(215): n is a, c, g, or t
  misc_feature (474)..(475): n is a, c, g, or t
  misc_feature (547)..(548): n is a, c, g, or t
ggatctcaagttgagatattaggtcgttgcccacgaccagttggcttacttaaaggaaatggagatatggaagttgatccttccaaagttgatgatgtgtcaaagttacaaaagaagcaattgaaaaagactgaccatcaaaatggaaatctgcaaattggttcaagaaatcccatacttaatggtcacaagtccaaggagcttgatgctcnnnngtgtacaattgtgctgttatgggatggtccggtgagatgcttttagattgactcagcagaagatttgctggtatctacaatctgacttagctttcaggggtgcttccctgttgattcatctcatttaccaagttaattgtccatctcccttgataagaatttgggtttctacttttgacatcttatttggatgtgtttctctctttcatgatccatattttttatttgcttttcagattacctagtaggcttacacagnnaattaaagatggagggatcccgggtgcattggttctccatcctagattcattgatggtgatctttctcccanncggaattgtctatgtcatttgctcgagaactgtaataaggtacttgact

SEQ ID NO: 1276 - DNA, 410 bp, Glycine max
tgtgcttcgcttcatttactcggaaataggaacatttctgtagcaacataaaaagatccaatgagaatatctttggtacgaggtgtctgttttaattacataagttaggcaagttatgccattttgcccatgttgaaggttggaacttaggaacttgatgatcgaaatttgacgttcatgtgattaggtttatcttgttttccggtggttgaatctcatttttcaattctttcacatgcataggatctgataaacctgtacatcattcatgacctagtgtccttcattcatgaatttaaccaatatagtttgtctttggctttcaatggtttaattggattaggcagcaccaagggtgtggctgttcaaaagtttggtgcctttttaccctcttggatgcttccttactt

SEQ ID NO: 1277 - DNA, 524 bp, Glycine max
  misc_feature (506)..(508): n is a, c, g, or t
tcaccacaaaaaagctggagctatgaatgctttggtagagtgtccttctcactataaaactgaactttctcagttttcttctttctccattttccttaccatttttctaatgctttgttgattgattgtgaaggtgagagtctcggcaataatcaccaatgctccttatgtattgaatgttgattgtgatcactacataaataacagtaaggcccttcgtgaagccatgtgcttcatgatggatcctacatcagggaaaaaaatatgctacgtacagtttcctcaaagatttgatgggattgatcgtcatgatagatactcgaatcgcaatgttgtattctttgatgtaagtaagaatttgctactgttgtttgtgcatatataatatacattcatataccttgcagtttgctttgaaggaaaagctaatatttgtttcaatgtgtatagatcaatatgaaaggtttagatggcatccaaggaccaatatatgtgggaactgggtnnncttcaggagacaggca

SEQ ID NO: 1278 - DNA, 716 bp, Glycine max
  misc_feature (320)..(321): n is a, c, g, or t
  misc_feature (324)..(324): n is a, c, g, or t
  misc_feature (385)..(385): n is a, c, g, or t
  misc_feature (387)..(387): n is a, c, g, or t
  misc_feature (397)..(397): n is a, c, g, or t
  misc_feature (420)..(426): n is a, c, g, or t
  misc_feature (432)..(435): n is a, c, g, or t
  misc_feature (443)..(448): n is a, c, g, or t
  misc_feature (536)..(538): n is a, c, g, or t
  misc_feature (588)..(589): n is a, c, g, or t
  misc_feature (604)..(609): n is a, c, g, or t
  misc_feature (618)..(620): n is a, c, g, or t
  misc_feature (622)..(623): n is a, c, g, or t
  misc_feature (628)..(629): n is a, c, g, or t
  misc_feature (644)..(644): n is a, c, g, or t
  misc_feature (646)..(647): n is a, c, g, or t
  misc_feature (694)..(696): n is a, c, g, or t
ttacaaagacaagggtgacaaaactgatgtagagaaggtcaaggggaaagaaaatgatggggaggatgatgaagagaagaaggaaaagaagaaaaaggagaagaaagacaaggatggcaaaactgatgcagagaagatcaagaagaaagaagatgatgggaaggatgatgaagagaagaaggaaaagaagaaaaagtatgacaaaattgatgcagagaaagtcaaggggaaagaagatgatgggaaagatgaagggaataaggaaaagaaggacaaagaaaaaggagacggtgatggtgaagagaagaaggaaagttctnnaanaccaaaactaacattgcgctcttcgggggtattgttttggacttccccgtatcatttcaangngggcatggtngaagagggaacatctgcactacnnnnnnntaaacnnnnaagaacannnnnnaattgaggctgatataaggggttacgaggaaacacaaaaggaccaaccaagccaaagtgtggaagaaatcatgcatatcattcaagannnctggactaaattccacactggtgagcaagctggcacatgaacttcggatnntgcgcgtgatgatgnnnnnnatgaggaannngnnattanngaccactttgccaantnnctatcccttgattaatttgtgggtggctaaattccctctctctctannntatattgtttaccgaaccta

SEQ ID NO: 1279 - DNA, 554 bp, Glycine max
  misc_feature (131)..(133): n is a, c, g, or t
  misc_feature (142)..(144): n is a, c, g, or t
  misc_feature (146)..(147): n is a, c, g, or t
agagtcaagcatttcctgactccgtgaatcaccctaattttccatcaactattgtgaccccagataagctttacaagcatgtcatgttgcttaagttttccaccaaagttccatatgctttttcacagttnnnattagaacnnntnntgtggttcatcaaagcacacaattctaattagaactgtgaaaaagcatatggaactttggtggaaaacttaagcaacatgacatgcttgtaaggcttatctggggtcacaatagttgatggaaaattagggtgattcacggagtcaggaaatgcttgactctccaaacaaagtgctgaacgtggctgataaacaaaccctccttttcccttgtcattcttgacaaaattagcagtgtaaaactgcaaaccaggagcatttgtgaagagcttcatcactctccctgacttcttatccaccgctatagctgccagcttaatctctgcattgcctttttcaccatcaagcacatagttgatgttatagccatttgtcttaggcaattggttgatcctttctccaacaatg

SEQ ID NO: 1280 - DNA, 366 bp, Glycine max
gactgatattcagaaacttatgggctgtcttctatggacgggaaagcttgatcgatctccttaccatgcattactatcagcatctaactgggataagttggccgaggaacttaaaaggcagttctgcaatcttttgggacagtcgtataatagtccattgagcgtgactgtagcagcaggggtccaggttttgccacctctcctcaaatttatgaatgtcatggcagggaagaagcatgaatggcagtctatgaaccagttaccggtgctggttgagttggaccgtgagttccagttccattctattttcgtttgtcctgtctccaaggaacaagcaactgaggataaccctccgatgttaatgtc

SEQ ID NO: 1281 - DNA, 385 bp, Glycine max
tgcttcaatgaagaagaagaaatcaagcaaggagatggatgctgctgcgcgtgctgctgctaatgaggctgctgcaaggaatgcaaggctagctgcatccaagaaaaaagagaaggcacactacaatcaacagccagtgcggtaaacggggtgtcaaagtgactgtatcttctctttggtgtttaattttccttttgtcctttttcatttgctatctttctatgtcatatatatgagcatatgctctttgttcatttgcaaatgcaaaataaacactggagcggctttaggtaatttgactttgagtaagttttgtctaattttatacttggtggggaatagaagtatttattggtgtatgttgttcatctttcttcagtattgc

SEQ ID NO: 1282 - DNA, 705 bp, Glycine max
tcattcacaatcgtcccagcatcgttcgtgacaaaaagcttgtccaagtgatttataaccatcttattcatccctgaatcagatcaaacaaaacatttgaaaacaagaccaccaccaacattctaaatctatccaaacaaaccctttcttcagcaacagattcataaaagcacaaacaaaagcttctacagagccaaaattggcaaattctctttgtgaatgaaaaacaaaaacaaatctacttattctcaaccccccacgaattttcaaagcactgcatcacgttaaaagctggatcaacataacatgaaaacgaacacatacccacattataaaaatccaaacttttggaatctgaggatgcagcaatacttggggcgaataagaaagacagaaaataaaaaagggtaagcgtgatcgttaccattgggaccgagggaagttcgagtgatagtggaaagttgtttgcaggcgtcgatgttcttgagaaccgcttcatccaggccagaaaggtgcttatggccttccttgagcatggactgaatcccatagggttgaatgttgaaacccatgttcttgcaatttgagaaaaccctaaccctaaaaccctcgaaatggcaagttctcgcttcgactttgaaaattttatgcccacactgtaatgtcactaccccgccactatctcactaaaccctaataacgcaa

SEQ ID NO: 1283 - DNA, 452 bp, Glycine max
ctccgtcctccccgtctactgcttcgaccccgccgactacggtaagtcggcctccggcttcgacaagaccggcccctaccgcgccgccttcctcatcgactctgtctccgacctccgccgtaacctccaggctcgcggctccgatctcgtcgttcgcgttgggaagcccgaggcggtgctggtggagctcgccaaggccgtcggggccgacgccgtgtacgcgcaccgagaggtctcgcacgacgaggcgaaggcggaggagagggtggaggcggccatgaaggaggagaatgtggaggtgaagtacttctggggaagcacgttgtatcacgtggacgatttgccttttcaattggaggacatgccttccaattacggagggtttagggatagggttcagaaattggaaaggcatgtcctccaattgaaaaggcaaatcgtccacgtgatac

SEQ ID NO: 1284 - DNA, 911 bp, Glycine max
  misc_feature (809)..(811): n is a, c, g, or t
  misc_feature (842)..(842): n is a, c, g, or t
  misc_feature (871)..(877): n is a, c, g, or t
  misc_feature (882)..(882): n is a, c, g, or t
  misc_feature (884)..(884): n is a, c, g, or t
  misc_feature (894)..(896): n is a, c, g, or t
attgcactaaatgcagcatgaccaggagtatcaagaaatgtgattgatgctcctgacggcatgaccaccacaaaagcacctatatgttgagttatgccaccagcctccttggctgccactgaagtttgacgcaaggcatcaagaagagaagttttgccatgatcaacatggcccatcactgttacaactgcaggacgtggtaaaatttctgcaccttcagctgaatgtagcctcttaacattgatgccagcctcctgcaccagcaataaactaattcagtggaaaaaaaaatagcaacaaagagaaacaaatgttcatcatgtggcaaatttagaggggaaaaaggagggtggagggtgaagcttttgaggtaatgactcagaatgaatgcaaacaaataaaaacttgtaagaataccttatataatacttcaacaatggttttaaataaaatatttatccaaacctacctactcatactttaggcctagtcttctcagttacttttcttcccctaatctttctatgcatagagcatactatcaacgagacagccaaataccaactaatttcaggaaaaacatctcatcaagctccatagatccatcaaaacttcacaataagtcttgtaggttttatttcaaaattcaaaacactaaaaaattctgaaagctagcttcaaatctcatatacttgaagtgaagaataagtaaaacaagagctatttttaatttcttcataacaaccttccatttacaaatgacaagaacaaacaaacaagtattgggatcaaacgaaggtagtaggtannngttcctaatattcactggtttaatgtcattngtgacaaagagggggaaaataccattgtnnnnnnntcagngntatccatgcnnngaagctcaaactctg

SEQ ID NO: 1285 - DNA, 383 bp, Glycine max
cggagacaggaaaagacctaaataggccggcaggggtcttgaaggtgattttgccagtgggagggtcatcaacatagatatcactgagcgtgatccagagcaagagctccttggtcttaaccccggtgagtttggtaattttaccttgttggacatgagcagttacctcgggcgcgtaggagacaagctttccgatcttgtcgaacttgtgggtgtaactcttcttttgtttgagccagacgaagccggtttgtctgtcgtagccgcactcctccatgtccttgaggggaagaaggccgttggggagggcgatttccttgagaagctccttggacttcacttggcacatttcgtccccgtggtacacctctgatctgctcttc

SEQ ID NO: 1286 - DNA, 681 bp, Glycine max
cccggagtcacctccattcgggttcggggaatgagaccagtggcattggtgaagttggtggtagggatagtaagcacaagggaagtgggagattgaggatggagggttttcctgagtctggtggaagggttgctgatgttgatgtccttggggagcagttagctgattccttgttggtagaggatgagtctgatgacaggactaacttgaggcaacgccgccgagagaaggtcaatagttatatttgttgatgttgcttgatgttacggattgttaaatcattcttaaaagctaaattttcaactgaatttcatcaagtactttgagtattatcatttggttgataatacaatggagttttattttctgagttattattaatttaaacttgtttgaacgctgaaggactgtttgttcaaaaacctagatagatagattattgagtgttacagttatctacctgtcatcaaattatgaggttcatgtggtttttattttgttttctcatagtgtgaaaagtaaatgattcttaaattatgaggcttacttacacttgcagcatttattcaggatgttagatttttggattcaagaggacagcagataatgagccagcggggaagaatgtacagaaggcagatgatgtgtcgaagggacattgatgattttaatgttcctttc

SEQ ID NO: 1287 - DNA, 396 bp, Glycine max
gatattttgatgaaaaaaaatacttttcatagccaagcttagatttgcgggcaccaattttagattactaaccaaatatataaaacgagtattcaacgtttctatcttcagatcattaactaggttgtacaatatctttgctgatagtgtagtatcatggtataacttcttgggtggtggctattgttattgtacagatgacatcaaatgaatagattagtaaaggaaatttgttacgctcgatctccatcgacaatgaacacttgcaagataaagaccttgccgtgtatttaattttgaattcatcttgtctttggcatgctgtctcaaccccggttgctttaatgtaatctgtaataaccccatttgccagctgctccttaattgtgtaacgtg

SEQ ID NO: 1288 - DNA, 363 bp, Glycine max
cgatgatgtttctctgagtctgaggattcacgcgttactgttactgttactcaactcttattcccttccttgattccaattctccgcacttcatttcatttgaattctgaaaaattaggattagggttttctttctttcagtgaaaaaagaagaagaagaaaaaagtggttttggagaaatggttgagcaatcggtgctggtgctcgaaaagcaagggccaaatccagtgttatcagaaggaatccacgattgggtgtttgagtgccatgggcttttgcacaatgcggttttgatcatcgcttcttttcttttcgtcttgtacttagcactgcaagctaaaaagagcttcctcagactctccc

SEQ ID NO: 1289 - DNA, 534 bp, Glycine max
agtcatatttacaaggtagcaaagaatatgtacatgaaagcatgaaacacccatacatagacaaatcaaacagaaggactagacctgagaaccttctcaagcttctcagctttaatgtaatcattgtcattaaggggtccagcaggaaaaggtgtgatttccacaatgatatggggtgttgggagctcatcaaaaagagctctcacattgttgcaacacacactttctccatgagcactttccctacggatttggcaaccctacaatggttgtttattagcagcatgtaagtcaagcatgtcttgcatcaaactatattaaattatgggtaaaaataaatcagataaaaaaacagactggcaattgaaacaggacagagggaaattccaaccttgtgagaggtggcatcaacaaagtgatcatcatctgataatagagatgcaatagctttaagaagacgtcgcccctcgagcttggatgggactctatagtttcttctaagtgtaccctttgttgtgggatgccatttactaa

SEQ ID NO: 1290 - DNA, 818 bp, Glycine max
ctgctgatctctcttcacatggcactacaaggaagctacataaagtggaagatgtagacacgagtgaaggtttgtgtttcttgcatcttatctgtggattgactttttttcagttttgattattgcctaatgtgacataagcgagaatgtatgtgtatctgtgagaatctctcacaagtcataacttgagaaaggaggcctttgttttaatccatacaaaggtttagacttctaatttttttcttttctaataaagttcttaaacttgagaaaggaggcctttgttttaagtgtttttttagaggatgaaatatattgatttatgtgaattattggcaggcaactttggcactgttataatccatggagatgaattacataagaccacacaagatgcagattctgcagcttctgtatctgctctgaccagtggctcaggagacagattggctgactctgggtagttacctatctgtttaccttcattgcctatattttttaagaaagcatttttctttcattctctcactcttaattcaaagttcaaacagtcttagctttgcaaacttgtaaaatgttcatttgcttattagagcctctcctcttttccttttcatttcctgtgttctaatgtagtttgctttctttatggaaaatcttttaggattgagagtcagaaagttggtattatgaacactgcctcttttagaggatatagtgctactaccaatactgttcaatcgtctttaccttatgttagtaattcaactgagcagagcctcaaaactagaggtactcatcgagcacaagctggaatt

SEQ ID NO: 1291 - DNA, 976 bp, Glycine max
  misc_feature (539)..(544): n is a, c, g, or t
  misc_feature (546)..(548): n is a, c, g, or t
  misc_feature (584)..(588): n is a, c, g, or t
  misc_feature (604)..(605): n is a, c, g, or t
  misc_feature (612)..(654): n is a, c, g, or t
  misc_feature (656)..(705): n is a, c, g, or t
  misc_feature (709)..(727): n is a, c, g, or t
  misc_feature (732)..(972): n is a, c, g, or t
tctatgtatggacagcttatgtcagagtagagaggctttattgaatggttaaacacccatttcccatttgcaacattgcactcctcagggtcaaaatcaaacctgtcatcaatccatgttgatgcattcacaaccacaacctcctcatctgcttttttgtcacctactaggacaatcataatatgagatatcattgcattagaatcaaattgataaacaaaaaacataaaaaggaatataatatgagataaggtgagatagatgttgtggtttatgtaaagcagacttactagactttgttttggtggtttttctaggacatggtttgaacttgaaaatggacttggaagagaggaaactgagcctctctacatacaagatagccacaaaaacaagaacacatgttgtgatgacaatgatgggaagaggaagctttcctctgggatacttcattattcctgaagggatcatgggggatgagtaatggagcttaacggtgagaagaaagagttaatgaagtggtgctcaacacaacatgnnnnnngnnnttgtttttgtggctatcttgtatgtagagaggctcnnnnncctctcttccaagtcnnttttcannnnnnnnnnnnnnnnnnnnnnnnnnnnnnnnnnnnnnnnnnnannnnnnnnnnnnnnnnnnnnnnnnnnnnnnnnnnnnnnnnnnnnnnnnnntatnnnnnnnnnnnnnnnnnnnttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaa

SEQ ID NO: 1292 - DNA, 797 bp, Glycine max
  misc_feature (763)..(783): n is a, c, g, or t
ctgcttgtctgatttatgtatctcattggtttacttcttttcttcacgtgtctcattctctcttgatttgaatatgtaatgcaggaaacggcttttcaacatgatcaatgaactgccaacaatatttgaagttgttactggtgcagcaaaaaagcaagttaaggagaagtcttcagtttcaaaccacagtggcagcaagtctaagtccagctctaaggcagtaataatatcttctcacacctgtgcatgacatataaatatatttattaacttccaaacttttgtgttccttacatgtataaatgatctatttggattttgtactcataactacccccctcattcctgtaagaagtggggagatgaaaaggggggataaaatgtccgaattctgagcatggttacttggttttgtaatagttgttttgaaatctagatttttgtgaatttcattgcttgaatttctggatgtggtagtgctacaacattgacgttttcaaagtctgttgaaggtcatggtttaaatggaatgcattgtaatgtatgacaatctggctcatattatgcatggtgtcaatgtgtcatattgtggttcttttactcagctagtttgctttctcatctaaattgtgtgttgtcttttgcagcagcgggctccagaatctcagagtagacagtcaaagccattgcaaccaaaagatgaggatgaagaactggacgatcaagatgatgatgaacatggagagaccttgtgtggggcatnnnnnnnnnnnnnnnnnnnnnatgaattctggatt

SEQ ID NO: 1293 - DNA, 689 bp, Glycine max
tcaatcgcttactacaatctgaagtgcaaacgtcagtaatacactgttgcatttacttcggaaaataataaggtagaaaaatagtcagcatacactaattaaaaatcactgcaactccacaaggttgagctatacggcagttctgcatactttgatatttcatcagcaatttctcaccacatgctattgtccatcacagcagaaacaatgcctttcaatgtctcctacatataatattgaaatgtgtacggttatttatttattgtttcttttcctttcccgtgaggaagagcaaagtagtaaaacataccacagaatggtctttaagaccaagtgagagcaccaatggcctggaggagccagataaactgcaaatcaagaattggagagtcaacatgatttccaaaaacgaattattaaattatatttacacatgtacaagagtcatatattaacaactgttttaaaatatctcttttaagggatatttgaaacccatactaattttgagaaaaagttgaacactccagaagtgtgtaatacaaactcaaaaagtagattttctcttaagaaaagaatacgtacctcatgcgctcaatcagctggcgtgcacatgctactaacattggctgcatcaatgcattcagtgaacaagaagcacaatttcatataaaagatcaaggagaaca

SEQ ID NO: 1294 - DNA, 755 bp, Glycine max
gtacttcctttaacacactacagatttcgaacttgatttgccaagttgttccttgaagagtgttatccacttttttcctacagtttatataagcttgaaaaattagtacattgtatataacgtataactcaagaaatccaacaataatagatgaagtaggcttgcatgataatctttagccaaattatacaaataatcaataatacaaaaatcagacctcggagcctgtgcataaaaccaatccttcgtatagtcactaacaccaattgtgtaaaccaaatctgcatcaggatacaattctgaatacctatcccacaatccatactgcctgaacctacaagttgaggaaaaaagaaaaatctaagaacagatcaacggacatctaaaggaaacattttcttcacacattttttttcttctttttattggcaaatgttaatttgttagtttttgttagaaatcacacgtaaaaggataaaaagcacagttggataaaattttcatcatttcatgttgtaatatgtagcacagattcaaaattaagcaaaatccattaaagcaatataaggacaaacaaaaagaaaaactggtcacccagttaagaattatcacagtagcatgcccctaatagcacataacagagctaacctgtctggatggttgataaaaagcttattaatatgttgtggactgggatcaggagcataaaattctgcagcggatctatcaggaatacctatttcccacaatgtggg

SEQ ID NO: 1295 - DNA, 448 bp, Glycine max
ccactagcccttcattcaataacttatattaattaagggaaatgtttcctgaagaaggataattttattcagtttctttaagggtctttagagataaattatgctggtgtaacattctctttctaatatttttttaaaatattattgtttgcttaaatttactgacaatcacaaatttcagtacatttcacttctaaacctggaataagacttattaattgagaagtgaaatctatcgatatttgtgatattcagtgaattatagccgataattaaaaaatgttagaaagaaagtgttagagtaaatgttgtctgtcttatatcatggtttttcatgaattagtgcttacttcaagaaggacatgctatgctatgctaggttgcgtaataagtagataagtagaaacagtatgacttttgtgtgttttcttctcgctttgtggtgata

SEQ ID NO: 1296 - DNA, 418 bp, Glycine max
tgaggttgcaattttggatcaagataaggtggcaaaagctccttgactccaaattttgcagctgaaaaaacccaaatgaaatttgttaagaaattgaataagaccatgttcattctattatgtatatgaacatggtgcaatgatttttgtctgtacctatgatgtctgatggggttaaaccattgctgaacctcccagttggttgatttcctccaccaaaatctctaccatatggtagaaaattgcattttgctatggtggtgatgtagttattgttacccgtatccactatagagtccccaaacacaatcactgctgggatactttcatagtttggtagactcacagaactaacatgaagagagattataactatggcaaaagaccaaggaatgacttgaggaaattgagaaagaaa

SEQ ID NO: 1297 - DNA, 407 bp, Glycine max
tgtcgctgtgtcaccctctgcgcgtgtcgtcgtcggcgccggcgccgatgccttacccaaacgacaagatctactgattcacggcctctgtggccagatctgtggtcttcacggccagatctgcgacccttagatatcagatctgcgacccaacaaccttcgcatcctcgcttcactcacctcatgtggtgaaggtggattcgtgaatttgaggtaacggattgtcggttgtcaaggtagctccagagagtgccatccagttttatgcttatgaaatgctgaaaaatgtaaaatgtaattgaagatagtcaagacagcaagttagatattgagtagccaccccgtgcaaattttctattgattcacggtggacttgtagtacatggtcatcgatcctctcgattgag

SEQ ID NO: 1298 - DNA, 400 bp, Glycine max
gtggttgatacaaaaaggcataaatcataaatatgaaaagcttgttgaatgattacaaatcagctcctcagacaatggagtggctatgtgtgactgcattgaaattaggtaatcgatttcctgtttatagttttattaataatttaggtaggctaaaaaagagattataacactcaagatgctggtttgtctctgatccttaagctttggtgaagctagcatcgaaaggaacgccagcagcaggcaaccaagtgctagcttggagccaaggctcagcagtgaattgtgcagcctcctgcttgctaatgagacctttgccaaacttggctcttgcttgagcaacggaacctggtccagtgttgccaaactcagcgaagtagcaatcctgtgtgtttggttc

SEQ ID NO: 1299 - DNA, 573 bp, Glycine max
  misc_feature (533)..(570): n is a, c, g, or t
caatgttgcaagcccaaacaaatattaagcaaatcaaaagcacaaagtctacatgagttctacttgaaaaaaagaaaagaaaaatactagcatgcaggagactcagaaaaaagctatgagaagttgaaccctgtacagagtaacagtgaatatatttgtcaacttgttttggctaaagattttgagagtaaactttagccacacaaggcactaatgcaatcatctgacattaatagcaaaataccttgaacatttgtcagaagcaaaatatagaagtccttcattggcagaatgaccatgattcttatgcatcaatcttgaatctaaacttcctggtgtatgacctgtcaaattggaaaagcttctggatttggcttcccagtcataagatgctgtctttattttgtcattattaacatgagcacatgggtgccctctaagatgcttcttctgtggtgggggaagatcacaattttcaatatgattgagagatttctgcgaaacaaatgaagctaattcatctctatctgtannnnnnnnnnnnnnnnnnnnnnnnnnnnnnnnnnnnnnacc

SEQ ID NO: 1300 - DNA, 372 bp, Glycine max
tccgacccgaaccaaaacccgggttcggagtcctttccgtacttcgaagacatgaacgaactcgagacagtcttcaaccgcttcgacgccaacggcgacggcaagatctccgccgacgaactcgacagcgtgctccggtcgctcggatccggcgtctctcccgaggacctccgccgcttcatggaagacctcgacaccgaccgtgacggcttcatcagcctcacagagttcgccgccttctgccgctccgacgcctccgccgacggcggatccggcgagttccgcgacgccttcgatctctacgaccgcgacaaaaacggcctcatctccgccgcggagctccacctcgcgctcaaccgcctcggcctcaag

SEQ ID NO: 1301 - DNA, 370 bp, Glycine max
  misc_feature (336)..(365): n is a, c, g, or t
ttgaatccagaaccaaatgcaatttgccatgttctatctccccttttgatcctccctttggcttcagtgtaagccagttcataccaaagtgaactgctggaggtgtttccaaaacgatagagcgtcatccttgaaggctccatatgccaaggagatagctgcaagtttttctccagttcatccaaaacagctctaccaccagcatggatgcaaaaatgttcaaaagctagcttgaaatctggaatataaggtttgatcttcatcttgaaaatcttttttgcaactaacgtggcaaagaatagcagttgttcagatgttggaagtacaagaggcaannnnnnnnnnnnnnnnnnnnnnnnnnnnnnttctt

SEQ ID NO: 1302 - DNA, 302 bp, Glycine max
gggaaaagctcgtgtggatcagggttcaacttttggtcccgtgaaagaggatttaggtcgctgtttgaagacaagaatatgatatcctactgtgtattcctgcagtgttcttttgtctgcgagtttgtgtgggtgctgtgttgggtctcctttcttgaatgtgttatattattttaatatactggtgtagttctgaaacttaatgcattaaaatttatagttttttgatcgacaaacaagatgttagtttttgttagttagtgagaaattggaacttgtgacctattttttctttttttttt

SEQ ID NO: 1303 - DNA, 744 bp, Glycine max
gctcccccctgaggaggtggggttgctggtgcttctggtgtagctggcttgggtggtggtggctttggtttcatcataattggcttacagaacctatcattgtatagatggaacaatgagcaaggttaaaaaacacaacctacagaaagtgcgatctaaatctaaagaacaaaagcaaatacctgtcaacagcttcagctttctttcttatgtcagctgacaaaagtaccggggtgacatatttcggaagagagtcctgttgctgttttttctccctgagccagttctcagcttccacacattcatttaagacctgcaaacaaaatggaaaacaatttcagctaaatggcaaccatgaattaaaagacttacagaaacggcagcaaccaattaccttttgtttctcattgatgtcaatgtgatcgaatttgggatcatttgacattgcagcttctctataactatttatacaatagacaagttgatctattactgtacccctctccatgtattctttgtaacgctcttcaattggatcaccttgctgcaatcatgtaaatatccattaagatggcaaaaacttaaacaaaaatatttccttttagctggcatttatgcatgatactaccaaaaataatacaaggtgcctccttaatcattccatctttgaaaagatttttgctatgatggggataaaagtattttctaaaacaaggccataccagatcagctagagtcagagat

SEQ ID NO: 1304 - DNA, 523 bp, Glycine max
catgtgagctaggcccaatagtcgtttcggttggtggttgagctgagcgcgagtgtctgagacttagccacgcatccccgaaaggccaccaaacaccgcttcaatttcaatttatacgtcaacgaagcaatttcagaagcagaagcataagcataagcataagcgttcagttattaagtgtcggtgttgaacgttaaaacctaaaatggccggtaaagggacccattcagattcaaaagcagcaacaattgtgattaaggatctgagattcacataccccggcatcgacggccaccctccgccgggttccactcccctcattcaggatttcaatctcactctttcttccggccatcgctgcctcctcgtcggttccaacggcgccggtactttctttatctctgaatcttaagcagaaagaagcatttggctatttgcatatctatttataactttttatttgtttttgtgattaataggaaagaccactctcctcaagatattaggagggaaacacttggtg

SEQ ID NO: 1305 - DNA, 695 bp, Glycine max
gttctctgcaggtaaccttgtccattctgcatgcggcaaaagagttattttcatggatggggatataaagtaatgcgtgttttatctttaacccgttttttctcctctcctctggattttactggaatccctgctgttgttgacctggcttgcgtgcgtgatgctatgaataagcttggcagtgattctaataagattaatcctctggtatacatcattcttaccatttttctgtgcttttgttctctgaagtcattttgatttgtagaaatttaacaaacaattttgcctatatgttatatttgctattgtataagtggctctaactcagctacaattgttgtcaggttcctgttgatcttgtcattaatcattcagttcaagttgatgtagcaaggtcagagaatgtagtgcaggccaatatggagcttgagttctagagaaacaatgagagatttgcttttcttaaatggggatcaaatgctttccgtaatatgcttgttgtccctcctggatctggtatagtacatcaggtaagttcaaaacagacattccaaatgattttatggattttctttactgctattttttttaataccgaggacttgtaatgtctcatttcaggtcaatcttgaatatcttggacgcattgttttcaatactgagggcttgttgtatcctgacagtgtggttgg

SEQ ID NO: 1306 - DNA, 818 bp, Glycine max
  misc_feature (38)..(42): n is a, c, g, or t
  misc_feature (758)..(758): n is a, c, g, or t
  misc_feature (779)..(783): n is a, c, g, or t
tgtaaagtccactcacaatgataatagctccaatcacnnnnnaaatttaaaacatagcaaattggcacatttaatttaatttggctatattgattaagagagggactagactatgctagttgaacattgcataccttcccaaataaacttgctcagccaaaacaatggatcccaatgcagcagtgataatcatacatagagggctgaaagaagtcacaaacacaggtccacgttccctggtcacaactccttgtacatagtatgccattccagagcataccaccccctagttataaaaaaaatgaatttttttattcgtaagaataaaagataattatcaagatatttataataactcatgcatttcttgttaaatgagtgctaagaattagttgaaccatttaactactaattcaccatattagtttaattaaactaattaatttatctctaggattgagaggatataagttattaaatataaggcaaaaacaacagatgggttggtagattagtatggaaaggtgctcacagaataaacacaagctaggagccttgagtccatgcctattgaccacacgctcatgtcacgttcaaatataagggtcgcaattgcaccctcaaaaatgcccaaaaagcaaatccaagctgtgaccgagagctctgccgggtacatcttcaaagtgaaagactaaaatccacaaagtacagcaacattattagtacatgaacatttttttttgtttttttttatcttngacataattaaaataaaatannnnnttaatttttatacactcaatgtaaaaaaaaaaaaa

SEQ ID NO: 1307 - DNA, 465 bp, Glycine max
ctctcctcagttgcccatttctgctcattgctcaatctccaagtccaattatctcccgtatcagtgtggtaggagctgtttattgtgatacctgctccaccagcactttctctaaacagagctacttcttgcaaggtaaggcaaggcaattaattaagcaaagcagttaagagtttcaattttgcaatgcactgtttcattggtttgtttgttccaattaattaatcaggtgttgaagttcacatacagtgcagatttagagcaacctcaccaaaaactagcgagcagataagcttctcagtgaatagaaccacagaccaatatggagtgtacaagttggaaataccatcagtggacggagttaactgcatggatggttcggcaattgtgtcactctgccaagcaactttgataagtagctccacttccacttgcagtgtcccctttctcaagagcacaacacgt

SEQ ID NO: 1308 - DNA, 403 bp, Glycine max
  misc_feature (55)..(57): n is a, c, g, or t
tgacttgtacccctgtggagctgagtccttgtttgggggcaataacttcctctcnnncaccatcaacaatttgttgccagaaggtgagggaacaaaggcaatgcctctgtggttacctcaaaaacccaagtctaaggccatatgccaattctcctggctccagaagggttgctagctcttgtggggttccctttccaacttgttaattaccttcatatcatatcatatatagtatgtaataaaccctgttggctggaaattatatatatatatatataagaatgatatcagtcagtattgcagaataagaaaatgatcgatgctagctagctgtttaagagtgactatatgtttgttagcttgaacaagttaatatatatatgtgtgtgtgtcgaagaaattc

SEQ ID NO: 1309 - DNA, 351 bp, Glycine max
gattacgatgatacccctcctcatcccaaaaatggcaaaagtggtaagggtagtaacaatgtcaaagaaggccagatgggcctgggcccaataatgggtaataatcttccaatgcgtcatcagatggagaatattcaagcagtacaaggacttccggcgatgaatggtgatggtgggtattatcaaggggtgcaaatgcaacatgctccatacaataaccttcagcagcactacatgggtatgatgatgaaccagcatcaacatcagcaagcaaatatgaacaacaacatgtacccaacacccatgatgtatggtaggccgcatccatctatgaactacatgccaccacct

SEQ ID NO: 1310 - DNA, 400 bp, Glycine max
aaggttgctgcatatcgctacgttgtccgcaaaagcagcaccatttgagaatggctattattaaatagtttctaggaccttctttattaattaatatcttgcttgtgatgttactttttctacctttttttgggttaaatttttagagggtcttcttatttatgcttctgaactcattaaaagcctgtttcacaggtattaactagtagtagtttattaactagtagtagttgtggtggtactaatgtgatgtaaaaaaagagagaaaaaatggttgttgtggtggtggtagcatatggcttggtatagaaggaaagcaagtaagtttgcttatatagcattaccaaattactgtttgttgtccttcacattgtggtgactcttgttgcaagtaaaaaaa

SEQ ID NO: 1311 - DNA, 883 bp, Glycine max
  misc_feature (824)..(831): n is a, c, g, or t
  misc_feature (877)..(880): n is a, c, g, or t
tgggcagcgagaggagactcgtgacattgctcgtgttttgtctcgctataatgacatcattatggctcgtgtttttgctcataaggtatgctggtgaccagtgaatgtgagttacttgtatttcatttggccattgtaccgcagttactcatgtttgtggtcagtgaagaattatatctgcatctaatatttgtgacacgtgccactggtaatgtataatgttggattacatgtaatgctaacatgagaccttgagatgaattaacagtattcaacaggagtattttttattattaacattccacagccgtgaactaattttcatatctattaagattttaatgagcttagtatcacaatgacagaaactgctttgcaattgtgggctttgtcatctcattgggttgggaggaatttttatctgctccagagatgtgatcaatcattatgaaagaaaaatgagcactttttgtttacctttttttttgtgttgaaaaaattgtaggacatacttgatcttgcaaaatatgcaactgtgccagtcatcaatgggttgacagactacaaccatccctgccagataatggctgatgcccttaccatggttgagcacattggtcggtttgaaggtacaaaggtcaggttatgttgcttgtcttgaaaagtttgcttcttcctaattcttagtggcattttcaagggaatagttgtcttactgtattctgcattacacatgtcaggttgtctatgttggagatggaaataatattgttcactcatggttgttgatggcatctgtaattccgtttcactttgtctgtgcnnnnnnnnaaggatttgaacctgatgcaaaaacagtgagaaggcaaggaaagcnnnncag

SEQ ID NO: 1312 - DNA, 774 bp, Glycine max
catggcttcttcttcttcgattcgacccactctctcctcccttagattcttaacaccgtcatctctttcgctctccaacccttcttctcgtatctctttctcccatcttccctctccctctggtaagttcctctcgccatttgtttaaccttaaatttcacatccaactataaatcaaacaccactttactaacctgaaattccgcacccttgctaattccctttttgtttttaaatatactatagtattagcaaaacttgtcatgaataattgcattatttgatgaactaaaattgattttgggtgcagtgtctcaatccaatagttttggcctcaaagcttccagagagttgagacaacatggcaactccacgagaatcatggcatcagggcacgtgtctcaatcgatttcagctgcttcaccagaaaatgtgcttgagtgggtcaaacaggacaagcgaagaatgcttcatgttgtatatcgtgttggggacttggacaggaccataaagtatgtactatcatatcctaattaggttctgtttggataaaacttaataagcacttataggataaaatgaattaagcttccctcacaagttaaaattaacttacgtagaggttaaaatcaagtcttggagaagctaaatgagagagcttttattaaattgattgaaaagtgcttatctatgatatgataaactttgtcgagtgcatgtttactcttggtggtttcaggttttatacagagtgcctaggaatgaagctcctca

SEQ ID NO: 1313 - DNA, 372 bp, Glycine max
cagcacaacacaacacaaaaccctttcccaaaaaaataaaaaataaaaaatggaggaatccaaattcggccaaaccgacaagcgaaagcgagttcgcgacgagtcggactcggtcctcaactcgcccgactcgttaaagcatccccgagccgagtctaactcgtccgagtctctccgggttgactcggacgagtttgaactcgcgcggctcgacccggttcttctcaacatgctgaatgacgcggagaatgtggcggagcgtgaacccaccgtgcttgactctgttattaagagtttcgaagaagaaatactttctccggttccgaacccgaacctagcatccgaggcagatgtgtttaagccgaacctagg

SEQ ID NO: 1314 - DNA, 521 bp, Glycine max
gttctgaacatgaagcacttgagctggcagataaggttgagtcttcaatgttcacttgaaggcgaaaagcttgtctgagccactcaaaaacatcatggaacaaagttaaggatctcatggctgacactgaccgaagtgacaaaaactacatcttagctgagagagctgagactttgttgttttgcttgaagcaaagatatcctgaactttcacaaacatcattggacacatgcaaaattcaatacaaccaggtaagttcagccacttacaacatatcaagttgaaaaataacaaaaaagacattacgaggtcatttttttacaaatgatgaacattttaggacaccatgatatggatatctattgtagaaactagcagatatctagattatgaactcatggactaagaatgagtattatcttctgcaggatgtaggaaaagcgatattagaaagctactcaagagtattagaaggcttagcattcaacattgtagcttggattgaagatgttcttcttgct

SEQ ID NO: 1315 - DNA, 386 bp, Glycine max
agcggaatgctccaaatggtcaaaaaatcctatgcgctccctagatctgtgcctcttaccggagctgcacccgcacaagcgcatgatgccgccacctctgctctgcagttgacttccccgaggcctagaggccggcctcgcaaggctcaaattccggtccaaaacttacctcaggacattaatgtgcaggttcagcagaatgccgagcccgtctgggccgcgctcggacttgcagatgagcccgtgcagacagaaggcagcagcaagaagcggggccgtccgaagaagagtgtcactcccggagcaggtccggcaaagagaggacgtcctcccggttctgggaaaaggttgggccgtcctcccaaggagaagtctgtcactgcaac

SEQ ID NO: 1316 - DNA, 405 bp, Glycine max
tccgattccaatccgttactctattcctacaccaccgcctacaacggtttcgccgcgtccctcaacgacgaacaggcggaacagcttctcagatccgaggatgttctcggagtgtacgaggacacggtgtaccagttgcacaccacccgcactcctgagtttctagggttggaaaaggaaacagggctttgggagggtcacaccgcacaggatctcaaccaggcttccaatgacgtcatcattggggtcctcgacaccggagtgtggccggagtcgccgagcttcgacgacgcaggaatgccggagattccggcccggtggcgcggcgagtgcgagacgggtccagatttctcccccaaaatgtgtaacaggaaactcatcggcgctagaagcttctctaaaggt

SEQ ID NO: 1317 - DNA, 742 bp, Glycine max
  misc_feature (729)..(731): n is a, c, g, or t
  misc_feature (735)..(735): n is a, c, g, or t
gttttgattgatattaggtcagagaaagataaggacagggctggtatccctcgccttccctctaatgctaaaaacaggatggctgccattccgtaagtgttactcatactaaggagttctctcatttagtttatctaaaagttaattttaactcatgcagaaattagttttagcttagaagacaaatttatttcattttaccttcttattttcttcgtcaataagtatttgtggaaaaatttaaatcagggtctaaaactttagcttttgagttatttccttatctactaccaagcacttactaggacaaaaaaataatcaaaactctatcatgatacacccactatcacttgttgtggcctttcagtttggaagaactgcaaagcaagctcagggggcaggtcaagaatgttaagaaattggaagctgaaatagtcgctttgaagatttcatatctcaagaaaatcaacaaaggcaccaatgttgtgatcttggactcgtgagttcccttccatgtctaccctattttaaccatccaagtttgcttttcatcattttcactttgtggtggattctgttcttcttcatatcaacttatatccttttgtgataatattaggtactcggacgtagcaaaaacagttggaagaacgctaaccagccttggctttaagaacacatggattgttgctgatggattctctgggaacaaagggtggttgcagagtnnnttangaacaga

SEQ ID NO: 1318 - DNA, 314 bp, Glycine max
ttcattccaattcctcctccgaggtcgatcgcaacttcgacgattcctatgttgccaatcagatattcccaaattccaccctcgcaccctggaacggggattccgattccgacaccaccgccaccaacgcccccgtggtggcgatggccgaggccgaggccgaggctgtggtggaacaagaagaggaacagaaaaaaatggaagaagtggaagagaaagatgatgatgaggaggatgagggggaggaggaggaggaggaggaggaagaggagaaggagaagagattggtgtggtggaaggttccttttgaggtg

SEQ ID NO: 1319 - DNA, 611 bp, Glycine max
cataccacatctcacacaagtgtaattagcagaaaaaccacaaacggtacagaagtggcgacgggaggttgagcttgggggtccaactgcggctttccaataggagggcacatgaggaggcaatgattctaagttagcctgcatttgtaggaggtgggttaacaaaaacaaaaatcaaggcaagagtacaacatgagagtgctacttatgtgtatgacctgttgtgggtgtaattgtaatcactgacctcatgtaagagctcaaggaatgttcttggggcccttctagcttcaagtgcttttgcctgcctagttttccttttggtgcctttagactgctttttctgcatataaactgcaaaaagaaggaatattagtatatgttcaggacccgaatggagacttagatgaaacgaattaatccttaaaagaacaaaaattctgatttagtccctaaatatataaaaagtgcaacaattacatcctgctatataacttaataacaaattggttccaaaactttacaactaatgttaaattggtcttttaaacattacaacttaatgacaaaatggttccacaaaaattacaactaatgtcacactttttaca

SEQ ID NO: 1320 - DNA, 860 bp, Glycine max
  misc_feature (811)..(819): n is a, c, g, or t
tctaacttgaactcatttgaaattggatctcaactgatcattgtgtcattttgtgtagaaaattcgcactgttgagcaggatgggaagacaattaaactacagattgtatgtattgattgacttgattttgcctttttatttgctaatgttatactttcagtaagcttgagatatatgttttaatcttttgtaggtctattttgttttcctttgaggtgtatgttattgttcatttctatattaacttttgagaattctttttttgaagctactttgttcctagacagtgagattgtgagtcactacaattcttgattatattgtcaaatctttccttactttggtttacaatctgttctttgtagtgggatactgctggacaagaacgatttaggacaataactagtagctactatcgtggagcacatggaatcattgtgggtgatgattttcttagcataagattttaaacatagaaggtttcctgcctttgtggggatttcaatttcattgcatttttcactaattgtttccttttgcagattgtttatgacgtgacagatgaagatagcttcaataatgtgaagcaatggctcagtgaaattgaccgctatgccagtgataatgttaacaaacttttggttggaaacaagagtgatctgacagcaaatagagttgtctcatatgacacagctaaggtatatagccttgacattctgtttatagttgctggaatgataatgttcatgccccagaaccagcacatctcaaccctcctcttgcttttttttcctattgcaggaattcgcnnnnnnnnntggcatacctttcatggaaacaagtgcaaaagatgctacaa

SEQ ID NO: 1321 - DNA, 378 bp, Glycine max
ctccatatggtgcaggaacttatgctggagatggctcaaggcagcctagtgaattggaattggctcaagctttccatcagggaaagtactttgcgggcattgcaaagaagctcaagggatctcaatgatttttatcctccatatatctcccacaccatattctgtgtcaaataaaatgagatgttagaagcaaaaataaaataaaagtgtgagagaataaagtaatacttcatatatcttcgatacaattgttgtcaccacttgtcatcgtcgtatcctgtaatgcagtttttattgtcaataacaagaatttggtaattaatactggaaactcggtgctaataaaattgatcaccatcagccatcaccatcagccat

SEQ ID NO: 1322 - DNA, 832 bp, Glycine max
  misc_feature (642)..(644): n is a, c, g, or t
  misc_feature (647)..(649): n is a, c, g, or t
  misc_feature (660)..(662): n is a, c, g, or t
  misc_feature (674)..(675): n is a, c, g, or t
  misc_feature (688)..(693): n is a, c, g, or t
  misc_feature (695)..(695): n is a, c, g, or t
  misc_feature (698)..(699): n is a, c, g, or t
  misc_feature (705)..(705): n is a, c, g, or t
  misc_feature (711)..(715): n is a, c, g, or t
  misc_feature (717)..(724): n is a, c, g, or t
  misc_feature (727)..(756): n is a, c, g, or t
  misc_feature (758)..(759): n is a, c, g, or t
  misc_feature (761)..(766): n is a, c, g, or t
  misc_feature (772)..(773): n is a, c, g, or t
  misc_feature (779)..(781): n is a, c, g, or t
  misc_feature (789)..(800): n is a, c, g, or t
  misc_feature (802)..(807): n is a, c, g, or t
  misc_feature (810)..(815): n is a, c, g, or t
  misc_feature (822)..(827): n is a, c, g, or t
gactgtattaaaatttgtgtcaagtacaaatacaatcaaacagtgcaatacttaaaaagcaatctatcccccaccttccatcatcgcgaataaaaccttgatgccaaaggggactgacttgaaaaccttccagcactctatcattaaattcctaagcaaaatgaccgaatacaaagcataataagtggaaatagagaacaagacttgttgctggaagccaaatatgacagaacatacaccatttgctaaggtagtttaaaatagttggaaatttaagaaagaaaaataaccatcgcaatttgcaagacagtcaaggactaccaactaagaaaaaccaaggtccaagaaagaaacaaaattaatgccattgaaaaacaatcacctaaagtcttagaatttgagtttaggcctaatcaacctcaaaagttgctcatgaggagagagttgtctttcagaccttaacttacatacactgttatggttatagtgctagtcaatgggattttcaacataccccacgaagaactggacgcatctctaacatgaattttagaggattggacataaacgggttgtctaataacatatgatcagataggcccaacaacaaccactaggatactaggatggactctgatagcnnnttnnnatttgagtttnnntctagctcaccnnccccaaaagctannnnnngnggnnaaggtngcctcnnnnntnnnnnnnnatnnnnnnnnnnnnnnnnnnnnnnnnnnnnnnannannnnnnacaaannaaaatnnnaaaatgannnnnnnnnnnnannnnnntannnnnnaaattannnnnnaaaaa

SEQ ID NO: 1323 - DNA, 235 bp, Glycine max
  misc_feature (51)..(55): n is a, c, g, or t
  misc_feature (196)..(202): n is a, c, g, or t
  misc_feature (210)..(213): n is a, c, g, or t
  misc_feature (218)..(218): n is a, c, g, or t
ttactaataatgccttcatgacatcaatggaaaatgcctccatttctttannnnnctgtgactgcatacatgcatgtatgagatgtatctcttcctctccgaataaacggagaaagcgagcctctattactgtaacttgagtttgatacattgcaataataatacaatacaagacaaaaaaaaaaaaaaaaaaacnnnnnnntaaaaaannnnaacanaaaaaggaaaaaaaaaa

SEQ ID NO: 1324 - DNA, 393 bp, Glycine max
gtaggatcatatgcatagaaaatcacacacaatacatcccaatacattagaatgactttgcgatcaaaattggcgagtttagtgaaaggctttccgggatgcaaatagattcgagtttctccgtagttgtaaaagaagaacactggtgggtcgttaggggacataccactagcaatggaaagaaacaatatgttgatgtttgtgtcgtttgatgaaaggtggtaattgcttggaattgcagacctattcagagaagaagattcagaacaatctgcattgattaataaacacatggttagaagaaacaagagggaaacatggtggattgatctacacgttgtttttctcatcttaatttcacttcaccaattgatcgcgtattctctctcactc

SEQ ID NO: 1325 - DNA, 440 bp, Glycine max
  misc_feature (17)..(18): n is a, c, g, or t
  misc_feature (385)..(385): n is a, c, g, or t
  misc_feature (387)..(387): n is a, c, g, or t
  misc_feature (389)..(389): n is a, c, g, or t
  misc_feature (391)..(392): n is a, c, g, or t
  misc_feature (411)..(411): n is a, c, g, or t
  misc_feature (418)..(423): n is a, c, g, or t
gctgacttcttttgggnnggtttgtgtcattgatttgttttcattaattattgttactacaatactatattgtataaattttccacgaaacaatgtaaatgttttcttgattatatgccacccatgtgttatctaaaacaatctaaactttttcagccattattccctggcgaaaatgcagtagaccagcttgtacatattataaaggtacaattggtgttaacacgtattgcatgttccttagtcatgccatccttgtcatcataactcacctttgtaaaattttgtattgcaggtgcttggcacacccacccgagaggaagtacgctgtatgaatcccaattacaatgactttaggtttccacagataaaagcacacccatgncncnanntctataattttatctcctncagacannnnnnttttcaaatgataaaaa

SEQ ID NO: 1326 - DNA, 366 bp, Glycine max
ggcctcttgatggaggctaagcaaccaatcatgccagacatggaatgaccaacaaaggtgacagctttgaggtccatctgatccataagagtgatcaactcatctgcaaaagcttccaaggaggtatacttcaaagggtcatagaggcttggatccttcacagctccagaaaagggccaatcaaacagcacaacccggtagttttcagcaaaggagggagtgatcttctcccagatggactggtctgttccatagccatgagcaaagactatggtttcactgcctgatccttggcttctcacattcaaagcagtagaaagccactttttctgtaacatctttgggttgttgttaaagtttggttcc

SEQ ID NO: 1327 - DNA, 484 bp, Glycine max
  misc_feature (55)..(56): n is a, c, g, or t
attggtcataatttgcctctgacgacgatggaggctctttgggtcctctctcaannttatttcatcgtggatattttcacgtcttgtacgtattaatttacttccgaatatcttcattcttaattttaattctacatctctttctttaccttctttctttaaggacctaattaacttgataactcctaaccatgcatttacttaagagtaatattctcctcattttcaaaattttcaattcattatatttttttttctttatccccctcatattactcattattgtagaaaatatggtaaaaaataaataaataaatttgaataacattacttattaattaaagctacgtataaatttcttaacaaagtactgtattcactatgggaagaaaatcaaaataaataaagaggaaaaatgaatcaaattcatctcataagttaaaattaacatatatcttaatttatttataaataagttatgcgt

SEQ ID NO: 1328 - DNA, 454 bp, Glycine max
catggataatcataacaaataatttaagtaatcccgctatatttggtttcaggtgctggccaagcaaaatgggtcttggcgtgatcgggttcgtcaaacttagaatttgcacccttaaagttgatgctgataatagaaaagttggctgaatgttgaatgaagttgagctttaaccatgtctaaagcattcaattttgcgttgctcagtctgtatatggtgtgagatgggctttaaccgtgtatacaacttgtatctggttcctatgcaactggcattattttcaagcctataatcactagtgaggtaggctatgtgttactgtttatcatttttagagggggaagcagagtgatgtgtgaaacgccatttgtcttttgtgtaattccagtttcatagttaagtatttagaggaaaaacttgcaaataggatgatgctattcatcgctgatcttc

SEQ ID NO: 1329 - DNA, 409 bp, Glycine max
ggcctcatcctcttcatgtcagtaactggggcaattctcttttctgtgattcttgccaatgctattgtcatatgcaacatggcactggctctatctggcatggagggacatggtggatacttggcaattctgaaagcatgtcttctcctaaggggaaggacttcaatggctttgttcctggcacttcctgtcaatgtggccttggctgccattgaggccttgttccaattcagggttgtgaggccctatcatgttgctggaataacaaggccttgtgtggctttggaggggattttcattgcttacctctactcaattttcatcatccttgacacggttgtgagctgcatgttctacaaaagccttaagacaggaccactgatcggtcatgaggacaaacatttgttca

SEQ ID NO: 1330 - DNA, 498 bp, Glycine max
cccttcatcttgttttctgttctctgactgattgatacatcaaattttctgttgtctacttgctgcttgctgcacacctttgtatttctgatgttgagagattgaatgtgatatatatgtatccttcaggaaaaggaagagggaggaaggggacgatttaaatcacattccaatgctcctgccaggatatctgacagagagaagaaggcaccactgaagacataattatatgacacagcctgtgatttcatcattgatttttgcctagtggatgggaaaaatgactataggtgatgatacatccaaaggcaaaggttcttatcttgattgctcatgcaacataggattgaaaattcctcctgagcactaagtggggcacctatatttttttgtcacccaagtgttgtaacatcccctccccctcttttgaataatagtttttatcagttatgaagtgtgcatctatgatttgaagagaagcagaaagtaaaggaaacg

SEQ ID NO: 1331 - DNA, 393 bp, Glycine max
cggcttgctcacagccctcaacaacttgtggacctggctcgctctcttaaccgccgccttcagcttctggaagattcgctccacgggctgtctcaagcccgagcccaagcccgaggcccaagtccaggcccaaccttccatcaggcccgaccgggttgcggatttgttaacggtggagaaaacggagccgacgcaacaagatgcagtgttggttcctttttctccatcgttattgcaaggagaaaacggcgcgaggaaggggaagcttaccgtttattacgagaaggacatggacatgcaatgcacgtgcggcgagcgtgaggggttgttaacggcgtgggaagagaaagaggggaccgaaacggagtggtggaagaggtgggagaggttgtt

SEQ ID NO: 1332 - DNA, 779 bp, Glycine max
ctgtggatggcatattgcattccaaactcaccatcactccagggttggaagacaggtccatgttgtttattcggctggaacataggcaagaatagagttaatggcaaacctcagattaagtaccatgatattgatcttacattcccaacttctctggtcgacaaaacatttttgagaggtactactatccttttctctatctcttcaagttttaaactagttattaaggtactggcaaaagaaaatttagaatctattactatttattattactatgattcatcaactaaaaaaaatataaaaccaagagggtctagacgtgtagttcagttgattgggctagttgcgtgagtattataaactcctattttcatctattttcgattaatatggataaaagaaaaatgaattgaactggcacgctaagattctcttgtttgaaaaacattacacttagaaaaatagggaaattttgtgcaatctcacaaaatcttatgattatcagtgtaatttacttaaatatatgagatttgacaaaattttgatcagggaaggagctcaaatgctgctatagggctacaattgatggattcagtgcaaccaatttccacgaatgttgtgacttcaagggcccatgtgtgataatcggctacacaaacaagtctttcaagtttggtgcatttaaccctgaagggtatagaagcacagatgactactacgacacatttgatgccttcctattttactggatagacaatgaaactactaaacccatcatg

SEQ ID NO: 1333 - DNA, 373 bp, Glycine max
  misc_feature (339)..(340): n is a, c, g, or t
  misc_feature (342)..(344): n is a, c, g, or t
  misc_feature (347)..(347): n is a, c, g, or t
  misc_feature (350)..(354): n is a, c, g, or t
  misc_feature (356)..(356): n is a, c, g, or t
  misc_feature (360)..(360): n is a, c, g, or t
  misc_feature (369)..(370): n is a, c, g, or t
ataaataaaaaatccatgtgacgtctcataattcatccatcacgtttcttataattggtaatgaccagagcttctttcttttctacaggatcatacataagaccatgattgcatgaaaaaaccctctcatcaatttattttttttataatatagtaaaaccaagatataattttcttgtatcaacttatttaaccaaaatacttatggaacgaacaagggttgaatacaacaattgtaacaacatggggtaatgcccacaatggaaaaagataaaagaaaattatatcttggttttactatattataaaaaaaataaattgatgagagggttttttcanncnnntanggnnnnntngtangatttcgtnnaaa

SEQ ID NO: 1334 - DNA, 873 bp, Glycine max
atcaatcaaaacgaacacttcaacaatgctcgttctgtattcaaagtaccacaaaaactaaaagccactatgtcccaggccaaatgtaattgtccaatacacctaagcatgaccttcatacaaaaacctaactttcactttcacttttaaggaagtgagggctaatcaagcgagcaatctctagcatctcaacttgatctttccctgcaaacaccttcttcagcttctcatcacaatttatagtcctcttgtctgtagggtcctatgagaagtaaaagaataaattcagtacaaaccaatttggtgaatctattttttgaatgcaagatagcaaatatttagaaaatatcagataaaacatccaaatacatgaatggcaagtaattcacacactgcacttgtacaagaaggatagagtctcattagtaagccagtgaagcagcatactaacataagccttcaagtaaaaaatagcaaatgtttatcaaacccaggaacttgaaatggctccaaaattgacaacagaattcctcgacatcaacttaacagaattgcatcaaactattaaaaatggaatagcagataggctaatagtttgtgtgaagatgaattaatttgtggaataaacacaattaaggttaaggttatgaaaggtaagatagaaaagaactagtactgtataacaaataaaatattcgcaatggggtcgtaaccaagtaggaaatgttgaggactggccctattcacaagttaaagcaaaccctatgttggttagaaaggaaaaggaatgcaacaaaacagaacagagggtagggttttagggttaacctgaagattgttgtccttaatgtaagcccaaatccgttgaggact

SEQ ID NO: 1335 - DNA, 407 bp, Glycine max
ggggaggctccttcgacgcagcatgggagagctcctcctcgtggtcgacgggccttgccggcgaccacttcaacggccagtccccctcggaggtcctctcaaacctccaggacacggaggacaggctcttccagctggaggcggagaaccgcagaggtaaagcctactgtgacagctggaggagtcgcttggaggagacgacggtgctgctgaagcaggttcaggagcccggcgcgcgaggctcgtatctcaaggattccgagaaggcagagatttatcgactgcacaagaagaaccccgaggtctacacagtggaaaaactcgctagggattacagaatcatgcggcagagggttcacgcgatcctctggctcaaggagatcgaggaggatgaggagaagaagctc

SEQ ID NO: 1336 - DNA, 445 bp, Glycine max
ctcccgtaactttcacctgactttattctactttaatgccttccacaaacattttccaccatagtcttagttatgtatgcctgaagattaatgcattggttttgtatgttaaccaatgcattggttttgtatgttaaccaatgcattggaaggagatgttttacactatcatccttagcaacattttctcttcttatttggggcttaagtcccaatgttgaaaaaaccctaccttaaatccacgagtcacctaaacaaaaattgatggctcataatggtatacaacaccctttcacaatgttattcaaaattgtgcaccctctttgcagagatgagtgtattttgtagaagcattgctatggtcattggaccaactcctccaggaactggtgtaacagcagaggcaattcttatggcttcttcataacaaacatctcccacaagt

SEQ ID NO: 1337 - DNA, 750 bp, Glycine max
tgccccatttctacacccccatgggtaactaaaacagttccatccgtatagacttgaaccagagcacctgcctatagttattgagaaaatatgaaagtacacaattattactatctaataatgcaatcatttcacaactaacaaaataggaatataaagcaaaagaaaattctgaatgaaagcaccacaaaaatttagagcacaattaccaactgactaatgtagttcttattgaattaagcaccaaaggatttgaattttggactgggctttgtaatatatacttaatctattataaatagcccttacccttaacatgctgtattcagcaaccatatcttatgctttcaaatttgaagtggtttatgagttatgaccatactagatacaatatcccgtgcatttgcacgagaaacaataatacagtgagcattaaaaaaatatatgaagcaaaagagttcaagaggtgagaaatgcaaacagcagaatagcatacaactcaaaagagagagaaaacacaaaacttgacaagcttcttatttccttaaacttcagttgaaatcacttttttcttcatttttaaaattaaaatagaatgatagaattcagattttacctggttcataagctttgttgtaaaggatataccaaacttattaggaatcatagcaatgccacgcttcctccagcggttgtgactattgaattggtcaacttcttcacgtgccttcgcaaagtcacaggataact

SEQ ID NO: 1338 - DNA, 390 bp, Glycine max
ttttccatctaaaattaagcatatgcacaaacaacactttcttgtataccagcattcaacacgcaaaattttgaccgcaccagcaaaatgaaagttcccttgtgcaacttcaaatccactatccaatataatgcatataatattacagatatcgcatggacagttgctattgacattcttccgagaaaccaactccaccgaagtatacctattcttttttctcatcttttccattattttgaggattaagctcgtcatcatcataatattcttcaaaatattcttcatcactatcctcctcatcatcataataatactcctcgtcatcgtcatccttatcatcctcgccattttgtagacgaagtgtgccatctcttgactgctgacctc

SEQ ID NO: 1339 - DNA, 803 bp, Glycine max
ataataaccatgatcagagcaacaatgtacatatataagcctcactcacttttacatatgcatggtcccaacagtcacaaccaaactgagcaccttcaaatttggggaagcagaaaagggaggcaaagaatacaaagagtcaagaaatataaaaagagggagaaaaaaaagcatataaaacggagcagctatgcttcaaagagaattaaaaaatgaaatcgtagaagcttgtcggcacacttcgccctcaattcacctcagccattttctctctggaagaagcagaaatcaagtggtaagtaacacaaattacaaagcagaacttttttctttttcggcacaagagatcaaacaaacacaatcatacattacaaatatcttaaaggtaagagcaacattgatatattggcaaatatgctggtctaagaagaaagtgataatcaagtaggcaaatattaatgctcaaaggacaaaaaacaaatgcacacaaaatatcttgccattaaaaggtttgcaacattttttcattaacaaggaagatctgcctccttgcacttgagcctcaaaaagtggcatttccaacattatttttaagaacacaccccgaaaacaaactgatgaaaaaatgccattaacattctagctcctctccagccccaaacaaccacgatgatcagaaacacaaaatttaatataatcattaacttttggcatactaaatcccagacataatctgtaaacgtagtatggattcttgtaatgaacacagccctgattaatcaaaggttatacccacacaaaaa

SEQ ID NO: 1340 - DNA, 387 bp, Glycine max
agccctggaacgaatggtgttggaagtggaaaacgtggaaatggaaaagcagcacgtggaaatggaaaagaaggacgtggaaatggaaaaccaaatgggaatggaagaatgggagggatgatttggtttttgtcaaatctttcttctttcttttccacgttatagttcttgcttgttggatcatctacttgtacttgatgatcatgtttttcatcatgtcctctatttgcagtgccaatattcatcatcacttctttctcgtctggtgaagtagtggtggtactcatgagttgtcttgcactagttggaacaacaacattgctgatcactgcaaccaaacagaacaaaagcataagattaaaggtcattgtgagagatctaaggaaa

SEQ ID NO: 1341 - DNA, 1093 bp, Glycine max
ggacagcaacagcccttgaacaaactcgcatcttttttccttctcctccttatccttaactgacaaggttgatgtctccacatttctacagaaaatagtagaaacacattagaaactaggagatgctaggaagacaatgaaacccacgctacttgatagcatattatgcccttagcaagcattgttttgcaacagagtactagattgattgggaaggtgacaatttatagaaacatatgagaaaataatatgaaaaaaaaaagatcaagagaaagcaaatagagtgttcaattgaataggcatgaagctataaataataaataaattcaaacaaataaaacatgctagcatcacatggttggcacaaatgggagtgataagaaagaagaaaatcatctcagtgaattcaatcttgtaaaatattttacaatattaacaaacaatttctaaacttctaatacaagtataataaactaggtaattttgcatgaaaaacaataaatgggaacagtatgtaaccaacccaaacaggaatacttgcaaagaattccatgaagaggaagcgatttttttttaaaaaaagaaatagaaaactgaaacagaaataccttgttgacacagtctcatctaagcattttttagatgatcttgtctcagtgtgtaagtgaggctgagaactggcatgttcattagctaaaggcaatataaatgatgacaacagtggatctgcattagatgaggacactatacatgaagatccaccaaaaagggattgcaaatttccttctcgtagttccttcctcaataaagatagtgttgaatacgatccacctttccgtgatttccttttgcgctgcatgtattcactggttaagaaattcagccaagtaaaagttgggtttaaatgtaatttttttttgtgttgttttcaattttattttgattatccttttttaaaatatgcattttggcaacagcaacatgtcccataataataatataataaaagaaaactcaataaatgctcagttaacctgcgattaagtaaaaagttgtgctaagctgctaataaccatttaagaattggcacagc

SEQ ID NO: 1342 - DNA, 384 bp, Glycine max
tattgttgtatgggttgatcctgagacgcagattcagcggctcttggcgagagacaaatccagtgaggaggatgctcggaataggattaatgctcaaatgtcactggatgttaaaaggggtaaagctgatatagttatagataacactggttcattggatgacttgaatcaacagtttcagaaggtttttgttgaggtcacaaggccattgacatggactgagtttttgcgctccaggcagggagtcttcgccattcttgcttccttcacctcaggtgttgttctgtttatgaagacattcaacaatcatacccacatttcatagccacctgtgttctacacatttgttaatgtattatttacattccctctaaagccctaaac

SEQ ID NO: 1343 - DNA, 481 bp, Glycine max
gaatcgaagaacacgcgcttatgtttgccactgttcctccaatctcactcgcgctgggtctcttgcatccctgtacatcaataattattcagatcaggacaccaaaaacaaacactgaaagtagtagatctgagaaattgaggggaagctgaacctttcgataagtggtgccatcctcttccacgatccaaccagcttcggcgcatagagctttcaggacctcgttgttgtcacagtgcttcggaagcttgtagttcccctgagctcgaagaccggtgtagatcttagcggcgatcgctcttcgtctcctctctctcctcttgttgttttctctctccttccatgttggcaacctccccgtcgatccgccgccggtcatcgttccggcgaaacgaagcttgtttgttccgacacctcttctagcgtcggatgcagaagaagtgaaagatatttgttttcgtttgtgtgaggattgaagttt

SEQ ID NO: 1344 - DNA, 662 bp, Glycine max
  misc_feature (586)..(615): n is a, c, g, or t
  misc_feature (618)..(625): n is a, c, g, or t
  misc_feature (629)..(657): n is a, c, g, or t
tgtaaaaataaatatatgcacatatcaattattttaactttcaatttttttatcaaacatgtagagaacaatcaagagagtagtaaactatttcctttgtaccttagttatggaagcgccatggtcatctctgtagcggttgaaagttgccagaagttgtgtcttgctccttgtggtgaggatcctgatggcttcttcatggttgccctttttctccttgatagattcatgaagaatatcagcttcagttttggccaattttgcattgacctcatcaccatcatacctatatgctgtcaccaacccaaccaacagctgcacaaagccaaaaccaagcacaggctcaaaaccattagcatataacccttacatttcattaagcatgtgctttttatcaaagtcttcaaaaatggtccagaactgcaattgtggccacatcaggtgatgcactttgccatttgaaaccatggtcaaaaccatgagcgtttttgccccgaacattttgatcattaaggattgtgatcaaggttttaaaaaacagtcttgcgattctcattttggctatgacatcaagttttttttttgnnnnnnnnnnnnnnnnnnnnnnnnnnnnnnttnnnnnnnntttnnnnnnnnnnnnnnnnnnnnnnnnnnnnnaaaaa

SEQ ID NO: 1345 - DNA, 380 bp, Glycine max
cacccatctggctgctcccaaaactcactcttctcaacaccctcatcaccttccaccttctccaatccctgtgctctcagctccacatgagccaacaaaacctcatcttttttttggtcattattctctctcacaacagcaccaaggcttggctttgaatgtggggtggttgagatcatgttccgtggcagaagggttgtggtggcacatgggtaggggggaaacggggtgtgaagtgtgaggccaaacttgagcatgccaaggaaaccaaagagaaagagtgtgaggaaccacatccttggttttctgaagatgatgctgttggtgttggtgaagaagataaagaacctgctgttggtgttccttgaagacttcttgag

SEQ ID NO: 1346 - DNA, 674 bp, Glycine max
  misc_feature (57)..(59): n is a, c, g, or t
  misc_feature (582)..(582): n is a, c, g, or t
  misc_feature (621)..(628): n is a, c, g, or t
ttaactgtgccaatgatccttctcccatgtatttgtgaagttttgtgtggccttttnnntttctctataacatgtaaaatgtcagatagcccattgcaaatgttaatgtcccgggatgcattttttatctaagaaatcccaagtccttttttctcttttttcttccaaactaacatgcaatgtatataaaattgtgcaaggtggtagctcttacatacaatggaacttcattataaaaggacattagaaacatcccatttccacaaataaaaaaaataatcaacactttcttaatgcagcaaccataaggtttacatcctaatagtagttatccaaaaacaaaacatgttggaagaaagaaaaaaagaaagagcaaggctcatgctcaaaagagaaatgtacttacttgtatgagtacttcagaatgcctgataccgaagcaaacccatctttattctgatgactccaccaagttgaatgtgagcttttgtgaggattgtgaggatttggtgaccttgaagtggctatggaactggtgagagaagcaccgaagtcaatgctagtttctaatccatttgttcntatagggatagttgttaagctaggctcgttcgcagctcnnnnnnnncgatgagctcgcttcttgtaccaccttatgccaaaatatagagcaa

SEQ ID NO: 1347 - DNA, 448 bp, Glycine max
tttatctgattataatttttgcatacagaggcgaagagacaggatcaatgagaagatgcgtgcattacaagaactcataccaaattgcaataaggtcagcttcactttatctgattttgcttttgttaggcatgcctgaaaaactttgtaagattatggaatgatggttagtggttacctctaatgatttgaacttgaaaacagacagttattgaagtttgttcttgtggaacatggaaggtttatcaaatcatcagaagttactacttaaaatctgtagattcaaacctgaagttaggcattttgtttgaagggtttatatcctcaaattgaatataaacatgatctttcattaagtatattggtaatagaagtggaagattaacttaaactattagaatactttgtatttacatatatacatacttgattcctcatttattttggt

SEQ ID NO: 1348 - DNA, 396 bp, Glycine max
tggtgtcgctatgtcaggtttgttcttttgattagcatctttgttttgcttgctctcacaattttcatgttttagtaatcggtttcattattggtttgctttcttgctttacacaatgtcttgttcacaggaaaagaggttgagaatgaacatgggacttaaaaaattgcaggagagagtgaagaaacaacaagagaaagtaggaaagaaggtaacaacgttgatcatgaaatatcctattagctattatcatttgctttgaatttgcatcagcaactgttggcacatgagtctttgagaaaggttaccttagttcagagagcatatccactaaccattgatttgaactaaagcattttgtaagcataacttactttaaatcaatggtaggtaggc

SEQ ID NO: 1349 - DNA, 442 bp, Glycine max
gaatgttcgatctcgaccttaaccatcctcctccacatgagatcgcttgatccagaatctgactcatgccttgagtttttctttttctaattttgttttttaaagtagagaaagtagcagcgttcgataaggaaggaagggaagggaaggtaaagaaatactatgtgaatacgtagtcggtatgattgtctctatttttttgcgacagaggaaccaccagtttcatgctgttttttcttaaatcacgaagcgctcatccggtttttctttcgttttgattgattattttactacggtgtaatgttttttggttgcagccataatttggttcaatgaaattaacacggaaagtttgaattattttgattgtgatatacattttcaattaaatacgaatggggaaggaaagaaaagctgtgggtgaagcgtacttggtaataaa

SEQ ID NO: 1350 - DNA, 364 bp, Glycine max
acaccagttgcaaaactaatatcctttcaaacggatttgatctataatggcctggtttctctcttttcccctatccactctcttttctccgtggcttctaagtcctaccaccgtgctgaggagaccaaagacagtgttgaatcagcagtgcaacgtgctctttctcatcaaatcactcatggcagcgcactcttgctgaagaaactaggactttgctttctgagtgttgcgtatgtgtgcatggttatgattttggctctcattctggctgctgtggtgggtgttgctttggttcggttgtgggtggaggaacccgtgtctgtcaaggataatctgcattttgattacactgaagctcacccta

SEQ ID NO: 1351 - DNA, 406 bp, Glycine max
agctgcaaggaaacatgttaagtttggagaacataaaaagcatgcatcttccaagggttccgatggtcatatggaggtagtagaggactccggtagcaagaagcagcgttcgacaacaggacagggacaagctagtgatttgagtaaacaattgccacaaggtagaagacgtcaggcgtttcctgcttctgggaatcgtagttcaacattccgctgagacaatgaaaatagattttatgtacaaattgacaaagccatattttcaatttagcagtgttaaatccaacatgatcaagatatataattttgtgatttagcataggttgtgtcataaaagctcacatattttgattataatttttgttcattacttgagcagcaacagtttttttgcgccgatcagcta

SEQ ID NO: 1352 - DNA, 644 bp, Glycine max
  misc_feature (403)..(405): n is a, c, g, or t
  misc_feature (415)..(417): n is a, c, g, or t
  misc_feature (419)..(419): n is a, c, g, or t
  misc_feature (441)..(441): n is a, c, g, or t
  misc_feature (443)..(443): n is a, c, g, or t
  misc_feature (448)..(450): n is a, c, g, or t
  misc_feature (453)..(454): n is a, c, g, or t
  misc_feature (458)..(463): n is a, c, g, or t
  misc_feature (466)..(469): n is a, c, g, or t
  misc_feature (491)..(495): n is a, c, g, or t
  misc_feature (508)..(508): n is a, c, g, or t
  misc_feature (511)..(517): n is a, c, g, or t
  misc_feature (526)..(532): n is a, c, g, or t
  misc_feature (538)..(587): n is a, c, g, or t
  misc_feature (589)..(593): n is a, c, g, or t
  misc_feature (595)..(595): n is a, c, g, or t
  misc_feature (604)..(607): n is a, c, g, or t
  misc_feature (614)..(616): n is a, c, g, or t
  misc_feature (622)..(622): n is a, c, g, or t
  misc_feature (629)..(632): n is a, c, g, or t
  misc_feature (637)..(638): n is a, c, g, or t
atgaatgcaagaatattgcaatggtttttgcaccaaacatgactcaggtatcctcattactgtacacattttctgttaatattagtatagtttgctccatgttcttctatttgtatttgttgttttttttttttgaaaaaaattttttgaaaaaaaaaggaaaatggtttgggggaactttttttttttggggcccctttttaaaccccaaggttggcccaaaattccaaatttaacaaattttaaattttaaaaaaaaaaaatggaaacccccctaaacccaaaaaaaaaaaaaaaaaagtttttctttaaccaaaaaaaaaaaaaaaacaaccaaaaaatttgaaaaaaaaaaaaatcccaaaaaaggaattaaatttttttcccccgggaaaattttggnnnggttttttannncntttttcccaaaaaaacccgttncnttggnnnggnnaaannnnnnggnnnnaaaaaaaaaaaaattaaatttnnnnntcttcccccccgnaannnnnnncggtttttnnnnnnnaaaaannnnnnnnnnnnnnnnnnnnnnnnnnnnnnnnnnnnnnnnnnnnnnnnnnannnnnanaggggggannnngggggtnnntaaatnttttttnnnnccccnngaaaaa

SEQ ID NO: 1353 - DNA, 379 bp, Glycine max
aagaggtttacaacctaatttgcctttacatgctagctagcatgcacatccccattaattattggtttatttagattgagcaacaagcttttgtttagcatctttggacgccacactagctaatccaaacgagtctccattcacaaaattacattgcaagcgaatttctccttcatccccagtcagcactccaatattacccatttttatcattgaaactctaaagttggaaaagaaagtattctggttactgctgaagctattgacaatgggaatggtatcagcaccaggagtggagaaaagttcttggtcactctgaagtaagccattgagctgcagaagattggagtagtatctgttgtcaaattgatcaggtgtg

SEQ ID NO: 1354 - DNA, 427 bp, Glycine max
gcacctcagcttatggagaagttagatgagagaacttttgtagaagttgagtgcttaggttgattttaatgtatgggagaaatttacttaattgcaccttattttcttctcttgtaagtgcttatagaaaagtttattcaaacaggacttaagtacaaatgggaatttgaagcagtggaagagatattgcgtatttggttttaagaaagaaaagatttgttttccctttagttaagtcatagtttatacctgagctgagttatggaaaaggattttggggaagaggatgtgcccaatttgacaatttctttgcattgaaatggattaatctctgattttgtaagggggaaatccttttagcagtaaataaaaaaactatacttgagtcgacaatatgatataatatggtgtccttgtttcaagcaac

SEQ ID NO: 1355 - DNA, 762 bp, Glycine max
gttgcagattattttggtatcgcagggaatggtcccaaagtaataatttcccctctcttcttaattttattttagtggttgagtcacgggattcttctcctgttaaagtcgttcagattcaaaataggaagtaaattaggtaactgatgaaatttccaatataggtacttgcattcacaggaaatgatgatggaagaaaatttttgcttgatggagaggtgactattgacacaattacggtactcttctctttcttcctgcttagggggctctgttcatttttatggaacatgcataaatgctttcttctgttttagaaagtcttggaagagattgtggctaaaaatctgtattcttattttttctcaggcgtttgggaatgatttccttgaagacaagctaaaacctttcctcaagtcagatccagttcctgaaagcgtaagttattttgttatcagtccgtgttccattggccaaaattttcatgtctgacatgttttcttacttgatgacagaatgatggtgatgtgaaaatagttgttggtaataactttgatgaaattgtcttggatgagtcaaaggatgttctgcttgaggtacaattctaactcataagtttccaagtcatgtatttgcatgtgcagcttgttcgtgttaatctaatgtttgttgtaatattagatttatgctccctggtgtggccactgccaagctctggaaccaacatacaacaagcttgctaaacatcttcgcagcattgag

SEQ ID NO: 1356 - DNA, 345 bp, Glycine max
gcagaccaaggtaaaatctgtacctgcagctcttcgcaaccgggctaagagaagaattcaaccatggatgtgggttctaattgcagttgtggttgttgttgccttgttttatgtgggcaatagcagctctttgagatcttcgcttgaaggctttggttactgaggacactcggaagcaatcacaaggcgtttgtcggggaagagttaccgttacatatttatattttacacaaatacatatagacgcaattctttcttgcccttgcaattttttcctgctagcttttggtcatagccattattttcttcatattgagatttgttagtttgggatgtgatgtgact

SEQ ID NO: 1357 - DNA, 968 bp, Glycine max
  misc_feature (917)..(926): n is a, c, g, or t
  misc_feature (940)..(942): n is a, c, g, or t
  misc_feature (965)..(965): n is a, c, g, or t
gcactacttagtagctccgtgtggattagttttctaccaactgcagctgcagcagcaggaccaccagtcttggcagcagtttgaaaggttgcaaaagctgctggtgcaatagttggttggattaagatcatagcaagagcagaaagtattacaagcgtccgagctgttattacctgagacaaaaaacatagaggattttttttcttctcttaagatctatttatacaccagaattttaaaagatctagggaaaaacaaaagtactaccgagaagaatatcatccaaaaccaaaataaaacaaaaaatcgaagtatgcaacccataataagtctctattcaattacgcataacttgatgatcatgttttattggcacaaatatgtaactaatgacagaaattggtcaagccgtcaaggtacaaaaaaccatataaggcccccaagaagctaacaacttgcactagtcccaaatcagggtcatagatttgtttggtacgcgagaaaataagaaaaaaaaatagaagcagggttacagattgaaacagcaaaagaacagctaaactaaatttacaagaagcatggcatttaatttaagtttctaaggaagattcttcccccttagcacgcatatcaaattcgaattgtataataaggatccctggcatttttaaaaatcaaaagagtagttttatctccccacaaggagatttcatttcctctttagttcaaataaccaaacggcatttcttcttaaaacataaacttgaaaatgaccaaccatacacaaattaaaaaaacaaaaaagtgttcatacctttggttttgggaaagccccggttttgatttgattgagagaatgggattcgagtgtggagggatctgaagaagaggaaaaggatggaaaattaatggggtgnnnnnnnnnnagcgagaaagggannnaagaggaaaaaggagatggattngca

SEQ ID NO: 1358 - DNA, 325 bp, Glycine max
  misc_feature (267)..(268): n is a, c, g, or t
  misc_feature (277)..(281): n is a, c, g, or t
gcagaactattgtgtccaacaatgttgccccatctggctggtcctttggccaaacctacactggtgctcaattccgctagatcttgttgtccaaagttctaagtcacacattcaaatactactactatatagcataatagatatatggtattagtaggttctaagagtattattattatgagtttatgatgactggttagtatactagggtattagatagtatgctgctaggggaaggggtcagttttttggtaatttttgaaggcnngggaattannnnntaagaaggggtatgttttaaattgctccttcattttaattttaa

SEQ ID NO: 1359 - DNA, 388 bp, Glycine max
attaggtgaaaaaggtgttagagcatttggagcacttttgaaatcgcagaaatgcttggaggagctttatctgatgaatgatggaatctcaaaggaagctgctcgagcagtttgcgagttgattcctttcacagagaaactcaaagttcttcattttcataataatatgactggagatgaaggggcactagctatagccgaggttgtgaagcgttctcctttgttggaagattttcgctgttcctccacaaggataggcgctgaaggtggagttgccttgtctgatgctttagggagttgtgcccatctgaagaagcttgatttgcgagacaacatgttaggtgtggacggtggggtttctctgagtaaagctcttagcaagcatgca

SEQ ID NO: 1360 - DNA, 645 bp, Glycine max
  misc_feature (442)..(459): n is a, c, g, or t
  misc_feature (463)..(611): n is a, c, g, or t
  misc_feature (613)..(613): n is a, c, g, or t
  misc_feature (616)..(630): n is a, c, g, or t
aagaggttgacagtgtggtcggggcagacaaaagtacacttgaaagcaagattgcacaacatgctggctctctttaagtgaataccttataaaaaccctgatacaattaacattttcttgtttcttgttttaacatgtccatagtgtcatacaaaggcaaaagatcaaattgagttacaatgtgttatggcttggcgtttcctctgtctggttgcatgtacaaaatgttgtattgatttgtaataagtttcatattttcaagccgattttatgtttgtgatgtggctgtaattaggggtggaaatgagtcaagtcaagccaagttttactaggtttgaacttggtttgagttgaatacgtaaggtttgagcttgactcattaccacccctaattacagccacatcacaaacataaaatcggcttgaaaatatgaaacttatnnnnnnnnnnnnnnnnnntttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnaannnnnnnnnnnnnnnttgtgcaatcttgct

SEQ ID NO: 1361 - DNA, 345 bp, Glycine max
atgggctcgagtggataatatgaccatccttggagaagatgtccatgtatgtgatgaaatttacagcaatggtggtgttgttttgccacacaaggagatcaagtcaaatattctgaagccggagattgtcatgtgagtgaggtcaatgatgttcaaaatggtagcatgtggtgaggaggtagaaaaattattgagtctgaaatgtttgtccgtttcattttgtttttctttttactttatggcgtttcttttctttttataggtcagttttttggattagaatgagtgatgccattgcattgatgaaaaggtcagcatctttgtaaatggcgttaagtttggtct

SEQ ID NO: 1362 - DNA, 716 bp, Glycine max
  misc_feature (709)..(713): n is a, c, g, or t
ttttgaaggccgtcagtcctacgacaggtgagatccaataattgaagtacttcagcatctattttaatttataagtaaattacaataactatccctgaagtttaatgaaattacacaagcactcctgtctttatctattcttacactaacccctttagttatttaaaaatatacattgagacttccttaatattacattgtaaatgttaaaaaaaaacagaataaatttgtgtaattttacaaaatctcataagtggttagtgtaatttacttttaatttatttatggtagttgttaattcatgtattctgaacatcttggacaggacacgccctcgaggggagcagtttctggtgaggtgggctattcctcagcttcatgacattgatgcattatcaaagatggttgatccttctctaaaaggaaattaccctgccaaatcattgtcaaattttgcagacattatttctagatgtgttcaggtaagctagcttctttcactctgagcttaaaagtgttgctaagcttgttaatctctttgacatggaattgatttcttggccttatgtgtatgtgttatgcagtcagagccagaatgtaggccagcaatgtcagaagtggtcttgtacttaataaatatgataaggaaggaatatcagcaaagtgaatcaaacgaataaacaatggaaatggtaatgatattgaacannnnnaaa

SEQ ID NO: 1363 - DNA, 363 bp, Glycine max
agacatgcgtctaaatctaaatccaacttgtccgaggcctcacatggtcacagcactggcatttcctccatgtccccggatcattctcatgaaggaaaagcaaagagaagaaaacataaggaataataatgtttcctatacttgccgttggcctatttatggtgcaatatttagaggttacattctacctggcctttaaatatgtccggaaagaatagtgctaaactttttatgttgcagaaggacgataaatttaaatgtttgcattctcttttttgtcttttttttccccttgttttgcaaatgttcatttgcttcagttggacaatgttcactggcgtgtactgaagggcgatattaatt

SEQ ID NO: 1364 - DNA, 393 bp, Glycine max
tggtgggagtgattcctcaaatggggtgctgaatgagtcattccctaagcctgttgtgactgttaacatcgagccggagccgaatgtggtgcagcaggattttgtagatatgtacatgaaaagcatgcagcaattcaccgagtcattggcgaaaatgaagcttcctatggactttgaaagtggaccaactagttcaggaaactctagctctgaacagaagatacagacaccaaagagcactaactcccgtgtgttttatggaagcagggctttcttctgaactttggatcaagggaaatactttcaggtgacttagattttagaatgaaaactgatatcagtagtgaatgaaataatgcactgtccagtgggattctcgcttctggtacttgt

SEQ ID NO: 1365 - DNA, 1033 bp, Glycine max
  misc_feature (997)..(1004): n is a, c, g, or t
ctagtttcttttttgcgagtgtttcttttgtaaatagatataagagatacgttggtttgaagtttcccttcttgaactaccttgtctactagcgttccctagtgttttgattccccacacatgggttgcttaaacatggattgtttgctctcatttgattattggtttcctgaatataagagatactaacatgcaggttgttgtaaccatttggtatcgtgcacctgagttgcttcttggagcaaaacattataccagtgttgttggtatccttttattaaagttttactttctttatgtgttgggtatcaaggtgattttattttttgtttcattcatattttccaatcaaggaattgttatgctgtggcatagttagcttcatagttacaagttttgtggttctgttatccccaatttgacttgagacacctgctttaatgagttataattttgctgaattggagatgtccacaagattgacataatatttacattttaatttatccatttggatgttgggggaagcttctactatggtacacataatccacaattaaacttgtccatggtgtatagtaattgaatgtgtctgttgcattttctcactattctaaaagtggtccattactcatcatttttccttaaatatacatttagatatgtgggctgtgggatgcatttttgctcagttcttaaccttgaagccactatttcaaggggtagaagtcaaagctacatcaaatccctttcaggtacttgatgcaataacttatagctttctggttctatagttgaattttgtgccattgatttagttttctttaggttggtgttgaagtaatttttatattaatgtagtcttttccttttggattttgtatagttgttgttctctctgtgcagcttgataaacttgacaagatatttaagattttaggtcatttatccgcttagagtttttctttttccctactggtggacattcattctgttnnnnnnnnttctagagctatatcgtaggacattgtta

SEQ ID NO: 1366 - DNA, 410 bp, Glycine max
tctcaaaagtgggggcagtcctgaggacgctgtataccattgcccagccaattgatcagcttgaatggatttactgttaccacttgatccactgtcatagttaaaatacgtaccattccacagtttttcttcaaatgctggcttagccttcaaaaacttccgtttgcatttttccgcaaattctctgtcacctaaatcaagggccattgcagctgcagcttgtagagcagcaagccaaagacaaccacagtaagtgctcacaccatggactgtccatgtatcgtatgtttgatcagggaacccatcattctcaataagaccatccccatctctatcaaattgttccatgtactccattgcagcacggacagcaggccacacatccactccaaattccaaatcacctgtgg

SEQ ID NO: 1367 - DNA, 371 bp, Glycine max
ctggcaagctccgccatttccggggcagcccgacccatttcctcgccgtcacccaccgtcggcggcaacccgagctcgtcgtcggaggcttctagaagatagcccaagttagattgtagctccccggagtcgggttcctgggccgggtcaccggaaccagaatccgaacctggagcatttatctcatcctcgaagcttttgatcactgagtcaagaccctgcaccgagtcacgctcgggcacattgtccgtgtcgtcaagcatgttaaaaatgtcgtcttgtagctgcacctccgacgagtcgaggaccgattcgagttgagactcggacgagttaatacccgaatcggacgagtcaactcgacgaatctt

SEQ ID NO: 1368 - DNA, 722 bp, Glycine max
  misc_feature (653)..(653): n is a, c, g, or t
  misc_feature (690)..(691): n is a, c, g, or t
  misc_feature (708)..(712): n is a, c, g, or t
ttatcctctcgacagcatcaaagtcctcattcaggttctcacttttacttcattttaaccactacctatctatatcaattacttcaatctcgtgttttctttattcaaaggttggttccagcaccggtaaagaattggaccctgcccaggctttgacgagactactctctgtgtccggcaatgcaggtaattgtaaagctactcttttcttcttcttctggggacttaggcttagtccatagtctggacaaatttcttcgtaagcacttattgaagtagaaaatacagtaagaaaaaataaatgtctcccttgagttaaaattagcttatgcatttgttaaagtcagctctttggataagctaaatgagagaagcttctccaaaaagctgattttaacttgtgcatctgttaattttatcttattggagaaacttatccaaacaggcctgtactgaatgataagttgcttaggagaaatgctcaaccttagatgtgtgtatgcgtaatagacaagaggatgcagcgtgatgatggacacagtttactaattcttagtagtttgtgcactggattaatagaaaagggctttgttttggcgtttagatttggtctcatggtacaggttttgtgaagctaactgcatgtttctgtnggtttcttgatgcacaaactgtatatacacggtatgnnaactcagttgtcttgtnnnnnttgggcattt

SEQ ID NO: 1369 - DNA, 366 bp, Glycine max
ccgcgccgttaaacgcggcttacacagccgaagagtttgagttttacttgtccgactccgagtccaagcttcttctaacatcagcagaaggaaacaactcagctcaagccgcagcttcaaaactcaacatccttcacagcacagcttcaataacccaagccgaagacaaagaagccgagctgagcctctcattaagccactccgagtcagagtcaattaactcggttgagtcactcggaaacgatccagatgacgtggcgcttttccttcacacctccggcaccacgagccgacccaagggagtgcctttgacgcaacacaacctgttctcttccgtgaacaacattaaatcggtgtaccgactca

SEQ ID NO: 1370 - DNA, 994 bp, Glycine max
  misc_feature (45)..(45): n is a, c, g, or t
  misc_feature (894)..(896): n is a, c, g, or t
  misc_feature (932)..(945): n is a, c, g, or t
  misc_feature (982)..(985): n is a, c, g, or t
ttattgttcttgagagggagagcagttatataggaacattaattnatgatctagtaaccaaggacctgcgagagccttaccgcgtgttaaccaggtaaactaaccaagataacatttctgctcatagatgcatatatgctgcttcatcctgttactccttattcctttcttgttatttaaattgaaatttgtcttcctcatgttagccgctcagagcatcggttactcttgagatctgacaatgctgatagccgtctcacacctttaggtcgtgaaattggattgattgatgatagacgctggaaactgtaccaggataagcaagctcggatttctgaggaaaagaagcgactgaaaagtgtcaggatatcaggtttgtttgtctactatgcttgtgtagtaactcattcttgggagctgtttctttaaaaagtaccgaaagaaagtttatccttttggggaaaacaggatggcaataactgcacataataacaaagtcatttaaatgttgatgcttctcaagtcaaataaaattgttgcattaacatgaggatggttgcctgtaaaataaacttatcctcacctccctccacccccttcgttttccttatgatctttagctaacaaaagtaataccgacgatagaataatatagtgagtgttgaaaaattgggagctttgaatcttcagtcatctgcactttatacggtcacaaaatatgttacataaggattacaatgtaaactactgtttaatatagtctggtagataattcacgctagtgttaaataaaagtctaaactattttgtgattactattatccattctcttggcaaaaatgtgttttatatatagtaggagtctgttattatatttatactgatcttccaacnnngcactcttcccttcaaatacatattctgctgtagannnnnnnnnnnnnnatttgactaattatcaattattgctactctcctcaannnnctcatcagg

SEQ ID NO: 1371 - DNA, 1083 bp, Glycine max
  misc_feature (42)..(45): n is a, c, g, or t
  misc_feature (1030)..(1031): n is a, c, g, or t
  misc_feature (1072)..(1077): n is a, c, g, or t
gacacactccaatctaagccatcggagatgccttatgagaannnngaattgctaaatgctgctgtatgtcgggtggatgctttggaagcagagctaattgcaactaaaaaggtaggatgctataactttttttttccaatttttattttttttgaaaaactgcagtcatgatcacatgtgcatatctattacagcgaggtatttccatggcttattctttcttatttttgtttgttatcgttaaattcaaacctaaaatcctaccttgctcgctcctgttagctggctgcactgtgaaattgtgaatatatcgacgagcacattcttaatgaaccaatgctatactttccatgtctggtttttatgttaaaatttagtaataattgttagaagttaaaggattaaaccaaagaaagagaaaaatcaatgtttttcttgcctattacctcctctcagccaactaaagctatatatatgttttgtctgttggtttaaacaagtgtatttatgttctcatgctgatatgctaattatgctagggaagtttcattattttagattttaatttctttacagtttcatttcatggtgaattatataaatttcttattgcagttgtgcttttgttctctttatgcatgtatctattttccccctatatatgtttgggtttattccctaaatgtcatatcctggtcgtggagatgtgatgaatacatagtttcttattgtttccttacctgaagaatactgttacatttgcactttctggattgttcaataggctctttatgaagcactaatgaggcaagaagagctgcttgcttacattgatagtcaagaaaaagctaggttacgggtaagtttgtctattgtatcttttgaacaccggttacaaacttggggatgttattcaaatttctgatatttatgttttgctgcttatcagaagaagttttgctggtgagttttggttgctgatagaaagggactctgggagagggtgttttcgaatcatggtgtttctagnnctgaccttgcacatgatgttaaactctgaatactgattcannnnnntgagta

SEQ ID NO: 1372 - DNA, 807 bp, Glycine max
  misc_feature (49)..(50): n is a, c, g, or t
  misc_feature (780)..(781): n is a, c, g, or t
tgatgaggttagatacttgatgcttgcagatgagtgagagaatgatttnntataactcattacatgcttcctgatttcttattacttgcagtttgtttcaccactacggtatgcaaatatatattcagagaagattgtacatctaccgcattgctactttgtaaatgattataaacaggttatttttttgaacttttaatgcataatcttgggcttaattttgtttgtgttttttatgtatttgtatgcttggcattgagtgtctttatcctgcatgttttgtttgttcagaaaaatcaggatgtgttagatccaaactgcccacacaaacgatcagattatggtctacctgaggataaatttatatttgcatgcttcaatcaactttacaagatggatcctgaaatatttaatacatggtaatgtcaggatgctctttattgcttgtttatatagaatataatatccctcaattatgttccatatttcttctatttttccaaaatttggcatcttattctctacatgtctgacaatgcttgtattattttaggtgtaatattcttaaacgggtacccaacagtgcactctggctcctcagatttcctgcagctggggaaatgagactgagagcatgtatgtgttgtcgtttgattatgttttttagactctgatcggtaatatcaggtttcatttttatttgttctccaatgggcattgtccttgtgaatacgcatagttcttttcaagttattattatcctatttgtattgagtgctnnacgtctttcagatgctgctgcacaag

SEQ ID NO: 1373 - DNA, 880 bp, Glycine max
  misc_feature (818)..(820): n is a, c, g, or t
  misc_feature (822)..(822): n is a, c, g, or t
  misc_feature (858)..(860): n is a, c, g, or t
gcactcaaactttgtgcaacacatagagctgatatcaaaacttaggcatcgtcatctagtcagcgctgttggacactgttttgaatgttctttagatgattcaagtgtcagcaaagtatttcttgtcttcgaatatgtaccaaatggcacgctcaggaattggatctctggtaagtaatttataaaaaaaacagcttctttctcaggttggaggttgtaaaaatggtattattattctaacaataaaaagaatggggaaagttcactagagggaaatccattagtagtagttacaaattcatttatctccttctaccttagcgatcggaaacttgcatgaagaagttctaaatttgaacttgaggaggtggaaagatcaattgagcttaacttaaatgcattgtcagggtaaatatttacactgtcaaccaataaaaatatggtatgcatgttttaatgtcattattgtagaagtttacaaacttaccatatatgacaatctgtgattggatggcagtgtaaaaacattttacactgacaatgcatagactatttacacatatcaataatattttctcctaaattagtcacttcagtattatgttgtaatggaatattgagacagtaatgccatttttgttatcttcaaccctgattatttattttctgcccttcacaattatggtattgatgcctcataattttggcagatgagcatgctagaaaatccttgagttggactcaacacataggagctgcaattggagtggcaaaaggaatccagtttttgcatacagggattgtccctggtgtatatnnnantgatctgaagatagaagatgttttattggatcagannncttgtgcaaaaatcagcagt

SEQ ID NO: 1374 - DNA, 834 bp, Glycine max
  misc_feature (827)..(827): n is a, c, g, or t
ttaacagtaaaccaacagaagaagtggctgcaatcaggattcaaaaagcttttcggggatacttggtatgttttgcaacttttattgaaaccaatgtaacttatttcattcttctatttttattttcagcctccctcttaccaatatctgttgaatgtttttactacaagtgaaaaacctcagttacaatagtgatatagcacttttttgtttactgtacactaacagttggtcaaattcaaactctttaaatgtgaatccatacaaaaatttatttattaaatgtcctatttaattatgctaacttatgaggccatacatggtaagtaatcaataattgctgcaaaagaaagcttcttgattcagtgataaactattttcaagctgaattttcttttaaaatcatttaggcaagaagagaattgcgcgcgttaagggggctggtcaggttgagatcgctgatggaagggccagtggtgaaacgtcaagccattagtactctccgttctatgcagacttttgctcatttgcaaactcagattcgttctaggaggctcaggatgttagaggagaatcaagaactacaaaaacagctcttacagaagcacgcaaaagagctagagagcatgcgggtctgtgtttcatgtccctgatatattttaaaatgctaatctattgacacggaataatgtttatttgaggtttaatatatggaatttggaatgcttttaacttatttcaaattctcataacagcttggggaggaatgggatgacagcatacaatcaaaagaacaagttgaagccaagttactgagcaagtatgangctgcta

SEQ ID NO: 1375 - DNA, 531 bp, Glycine max
gtgaactgctaagatagatatccaaacagacttgtcaacaaaattgggcaaatttgagatgttaagtgtagcttccaatcgaaaaacctcagttatgcccagaaacactatgatagcttgatcttctttcaaggtccttcattgttattcagagctaatttgcaataatttcaactgaattaattgtcttccattgtcatcagctaatgatcatcttgttcaaaaactcagcttgctcgggaaaatactccatcaattcatcctttgtcacccagacatgatcctcacattttccaatgttgaatttgtttttagcaataacttgagacttgaagaagaatctctggcagaagatttcagcaaagagaaagaataagcaagtataataaattttcacatgaagaggcaagtataacatattgaaagatgccaaccttccattaatagaccagaagtaccacaaagttcctataaaatataccttaaaagatgtggatctagactggtcttctgtaggctgaacaaccgtat

SEQ ID NO: 1376 - DNA, 762 bp, Glycine max
  misc_feature (614)..(617): n is a, c, g, or t
ctctctcgacgtaaaccgcagcaatgacgcgaagaaggagtcgcgctccgccgccactgtgcgccgcctcaagatgtataacaccagacccgtccgcgatcgcaagggaaaagtcttatcccacgagcttcagtccaaggagcttcccagcacaagaatccaacccgaccgtcgatggttcggtaagtccaattcacaaaaaacatttttttagttcttattaatcacttaattacttaattgaacacataattaaataatatcaatcgtgtttcttccacttgaacttacaaattttatgattcgcagggaacacgcgtgttgtgaatcagaaggagcttgagtttttccgagaagagttgcagagccgcatgtcgagtaattacaatgtgattctgaaggagaagaaactgccgctgtcgctgctcaacgatcaccagaaggtttgtttgcttgttaagatgcgtaattggtgaatgagttgtgtgttttttataataaaaatgaaagtgaatttgataatggtttgtggattttttaatttagcaagctagggttcacctgcttgatagagagccttttcaagatgcgtttggaccgaagactaagaggannnntaattggtgaatgaatgagttgtgtgtttttcaaaatgaaaatgttagtgaatttgataatggtttgtggactttgaatgtagcaagctagagttcacctgcttgatagagagcctttccaggatgcgtttggaccgaagactaa

SEQ ID NO: 1377 - DNA, 675 bp, Glycine max
tcgttgtaggcctacttatctggattcttgattgacatgtattatgattatgatatattgtttagcattcaattaaagtaccctacaacttcatgtcattattctgtatatattacttggaaaagcatggtgcattgtatgtttttataatggcacacaccacggacaatacttgaaccttcatgtgcattgatctggtgacaagggtctttagtcatatcactggggacagatgtattaaaatttaatcatatctgtatcatgaatcctcattaatccatcttctaataatttttgttgctgcaggtggtgttccctagttctggagagcgctacctctcttctccattgtttgagtccattagacaagaggcagaacagatgacatttgattagagaactgtcactagccctgtttctggttaagagattttgattcacttgtgagttttatttacgaaattcaagtaataaagaattgtgctgataactcatttttcatccgtactgtgtagaactgtaaagtagggactagctctgttcatatattggcacataggacatttcaaaatcatggctaagttggttgcatgaggtgatttcttattaatcaaaatatttgtcgcattagctaagtttacaaagagatcatgattatgtaatggtcctggttaa

SEQ ID NO: 1378 - DNA, 487 bp, Glycine max
  misc_feature (418)..(426): n is a, c, g, or t
  misc_feature (429)..(432): n is a, c, g, or t
gaaggcttgcaatgcccttctgttgaaggtaaattaacttttgccttcttttcatctgctagaagatcaaaagttaaagttccctgtttattagctattttttaaatctgaaaaattctctatcaactctaacaaggaaagttttatttatttatcatcattgttaggtgaatcaaattggtagtgtaactgaaagtattgaagctgtgagaatgtctaaacaagctggttggggtgtcatggctagccacaggaggtatttgttctgttttgtgacattgtattattctttgtatgtgcacactaatgtgattcatcttgtttattgtagtggtgaaactgaggataccttcattgctgacctctcagttggattagcaactgtaagttgccagaatccgaagcttttttttttcannnnnnnnntgnnnnttttctttgttccagggggggattttgggaaaaattttttttaaattttaaaaaa

SEQ ID NO: 1379 - DNA, 1116 bp, Glycine max
  misc_feature (1056)..(1060): n is a, c, g, or t
  misc_feature (1100)..(1100): n is a, c, g, or t
  misc_feature (1102)..(1102): n is a, c, g, or t
acgcttatggccgcattgacattctggtcaacaatgcagctgagcagtacgagagtgattccctggaagatattgatgatgcaagactcgagagggtcttcagaactaatatattttcccatttcttcgtgaccaagtaacaaaataaacctttctcttaaattttagttctgagtgggttattgatctcacatcatttattctgatattttttcattacattaaagtagcgattgaggtgaaaattcactaactacttaaattaaaatagcatacattattattattattattattattttgataattatcataattaggatcttaatttaatcttctatgtgaatttctcaatgtattcccacaacaataagcattaagccttttagatttactgtgaaattaatcgttagtctaaaatttagttatacttaaagtttaccgtcactttctaaaaatatattttgtgaaaattaaacttaattcatacttcataaactctaccgtctatggtaaattcaactacactcattcaataaatagcactacacatgtaacttttaataatatttttttatttaaacacttattaaaaatttaaaaatgttattaaaaatttctcgtaatatttaaaaaatattatcaaatacaaataaatattaccaatatgtttttataacattttatcaaatatttgtataacttatattgctaaaacaacgacatgagctatacaaaaacatttaataaaatgttggaaaaacatattaataagacttattcatattttaacaatattttgtaaatgttataaaaaattaaacaaaaaattattgcttaatattatgtatgttgtagtgacatgcattattaatttggtatcttgaaaacaaaacaaggatccactgatttcaatatccaagtttaactaaccttttaatttatatttatagacatgctctgaagcacatgaaggaaggaagtagcattatcaacacaacatcagtgaatgcatatcagggagacggaacactagtggattatacttccacgaannnnngggattgtggggtttacacgagccctagcgcttcagcttngngcaagggaataaga

SEQ ID NO: 1380 - DNA, 334 bp, Glycine max
tctttctctccaacggtgagcaagtgggacccaattgggtatcttcaaaatctcttcttggagtctccaattcatcatcatcgtctgcaatctctttttcttccaattcttcactatcttgagaaacggtaagggagggggaagaggaagtagagaagagaggttttcgaagcggtggaacttggatatgccgaaggggtgtagatacagcatagggggaagaaacaagaagaggtttgagaagagaaatgaaagagggtgatgatgataatggttgtgaacgaagaacaaacaatagatgagaagatgctgatactactgccgccatttcagt

SEQ ID NO: 1381 - DNA, 477 bp, Glycine max
gaggaggtcgtcactcgagagttcaccatcaacctccacaaacgcttgcatggctggtaatcctccacaacctttctttcaaacctatttagggtttttggaattattctcactcttaactcttaattcatattttgtatctgtaattttatcattgcgagatgccttactggattttgtttctaatattcgtaaacaaacagcacattcaagaagaaggctcctaaagcaattaaggagataaggaagtttgctcagaaagcgatggggacgaatgatgtgagagtggatgtgaagctgaacaaggctgtgtggagccaggggattcggagcgtcccgaggaggattagggttcgcattgcccgaaagaggaacgacgatgaggatgcaaaggaagagctatattcccttgttactgttgtcgaaatccccaaggatgagctcaaaggtttgggaaccaaggttattgatgatgaa

SEQ ID NO: 1382 - DNA, 695 bp, Glycine max
  misc_feature (659)..(659): n is a, c, g, or t
ggctcttccaagcacctctcaacatgcttccttgcaggacaccctctcatgctgctgcacttataatatcccctgaaaataaaaagggggaattatggtcggttttctcaaacataaaacatgtgtttcaccttcacctttcacctgattaccaataaggtgcaaataatagaagagcatgaaccttacagttatatgagttatcaggaaggagtatatgccaagactacgaaatgcaagaataatttctcaaacatgcttccaggacagaaaatagaagagccacgaaattttttttgtagttaatctacagcaaagtactacatagaactgtggatgcaagatttgtgctagaagatgttgagattgttgcagacatcacatgaaaattcaaggacaatttcaatcatcccaagtctataatgtcctcatcagcctgaatacaagaacaaattacttacatagacgggaatccgatcaaattattagtgacatattcacacgctcgaaaattaaagaatacgaaaattaaaatgctctacaggctctagtatatcttccttatttgcacttaacttcaatgctataaaaagaaagatagaatcataaatgcgtgccaaacagggtaataatagtcagaaataacaaggtagctcagnagctttacaaagtcaatatagcacaattataatcat

SEQ ID NO: 1383 - DNA, 393 bp, Glycine max
actgacagcctctacggacggagaaagagttggtttcagagattggttgagattactatcgctcttgcttttgatgttgctattgttattgctattttcagagacatcgactttgttcttcgaagctaaatccgcgttttcaggttcgttgttcttggctctgtgactctgtttccgctgattctggttcttcctcgccttcaccggaatgtaaaaccgatcctcgccgcgaacgccgctgaattgcagtgcagttcccagcattttccaatcgttttcagaactgcgttcttctcctccgtttggtcgccgaggaaacggagaaaatgggaaaattcgtgatcgcagagaggatcaataaaaaaggaagaagaagaaagagtagcgaatcgg

SEQ ID NO: 1384 - DNA, 449 bp, Glycine max
ttcgagtttgttgagtaatgggggtatgggcattttgaaccttagtcgaaacgggtttgaaggctccatacccgatgtgttcgggtcacactcgtatttcatggctttggatttgtctttcaataatttaaagggtcgggtaccctcttcgttggcttcggctaagtttatcgggcatttggatcttagccataaccatttgtgtggatccattcctctcggagcacccttcgatcacctcgaagcgtcgtcgtttactagcaatgattgcttgtgtgggaaccccttgaagacttgctagttatagtgggtgacccgggatccgaatacgtacccggatagatacccgatttgtttacaaggtgtggtgtaataattttattttattttgttgttaagtggtgtaagtgtaatataacgttttagtgagaaagttgaaagagagaaag

SEQ ID NO: 1385 - DNA, 814 bp, Glycine max
  misc_feature (269)..(270): n is a, c, g, or t
  misc_feature (283)..(283): n is a, c, g, or t
  misc_feature (285)..(287): n is a, c, g, or t
  misc_feature (521)..(521): n is a, c, g, or t
  misc_feature (553)..(553): n is a, c, g, or t
  misc_feature (750)..(750): n is a, c, g, or t
  misc_feature (752)..(758): n is a, c, g, or t
  misc_feature (771)..(773): n is a, c, g, or t
  misc_feature (791)..(791): n is a, c, g, or t
gagatgatgaagtaatgaaaacctggagtatacaatactacaaaacaaattcactcatcatccttgtatggatactcttctgggacatgcttgagaagttttacctgcaactcaaacacatcatcaccgcgaagtacatcacgaagccaagttacctcagttttcattgacacctgtacatggatgaatgcaaatcatgttaaaagaaaaagaacaaagcttatggtgtaggaaaaaaaaaaattaacgcttcaccatgttaccctatnnccaagatataacncnnnacagaacattacatgtaatgcctcattttcctccaggacaatttactatcataaagttttttaagtaatttaattaggttgagttcagtgacatggttctggtcaagctaaacttgcccataatgtggaaattttcaagcaaaacattgactttcttgatctctacaaaagggaagctaaaaaacattgcattcataaaaatattaaatgatttatatagaatagaactagcanctcaaagcaaaaattgataaaaaataaaaaanaaaaaaaattgccctttccatgtacactgtggtacataaagaaataaaaaataaaataaaaaaggagtaatccatttcatgtttgagaaaatactcaaatttcagaagaccacagaggaaggctgcagtaatcaaactattatattttcccagtttcccaagtgttaaaagcgaaaacaaaaatgaaaaatacaaangnnnnnnnataaattgaaatnnnagaatgttgaagcaatgntgtaacaaataacaaatagaaca

SEQ ID NO: 1386 - DNA, 470 bp, Glycine max
cagagcgacgagaacttaaaaaccgtggattggacacctcagtaggtataatataattactcaataccgtatataaacacaatattataatatgtacattattatattcacaagttctaattatatgtatatctaggttggaagggaaacgaattcgcaatgagaaaagctaacctagtacctccaccagttgtgcccgccatgactcgctagaatttctcatgtcaacgatacaatttggagtagacttgctgttatatacaatctggtgctataagttaggagtttaactttcttagtttttaatatctagtatcagttgctttataatttcctgttgttgagtatgtagccactttgaattcaataaagaagcatcagtttgcaagttacatatatacttttcattctctacaaaatctgtttcttaattatctgtttgtgatttcccacggacaacaatgattacc

SEQ ID NO: 1387 - DNA, 616 bp, Glycine max
  misc_feature (38)..(39): n is a, c, g, or t
  misc_feature (53)..(53): n is a, c, g, or t
gattttgaagcatatattggtaatcaattatgattccnnctcatggataaaanaccatctcaaatataataaattagtactttctttcaacttgaactacttattttcatattcattaattaacttgttatgtataattaatacttctagctactcttgttgttgacagatccacaaaagcaatacgcagatgcagtgatagaagtgttgccaacccaactcattccagatgacaacgagggtaagattttgagagtgaggttgatacagaaagaaggggttaagtactttagcccagtttacttatttgatgatggctctaccatttcatggataccatgtggaaggaagcttacatgctcctaccctggcatcaaattcttctatggaccagagacttactacggaaatgaggtactaataactagtctattgcctccacacacaatttgagatgttcttgcatgtatgtttcatatattggaattcaaagtaaaattaacttatattttcattggttttgttttgatttgtgtggtgaaataggtgtcagttgtagaaatggatggacaatttgacagactagatgaactaatatacgttgagagccacctaa

SEQ ID NO: 1388 - DNA, 438 bp, Glycine max
  misc_feature (408)..(409): n is a, c, g, or t
  misc_feature (411)..(414): n is a, c, g, or t
gataaatggtggtgatgtgactcccaataacactggtataaaccccttgctgagtaatatcaataggaagcaagcacttgagcccggtatgataatcccccaaaagacaatgaaccctaagcaagcccaccatgctaaaataccccaacaccttcagcacattgctccccccattgtaatcataaccatcggtcgcggtaaactgctcgagcccctccttctcctgctccagaatctgaataatggcactcttctccaccagcgcctggaggaagttgaggaccccgaaaacattccaggcctggtcgaactggcgcaagagggcgatttcttgttcagtcttgctcttcatcttggcacggtactggcagaagctctggaactggtagacaaacaaaaaaaatcgcnntnnnncgccagttcgaccaggctggaaag

SEQ ID NO: 1389 - DNA, 659 bp, Glycine max
gttttttcttggatcagttgctactgttaacaatctcattgcctgcactgttgagagaattaaggctgctttatctggtgaagttgcttgacctaatggattataggtaagaacgccacactatcctatttttttttcacactttcttaactactaaatgagtcttatatctcctaagtatccaattaattaacactcttatctaaacattatactactatgtactcctcaatgttttttacaatttgcacttgattctgagttctgactcttcattttcatggtctgtttattattattatttatttatttatttggataaatcttgaatggtctcttaatttatatgtaaacttggatgcagtttagaagaaggataaaggggtgcattgcattttggacaaatgggaggtgttgggaacttcggcttataccaaaaaggatgagaattgagaagtcaagagcgcaccttgcatgatcctttcttagcacccaacacagtgctgaaaggattaaggttcgggaattgacttccctgaaaatcgtaaatgctaagagcttaaatcaagaccttagtaccttctctcttcaccttcaaagactacatatttatagttagtgttagctttttctatgattattaggttggagctgtgact

SEQ ID NO: 1390 - DNA, 395 bp, Glycine max
gtctcttccaactccatcgctcccccttctccgttgcatccattttcacgattccaatccattaaaaatagaaagccaaaaccccatcatattcctagaatcacatgcagtggaaaccaaaacaatccaacaccaaaccctaattcccagggagaacctccacatattgtaggacataggaggaacgttctacttggcctaggagggctttgtggtgctgttactcttaacaacaacaacccttttgcctttgcagctccaatatctcctcctgacctaaacacgtgcggtccaccagacctacccgcaggtgtaaaacccaccaattgttgccccccatcttccaaaatcatagatttcaagttctctccctctaaccaacccttgagggtaag

SEQ ID NO: 1391 - DNA, 383 bp, Glycine max
  misc_feature (371)..(371): n is a, c, g, or t
actttttgctagtacacagaagtttgataccctagttgactacaatcctgtttatgtgtcatgtttccggaagcaagaactcctgggtggggcaaggctgcttctgccaattggtgtcaatgaaactgtaattccagtatatgatgatgaaccctcaagtattatagcttacgccttaatgtcaccagaatatcatttgcaattgaatgatgaaggagaaaggccaagagaaggaaatgagttcatttcatcatatttttctgattcaggcaccttgcagtcattctcatctgttgacgaaacagcttttgattctcaaaaaagttttggatcgatagaggaaatgatattttccatgtctgggtctcgtnattcatcaaaaa

SEQ ID NO: 1392 - DNA, 368 bp, Glycine max
cggcaaaagggtgctttgattcgcattctgtgatctcaacgtcgcattcttttatctcaacgatgaagcgtccactgtcaccatcagcgagcggcgtgaacgttgaggacaggaagatgaagaagaaggcgaaggcggtggaaaatgacgacgataacgtggagcgcgtggaggggctggcgcatttcgacgacaaccttctgttcgaggtcttgaagcacgtggacgcgcggaccctggcgatgtcggggtgcgtgaacaagcagtggcacaagacggcgcaggacgagagactctgggaactgatctgcacaaagcagtgggcaaacactggctgcggggagcaacagctaagatccgtggtcctc

SEQ ID NO: 1393 - DNA, 401 bp, Glycine max
ggtggtgtcgacgacgacggagttggggcggagggaggagaggacgggggagtcgaggaggagggagcgaacgtcggaggggtggcccaccatggtgaagaggacgtcggagagttgggccagttgggccggggattgggccagggtggcgccttgggattggagagagagggcgttagggttggaagggttgcgggcgtagaaagagagggtgtagccagcagaaaggaggcgagaggccatggcgaagcccattacgccgatgccgatccagccgattcgggtttcggaggttgagatcggagttgggtacggcgttcccatggtaatgttgctgcctgagacagacactcagtgaattattagtttcctttttttattccatgcctctttctaaccaa

SEQ ID NO: 1394 - DNA, 596 bp, Glycine max
tgctgcttttctgctcgcccttcatcatctaaattaaataaactatcttcatcaagccacaactcagaaaaacgagattttgtcatgccattctgttgcgttgattctataccagcagagccagatcctacactgcataaagaacaccatcctacaatgagattcattctctcataatccattgaaaattgaaaactcaaaaataaggatgatattcaaaatttacccagggcggtggggagtaccagttgagcccagcgcctgatattcactcccaaatccacttacaacagaatttgcacctaaagtcctgatcctcgttgtcttggcaaattccttcgggagtgctatatcacgccaatcatctatctgtttcaaattacaagacagtataatattaaaaagggtaacgatttggacaacaaatcttctttgaacatttttataaaagtgtaaaacaagattggtggcacatacaacttgtaggagcgcatcaagcaagccgggaattttcgcaaggggagtcgcatccttgcgcatgtcatccttttctttaaaggagagcagcgtaagtgtattcaaagcccatgttagct

SEQ ID NO: 1395 - DNA, 323 bp, Glycine max
ggttcataaccaggtctcccaaacactctgttgatcctgttgcagctttcttgtatttcagcatgtatctcctccagatgtatccctttacctctagcaggattaactatctggaccagaacagctcttccttgccatttgggatgctgtctgagcatctgctccatagccaaaatcttcaaatttatgcctttaaaaatgtccatatcatcaataccaagcaagatggtttttccttcaaatttctgtttgagctcccttaccttgcattcctcatctgccattctcataactgactcaattcgacccatgtgaatcccaac

SEQ ID NO: 1396 - DNA, 777 bp, Glycine max
ttttctttctcaagatcgtacacatggagtttatgatactgaagggctgactatgcaaactatctacccttttcttttaagggaggaattgctagtgaattgtgcttttgcacacagatataacaatttgtgtttatttttcagctagaaactgtaaataaaaaccttgaagcttactatgatgcttgggacaaatacataaagtcttggatagtcatcaagattaagaacccaaactgtgtcttccaatggcgcttacaggtaggtttttttaacatcctctttcagaaattacaaactgtgttctgaacctggttgtagcatccatgtattgagctatttgaatatgcaggctgagattgccatgagggaggcaggcaagcctggaatgacagatgatgaggtttgttgctcacatggatttatgttttaagtatgatgaaatgatgaatgatgacgatgtatctttgtgttaaataatggcgcaacatctaccttctaatgattgaagctaagaattttcatggtttgccctctccaggtgagagattttgtttcacgctacctgccggcatactatgcataccttcctacactttactcggagggaccaaatggatcagatcctcaacatctcctaactattgaaatagatgaagggagaaaccccatccttgctacctaggttaattgtatgatagagcactgctgttttttcagttctttgagataatttgaatggctattcagcattaattagtggcatcatcagtggag

SEQ ID NO: 1397 - DNA, 356 bp, Glycine max
ccttatcactcaaagacaaatgcttgttcccatcatcaccaacatacaacccaagttccctgcacaaagtctgtgcaaacgagggacagaaagaaagcacatagtctttctcagccttctcaatcttgaaccaattgacaacagtgttaacccctggattgccttcaacaccaccagtgctcaaaaaccacaccccagttagcaccttgaggagcttccacactggaggtttatcacaagtggtggttttcccataagacttgatgttgagatcggttgaggttagaatgacaccactttcggcattgtagggtgtgaaggtaactggggtgccctttgagacttcaagcttctct

SEQ ID NO: 1398 - DNA, 438 bp, Glycine max
ggagtagattctcagaagagcgagcttgtctgtgggatcattgattatctcaggcagtatacgtgggataaacatcttgagacatggatgaagtcttcacttgttgtgccaaaaaatgtgttgccgactgtaatatctcctaaagaatacaaaaagaggttcagaaagtttatgtctacatattttttgagtgttccagatcactggtgttcccagaaatcctccaatccttgcaaactttgtggctcaggggaagatgacccttctcagcaaaagccctagcacaagagtgccaagtggtttctctgtccaaatctttttgatttaatttctcaaaagaaaaaaaaatacaaattgagaatttatgcaagtagttagcagtactgtatatagacagtcaatattgattataaacctagccccctgctattctgcgat

SEQ ID NO: 1399 - DNA, 689 bp, Glycine max
ggttttcgttgtctttatacctgtgatagcaatcagcgtcttgtatcaggtattaatctgaccatgtaactactgataataaggtgacatatatttcttgcattacttgcatccttctctgtcaatagccttaacagcacagcttatgaaccaaacatattttgcaaaattgacaccattatacaatattgcatgatgatatataacatcttacaagcttataatattgcagcaatattatattccatcagcccgagaactatcacgcttagttggagtctgcaaagccccaatcattcaacactttgctgaaacaatttctggtacttcaactattagaagctttgatcagcagtcaagatttcaggaaacaaatatgaaactgactgatggatattctcggccaaagttcaatattgctggtgccatggaatggttgtgtttccgcttggatatgttgtcttctatcacatttgccttttccttaatattcttaatatctattccacagggattcatagatccaggtgagttattcctatctgttacaaatcaaaatttaatctgctaatctaatatggaattgaacataattgtttctcttttataacttttttgtgattttgaaggccttgctggtttagctgttacatatggacttaatttgaacatggtacaagcttggatga

SEQ ID NO: 1400 - DNA, 665 bp, Glycine max
  misc_feature (657)..(661): n is a, c, g, or t
tggcatcctattcctctaaagaataggcactgtcgcctaaatacccagaaaactaaaagggcaacaaaacatattatgcttctaaatgcttgaaaacttcattatccatgaaggatgtcagtgctcgtaaatctctagtacaccatcaacttgcactgagaagtttctgcaattcaccactttggacggcagcactgagatctgaattgcaaaaacagtagccagactatgtgagtggtacaaacaaagggtatgcaaagtgaaaacagaatgaaggttaacggtgaaccttaggttataagacagtgtgggttagcgtgagtgtttgcaaaactgattttaaaatgaatttgttattgtaaagttgattttgaagcaacatgatttatgtttgaatatttttattctaaaagcaagttaacagtaaaacttggtatatctaacacaagatcagtatgtaaacatttatctaaaattacataaattagtatttcaatgtgattgcgagtgatccaaagtgaatttaaacagccacatagataaaagcaggaaagctaagaactaactaaccatccgatccaccaatatgcttgccattcacaaacacttgcgggactgtccttctacctatcaaatccagaagaacactctgaattnnnnnccca

SEQ ID NO: 1401 - DNA, 382 bp, Glycine max
cttcgctatagcaactctgcaggcccagtttcaggcccaccccctggtggacccaccatccaaattgattggtctttgaatcaggcccgctccatcaggaccaacctgacagcaagtgggcctaggcccaacccgcaaggctcctaccattacggtctcataaacacaaccaggaccatcatactgtcgagttcacctggtatagtgaatggcaaacaaagatacgcaatcaatagtgtgtcttacgttgctccagacactcctcttaagctcgccgactactttaaaatccctggcgttttccgtgtgggaagcttttccgacaggcccactggcggtggcatataccttgacacatctgtgctgcaaactgactacagaa

SEQ ID NO: 1402 - DNA, 413 bp, Glycine max
ctcgtcgtgtgtgttccttctttccacttcaaacttgtgacccagaaaaaagaccctttccattctcctccttttcttcctcctccactggctgcacctcgctgccgtgtctctgcctagcgtgaaattggcctcatttcccatctgggtcctgtgaattgcgattggaaccgcgttttccccgcttctgggcttggctcagaagtagtcagaatgatgtctgtcacaggcaaaagcattgattttgctggcaaaaacttggtctcttgtggctgctcttccaatgcttcttcgtttgataggtacactgtgaggaactatgccaagctgaatagtaataattctaaagggtgtggcagagatcatggggctcgtaaattggtttgttgtaagaagaggagcactcattgtcg

SEQ ID NO: 1403 - DNA, 718 bp, Glycine max
  misc_feature (618)..(618): n is a, c, g, or t
  misc_feature (620)..(620): n is a, c, g, or t
  misc_feature (654)..(663): n is a, c, g, or t
  misc_feature (705)..(709): n is a, c, g, or t
tatgtttcaaaccttcggtgatctcattcagagggcttctgaattagtttctggagatacccagaagcaaaaacttcccactatacccgaggaacacgcggtgatcactgaggaaagtgaaactctggtgaaggaagaggaaggaagacacaagaatgttttccatgtggtaaagccttccttgtctgcaggttagtttatttccgtttttacttgttattgttattatgttccttcctctaattatattattcgtggattatggttaatgtttgaaatatctctttatttttctctcttatgtaaaggaaagaagaacaattgatgtacttagaatttgtttgctgtatggaatctacagaaatggttttgttttacttttgaatcaaactaacatattgcgttctcttaaaaactatagttcatagctgcttcaatttgagaccttatcaattagttctctaggccaattgtctttctaaaaggttttaatttttaaattgtggtcaccatcacagttttgttgcaaattgcaatctttgatattatgggaaattgaagacatcctaccgaaatcgcaggcacaaactgtttattaaaacgttcatttgctatggnantcatcctttgatttgattttaattttgtaggggnnnnnnnnnntgagaaattaagtctaatgaaagtggctactgttatagaaannnnntgctggtag

SEQ ID NO: 1404 - DNA, 650 bp, Glycine max
atgatttcagtgtttgaagagtctgagttattgaaagtgggtgaaaaggatgtctaccctctagcagtaaaggcagacgcatcccctggtaatcatgatgagtcagatagatctccaacatctagtaacacaaactctcagattacgcaaacggtgtttgagaaggagaaaggagagttccgggtgaaagttgtcaagcagatcttgtgggtgaatggaatgaggtatgagctgcaggagatatatggtattagaaattcaacggagaatgaccaaggaaaatgtgttatttgcttgtcagagccccgagatacaattgtccttccctgccggcatatggtatatttgcagcttccctttttgaatgatattttgtgattagttgatagaatgatgctgatgtgatggtaggcatcaatatcataaccaattttatcaaatatcttttttcaaaccgtttcctatttcttctgcttttaatttattaggctgttaccttttggtctcaggctctttgcaaactcatgatcatttatcccaatttagctgttaaaaactaattagatgttatttgagtccttgatatgcattggctggattcattttgtatttgcagtgtatgtgtagcggatgtgcaaaggattctaggt

SEQ ID NO: 1405 - DNA, 394 bp, Glycine max
gtttattggcacctccaattggcttgttggttccgtagtcagcatagccgccattgtaaggttttggctgcgaggagtggcgccaatcaggtgaagtcacgtgaccggaggaccttggtggactacggttagcttcattgtgcaccttggtgaggaagtcatcaaatttacgtgggcttgtttgatgtggatgcttcccttcatcgtcatcatggtcgttgtcactctcgtcctcataataaggcctgctagcaactggaattatttttttcttggtaacgatcccgtctgagtaaccattaccgttactaaatttggggacgtagggagcaaatggctttgcaccagtttcaatgtttctcacattgctagtgttgtaggtggatatttgagc

SEQ ID NO: 1406 - DNA, 363 bp, Glycine max
ttgtcatgacaaagaaattacgtttgggttgttcttttcagggggaggaggatggaaagaaagtgaataactttctggaaatggataggggggaaggagtgaatgatggtttttctggacctggaccaaatgattcacttattcctggtcttattgatgatgtagccttgaattgtcttgcttgggttagtggatctgattatgccgtgctatcgtgtattaataaaaggttcaataaactgatcaatagtgggtatctatatgggttgaggaaacaattgggggctgtggagcatttggtgtatatggtttgtgatccaagaggatgggtggcctttgaccccaagataaacaggtggattt

SEQ ID NO: 1407 - DNA, 806 bp, Glycine max
  misc_feature (708)..(711): n is a, c, g, or t
  misc_feature (717)..(722): n is a, c, g, or t
  misc_feature (742)..(759): n is a, c, g, or t
  misc_feature (764)..(775): n is a, c, g, or t
  misc_feature (782)..(788): n is a, c, g, or t
  misc_feature (790)..(796): n is a, c, g, or t
tacctaaacaaatattcctcttacctctctctctctctctctttttattttaaagtaaggttgtatgatttattttttgataaaaagattgtttcaaattaaccagttctcttgtgtatctataggactaattgttgggtcttattcattgttatctctgttgtcggttgtaataattgtttgtggtgaagcgattaattatacaacattgtattaatgtgggaaatggaatgatgatacagagctttcaactggataaagtatacggtaagaaatgctacatgttatcagcgaggaatctcttcattgtatggggagacactcccaggtattggcgctggacttcgcttccagatgccaggtaataatcaattcaaccactattattaaattatgtaatttccacaatttagtacctgattttgttctcaatatgaatttattactgttaaattcttgcaatttaacctccacaattcatcttataaagccttacattattcgacgagatgaaatttcaattctcataggaaaacaacatccttaaattatttgattaagcacagtctatagaagtatccatacttttaatttgtttcatttagaatgatcatacagtaatattggatacatatcctatacgatacacgtatcgtgattgtgcatcacagagcatagtttcataattaaattggaattgcaggtttnnnnaggtannnnnnctaaggagtgtgtgctggtnnnnnnnnnnnnnnnnnngatcnnnnnnnnnnnntgctgtnnnnnnnannnnnnngtatggggcg

SEQ ID NO: 1408 - DNA, 996 bp, Glycine max
  misc_feature (969)..(971): n is a, c, g, or t
  misc_feature (990)..(991): n is a, c, g, or t
cttatgttgctttggcatcactttcttttattttcagtttgatctcacccgtatccttgcttttctgttgtcttagacaggaaattattcatttctttagctttaatactccaaccgtcaaaaaaaatttctttctgaaattcttgtcacgtaattaaagccagtaaaatgacagcattcacttggcatcttatcaatatatagcttgtcaaaaagagttcatatacttgttttcctctgaaaattatagagaaaagtacaaagttgctgaaatgcaaatttcaattagtttgtcatcagacaaagaatccacacgaatcatgtgcttctgctaccagtcatatataatcatatttgttagagtattaaaagaagcattaaatctatattaatctgacagctttgaatctgtatccttataatatactactatattgcgacaattatgagaagtgatacattaaccaatagttaccaagttaaagaagagtaagaagtgtttaaactgcatgtccaccaccttattaagttttttttgctgggattctaatagacaaaatatgaattttcatcagaatatgtctttgtctgttggaatacgaaattgtaggttgtgtcagccaaggttgccctcccagaggacacaaaagaggcatcattgaaggttgacgaggagaagaacacagaagaagttgttgagactccaacaccagaaactgtagtcactgagcaaaccaaggaggaaagtactgaggccccacgacctgcagcttcagaagacaagccctcggttgaagttcagactaaagaggtggcagaggaagttgtgtctgagaccgtcacacaagagccaacagttgagaagcaagaagctgctgagggaacaaaagaaaatgccgatcctgctgagattaagacaccagaagctgcagaagatgttaatgttaaggaagagaaagaagctgaggnnnaagctaaggaggaagaggnnccgca

SEQ ID NO: 1409 - DNA, 384 bp, Glycine max
ttgagggggcttttgcagaaggctgtgactctgtgacaatgccttctacagaaaatcagggcttttcgttgtccttttcctcgtttggccgttccatatttggtgtcgggcaggagcaggttcattctgtggaagcaagtaatgaatctgattcctgtaatttagagctcgggtcattccaaaagcgtgttaccgatcgatttcaagacctttctgtagctagtgatgagcaatttctctcaattgattggattcagaagctcctcggagcatttatctgctgccaagaggaattcagagccatcctgttgaataacaaagagcaggtcacaaaacccccccttgatcgcatgatttctgaattctttgagaggtcagtgaagg

SEQ ID NO: 1410 - DNA, 585 bp, Glycine max
agagaggaacactttttgagtagatctcaggaactgaatcgtcttcaaagagagttggaggacacaaaagggaaaattgaaaaggaacatgaagccctacatgacgagaaaaccaccctaaaactgaaggaggcaaccttaatacaacgagaagaggttcatatttgaaaactctctgttggctcaagatgattttaatattaaatatttagtatctttgtcttgttcatgtgctgatttatgttgtgtaaaaacaggaacttactaaatggaaatctgagttgagcaagaaagaacaagagttacttgaatttcaagcaaaactttctaatagagaatctgtacatcctctcacaattgtttacttttcatttcattttagttctgatccttttctctatatcattattcttttactttgctggaaaatgtaggatgaaactcagaaagttgttgctggtcaggaagccgcattgagaaccaaaaaatataacttggaagttgagctacaaatgctgcgcaaattggttgaaaatgaaattgaggaaaagagacgggcttgggagttgaaggaggttgatctta

SEQ ID NO: 1411 - DNA, 388 bp, Glycine max
tttgtgagtttttcctctttctttgttagctgagcttggtatctcaaggtctcaatctctaactaggacgacatgccttctctctccgttttcccatcactcccatcgcttcaaaaccctaacttgagccaacccaatttcttcaatttccgcttaccgtcgctctgtcaccgtcccctcgtcaaaagcactgcaacttttcaccgtagaatcctctgcaaagccttcagagattccggcgaggacatcaaggcggtgctcaagtccgacgacggtggtggcagcggcgacggcggcggcgacggtgggggtgggggtgaccgggatgcggagaagaaagaagggcccttgccggaatggttgaatttcagttctgatgacgagaggg

SEQ ID NO: 1412 - DNA, 458 bp, Glycine max
tataacgatgatcctaatattgattacatgccagcctccccttatttgttttttagatcactagctaatatagagaccagtatttgttctagttcttcatttaaagtcaaaacaaaagtaactaattaaccagaggtgctaaagggacatgtacatcaagcaccatgcatggatatttccctgtaccaaattcactcttcttctaaccggagcttgtaaacgttgaaggtgtccaaggaatgcttaattatcagctatcagcttatcattattacgcactaattaattattcttctagctagctaggtggaacccgtacattttgaagaagtagacctcggacctgcaatattagtaaatcagaggaatcaaaatcaaaatcatatcgtataattttatcacatatacacaaagaaaaaataaagaaagaaatgaacgaacctaaaccaacggcctct

SEQ ID NO: 1413 - DNA, 710 bp, Glycine max
gcttttggttgatccataggaaccaagtgcccagcttcatatacctgttgtatagaatcacattaaaaaaagttaccaaaagtgaaattaacagtgtcacactatcacacactcaaaaaatttcaacacttaacacataccttaaggaaagaaagaggtccatagctattcagagaccctgcttctgcaccatcaacaacaaatttcactgtaggagatgttccaaatgccttttggcctgaccactccatggcataaacccaccttgaattccctgccaaaatgaaaaccacatcaagaactcaatctaacataatctaacatacacagcttttcaacagagacaaattgcgaaatgccaacaatacactctctaacactcttatacatacactttcaattattgtctcacgcattattttataattttcaacaaattttaattaggagacgataatgtgttaaaaggaatgtgttactggcacacacaaaacaaatttgttccaaatgattgatgagtcattctcaccaagccaattgcatatgagatcttcttcccctgcatacacaagcaacttgattccatcctcaagaagagaaggaatccccacttccaagtttttcatccaatcttgccccatagcattatacactgttgtactgcatgaaacatacgtcaaatcttccgccacacctaaagcactcttcac

SEQ ID NO: 1414 - DNA, 322 bp, Glycine max
atggagctgagtactataaaagatgcttttgaccgtgttactaagaagcaaaagttatcttgttccaagactcaagaagcaattgatcagatcagacaggaaattgagagtgttttagacacactgcagtcagcgaataacactgaccatgaacttgattataaaactgtcctgaatgaacttaaggccagttttcttttaattgctccacttagtcaaatggaaggtacacagaaggagctaaatgtagcactcaccaagtatgggaagcttcttgagaaacatttcaaccctgatatatccaaggcttacagaaatgtcg

SEQ ID NO: 1415 - DNA, 563 bp, Glycine max
agtaattgtaatcaggatgattgactcgcaatagcctaagccagttttcagcagcccgcgacagagaattggctttctgacattcagaaaccccatcaggatcccagatagaaactttgaatttgtgagaggcaagcccaaagattggtagtgatagcttggatatgtccctacctcttgaataatgattatgtagcccatcagtatttgaacctgaatcaaagatcaaactgttataattgatgcctatttgcatacatcttgcatatagaaattaaacagacagcaagacatactctgcaaagctgttgacagggaatgaaaggtcaagaagcaggcactcaagctttgtaatgttggaccagtaggtattctgtatattgggtacctttaaaaatacacacgacaagaaataattttgaattagtaattattaccacgtgcattgtccaaccatatcagcacgaggacaagaaaaacataccaagcaaatgaaacccaacttgcaggggaaagatcacagctccagtatgttttcaactctggaaattgccgtgcaagat

SEQ ID NO: 1416 - DNA, 401 bp, Glycine max
acttttgacatggaaacactgctgttgttgaggctgtttcgcccgagttggggaaccggtcacagtatgttagagttcaactccctggacttaaccaagagctccttcagaaattcagggaaaagaatattgactttgcagctcatagtccccaagaagagtcaggttctcttttagctaacctgattgggaatctggctttccctttgctcttgattggaggattgttccttctctcgagacgatccggagggatgggaggtcctggtggccctggatttcctcttgcttttggtcaatccaaagccaagtttcaaatggaaccaaacaccggagtgacatttgatgatgttgctggggtggatgaagccaagcaggactttatggaggtggtggagttt

SEQ ID NO: 1417 - DNA, 645 bp, Glycine max
attttaaactcttaacaattcaacaactctgaatcaatacgatgaagataaaacacagccatgcatccttctgaaaatgacacaacaacaattccgattgaaacgaatacacaagaaagaaaaaagaaaccctaaattttcgttatggctgaacacagtgacaatgtgtaatgcaagaaaacctaaaacctgattccaaacgacgagaacaaaatacctcggagacatgagcggtgccgaccaagtaaacgtcgcagacgccgccttcggcagcggactcgcacgacaggacgagcacgtttcttgagagctccggcgagagcgtggctggacggcgatcggagtccggagcggagggagcggcgtcggcttcggaaggctcgtcgattcgaaccatgctctcggagaggctctccatcttcagatccgtgacgtggacgaagtcctccgccgaggcggcgggcgcggaaggttccggcggttgcgggtccatcgtcgggcggaggagagggtgcgttcggcggcggaaggtggcggaggagagtgtggagagttgggggagagagagggtttgggaacgataaagtgttggttttggtgtgaagaagaggggtttggggcgatgagagagctgcgtgactctag

SEQ ID NO: 1418 - DNA, 449 bp, Glycine max
  misc_feature (382)..(382): n is a, c, g, or t
  misc_feature (384)..(387): n is a, c, g, or t
  misc_feature (389)..(390): n is a, c, g, or t
  misc_feature (392)..(392): n is a, c, g, or t
  misc_feature (394)..(394): n is a, c, g, or t
  misc_feature (400)..(400): n is a, c, g, or t
  misc_feature (428)..(429): n is a, c, g, or t
  misc_feature (433)..(433): n is a, c, g, or t
  misc_feature (441)..(441): n is a, c, g, or t
caagcggggtgcagaaagcagcatcggctcagtcggacaaagtcacatgtagctccagatgttcttgctactccatttgaacctattcaacagggacaatgggcaaatctaccatcagaattgcttttggacataatccagaggatcgaagagagtgagacatcttggcctgcccgtgctgttgttgtcttttgtgcttcagtatgtaaatcatggaggtccattacaagagagattgtcaagactcctgaacaatgtggaaggatcacatttcccatttcattgaagcaggtaataaactcttaactctttttctggtctaatgttctccttttttttcctttgtggttttaacttttaatgtttcttgtgtttgttttcngnnnntnnangnatagcncgggtccgcgtgattctccaatacagtnntttncaggaganacaaagaa

SEQ ID NO: 1419 - DNA, 403 bp, Glycine max
cactgccgcaacagcagcaacagtttattcatggcgcacactttattcaccataaccctgctattcctgcatattatcctgtatatccttcccagcaacatccccagcatccccaggtttactatgtgaccgcgagacaggcgcaggcttacaacctgcctctgcagcaggctaatatgggcgagtctgcagggaacatcgcttctagccggccacaaactccaccaaatccttctacattggttcaacagcctgctacttacaaccctattagaaatgctcccatgcctaaaactgaaatgaatgcttacagagctgcaactgcaggcaaccctcaactagttcaagttcctacaagccaacatcagcagcaatatgtcacctactcacagattcaccatcc

SEQ ID NO: 1420 - DNA, 604 bp, Glycine max
  misc_feature (451)..(456): n is a, c, g, or t
  misc_feature (469)..(469): n is a, c, g, or t
aacttctccagcggagtccacgccttcaattcaaagcaaagatgtgcactttggagaagagaggcagcatattcatcctaacactcaccggcgatggcgagcaccgtctcaacccaacactcctcgattccatccaatcctccctccgccgcgtccgccaagaagccaccgcctcctccgccctcgtcaccaccgcgcacggcaaattcttctccaacggctacgacatcgcctgggcccgatcctccgatgaggtcaaagagcgcatgatcctcatggactccctcctccgctccgtcgtctccgatctcctcaccctcccgatgccgaccatcgccgccgtcaccggccacgcctccgccgccggctacaccctcgccctcgcccacgaccacgttctcatgcgcagcgacaggggattcctctacatgagcgagcttgagaacgtggnnnnnngcgagggcgaggntgtagccggcggcggaggcgtggccggtgacggcggcgatggtcggcatcgggagggtgaggagatcggagacgacggagcggaggagggagtccatgaggatcatgcgctctttgacctcatcggaggatcggg

SEQ ID NO: 1421 - DNA, 364 bp, Glycine max
cacttgatccccaaagaatggcttgcagatcataggaacaccactggaaacactctcaataacagagttagctccacagtgagtcacaaagactcctacagaatcatgtgccaaaacttgtgtctgtggagcccaagacactattttcccatgctttttggttctctcaacaaatccatttggcaaaagaccaattagaccttccttcagtgaccaaagaaatggaaatccactttcttcgagtgcctctgccactgccacaagctcgtgtggaggaggtgccaccacagtcccaaagcaaacataagccactgatttagaattcttcgtatccaaccatgacaagcatccacttgaatctgtg

SEQ ID NO: 1422 - DNA, 535 bp, Glycine max
  misc_feature (364)..(364): n is a, c, g, or t
  misc_feature (454)..(459): n is a, c, g, or t
  misc_feature (463)..(467): n is a, c, g, or t
  misc_feature (472)..(483): n is a, c, g, or t
  misc_feature (486)..(487): n is a, c, g, or t
  misc_feature (491)..(522): n is a, c, g, or t
  misc_feature (524)..(526): n is a, c, g, or t
  misc_feature (528)..(532): n is a, c, g, or t
tggagggagagaggcgcggtgggacccagaaggaggacccgggcacgaaggggagccagtccggtgtgttcttcttgacgaggatgcgctggattaggtcgtcgaagtgcttcagcgccacgtcgtactccgccatgtcaacctccaccacatgtccacccgccgccgccgccttgctcgaccggtgccggagggggacggagagggaggtgaggcggcggaggaacccagccttgctgcggaggacacccaacatcgtcgtcgtcgtcgtggtttgcgagagagagatgggattggattggttgcttatagatgtgagagagagagagggaagaaagttaggttgggaatgaaagacgatctngaaataacctagatcatttgcagaaattagattttggatctgcgcttgctatagtgagtgtgtacatgtcagaaaacctaggcaattggnnnnnnaacnnnnngttgnnnnnnnnnnnntannatcnnnnnnnnnnnnnnnnnnnnnnnnnnnnnnnnannntnnnnnttt

SEQ ID NO: 1423 - DNA, 259 bp, Glycine max
  misc_feature (14)..(14): n is a, c, g, or t
  misc_feature (250)..(252): n is a, c, g, or t
tctctttctctctntctctttgtaattctaacctagatcaaagataacggttctatgagaaaagcgtgagagagaaggagagagccaaaaattcataaagcatccgaggaacacgtgaattccgacatgtaacggtcgaaagttgtaacccacgacgacgaatttggatctgtcgtttacaaccattgccgatctccgccttaaacgacgcttcactgaaaccaccacactcttcctcctcaccgttacnnnttcacag

SEQ ID NO: 1424 - DNA, 510 bp, Glycine max
  misc_feature (458)..(460): n is a, c, g, or t
  misc_feature (473)..(477): n is a, c, g, or t
cgcgtcgacggcgctggatctgttaccggtggcactggaactcctcttcgaggagtgcgtgcgctggtgcgtggatttcctcgaggcggtgccgtggacggaggaggaagagaagcgagtagtgagattaatccccttccttagcgagaaagagtcgaaggagctggtggctagggtttggccttcgggagaggactcatgcgaagcgatgctgcaaggattgatttcctcggcgatgaacagttacggcaacactgcgttcgtgaaggctttcgtagggaagattcttcgggatctgtcgtcgagggagacggcgaagagagtgttggagaaggcgttcaggaagagcttgaagacggtgaaggagtcgttggaggattattcgagtcaacttgaaggtctatggaggctacacacaactcctcaaagctctagaaaacatgttcaagttgaccatnnntgagaaagagttnnnnnttttgtttgttttattgagatgaaatgaaacta

SEQ ID NO: 1425 - DNA, 376 bp, Glycine max
aacaattacatctgttgctcttaatcaatcttaattgccacatctatcactgaatgtagtaacattactttccattaataaaacaacaggacagctattattttaacttgaaacctactattttttaagacgaatggacttaaaattaaagagattagaagagaaagacttcaaactcaacctccaaaacaaacctatattataaagagcaacttcaacctatttcactcaaacatgcaggacagacacgttgtattcgacaattgcaacaccagccttagcatcatgcacatgtgtcttaagcacagaagaaccccttgcatatttgaagatcccactacccccaacaattggcatttctttaacactctgcaac

SEQ ID NO: 1426 - DNA, 387 bp, Glycine max
cagctgacttatcagactcaaaattggtgacgggatcggagcctttcaagtcttgaagggtggaccctacaatttgcttcactttccctttgtggatatcgatgcaggggcggaattgaactgcaccgcactggatggaagggagagatcttcgagagagtgaggggagagtgagaaaaggaggcttattggggcgaaagatgaaaacccccaaggaatgaggtgcagccagattgcgcattctcgatgatgatcggagacgactacaacaaagcacaccaccgcaccgtttcgttaaccattgtcgccgtcgacttcgtcctccgccactcctctgctccaatttcgtagcggaaggggacaggaaggctaaatctggaaagagaa

SEQ ID NO: 1427 - DNA, 477 bp, Glycine max
agtaaggaaaaacttatggacataaaaagcaaattgtaattgaaagaaatacattatgagtaaatagtcaatgcaccgaaagtgtaaagactttttacactgtcatccaattagaaattgtcagtggtgaatttgttgacttttataataattatctttaaaatttaaaagttatatgcatcacaatttctgattggttgatagtgtaaaacattttacacatagaaattaaactcatgttattgtatgcatgtatgttaatacatataataacatattccttatgtgtgtgaacatacataaattaatatgtatgttattatgtcctaaattgttgctatctttaacctgcaaatttttgaaacatattgttccagtatctggccagttgcttggcggcctgctgtcttcaatcacaagaggtgcttcacttgttatatttgtatattgaaggatcctttcaactgatatcatctt

SEQ ID NO: 1428 - DNA, 397 bp, Glycine max
  misc_feature (385)..(390): n is a, c, g, or t
atgatcttggtggcgttggtcttggaattgtggtggctcttgataaatccaataacgaggttgctgcacgtgaagttttgcccaaacacaccgtttgcacctccaatttgaaccggtccggcccaattccggttcactacaccaaaaacccagatgaatttgatgtggaggaatacacctatgtgacatgccgcgtacctaacaaaacgttcactaaggtatactatgatggtggtgaaggtgatattattcggagacaaaacaacaacaacaacaacaaaaacaacgttgtagttctcagaagaaccgaaccacaacctttgattgagcccgaatcatcgtaccccacatcgagttttctcagttcatgtcacttatgtggaannnnnntccacgg

SEQ ID NO: 1429 - DNA, 1083 bp, Glycine max
  misc_feature (52)..(54): n is a, c, g, or t
  misc_feature (95)..(96): n is a, c, g, or t
  misc_feature (819)..(819): n is a, c, g, or t
  misc_feature (828)..(828): n is a, c, g, or t
  misc_feature (1034)..(1038): n is a, c, g, or t
tcagatatcacaaaatcaagcttcacttggctatggacctcctccaagcccnnntatgaatccttttggtgtcacggggtcaaatcaggtgtctnnggatggtgcttatgtacagtggccaagtgctgcaatgatgtatgcacattcatatgaccaatttagacatgctgttttccaggtaagccatggttaataattttgttgtgctgctgaatgtgatgtgtggctttcagttcaattttttatcaaaagattgataccataatgtgacactgtatgattatctctttctcacttttgtttcttttttttcttttatctttttcaatacacacatctcaataatacgcctcaaaattgatggagataacttaattcttgccctattttgatgttcacaaaacattcttcagtgttttttatattttagttttaaattgctagggtttgctagaaataatctgtaactttattatgaaatttaggttatgtgggctatattatgacatgtaaaagtcccatagctcattttctatctccagattactacttatttgatgcaagtccattgtcttgtggctcttgcctttgcattcattcaattttcttgttgcatgctgctcatagattttgtattgattggctggttttatttgttaaactaatcaagttgtgttggggtggaaggttgatgggaatggctgtacatttgtattgtagttgtagtgtttcttgaatacgtgttttgctttagtagaatattgggtatttcccaatatgcaaagaatggcaagtctgtcaggcaaggttaatgatttngtttcacanttgtttcatagttaggattataatttaaaacattctgtttcctttagatatttgtagaatatagtttatctttatcatgtgttatctgtagttttgttgctttgcaggctccgattgctcaacgcccattgagtttcgattattcacagaattactagatgacgtttagagggaagttttccatttggctgcagatgttattttannnnntaaggatttcagagtaagatacaatttttctgtactgttataata

SEQ ID NO: 1430 - DNA, 355 bp, Glycine max
  misc_feature (312)..(312): n is a, c, g, or t
tctttaccaaaatgacaaaaccccaaatcaacacctatactttgttttcagttgtttctccacaaataatctgtgcaaaaaacactatccaaaaacactactctaccaccctatatgctgctactcctcctagaattagcaacaaaaaaaaagcagtaaaatttccatcacccattgctgctgcatcatcatcactagtcaaacttcaaaccaacaaaggcatcatcatccccttccgtgaactcaaactccccatcttccacatccaaatcgaaatccgagtcgccgccatcgatcggcctcctcctcctntttccagcaaccttgttcgccacagtcttcaccctcatcctcc

SEQ ID NO: 1431 - DNA, 734 bp, Glycine max
  misc_feature (670)..(674): n is a, c, g, or t
  misc_feature (690)..(694): n is a, c, g, or t
  misc_feature (706)..(714): n is a, c, g, or t
  misc_feature (716)..(718): n is a, c, g, or t
  misc_feature (725)..(730): n is a, c, g, or t
tcttattccttagctctatgctcttctctctcaactagattcagttactaaattcacaatatgcattatatttattataaggcctcatgctctaacttcttacacgttttctggtatatgcttttagatttttcaaaactaaatcatgctcctatactatcacagacatggccaatcagccactctcttaacaaaacacacaaatttgcaaccacaaaaataagaacagtcactttcaaaaggatagagtacatatatatatgctgtccaaaacgtgcaataaagtgcaaatatttctccacatttatttgtgttcatgtaatgtaattttcaaaatattcccaaaggcccatatgctctcacatctatgatctaacactttttttttcttgtctctcgccccagacatggacactatactaagtacaacgttgttcctcatgttggcatgctccatcatgcatgttcttcgttcactgcatgcaagaatcagaagaaaatcaaactacaatcttccaccaggaccctctcttctcaccatcatcagaaactccgtacaactctacaaaaagccgcagcagacaatggccaagcttgccaaaacctacggccccataatgcgcttcaccataggccaatcaaccaccatagtaatctcctcaatagaagnnnnnaaagagattctccaannnnntgaatccttatnnnnnnnnngnnnaaacccnnnnnncaca

SEQ ID NO: 1432 - DNA, 519 bp, Glycine max
  misc_feature (332)..(336): n is a, c, g, or t
  misc_feature (343)..(382): n is a, c, g, or t
gaccagccagaaggctcttatagcaaagacttatttggttgatggaagaaattctcattcattgccgggttgggcaacagacctggaagaatatgtaggtcttgttgaagactttttcttgcttcctcaaattattgggaacttagtctggcatatcgattgcaaacctctcagaaaactatattttattggaatcactctggtcagacttcttcctcacatatatgactacattcgagctccagtttcaaatccttacttttctgaggactctgaatttgtcaatcctaatttggatttttactcaaaatttggggatattgccattcctnnnnnctgctannnnnnnnnnnnnnnnnnnnnnnnnnnnnnnnnnnnnnnnaataatgcaattttggaacgagataatgcaattgcaactcttcagtatcgcgaaacctctttaagtagtggcagtatgccatcatgccctccaggatgccaaatttcacgtggtgtgaagcatatacatcatcccca

SEQ ID NO: 1433 - DNA, 393 bp, Glycine max
ggaggttgcggcagtagtcgatgagggcgcgcatggcgggctcgttgtgatgggccatgtccatgtgatgggccttgaagtagatctggtagccgacttgggcctgcgcctcttgccagaggcggtaagagtccatgactaaagggtagtagtagtggtggggataggtgaggcggatggtgcgggattcgccgtgggaggagccacagtggtggaggaagtcgaactgttccaggagaagggttttaaggccgcgtttggtggcgtggtaggcggtggagctgcccatgacgccagctccgatgataatcacgtcgaactctgaattggactccataagtcacacacacactctcagacactttcactttctctgataacaaggtgtgatgg

SEQ ID NO: 1434 - DNA, 360 bp, Glycine max
atttagtttccccatggacagcaaggtccgtcaatatcctgccaataaccggagccatcttgaagccgtgaccagaaaagccggctccaagaaccacatccttcccaaagtccccacccaagaaatcaatgaggaaatcctcatctggcgtcatggagtagatgcaagactgtttgatgacgggctcagtggattcaaccatccccttgaacgtaaactccacccattctttgagtttttccatcatcaccgctgctccccacggcctcttatccgggtcgcacggctcccccccgtgcacaccaaccttaatcagccccggaaactccaacgttggcgtgccgtagacgtaaatatctt

SEQ ID NO: 1435 - DNA, 618 bp, Glycine max
  misc_feature (543)..(545): n is a, c, g, or t
  misc_feature (607)..(609): n is a, c, g, or t
ttttttttgtcttttttgtcactcttaaagcatcccttgtggtatccaaatacaggagcacagtaaatttctgtgtgaaagtcttgctttacttcctttgtttgattcttttctttttcttccattattatgaatttagctccagggtgtgtactttagagacaaaaacagggatcaaggaaaaaagtttagtttgtaacatgcatggattgtgcatgtgcatatgatagcaattgttgatcttttcttcaatcggttgaaatcccatagttacttatcctgtaaaataaagcaaaatcttttttatttatttattggtgtctctacctaacctgccttgtttgtttttgccaggcgtcatgatcgatactagcaattgccatgaatctcatgggtttgagaaaatgtctagtttaggtgggtgttgaacctcatgttggacaaataattttgcaatttcttctgtattgaaccgtttcttggatgatggatgtaactcaagctttaggtgtcagctaaactatggtttgatgttgctttgcnnncattaaaaccaatttgtaatctgccttactttggagcagttcttgctatgtgcttaaaaatnnnagtttgatt

SEQ ID NO: 1436 - DNA, 362 bp, Glycine max
tcttggggagaatttttcgccggggagagccaagggtttctcgattgcttcgctcgcggttttcccggggccgagggagttagaggcagtggattcgaacgaggagttggtgaattaccagaaggataaggttagggatcaaatcgagagtgtggtcgtggttgattatgtggtgccagagcctcctcctgctcagagtgcgagcctttgatggggttattgctacgctatgctttcttcttcttcttttgataagcttaattgttattattagtttattttgttagcaggatggatgaaaccccttttcttcttcttaactacccaaccaatcttatatctccctggcctatgctttgtat

SEQ ID NO: 1437 - DNA, 359 bp, Glycine max
atctatatccaaatctcccttcaattctcaatctctgaaaccacaattcacaaccgaaacagtttccatctctctcacaaaatgacaacaatatcaaattgctcccttctcttcctcttcctcttcctctccaccctccacatagcttccaccctctcaacccccaccaacttcatcaagtcctcctgcagcaccacccagtacccagccctctgcatccagtccctctccgtctacgcctccaccatccagcaagacccccacgagctcgtccagacagccctctccctctccctcaaccacaccgaggccaccaaaaccttcgtcgcaaaatgcaacaaattcagaggcctcaaaca

SEQ ID NO: 1438 - DNA, 379 bp, Glycine max
ttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaaga

SEQ ID NO: 1439 - DNA, 1229 bp, Glycine max
  misc_feature (19)..(21): n is a, c, g, or t
  misc_feature (1171)..(1174): n is a, c, g, or t
  misc_feature (1216)..(1217): n is a, c, g, or t
  misc_feature (1219)..(1221): n is a, c, g, or t
gctcattgtccctttaaannnacacagtagggagcccaagtcccccactgccggtaattgttatttttttcaagcaacacactctttaatgtacttttttttaatactttttattgttgattgaaattaactatttgtagatctcacttcttatttaacaaatcttattcataattttgtaagttttaataaattttaattatcacgggctatgttgatagtactcctgatttccttattgcttagagtatcttacattgaaatttttttactcacctgagcctaattatttttatacctatgtgattgtactagattcaaagtgagatgggaggaaaaatgccatccgtcaagccaactgtgaggaccttttgaaacctttaacaaaaccaatttgattcatgtttgggagttattattggaacataacgaaggtgatttttatttttatttttatgcacaggcattgcggttctatgggagttttaatccaacagttacaggcattacaattcaaaatagtccacaatgccacctcaagtttgacaactgtaatggggtcatggtccatgatgtgaccatatcatctcctggggacagtcctaacacagatggaattcaccttcagaactccaaagatgtgttgatatacagcagctctatggcctgcggtaagttatggaatatttccatttcatttgaacattcatagggcaatgtaggagatagagacattagctaaaatgaaaatgaaagttcaagacaagaagaaaactaaaaaacaaagttctatgcattttctatgattctcaaaatggcatggcattatcttatcttatccacaaccatgttggacacatatcaacaaaagtaccttccaatgcctgcaagtcatatgctacatggcacgtgtcaaccgtaaaatccacactgcatcacccaattgaatagtactctgttagttccataaacaagagcttttgattttgtatttctcgccatcaatcttgtctcattagaagttataacttctgccccacatttctcgagtccttcgcaccttaggctggatgaaaatggcacaacctgtggtccattataagctgagccaaaactttggagggggatgattgcaaatggacaaaaaattaaagtaaaacacatgatgtannnngactgacataaatggtccaagttggctcaatatatttaaatnncnnnttatttgc

SEQ ID NO: 1440 - DNA, 584 bp, Glycine max
cacctatgacagtagagtggttactttatggtatcgacctccagagcttcttcttggggccactgaatatagtgtaggagtggacctctggagtgctggctgcattcttgctgaattgttggctggaaagcctattatgcctggtcgaacagaggtaatctctgtgatggatactctatatatgggcttaatgtctatttttgcggcttttatgggctttctgtgtattcagcttacgagcctaatgtggttggctttggtgtctctggtttctgctttttctgcgacttgattgtgctttgtatgcttcttattttactgctatccttatgggcctttaggggagctagtacaagaaatattccaacaaattggatctccttgtgactccttttgaaaaaaattgaaaaaggcccaagttgccacttgttaccctttttaatcccccacactattacttgcgaagacttgtaaagactttcctccattttcctccctcttctctgccactctttgatacccttctcccaattaacccttaagagcctctgactgcctctgttgcgtagtcttcagaattcttc

SEQ ID NO: 1441 - DNA, 454 bp, Glycine max
gtactttcataatttcccgattaataacagctacagaagcaaagtttctaggcccaatataaataactcccttctagagatattaaaatatatatacgcacattcaatacaatcatttttaactttattcttattcttctgtcagcctcatttgcttctacgccgatttttggttgctgcacaattcgaacagtaccattttccttttggttgttctttcagaccaacacaaccaaaatgaaaccactctattttacactgtcattttgaatagatcaaggaaatatgtaaggaatgtgggtaaaatggatataaaatatatggggaaaaaagataaacaaacacacatacattggggttatcgcatgcaaccatcgctccatagctaacttgattacaaaagcagtatgtgggttcatttggatcaactggtaactctaaatccatgccagtt

SEQ ID NO: 1442 - DNA, 789 bp, Glycine max
ttgtccgctcacggcggcgtcggcgacttcaaccgatccaggttgcccagaatcagttccgctgatgccatggagacttgggccaacagtcagaaagggaagaagctctacattgtgctcatcaggtacgtctatccttcacctcattcgtagttcaatcaatcccttattatgattagattaataatttaatatcgtagatttgtagttagtctgcttgtttcttgattttaacaaagagtgtgtatgtatctgcagcattcatggcctaatacgaggcgagaatatggagctgggacgtgattctgacacgggtggtcaggtaatacttttcatcttatcttgtttgctgttaagattgattctcttaggtcccgtttactttcagaattcattctctgttttcacctctaattacaaaattgacacattgttttcaaagaattgtacagaaataaattgaaaacaatgtaacaattttgtaattaaaagtaaaaaatagaaaatgaaaaataggaaatgaagatagaagcaaacataccccttggctttttacttatgccaatatgttggaaactaatctttctgtctgtctgtatgtgtatttctgctgaacaggttaagtacgttgtggaacttgcaagggcattgggatcaatgccaggagtttatcgggttgatttgctaactagacaagtgtcggcgccagatgtagattggagttatggggagccgacggaaatgttgtctccaagagacacagatgattttggagatgacactggagaa

SEQ ID NO: 1443 - DNA, 380 bp, Glycine max
tcactgcaattgctgctattcaagagctagaagtactgggaactatggacctcaatgtaccactaagggatgaaacacttccacatcaagtggagctgccaccaccacagcctccagtgcagcagcagcagcagccaccacagcagcagctgcagcagccaccacagcagccaccacagcaacacctagcaccacaacaactgccgccacagccaccgatatttcagcaaacatatcctccatttcatctgccgcagttccaccatcaccagccttcgctgcagttccagcaacagcagcagcagccgccacagccaccgccacagctattccagcaccaggcacagcctccttcccaccaacagtttcatccttaggaa

SEQ ID NO: 1444 - DNA, 426 bp, Glycine max
gcatcaatttccccagtaaaactggagtccctgatatcatatagaggatagattacatttttcttaaattgtctaaccttgcctgtaaatcactatctatcccgccatcatcattcccagtcgtttcaacttgaggtacctttgtctttgcagccggggcagcaacagctgatgatggtgcatttacaagctgtacatcaaacaaaaaactcattaggctttgttatagtgactcagccatttactttttcagatgaagagagatattgaatgggaaaccataaacatacctcttggttgatgtcaattccaatctcatcaaggacttggttaactagatcttcagtttcctcttcatcttcttctccttccaaagcatcatctattgcatctcccatcatctcagatgtcaattccatcttctca

SEQ ID NO: 1445 - DNA, 896 bp, Glycine max
tagtgatcacaatatagctttcccatatgagattgtatattgatgtagtaacctgaaagaacaagtccatttagaaattagaaccaaagcaggatattgtagcagttgaagcagataataattaccttgctccactggaaaacctccccgtcatcaaattccaaagtcaaagtaccaacagggtccagttgaattgatcgcccccagaatttgctctttaggttgctatcaccccaaaatttccaacctgtaccctcacagtgacatgcgacaatcattgggtgatgactgacctgaggggaagcaaaaacattaataatttctaataggcgacataaaataaaaaagccaaatcatatcctttttgttcacaccaaaatccaaattgtcttgttttgtgttcataggtttctccagaactaatgcactcacattacacctcttattccaaaaataaatggtgtagtttctgaaattatgatcctctgtattggggaaaactgtttctttactggtgaatgaatgatcaattaaaacccaagaaacctctagggaaggaaatacaagacaaatctgcaaattgttttgttgaatcaaaagcaagtggttttaaggaattcaaatgtggttagtacatataatttccatcaaatgaatcattcaaaaaactctgatttaagaccaaaaaaaatgtccacacagttgtagattttctaaagataccaattgcctgacccatttcacaaatatgtaaattggagtgcaatcagaaaggaaaatatactttggtagagttgaaaatatgtaatattttaatcacttcactgtgtcaagttagattataccttctctgagaaaaaacgaaggcctttatcgggatagtgagcttcatatgt

SEQ ID NO: 1446 - DNA, 697 bp, Glycine max
tgtgagtggtgcttacagagaagctataaaggatttcacctatgctgattataacatccctaaagggtggaaggtatgtttcatatcttttgttatgcttttttactactatcttgcttttttcactctgcattcattggaatcacaccttggtcatgaagtattttcttatcacaccttggacttgggaaaatatctcgtttatgatttcaaatagccaaatgctacccctttttaacttcatacacacgcttcaaatttgtattttcttgtatcgttaagatcttattgtaacataacatcaaggctaaagggactagttacattacagtctatacttttaaaacttgtcatattactgtcaattgtaggtattctgttcttatattgaccaacaaatattttaaatcaagcaactaattcagttgacgtttaatttaacttttgtttcaatcttttaagtctctgttatcttttttttccttctttttcagttcttgtttctatgaactatttgatgtttcttatgttacattagaccgaaaccagccttcattcttttgaggctaaaaaatactgaagtaatgattgttggtgacaaaaacttctgaaaagcattgcttctttacaaatataatatacagtaaaagtgtaaaagaggtgctagtatgctagaaggagacaaccttgtctcgtg

SEQ ID NO: 1447 - DNA, 667 bp, Glycine max
agaagcgaagcgaagcaatgagacgaaaccattctaactcgggcaattaccggaatccatgtttaactatgcaccagccttgggcttctctcctcgtttacgggatcaagcgcgtcgagggcaggtcatggcccgctccaatcacaggtttctcttttttgtgtttaatgttattattgtatcaaacaaacaaacaaacaaagacatcattgaccacctgcacgtgtcctatgttttgattttgttttttaaggtcgtctttggattcatgctgccagcaaagtcccagaggagtctacaatcaaagcaatggaatacttctacaaggagatttatgcactcaatggcatcactgatatccaatttcctcagcactaccctgtttctaggcttttgggtataatacctcaacctcgttctctgttaaatgttaattcagttcaattcatcgctcaccaatttgaatgcttgataacaggatgtgttgaagttgttggctgcttaacacgtgatgagctagcatgctgggagatggttcctgaaggggtaaggggtaccatgtcaattactatacttttgtttttaactattcattcctagttatacacattatcttcacttaagcggttaagcccgtttttttattccttaggtgcgggtggaagca

SEQ ID NO: 1448 - DNA, 390 bp, Glycine max
ctctttcacatcaaaagaagctggcaaaatggtactctctgttgataactctgcctcaaggaagaaaaaagttgctgcttatcgctattttgtgcgcaaatccagcacaccaacaccatctgaggtgcaattaagccctaaatgattgtaggagccatatatgatctttatatgctttgaagttaattataagtcttaactctcttcggttatgaacttatgattctgaactttgtttgagccaacttaaaggtacttagtactattgtattagtgtaatgtaaaaaaatgagggaaaaaaacgtgctatagcatggtgatttggtacatatgaaaaagcaagtggctttgcttattataatacattttactatttgggcatgatgtggt

SEQ ID NO: 1449 - DNA, 337 bp, Glycine max
cggcggaggcttacttggtagggttgtttgaggacactaatctctgtgccattcacgccaagcgcgtcaccatcatgccgaaggatattcagcttgcgcggagaattagaggcgagagggcttgaggattttttaatgatttgtcactgctaggatacgttaaaactggatctggtttatgtagtttgtggttttggtgtatttattcgaccgtaagggttgtggttgttagtatgaagatgtagagttaacattatctggctaattagttggttaatgtttactttgaatttgctgtttgtgtgaatgaattaaaagggttgattgcaatggattt

SEQ ID NO: 1450 - DNA, 442 bp, Glycine max
  misc_feature (409)..(414): n is a, c, g, or t
  misc_feature (416)..(420): n is a, c, g, or t
  misc_feature (422)..(424): n is a, c, g, or t
  misc_feature (429)..(432): n is a, c, g, or t
agctatttgttcctgatcattttaacctcagaaaataaatagattaaactctccagattgatttttcccaccactattcatttcaatacagttcttttgggtcaaccaaagtctacacttctgaatctgatcaacacgagcattattattttggctttaccaaggtgaagttgcagaaaacacaacacaccatatggttgaaagcctgtaaagattgctgagatgattgtggatatgtgtatatacttgtgttctgcatgttatacagaggtgaaaggtgatgatttgcttggtgcactatgagacgatactgaattgagtccatgtgctagtgttttagacttaggtgtggaagcctcttgcttcctgtaatattagttttcccttgtaagctgcattcatagaaatnnnnnnannnnntnnngcatnnnngggggggggg

SEQ ID NO: 1451 - DNA, 656 bp, Glycine max
tggaggcttccttcaatgtaagcaagcaacacatgcaccatctaatttgcatttccgtttagtggtttgtctaaatgtcatactaattaaatattatcattatatttgcttgtgtgcgcaattggttttatagaccaaattcgaggagataaacagggttttgtttggtggagaggggaggcggcaccagcaagagggagtgattttggaactatcaaaggaacagattcgggaactgagcaagcgtgccaaatctagttcaaggagtactaattccttcgattatgaaccattctacttgagaggctcccaaatctcttccaacaactttggaaagttctatgagatcacccctgagaagaacccccagcttcgggactttgatatcctcctcaatactgtggatatcaacgaggtaagtgcaaaaaccatgtagatctagacaaagtgaactgcactattgagttctattcactctcttcttaattagttagttatactaattattgagactaaacaaatacagggaggtcttcttctgccacactacaattcaaaggccatagtgatactaatggttactgaaggagaagcaaacattgaactcgttggcctaaaagaacagcaacagggagaggaaacaagggaagtgcgaa

SEQ ID NO: 1452 - DNA, 253 bp, Glycine max
ccagagttcgatccatgaacatggccgtcaccgacgctgacgcgcgcccggtgctcgtccccgccggcaacaaggttctccctgccatcgaccgacgcaagccggtgatgaaatcgtcgccggagacggagaagaaaccggtggcgcattcgccgcaatgcgtctccgttacgccgccagctatttcgcggcggcaggagcaccatcaggccgtgctgaaaagcctgtcgtcgatgaacgcctcctgctcttc

SEQ ID NO: 1453 - DNA, 375 bp, Glycine max
tggagagttatttgcattaaccttgggccctagcagattcggtagctagcatgaaatggggaagagaattgttgttagtactattatctctaggttcttgatcaatgtgatcaggctttactaagccaaaggaattgcgcctctttccattctgctgatctttaggcagttgctccctactgccttttgagcctgaatcatgatttggatttgtaggtgatttgttactcaatgataggctccgacgtttattgccagatctagtcttgctgattgtactatctttaggttttacagacacttcacttgaaggtgttccttgtgattcagggacagttaaatggcttctaggtgaagcttctggagatgatctaa

SEQ ID NO: 1454 - DNA, 1086 bp, Glycine max
  misc_feature (1037)..(1048): n is a, c, g, or t
tttttatgactcttgttgggggaaactgccctaagtttccgttgcttggttgagcacatgttatttgccgagttaacttgcttatgggtctgtctgtcatctacttcattataactagtagttaaatctatcggtaatatgcttgtgcttgtcaagaacttaatttgaataagtacttttaatcccaggaatttaccaagctcgtgcattggactatagcagaactttttcataactttttctataatcaattatgagctttaatattcttacattataggcatactattattgtttcaggcaactaatgaaaatcttccaccaaatgtaataaagcaactagccaaggaattaaaaaatattgatgaatcacctcctgaggggattaaagttgtggtaaatgatgatgatttttcaataatatatgctgacattgaaggcccaggtatgcagctttattttcaatttttttgtttgagcattatgtaataatgagttatgctgaacctgaaatttgttcggcagctggaactccttatgataatggagttttccgcatgaagttgttattgtctcgtgatttccctcactctcctcctaaaggtttgtttagttagactgtcctatggaccatcttaacaattgttgagatagaatcatattattgttttttcctttggaattttagcttggttatctggattttgtttttggtgttctgagttaatcttacataattagtagaatctattggacatttatttgtcccatctattgttttgtgttgtgacatggtcaaacttgtgatggcattgttgtttgtagggtttttccttacaaagattttccatccaaatattgcaaccaatggagagatttgtgtcaacacacttaaaaaggattggaaccctaaccttgggttgcgtcatgttctcattgtaagtgttttggctgttcttgtaagcttacactcattagtttttcagatctgcctagttgagcagagagttatttagatcttattgatttgttgaatnnnnnnnnnnnngatccatgccgattggtctaggtatttattaagttttc

SEQ ID NO: 1455 - DNA, 355 bp, Glycine max
cctcagttcttaatgctgaagtcaaaactgcaccatcgggtgcgacattgccattgcaatcaccattggccccctcaactaacaacacaacaagaggaaacaagcaggaacaggctgtggttggagctgagccagctgttaacagttcttgtgccacatccatggttcatgctgctgcaccaatgaaggcaggtggagtagcaaaagctcaggctgacaagaagaagattgatgcccggaaaagaagtttgaaaagattgtaatgaagttgttcaataattgaacttatatcatttgtggggtaattttgtttattgaaataatagagaaaggggaaatgtggttggggtgtatg

SEQ ID NO: 1456 - DNA, 399 bp, Glycine max
atttggggcttatagataataacccaattgatgagtctgcgttgatgcaaagtttggattttggacaaatgggttttcctggagatggtaatcctcaggtggatgatacgctttcaagctttatttatcagttgcaaaatccagatgccaagttgttgggaagtttgccccatatggagcagacaccttcaggttttgattatggattagatttcttaaaaacagtggagtcaggggattataatggtggaggggaagaaccgcgatttcttaatttggatgatgatctgaaccctgattcaaagggcatgcaagcaaggaaggatgactagagaaggcgacgtgcataagtctatcatctgcctcattttcaactggttcgagcatctgctagtaatc

SEQ ID NO: 1457 - DNA, 374 bp, Glycine max
tctttccaaatggattcagaccaattcaattgttacagtatgtagggacacaacaaatgatattcgtctcatgtcataccaaagtaaaactgcaaggtattcctgaatcaattcacatactatgcatatctagaactcaataattatcttcccagttgcatggccagtaatactcttagcccaggcatcttcagccttggttagaggatatttggagtccacaactgttttaagctttccttccttgactaaatgaataagatgttgaaggtcctcacctttaggaaataaaagcaaaggcacaagttgctttttggagaaggtaagttttttcagagcaaatgtcagcattgaagcagagcttggagttatgt

SEQ ID NO: 1458 - DNA, 316 bp, Glycine max
acaatgatgtggttggagacaatataacatttatatatgagaaattaggaagagaaaacaagtaagtgttgtgcttacaaaatgtgcaattgactaccaaacaaagatttcaggacagttgatgttgatgtcaagggttaaagtcaaatgaggaattatagcttgaaactaaaggtgtcaatttctagaactccaaatctggctcccaaattactgacttcatatttgagatttgtgagactgtttggtaaaacaagtgagcatgtgacatggacaatgtcaaaagaatttctttgatgccactcatcctgatact

SEQ ID NO: 1459 - DNA, 395 bp, Glycine max
  misc_feature (280)..(280): n is a, c, g, or t
  misc_feature (282)..(284): n is a, c, g, or t
  misc_feature (290)..(358): n is a, c, g, or t
  misc_feature (363)..(391): n is a, c, g, or t
gctatttgcagaaccaccttttccaaaacatcttgcaacaggtaaggttactttcatatttcatatataatttcgtgtttggtcccattttcatgaaaattgtaatggacaaaattgagatacacttctttagatgttgccatgttggccttgtcttcgatcagaattgaagtttcagcataataatccgcaaaatgcatatctttattacgcatacgcatattactgaggtgaaacttcaattttgataagagaacaacactaacagaatctaaggatntnnntctaannnnnnnnnnnnnnnnnnnnnnnnnnnnnnnnnnnnnnnnnnnnnnnnnnnnnnnnnnnnnnnnnnnnnaatgnnnnnnnnnnnnnnnnnnnnnnnnnnnnnattc

SEQ ID NO: 1460 - DNA, 366 bp, Glycine max
  misc_feature (20)..(20): n is a, c, g, or t
  misc_feature (347)..(347): n is a, c, g, or t
  misc_feature (361)..(361): n is a, c, g, or t
ccccggtcaaacccttatcncattgtttacaacctcaagcacaccaggatcctcagccatttttggatcatctgccttagccaaaaggggactaatatctgcatcatcatcattgttcttattattattagtattatttgaaaaaaaaaaaactgttgttagattcagaacctagcacacaaaaatttccttcacttagttctaaactgtttaatattttactccacaattctctactataggtattgaatacttataaatcgtaaaaaccatcctaagcaaatccaatcgtaacatatttcgataatttccaataaaccaaggtatatatatgttctcaaattcangaaagaaaaccttncagca

SEQ ID NO: 1461 - DNA, 1261 bp, Glycine max
  misc_feature (1208)..(1215): n is a, c, g, or t
atatgctgcacggtatgctttgtatttacataattgctttcctttacctaagctttttgttaattactttccatcatgtatttgtgtgtttatgtgcatgaattcaaatgtcaatgatataatgtgattaccttttgcttttcatgaagctttatctaaactagagaaatgttaatttttgttacatttggagagtttttgaaaaacatgaacaatttcttcaaaacaaagggggaattaaggatttgtaattaatcttctttttacttccttcttatttatttattttgctcatacattgaggtgcaaacttattcagaatcttcaatgcttgattgtgtatttcactaattcatggctttatctctcccttctctacaagttaactatcaattctgttatttctaaatctcttttgaaacttgaaagctgtataaatttaaacttattgcaggcttgagttatgctagtacttcctctaccttcaaaacgcaaaccacttcttattgtgcccatcatttgaacaagaatatttcagaaagcacatttgatttgtacttcatttcattcaaccttgttaagtgattcatgcatgatattcatcagcaaatgatgtgataaatatgtgtctttctagtattgttagatggacctgccaatcactttgggaactatctaacaagtatcttgcagaagtggccactcttataagagtatttctgtttgtgtagtatttttatacagactgatgtgtgtcttcttgctttaagactaaacataatattgaggggattagccttacaattttttgtttcccatatacaaaaaactggtgcatgatcttcttgttctccataacatgcctttgcacttgaatacattattatttggcactctcaatcatcataatgatttacgttgtcattttctctacatatagcttttatgctgcggaggtcctgcttgctcttgaatatcttcacatgcttggagttgtgtatagagacctcaaacctgaaaatgtgttggtccgagatgatggtcacataatgctatcagattttgatctttccctcagatgtgctgtgtcacctactcttattagaacttcctatgatggtgacccttcaaaacgggcaggtggtgcattctgtgttcaacctgcatgtattgagccatcatcaatgtgcatccaacctgcatgtttnnnnnnnnggttatttcctcagaaaaacaagaagtcacggaagccaagagctga

SEQ ID NO: 1462 - DNA, 308 bp, Glycine max
tcttgggcagcatccaaagtgaaggacatgccactgtcagaaactatgcaagtcacaggaggagtatccgaggcactattgagttttgaaaggagatttttgaagggagttaaacaagtccttctagtagactcacttaaagaaactacgtcttgtgtggcatcaacatcagggttatcagagagaccatcagggatggtttcaaattgaaatgatgggacactattgagggaatcagaacctcttgatttgagaaggcgtttgtggttgtattctgtgttaacaaaggtgatgtggaagcctctaac

SEQ ID NO: 1463 - DNA, 625 bp, Glycine max
tgctttaaatggcaaacaccatttttaattagttaattctcaatttcttattttaattatattgcaccttttacaaataatgttacagaaaaatgcttttgaatgggctacatctttgaaagcccctcacacagaggatgcaattcgggttactcagtccacagcaaactttttcataaggttaggcctcaaacattaatatttccatccattttattcttctcatattataaatggtcattttagagggaccaaagttgtaattatgatgaatttgggtacagtgaagctaggaaatccacaaacacacctgatgctcaaaaagtgcgagataatctcatctacaattacaaacctacttttggtggaacggctgggtaagccccaaatgtctttgtgacaatgttattaattaattaccttgcacataaagtttctaacatggttttttgcaacttgcaggaaaggatatgatcaagtgtatctctttgaataattctatctgtaggaggtgtccttgaatttgattttatgcacaataaattatgaactggggatgtagtttgaagaaataaaaatttgtgcacagtgatgtttgtaagatgcttaatttcagggcaatgct

SEQ ID NO: 1464 - DNA, 448 bp, Glycine max
  misc_feature (410)..(410): n is a, c, g, or t
ctctcttctgcatcgtgtgcacgaatggttggggggaagacggagatccctgaagtgagaaaaaacaggcaagtgcaagagcttggaaggttcgcggtggaggagtataaccttggtttaaagctgttgaagaacaacaacgtcgacaatgggagagaacagttgaacttttcagaggtggtggaggcgcagcaacaagtggtgtcagggatgaagtactacttgaagatctctgctactcataatggtgttcacgaaatgttcacctctgtggtggtggtcaagccatggcttcattccaagcagctcctccattttgcgcctgcatcatcatccaccaccaccaccaccaccaccatgcatccagtagtacgtaaagataattgagttgcatgcgtacgtactactgnatgcatggtggtggtggtggtggtggtggatgatgatg

SEQ ID NO: 1465 - DNA, 745 bp, Glycine max
  misc_feature (381)..(422): n is a, c, g, or t
  misc_feature (426)..(431): n is a, c, g, or t
  misc_feature (437)..(440): n is a, c, g, or t
  misc_feature (446)..(452): n is a, c, g, or t
  misc_feature (460)..(463): n is a, c, g, or t
  misc_feature (513)..(517): n is a, c, g, or t
  misc_feature (519)..(519): n is a, c, g, or t
  misc_feature (521)..(525): n is a, c, g, or t
  misc_feature (533)..(545): n is a, c, g, or t
  misc_feature (561)..(561): n is a, c, g, or t
  misc_feature (569)..(573): n is a, c, g, or t
  misc_feature (580)..(583): n is a, c, g, or t
  misc_feature (589)..(595): n is a, c, g, or t
  misc_feature (616)..(622): n is a, c, g, or t
  misc_feature (627)..(629): n is a, c, g, or t
  misc_feature (639)..(642): n is a, c, g, or t
  misc_feature (672)..(674): n is a, c, g, or t
  misc_feature (701)..(705): n is a, c, g, or t
  misc_feature (724)..(736): n is a, c, g, or t
tgttgtcttatctgcttaaggtgttaccaatggtttatcaggaacatagtttttaaatatcttccaaaaacacaataagctttcctctcagctaccactaactccaaatggtgaaatatggggcacaagaggggaaaggattacaggttttactaacagtttgtaggttgcagatacttgcatgtgtgcatgcgtgcacgtgtatgtagtttactgtcctttaggcttatgtgtgtatcttatgaagatggttgtcataggaatgcaggataatgagtccagagtcctgttaaggtaacctggaggctgtactgtacagaatattgagagcgtctgtgtgtaatgttgtgatggttttttctacaatttagtatacaagannnnnnnnnnnnnnnnnnnnnnnnnnnnnnnnnnnnnnnnnntgcnnnnnnaagaannnnggtttnnnnnnntgaatatnnnntcaattaagatattttgttatatgttacttatatttcatttaattagaannnnncncnnnnntgtatctnnnnnnnnnnnnntatcttatattttagntatttagnnnnnttgaagnnnntatgtnnnnnnntcatagattctagcacaatannnnnnnaattnnnactaaccatnnnnaccatatttgtttacttcccatcctcattnnntcaaaattgaaaaacctacttccgaannnnnacaattccaataagagaannnnnnnnnnnnnctttggaga

SEQ ID NO: 1466 - DNA, 367 bp, Glycine max
agcctttttacagggtttgcccagccaactgacccaccagatccatttggttgttgagatggctggccagcccacccttgtgcatgggaaccctgttgagttaacctagcttctttggggactgaagatggacctggagttctcatgctagatggtgaaacaggaccagttttaggtttcacagcagatttctccctgtcatttcttctcttcttgcatacaacaagttcacccggatgcgcgagcagtgaagaatcttcctgctgttgctccctggtgctgctgcccccaccgcttccagttcttgattccctctgtggcaaatgaactttaattctgttgttttcaccactagaagctgatccac

SEQ ID NO: 1467 - DNA, 374 bp, Glycine max
gtttatgatccttccgttggtacaagtggagggaaagttgtcatatctgggacaccagatcaaacctttgcagcgcagagcttgcttcaagcctttattcaaacgggacaagcaagctgatggaaagctgcatttcatcatcagttggtgccatgaatggtgtacatagatgtcacacgacaaccttcactttgtgaatacggattcactcttttttcttaaagataatgcttacctcttatagactataaacacagattttgttctctttctctccctccttcccccgcacatagtctcacttttaatttaaggttcatcacaataccattttgcttcaagacccattcatattcatcctcaccatcctcacc

SEQ ID NO: 1468 - DNA, 472 bp, Glycine max
atcgtgctggtgaaggtgatggtgaactgcagagcattctgtcacgttctgttcaagatttgttggctgtcactgaacagatttatgccatcactgaccgcacaaaactcgtggatgccattaagtgcttaaaggctgctatgttaaatgctgttcctattgttagagcctctgatgttgatcaagatgatcacaagcagcacataaatgcaagtctagctcattaattctcgatcccttaattgttattccttcctaattttggtgtcacatacgtacgtacgttttgcagggcagatgcaggaagcttatcggtacattttcttcaactgatttgaggggatgccacatagccacgctgaaatcatggttgggaataagtgcactagcattcactgaagatgttgcatcgagtcctttgtacacagaatcagaatcggacacccagattaatagaagggagcttgggact

SEQ ID NO: 1469 - DNA, 398 bp, Glycine max
tttggaggtatatttgggtggacttttgggcatgaaatcgcaaatcacacacttcaactttacagggtagacacattggctgctgaggccaagtttctggactggtggaataagaagactggagggtattaaaactgttggcttatgggaattaatgctacatttgttatcgtttctgaaaaatgaagaataatttttggtgttggcagtgcgatttatgctcactgaataagtatgttgtgaattaggttatgttttaaaactaatgcatcatcgcaaaacaaatggtgacttgtgccattttttctctgtattgttgtgctgttgtttattagtctgggaccaatggttgagagaggtcataagtgctggcattttcatggtgtaccaccgctaat

SEQ ID NO: 1470 - DNA, 781 bp, Glycine max
ctaatcaactgtgtcactggcaaaggctcagaaattggtgacttccttacaatgcatccaggagtgaactgtataaggtgactatttgttccttctaaatgatatgataggatgttgccacacatcctcaatttcccatgtgctagtaatttttcctctactgacttgtcacaatgctgttggtcagctttactggtggtgatactggcattgcaatttcaaagaaggcaggcatgattcctctgcaaatggagttgggaggaaaagatgcctgcattgtacttgaagatgctgacctggatttggttgctgcaaacattataaagggaggtttttcatacaggtaatggcacatcagaattagtacttatgaggcaaggtttccttttctgcattgatttgacagaactgcctaccaatattaagatagacaattagacatcctccacattttgcatgcattcttgctctttctgtgaaataaacagtttgtgagatattgcaactcacatcagataattttaccatacaagatgaatgttgcttggttagaatttatatagatctagaaactacgtaaatatacttccatttcagcttcatgtgcttctttacataatggatacttacttgaattataattcttatttttttttcaacaaaagtggtcagagatgcactgctgttaaggttgtcctggtaatggagtccgctgccgatgctttggttgagaaagtgaaggctaaggtggcaaaactaactgttggaccaccagaggatg

SEQ ID NO: 1471 - DNA, 1143 bp, Glycine max
  misc_feature (1087)..(1096): n is a, c, g, or t
  misc_feature (1133)..(1137): n is a, c, g, or t
atgcagcaggtattgaaaaaccctaataattcttgagatcgcactttgttatttcgacggattcatgtgaaagctgatctcctttctttttctttttttgtgatccgaaaaggggggaggatctgagacggaagtaacatgggaagaccagcagaacatcaacaaattcggaaggttgaataatcgctttcacgagcttgaggatgagatcaaaatcgcaaaggtattctattcaaccctttcattccactcgtgtttagtgtattatgcacacagaacattagggcatgcacaaattatatttacttcttgtttagttatatattactcctaagtcactgtatgcttaagattaagaacttaggacaagctccaagacttaaacttctctgtgtcctgattttatttattttgctgcttttcattggtcaaacataatatacatggctacgtgccttttgtagagactggaacatttggtgtgagttgtatctggaattaatcatatcattcgccaaaaaagaaaaaaatcatcttgcctacactcttttagcagtggactaaaaagaacttttatgcaatgtgtgaagttaagaaaaagattgagtcccaattcatcactaaattagagggaaaagggaggagaggaaaaatagaagacgattacatcattatattctcccaaattaattctaagtttgcttgagtaagctactcaagtccttcctttaaacacaaacataaggtttagagttttttaattcatccgttctgctctctggttctgtgtttggtttaatgagatttagttgttgaagtatctgctctgcatttcctgttgttttaattttgctgctatccaggctttgctatggcaagatccattgtaggcttctttttccacattatgatgcaaatacagcaaggttttattttttcaatctttttaggaaacaaatgataatttggaggatgcaagcaacgagttgattctcacagatgaagaggtcattcggtttcaaataggagaggtttttgctcatgtgccaaaggatgaagttgagaacaggatagaacagataaaagnnnnnnnnnnccagaaattagcaaaacttgaagaggagaaagaatcnnnnntgctca

SEQ ID NO: 1472 - DNA, 373 bp, Glycine max
actaaaatgattatagaaaatagtaggctttctggtgggagcagcactccttaagccttagttactcatggaaaatatcctagtttgtgggatggtcaacttgggtagttatggtcccaaactctctcaattttccaagttgtggcataaattctattgcaccttttaacaagctttgcttgttccagtgtgttttattatgatttgtgatttatacaaccttgcgtttgagtgccattttagtcgtcttatcccttactagttgaatttgtaactgtttgtgttatcagacaaaaaatggggtttcttcacttattgacactcgtcatccactaatgttttgtgacttgttctggccgatatatgcttactt

SEQ ID NO: 1473 - DNA, 586 bp, Glycine max
ttaccactccttcaactcctgttagaagataaatacaaaacaaaataatgagtgcacatgaatgacatttggtagcaaaaggaaagagaccgtgtattaataaatttgaacctctcattttcataatgtatctctcaattttcttggcacatccctcacaatgcaagtccacaaacagcacacatggtgaaggtggtttaggctcttccttcttctcttcttctgtcttttcttctggtttttcttccttcttttcctctgctggcttttcctctgccttctcttctttcttctcctcaggcttggcttcagccactggttgtacttgctcctacaaaatataaaagaagaaacacacctaataagtactagaaccaatgtagaccaagttataacactcgcagaaaaacaaaaaatatcactaggaaattaatcacaatgccaacagaaatgttatatcacctgttttgcttcctcacccatttgtcctatgaatcgagactgatgaaatgtcaaattgttattctgaatttggaaaaaaagttcttagacatgcaaaagatggagagggtttaacaagtgttga

SEQ ID NO: 1474 - DNA, 954 bp, Glycine max
  misc_feature (47)..(50): n is a, c, g, or t
  misc_feature (944)..(946): n is a, c, g, or t
caccaggcagaaaatcatgggaatattgttcatgatcaagaaagggnnnnttgtggcagaagactggaagcagggctgtggcttaaagaattctcctaacttttacaaactcacttctatcattgataaggctacaggatcaccaagtttgactgacacagtaagtaattgatttgatttcagtcaatatatgttttgctaattgtagttattcttactaaaatgttatttacttagttttggtattgaatgtgctctcaggaaccatatgttatgaaactaactgaagatcaaatggcccagctgctttctgccttttggattcaagccaatcttcctgataatttaccttcaaatattgaagctatagctcattcattcatattgacactaattgtcttacgcataaaggtagtacttgatatgtatttgtactacttcctgtctctgtcatttttgtatcccagtagtttcatctttattgtatttctgcttctggatagatcatgcatggtaaattgagtgtttgtaatgttgtatcttgagttcccagtaaaagtttatcttcactatagaaaaacagcagtttagtgacattaagatttactgaattatcagtgactttgactttgtcaaacaattttgtcataagcaagttagcaaactatacaaatttgttgaacttgtcatcttaaattattttctcttcaaatttagtctggttccatttgtcttatattcacactgactgattgccctaccttatagatgaatatctatgcttttattctcagcagctattggattctcattttcatagtaaactgaatataatcacaatcttgactgcactttcggttataatacttctaataatttttactctgattgttaaaaattgtcaaaattcgatgtgcagaacctgaaagacagagatagcctgnnntccgctct

SEQ ID NO: 1475 - DNA, 368 bp, Glycine max
aagacattttcagcggaagagttacagacaaatggcggaaattcatgaagggacaaataaagagggcgaggatgttttttgatgaagcagagaggggagttgcagacctcaactcagctagcaggtggcctgtgtgggcatcattgttgttgtataggcaaatattagattccattgaagccaatgattataataacttcacaaaaagggcatatgtaggaaaagtaaagaagctattatcactacctactgcctatggtttttcacttctaggccctcagaagtttgccaaaatggttaggagataactgttacaatgtgtgatacttttcagttagagttgtatacatctcaatttaccatgtgtt

SEQ ID NO: 1476 - DNA, 568 bp, Glycine max
cgaggacattcgcgccgacgagacatggcccggcctccgcaaccacgaaatttctctcctccgactcttcgaaaccgtctgcgacgattgccacgtcgaaatcaacgaaaccggtaaccattttcttaattatttatcgccaaatcttatgtttcttgtttcttagtttcatattagaatgttagcgaggggattcgaaccaacgaccgtttgattattcattctgtttggtttgggcaggtaccaaattaaagtacaaaccgggaactattatgggtggcagacaacacagtccacacgattgcggcgtctcacggtccattggttactttctggagccactcattgtgttgtgtttgtttgccaaacagccccttactatcaggctcaaaggtataatagtaattgtattctacttcctatttatgtagaaaaacgaagatattgtggtggtttaaactttaaatctaaaaaaaactgttcgcacaggaattacaaatgattctaaagatccatctgttgataccttcaagtcaacgactttacctatattgaagcgctttggagt

SEQ ID NO: 1477 - DNA, 392 bp, Glycine max
tgcttcctaagagtaaaaaaaggcttaccaaaccaaaagaacacaatcacagcacacggtagaaaagacccaaatgaaccaaccggtttctcattccagttctgcaacataactgcagattctgatcttataccttctgttggaaccgcacaaacgtacctggggagaccctggaagagttactcacgaaccgttttcatgcaatcgtacatgagtgaggtgataggggcagaagggtggttggagtggaatggaaactttgcattggacacattgtactatgctgagtacatgaacactggagcaggtgctggagttgctaaccgtgtgaagtggccagggtaccatgcattgaatgattcgagccaggctagtaacttcaccgtgtctca

SEQ ID NO: 1478 - DNA, 784 bp, Glycine max
tgtcttcactactcagatctcaacaatgtctcagatgctatctatagcatattttaagcaaatatgctcagagggcctgttttgtttgatgcatctagtccatgttcaccattacgagttcctgtaataaaggccctgcaaaaaacagattttggaggaaaggttatacataacaattttgggagaattctaaaataagaagccttgataataaaaggataatgaagaaacgaaatgtggtgattctatgcaaaaaaatgtgactacttttactttatgatacaagatattttattggtatggtatggtcatcttaatggtttagccaaaagttttcttgctatccttttctgtttggtcacctgatttatgatccatgtccaagaagaaatgtcatcatatagttattgacaaagatggagatgaatgtgtaacaagactaagctcgttctctttctaaccttttgatatttttgctgcctgaatctgtcagaattgtcaatctttttgctgtcttcatgaagtcactgcaataagatcacaagaggaaacaaaacccaaaataaatataagactaggataaacgcacgcatctgaagagtacaagtaatggaagtgctgccagatttaggtaccttggtgaaaatataaaattattcaattgagaccaagaaggaaaaggtggaaaaaaactgaaaacaaaaatgatacctgaaaggttcttctccagtttgcttaacagcaccagctgcatcataatagagcacatggttcaaaatctcag

SEQ ID NO: 1479 - DNA, 434 bp, Glycine max
  misc_feature (345)..(384): n is a, c, g, or t
  misc_feature (392)..(392): n is a, c, g, or t
  misc_feature (394)..(419): n is a, c, g, or t
  misc_feature (422)..(426): n is a, c, g, or t
gattcaagtaaacttcttctttgtcagtcgttgaaaagaaacaatgccttagggcaacaatatttggatgatccagcatttgcataatttgtaactctctattcttgtatcgtttgtcctggagaactttcttgatggccacaatttctcctgtttctctacattttgcctaataaaagcattgataaaacgaagaaggtatcatcagtatgtcatacatcaacagcatggtgtttagaagagatatgaaaagcaaactcacctgaaaaacaacaccaaaagagcctgtccccactacatgctctgcaatataactaacattctgtcaactcaaaaaaaaaaatnnnnnnnnnnnnnnnnnnnnnnnnnnnnnnnnnnnnnnnnccaaaaantnnnnnnnnnnnnnnnnnnnnnnnnnnttnnnnntttttttt

SEQ ID NO: 1480 - DNA, 380 bp, Glycine max
tgaagctccctgtgcgttacttgattgttattttgaccttcgtctgcacctcggtttgctacatcgaacgagttgggttttccatcgcgtacacagttgctgctgacggtgccggagtgaatcaatcgagcaaaggtacaatactgtccaccttctattacggatacgcctgttctcaagttcccggaggatgggcagctcagaaaatcggggggaggagggtcctgcttctttcctttctgttgtggtcattaacttgtgcactacttcctctagatcccaatcgcgttatgcttttagtcattgctcgtttgctcgttggtatagcacaaggcttcattttcccctccatccacacagttctagctcaatgggttaaa

SEQ ID NO: 1481 - DNA, 633 bp, Glycine max
  misc_feature (43)..(44): n is a, c, g, or t
ctgatgacctgcttctggctgcctgtaagtgctcaagacactnngcgaacattaatttcaaacttatgtttgggacaggtgaaaataggatcatggtaggaatgaaatatacatttggaattaatacaatgtcatattatttgattttgatggaacagctgaggctttggctgcacaagtgagccaagagaactttgataagggactcatatacccaccattcaccaacatcagaaagatttcagcacacatagctgccaatgttgctgctaaggcttatgaacttggtaagctcttggtttaatgggaggttctatggttgcactttttttttttttttttaaaattttaaaatttaaaaaaaaatttttaaaaaggggttttgggtttttttcagggttggcccccccccctcccccccccaaaaattttgggaaatttggaaaaagctttttttttcccccccccccccaaacccccccaaaaaaaggggaaaaaaaaaaaagggccttttttttttttccttttacaagaaaacctttccttggcaattttttaattttttcccccctttaaggccccggaagggtttttggaaatttttttatttgggggggtaaaaaggtaaaaaag

SEQ ID NO: 1482 - DNA, 326 bp, Glycine max
gctgccccagtcttcagaaacttgaaatgagaggatgctcctttttcagtgagtatgcactagctattgctgcaactcaactgaattctctcaggtacctatgggtgcaagggtatagtgcatctgcatctggacgcgatcttctggcaatggctcgcccctattggaacattgagctgattccttctagaagcgtggttgttagcaatcagcaagaagatcctgtagttgtcgagcacctggctcatattcttgcatattactctcttgctggcccaagaacagattttccagataccgtaatacctttggatcctggaacatat

SEQ ID NO: 1483 - DNA, 757 bp, Glycine max
agagatggattccattattccaatgtctaggcatttttctaattacaaaaaacctctcacgttgtggttttgctcttcaactatattattaacagtttcttcacacttgtggtttagtcttgaatcttattacattattcttaacaacctgaatgttaactataggcttcgtttcaggaaggaaatcataatatacttatacatacaaaagcagttgctaaaattcacatcttctgttgttgcctctttggatgagggtgcataattgaggaaataaattttgtatcacaacaatcaccatatgaggttgagtctaggcttctgacggaactgcttttttgtgacgcaccaatgaccaggaaaggtgctcaactgtacacaattcaaagacagttagccttgaagcagagactttttttttattacgtttactacaaaatatatggaaaatggtcaacgttcagctaaaaatgtccacccagaatccactcggaactgttaaccactttttaggcacagtaaccataattggaaatcttaataacactattaatcacctttaaggcaaaattaactatatttacacgtgtataaaccgtgtgagaggagtggacactgagtggataattctcaacggtgccataatcactacccaaaatagaatgcatatacagcaaactaaatttgagtatgtatcacaggtagtatgactcacattgccaacaatctttgctccaaaccatggagtatcagcacc

SEQ ID NO: 1484 - DNA, 456 bp, Glycine max
  misc_feature (421)..(423): n is a, c, g, or t
  misc_feature (447)..(449): n is a, c, g, or t
  misc_feature (452)..(452): n is a, c, g, or t
ccatatggttcaaacaactccgaaaaaaggccattcttccttctagggtcatgcttcatgtctttgcacaattgatcatgataccatatgccacaatgagcaatgcatgttttccaataatatttcccaccatattgcttcaaattgtcttcccacaatttcacgtccttttccatctctcttatactaggcaactctatgtttccatccaagaaatgtgatagccacaagcttttcatttccgaggcaaatatatttgatgggctctcggcatatcctattattgccaactgggggatctgagggtgaattatttgtctgaattggtgcaacatagatgacgtttagtgtatatatatataaaaaaagaataaactatttatgcactaataataatgaagactttttttttcttttctannnttaattttgatttaagttgttatnnnatntatt

SEQ ID NO: 1485 - DNA, 603 bp, Glycine max
ctccctgctcaggttctctatgctctccagcagattgaggtcaatttcatgattaattacctaatgaccatagtaaacattagtttccatgaaataatatgtttttttaaaaaaatacacataatcatagatgtaactttggaaagttaatgatagtctaaatagttatcaaatagtaatagtgttactaagaaccaaatggtatatatttacctgaaaaaatccccactcttcacaagcagttgcaagattgaaaagttcagtgaggacttcctctttgttccctttgctaagcttatagaaatcaatgactggcatgtcactatatggtgggggaagaggtgtagtgagtgttggtctttctgtcatgtctcgtacaaatctttgaggaattgtccttggcttggtttttcttagctcttggacatcatcaatatgcccaactttgatgggggaaataggtacgggaggcattggaacagaatctgggagcttgagttattggcttggtttttcttagctcttggacatcatcaatgtgcccaactttgatgggggaaattggtacgggaggcattggaacagaatctgggagcttgagtt

SEQ ID NO: 1486 - DNA, 765 bp, Glycine max
aagtaattgtttcttccctgttttaatttttttaaatgacaagtcatgaaattcattacattaacatgttacatcctttaaataatttggaagtatatttaagtaaccagttgaatttccaacataggtacttggatacactgggaatgatgatggaaaaaaatttgtgcttgatggagaggtgactactgacaaaattaaggtacttgttgctccctttttgcctagggttctgttaattttgctaacatgttaatgttagggaatgtgcatggatggtttatctatcacttaataaggtttgaaagcaatattttgagtaaatttctaatcttcatttttccacaggcatttggggaagatttcgttgaagacaagctaaaacctttttacaagtcagatccagttcctgaaagtgtatgttatttaattttcccaccgtcaattatgtcctattaatttagtttttcatgcctaacgtgtttgctaacttggtaacagaatgatggtgatgtgaaaatagtagttggtaataattttgatgaaattgtcttggatgagtcaaaggatgttctcctcgaggtaaaatttaaccctttacttttagttatatttgcatctgcacattgatcatgttatttaatgctcggttgaatcagatttatgctccctggtgtggccattgccaatcactggagccaatatacaacaagcttgcaaaacatcttcgcaatattgattctcttgtaatagccaagatggatg

SEQ ID NO: 1487 - DNA, 384 bp, Glycine max
gggtgtttaacgtgtatatttcatttcacggttgggtaaaggcagaatgaaagtgcaggcgaaaagggggaaaacaaattggctagtgctgtgcgtcacgtctaatatcttagtttgtctgatctaatctaaattttctcgcaaacagaagaaaagtcaagcgcggcacgaatcgcgatctttccttctttctttctttcgttccttcacaatcctaccagccgccaagccgcagagtcaacttgtacaaatgcccaccgaatccattaaaactaaaaaatcttctaccacgaacacttgtcttcattcttcaaccttcgtttcgtttctaccactccattccagaatgcttcgttacctgttggtgttcttcttattgggctt

SEQ ID NO: 1488 - DNA, 400 bp, Glycine max
tttataggtcacagatataaaaattccctctctaccagctttcagcagcaaaaaggttgaaaaagctttcaaaaatgaaaataaaaataccccaataataaaaaaaggccccaagaattaggaacccccatttgacccaataaaaaatgatcaagagccaatttaaaataagcccttaaccattttgcgatccaatttgaccccaccccctcctcctccaccaagtagcatactatattaataccttagtatactagtcttttttttggagtcatatactaacacttaaattgagaaattatagcatatactatatgtagtgtatctaaatatttggaacttcaacttgtgaacaattattaaggccctctctagcggaattgagcaccagtgtaggttt

SEQ ID NO: 1489 - DNA, 508 bp, Glycine max
  misc_feature (50)..(60): n is a, c, g, or t
  misc_feature (497)..(499): n is a, c, g, or t
atatatgtcaaattgttcagctgggtgtccaatcacctgacagaattttnnnnnnnnnnnctttaccaggctatgattgatttaggtcttgagaatgaattgctagagtatggaggtcctgatctgttgccatttttgcaaagtgctggtcgtaattctatacacgaggttgtttattatctctttctccccaataactaattgatggatagctgttcattaggtcaaaaggcacaaatattgtgtattacaattttgattgtatatgttttgcatgtagatgctacaccctgccatacttctcataatatttctttgtaaatttagtcctcttttgtttttctggatctgctaggttcgtgctgtgacggccacaacttctccagtggggcaatcaggagcacctatgtcatctaatcaagtcaagtactatgaacttttggcacggtattatgtcttgaaacgccaacatatgcttgcagctcatgcattgcttnnnctagctgaa

SEQ ID NO: 1490 - DNA, 389 bp, Glycine max
cgaagaagcaacagtctgagccttggttcaaatcagaagcaaaaaaataatacaaaaagatagtctcaatattctttatgcaagttttacccaacatttgacgatttctagctttaaacggtgttacacatggaataaatacccaaaaaagaatgatagaaaatacaacaacatttgtattttacacttgacctttcgtgaacacatatgagcctcgatgacttgcttttgctatcaccagcatttgaaaactattgtagtattatgcaaccactcacctccatggagaccgtgtaatgtatctaagaactctgtactttcccttgagagtgtgcatgagaattggcaagcccttccttccaccctttcttgcgcgctctaagttcaaa

SEQ ID NO: 1491 - DNA, 430 bp, Glycine max
agaggagagagaggcatcaacaagagcaagaattggctaaacatatcgcagaggaagatgatgatgacttttgataatgatttgctctttttatcttaccagtttgttgtcaggatgtatttatttcctatatttgctcatatttctccattggagaaacttccattaccatttcctttttggagcccgaagttttattttctaaaccaaaatcatctttaaatcctttgccatatcgagatatttgctgttaattacagatcatgggaacacattatttgtttcctgttaggtgaactatgttttgggatttgagtgaaatcaattatataggaccatgttagtgattcagttctaaagtttgaatattgtaaaatatttgctcattgacccaaaaaaaagaggtattataccactgagtctgagccat

SEQ ID NO: 1492 - DNA, 1441 bp, Glycine max
  misc_feature (55)..(58): n is a, c, g, or t
  misc_feature (1386)..(1396): n is a, c, g, or t
cttggttggggtttctctgatttaggtctgttttattacctttcctattgtatgnnnntactttcccctttgttcatgagatttttagcatgttttcttctctttttcttcttctatccattaggaaaacttcctccctgtgatgtggtatccaagcgtgatcacttctaccaggtactaatgtattaatgtatctattgtatccccaaattatagtcaaacctgaaaactcagttggaatcttaccaagtataagatgttagatgttagattccatattaaaaccaattggcgttaagtaaagtgaaattgcctaacagatatataagcttcaccctagaattgagccagacaatgtaggacactaggacttttcaacatccctccttgcctgccagaacaagcaatgcctactaggataggtgattcatggagatggactataggctctgatagcatgttagattgcattttaaaactagttgtcattaagtgaagttggataacagtcatataagatgcaccctaggaattttcccttaattaacaaaccgtatgaattggagtaacagatcagttaaattataggctttgacttgttcatcaactatgttctgaagaaatgaatgtcttcaatagttatttagtttctttccacatctattttggtttccttccaattgttgcacactgtgacactgtgttgaggctgaattggatttatctataacagttttggaagtcttacattagaaggccaattatattggttggaccaagccttggctctgctgttgccgttgactttgcggtcaattatccagaagctgtatgtgccatccaacaatttaacttctaaatgtcatccatggcccagtttacataaaatttcttcatcaaatgactctggtgtgctgtggtcatttatttgcagtttatcttttcaggtggagaagcttgttctgattggtgctagtgtatattctgagggaactggaaagctagcaaccttacccagagcagtagcctatgccggggtgaatatctctccaacttactaaattacttctggcaattatctagaaaatcacacaatatcccatctctctctatgcaatgtttcccttgctgaataagttcattttttttggtacatataaaatttcttaatattacatttaacttttggaaatggcatttttttttcttttggcttacatcagttggtgtaattatgccttctaagttccatctcataagccaattaagatagaaaattgatctttcacttgaactttctatcactgttatgagagatattagaatgagaggataaggatgttgaggattttaattactctagttacaactcactactggtattcnnnnnnnnnnnggttaatttattgaagagccttccattacgcttatatgccaccta

SEQ ID NO: 1493 - DNA, 816 bp, Glycine max
  misc_feature (781)..(781): n is a, c, g, or t
  misc_feature (798)..(799): n is a, c, g, or t
  misc_feature (806)..(812): n is a, c, g, or t
ggtaggcttcaatggtaatagcctagagaataaagagatcaaactgtatattagtgaccccataaaatcaaaagaaaaaaaatctttgggatctattaatatcaatagctatagatgatgatagtgaaaactcacttggagaatcatgaaacaagcgcaactaaagcagccaattgtgatcatcactgatccctttattgcatgttgaagattcaccccaccattttgctggttgtgggtactacttgcgtgtgttccaaaaagatcaagtattgggccctttatcagggtcatgaccatggcacctacaacagtggctaaagtccctaccacctttgcttgactgcgtatactttttagttttaccttctcaagcctggaattgccactcaatatttcagatatgtagatttcttaaacatgtcataaagagtttgctgtttgccactgcgtgtaacaggttttttagtttgacagaatgcatccagttacagacacaaccttatttgtgtatttctatattaataggtctgttttaaatacttttctagtaactaaacgactaaatgtattgaaaacaaaaagagaatcaagcaactacacaaatagtgataatcttttattagttttgtgcacattaagtggtgtacacgtattactcattttaactcatacttttctttttttctctttctattttatgatcatataaaaaaaatacaactttattgtacgaatataatttatgatgatgtctttttagctataaataaatctggantatttttctattgagcnncatgagnnnnnnnccta

SEQ ID NO: 1494 - DNA, 260 bp, Glycine max
acagcaaagaaaacaaacagaacagaagaagaaaaagaaactaagaactctatgtaagagatgcaacccatacataatctggcataaaaaggaataaggtttgtttgttctatttagtctggcaattaaaaatttatttattacaaccaaaccattcatttagtcttacacttgtctctcactcactcactgacagagagcacatgatgttttttaagggccagtgatgcctcatccggtgctgatgatccaaatttctg

SEQ ID NO: 1495 - DNA, 945 bp, Glycine max
tggcaacttgtaaaatgcttcttttgccattccaaatacagtgttgaactcatcctctgacagataggcctgaccgacaagtggagaagaaagaaaaatggtatatcaatctaaagcataaaattgaaagataatctaattttgttagtttggcttaggggaatgcaagtaaagatgatttaataaaattaaaggggtggcgattgtcaaaatttcaagagatatttcaaaataaaattaatataatattaaattaaatattagatcagtacaaaacaagactaacctctctccgtttaagatcaactccaggcacattatgaccagatttagtctttaattgctcataactgaacatcctttgaccatcatttccttcctccgcattctcttgttttagttccaaatccccattgctaccggtctcagggggaagttcctctgtttccttggcttctgcaacttcttcaacttcagaggagtcacttttagtttctgcaccaagaacttaaaacttataatatgatcagacgcaagcacaaacaattttgtgcgaacactggtcagttttgctttttaatgcaaaactggcatttatttcaatgattcctattgagggaaagaaaaaacctaaaagttattaaattggcatgtgttgtttcttctcttgatctcaataaagccacaggggtttctaagatgctatgagaatgtagtacaacaatgtagcgcttaggcttccagtcttagtagtttactagcagtatatattattatgattaaaaaatatcaaataattagaattaaacaaaaaggatttatattaattattcaaatttcaaaagaaaaacacataagtaatagggtgtagtaaaatattcaaaacaaacaacccattgtattcagggaatgcaacatcacatttagacaagaactattttgcta

SEQ ID NO: 1496 - DNA, 446 bp, Glycine max
  misc_feature (381)..(385): n is a, c, g, or t
tatagatatggaaatctcccatgacatcaagatcaaggatgacaagctaggtggtgtgaaggaagagaagattaaggtagaagttgaactgaagaataaatcagttgagaaagagcatacaaaaagtaaagaagagaagaaacataaagatgaagataaatcaaagaaaaaaaagaaagagaaaggggaagaggaagatgaagagggagagaagaaagaaaaagatgtaaaagataaaggggaggatggtgaagagaaagagaaaaaggagaaggataagaaggagaggaaaaaggaaaagaaggacaaggatgacaaaactgatgtagagaaggttaaggggaaagaacatgatggggaggatgctgaagagaagaaagnnnnnactgatgtagagaaggtcaaggggaaagaaaatgatggggaggatgctgaagagaagaaag

SEQ ID NO: 1497 - DNA, 673 bp, Glycine max
tctctccttttatggttttgatcattgctattctgaatgatggtaaggctcttgggcttttagcagatattcctctgaattacactcaagttctcttcatgcctatgaaattctgacacaataattgtcatactattaggaacaatcatgacaatttcaaaggacagggtgaagccatctcccttgcctgatagctggaaactgcaagaaatatttgctactgggattgtacttggaagttacttggcgctgatgactgtcatattcttctgggcaatgaaagaaaccgatttcttccctgtaagaaatattcaacagacatattttcaagtccttattttgtgtcaaataaataacaccactttgattatttttgcaggacaaatttggagttagacacttgagtcatgatgagatgatgtctgctttgtatttacaagtcagtatagtcagccaggctttgatatttgtaacccgttctcgaagctggtcctttattgaacgccctggaatgctgttagtttgcgctttcgttattgctcagctggtaaggatgatgctccatttaatctccctgaattttttgtaggggtgcaaccaaaaccagagaagggaggaataatattttgacaatatgttctgtcttgttgcagattgctacaatcatagcagt

SEQ ID NO: 1498 - DNA, 337 bp, Glycine max
aattacaaatatgactagatgtgcttaactgcttaaatatcttataagccgggagaagcctcatttgagaataaagagcacggaaaagcactattgacttctggtatgtcttcttgtaagagctagtaatgtcactggtttgaggagccaccacacggggacaatcatactgaacaacccacctctctataaccgtctcaacagaagagccagcctcttcatgaacaagtataatgtcaattatcattggatccatcaaattcctgtgccagaagtgcaagttatccagagcagaaggcctatcacctaaagccaagttaaaccacttgtcgctcct

SEQ ID NO: 1499 - DNA, 350 bp, Glycine max
ctattcgtcacatcgtatatatgcagtaccacatccgtcatctttccctttcacccaccaagacccaaactttaaacaacctcacttcacctttctctctctaaacgctattttcctatccgggtctctctctttctctctctatatgatttgattcagcttgaagattcaacaacgggtgttgttgttcctctctcttctcttttcgtaaattgaaccaagattcggccttgggatcccggaaaaccttccaatttcaccgtccaagtttttttctcgccggaatcgaaagattttcgtgtttctctcgtgaatttatattctaggaggagggaacataacgaggagag

SEQ ID NO: 1500 - DNA, 370 bp, Glycine max
gaggcagggcctagctcccacactgcacttcagagttgtaaaacaagtactagtggatatgatgaagaaatggaagtggatttgacactaagtataggaggtagccaagttaagaagaactctcacttaccacaattagcatgctcaaactcaaccaataatggagaaaccagaaagctgaattcacctgcctccttcaaatcagatagaacaggagaatgcagtgaccccacaaccccaatgagtagctccactgtgacatttactcagcaaagaaaggggacacattggctttctcaaggtctaaagcttaaatagcactataatagcttgattgtatcctttcaactctacatggaccaccgaattt

SEQ ID NO: 1501 - DNA, 428 bp, Glycine max
  misc_feature (329)..(329): n is a, c, g, or t
  misc_feature (365)..(365): n is a, c, g, or t
  misc_feature (396)..(402): n is a, c, g, or t
  misc_feature (408)..(414): n is a, c, g, or t
  misc_feature (418)..(424): n is a, c, g, or t
ttctctagtgtctcaaaacctccccacctaccacggatctttgacacagctaaaaaatctccagaatgaacatctgcaggatcaacagttgcacgccaaggctgaatgcgcttctcaaatgtagctcccatgtgtttctttaggaaatctaagttggcattctgaccccatgcagtgttcgagaatagaggcaaaacatcaaccagagaaaggagcgttcccagcatccccgatggcatgagaaacacagaaaccccatgccgctttacctgataatttagtgagaatattacctttctgtagttgctactccacattaaaaaaaagantaaaacagaacagaaaacaacaaataaagaaaaggnaaaatacatattccaactctgcaggatcttnnnnnnnaatcannnnnnnaagnnnnnnngcgc

SEQ ID NO: 1502 - DNA, 400 bp, Glycine max
tatccttttgccatttgtttatcttgtttgcatttgtgtgatgaattaagatctttgtcatattaaagtgttttgtttttattttaattttttttgctcatcattttgtgctcatggtggtgaggtttaacccttcatgtctcaccctctctcataatcctcaccacactacatatttctctaagcaagtgacagttaggagcagttatgggaaacacatgaaaaggggtggccttggaagaaggcctcagatagtgtcttcagttttggggaacagtaacactgaaggggtgagtgtgtttgtggtgtctgacttgcacactgactatgctgagaatttgaagtgggtggagtgcttgtctaatgtgaagcacaagaatgatgtgcttcttgtggcaga

SEQ ID NO: 1503 - DNA, 783 bp, Glycine max
  misc_feature (716)..(716): n is a, c, g, or t
  misc_feature (771)..(779): n is a, c, g, or t
tcccgcgcggtgcctctctccgccgccgatctggtctccgacgacgaccgctccgtcgccgctgactcctggtccatcaagagcgagtatggcagcactctcgacgacgaccagcgccacgccgacgccgccgaagctctctccaacgcgaacctccgacctccctccgattacaggttcacttcctctctctctctctctctcataaccactcttgcacctttttatttgttgattgcatttttcgctgcctcggtttttttatgctgtgacattgctggttagtgattatgcatagtgtgaaagtgaaactcattgtttagctctaagcgaaataaatatacctgggtttttaattaatgttaggtggaggaagtgaggtgaaatagtagaattttaagatcttgtttgtctcattggtgacatttgattttagggcaacgaaggcgatttatattttatgttcgctagtgatttatgaatctgatctgaattgtttgcacctttgtttggattttggttttttggattttcctttgagatttacagttgggaactgtgtgtctgtatgatgggaaacaaactaggagatgaccactgagttgaatggatgaatcatcattctggatttaccaatgctgactattttttgttattccggatttgcagttctgacaaggatgaacctgattctgaagcagtcacgtccatgctgngatttcagagttattgggatgctgcatatgctgacgagctcacaaattttcgtgnnnnnnnnnatac

SEQ ID NO: 1504 - DNA, 622 bp, Glycine max
tttatgcatcaacaaagaaagcggaaagagagcttaaatggaagtgagtgtcaattggctcttcctcctgaatatccgggatagatgataaaagcttaatattatgaaacaattattttataagacttgaaagttgaaacacatgttcttgataaattctggttttgtagtactttcatgcattttactttaaaaaattcttttattcacttcttttccaattttgttttttttttctctttctcaaaatttcatcttacgtggtagggcaaaatatggcattgatgagatgtgccgcgatcaatggaattgggctagcaaaaacccttatggctatggagatcaggaggattccaccgtttaactatatatatatatagtgttctctttgggttcttttccgaactcccccacaccgtagtccgtaggtcttgtgaatttagttttctcaaaagcttttctttagtccgtaggtcaaggtgacaagtacttgtattattatgattcatagttacatggtaaataagtagtggtttactgcactgtaatttaatttaaaggttctataggttccttcttacaggttattgattattagattcgaatactctcatgttccaca

SEQ ID NO: 1505 - DNA, 422 bp, Glycine max
  misc_feature (374)..(378): n is a, c, g, or t
tctgaaatccctcatgagcctaacccaaatcgagctcaacaatctgtccgtggccaaggatgttggcaaggcttttgggcttctggctgggctggcctcagacaaattcccgacttgggccattctcctcattgggtccctccaaggccttatcggctatggcgtccagtggctcgtcgtcagccagagaatccaacccctcccatactggcagatgtgcgtattcctctgcattggtggcaacagcactacctggatgaacaccgccgttctagtcacatgcatccgcaacttccgccgcaacagaggccccgtttccggcattctcaaaggctttgtcggtttgagcaccgccatattcaccgacctctgtnnnnncggcggaagttgcggatgcatgtgactagaacggcggtgttcat

SEQ ID NO: 1506 - DNA, 418 bp, Glycine max
aaaatcatacagaaactattaggttgctatgaaggcatttacagccttcaccagaaacgcaagcgactatctgaaccgggtagcccaggtgctgtcactgatgcatctttcagttgtgatagctcaaatgattcatggaccgtgtcatcatcagtctcactttcactggagccgctgttgaagaggagaaaatctcaggaccagcaaatgcgactgccttctgtcaattgtgtgtcaattgatgttcttaatagccctcgctaataatgaacttagtatttacttcaaatgtggtagctttctttcatataaatctggcagttatgttattgaaatgctactaaattatgttcttagttatagacatttctagccataatttgaaaattaatgaggcagagactgagatacccttctc

SEQ ID NO: 1507 - DNA, 340 bp, Glycine max
gcatataagaaaataatatgggacagctttttgctttgaatacattcacaattcacaaatgagtaaaaaaactcccaacgttcaccgggttcatattcatcgagaagcaagttttatggcccttttcataaccaaaaacaaaagctgattgtaatgtatctggaggctttggggtagaaaaataatttctttaaaaaagagaggtacttcagaatacctcatttgtgagtatgaatgatgatgatgatgatgtggttgttgttggttggagcaatgggtctatcatgtctcgaacctgggaccggtaatgctattgcaacaagcaaaccattacaccagg

SEQ ID NO: 1508 - DNA, 676 bp, Glycine max
agttgcgatggagcacccttggcctacaatttgattggtccaaggtaagatatgattcaccaattcaaatattttccggttctgttttttctccaaaacaattaaattttagttatgggcttatttttgtgttaggaaattggaataactttgtgtctactctactgaagtacattagtgcatttatgctatggggaccttgtagctagttattgatccttatcgcacataatctattgcttagcatccatctgattgtattttgttgttgtgtgaatgagatataagacaattgctttaagaactagccaagtgctccagactgtgcctcaatgtccttggaggactacattcatcttaatcaataaatttctgtgattgaagattcttattataaggttgcttaacatatatcttaaacttttctagctagtagaaattctctttgctctgttacaaagatgtcaaactaaacctttttgtgctaaggttattatggctgcatcacttacatgtgcaccattgggtctttattgggggttataatttaattctagcttctaaaaaaaatgcttacctattgggcattcacagaaaccactcaattattatgtttttgtgcagcggaattatgatgtatctctcccacataacaaaaatccctgaagcattatgt

SEQ ID NO: 1509 - DNA, 407 bp, Glycine max
tgctttgaaagcaccactccattttaaatattctgaattaggatagacacctcgctgttacctaacctatggttcatatgtaacttacattcttctatggtaaaagtgggtaaatgatgctagtaacgtgtgaaatcattaactggaactgaatatgatgtataatgatttgattcttaaaatgtgttagtgtaagcattgtgtgagggactgatagttgcacctagtatgcaagatatataatagaatttggattgatttgggagggatattataatgaaacctactacctagagagacatcttgcaacaacgtattgaggtataagcacagacatgaaaagtgattattaattgaaaatgcatatagttaccacattttaagttatcggcaggtaattaaatgtc

SEQ ID NO: 1510 - DNA, 506 bp, Glycine max
cctccaaaccaccagaagcagctccaggttctggcctcgttggattcccacttccaccgatcacatcatcgctgccgagaagcgccttctttccgtcgtcaagtaagtaatcaattctaaaccctaaacttcaaatttattcgcctcctatatttttggggattgattgttattaaaatggaaagttagcttttttatactctgtaacttttatgtgcgatggttatggattgttgtttgggtttggcaggactggttatgttcaagagcatgttaacattggctctggtcctcctggctccaaagtgaggtggttccgttcatccagcaacgagccgcggtttattaacaccgttacatttgacagtaaaccccattctccaacgcttgtcatgattcatggttatgctgcttcacaggggttcttttttcgcaattttgacgcgcttgcgtctcgatttagagtcattgctgttgatcaacttggatggggtggatcgagcaga

SEQ ID NO: 1511 - DNA, 534 bp, Glycine max
gctgatacccaaccgcgaccaaacgacgccgttccttcgaaggagcgcctcggcacacgatgctgtcactgcctctgccaaacattctggatccttttggttctcataatcaccatcgtcatgcttgcgattcttgtcctgtacatcatcatcacaccacgctccttcaggttcatcattttttttaatcggcaaatattaattattagttgtattgtaattttagcgataaactttgaacctattatatttctctaatcgttttttctttaattttttaattacaatcttataactttcatctaggttcaccctgattgacgcgaacctcacacaatttgattacaccgccaacaacagcactctctactacgacctcgttctcaacatcaccgcgcacaaccccaacaagaggctcaagatctactacgacgtcgttcgggcccacgcgctttaccggcgcgtggagttctccgccgccgacgtcaacatgccctggaacggctaccttcaggacaagaagggcacgaactt

SEQ ID NO: 1512 - DNA, 869 bp, Glycine max
ttgctcaagacgacaatcatagtactcaaatatctctagcaagagtagaaattaatacatagcaaagtaacaaactatcatgggtgtctactgttgcttaacttcaactttcttcttctgccacaagcgatctagggcactgtcagcatcaccctggaaatttaaaacacaaaaaacatgagctaagaaatgcaattcctaaaggtaattatcaaggtgcaccaatggaacatgtaggaatttccaggcagagaaaaagggaccagaatacaatagcgaacacaatttccaacataatataaaatgaaaagaaaaacatcaaaagtgtgcagtctacttggaatcatattaactgtattagttttctttccttcgtggaggatttccacagataataaccaaaagcattccttgttttcaatttgtttgttcttttcaatgatttatgtaggaactaaattaaattatcatttatacaaataataaacaatgccaaggtatttaaaatgacaagaaatacaaaaccaaagatcaaaacaggaaactctaacatccacagctcccatccgatccccaattccccaaatagagaacgagtaattaaatagaagagaaacacatgatcaaccagtacagtttgatactaattataacattttgcaatggctttaaacagtgttaataaatcgtgggtatagcaggtccaatagcaacacattacaaaccaaatcacttagtaaacgcaaacaacaaaaaagcaatgtagtgttttaatttatgcagattggttgataaaagccattaatgctcattttacgcaacaacaaaaattatcgaaaacaaagcattttttacattttatatttcta

SEQ ID NO: 1513 - DNA, 520 bp, Glycine max
tatcaacgttgaagttgttgctcatgttacacgacctgagctgcgtactagtgaggttagtctttactgacctgcattttagacaatacataaccattactcagttgctctttttctttttgcaacttcccaagttaattgaagatagtaatcagctttgtctgttctgttctttttatgtgagtacaggtatcaaatactttccacttctctttcactgtccgtccagaagccaaggcgatgaaaaatggatttaaacttcgcaatgtagtaccagcaacagaggaagaagcacgacgtatattagagcgcatagatgctgacaacttgaatgaattcttcagagcataagaagaaaaacatcaattagctgataaagtatttaaaatatccaccgctaattatgtgagcagaagttcaaagatgattaactctcttatataataaatttttctgcccaattttaagagggaactagtatgccttatatgtctagcatcattggacttgatagaaggca

SEQ ID NO: 1514 - DNA, 580 bp, Glycine max
tgcttctagaggtagtgtgtcttttcttagtaggaaagttttaacgcaacatattgaaaaataaatacatttttttgttgcaatattccttttatagtatttataaatcaccaatttaccacaactaagcacatgatcaacagctattaaaaaactaatagtagtttctgttggtgtcagattggttttaatgaaggtgttcctataacagaggaattttttattgagactgttgctggcaaacacaatgatgatatagcctcggttctctttcctggtgatctggaacgaggtttaaagtttgttgatgataaggaagccatgttccggaggtaaacaatgcttactttctttcactttctatctctccacccttcccccatgtggtcaatttgaagcttcatccatttccctgatcgtccagattggccgcagagcaagtgaagcctttgaatggccttgataaagtgaggaaatggattgaaaatcatgggctgaagagagctgcagttaccaatgctccaagggcaaatgcagaactcatgatctcaatacttggtctctcagatttctttgatgc

SEQ ID NO: 1515 - DNA, 631 bp, Glycine max
cttgcgtcacctccctgaatcaaacatctcagagatccctgatctcattgatgagtacaggttacaataaaacaaaacatttataataacattacacaatattgcatgtggatgacatgaagtattttacaaatacaagttagcacaaagtcccaaaaaacagatacagaatttgcaccttgattttgacttgacataatggatacaagaacaagtccttaagattgaacattatttcttacaagcagctgtatatatctcttttacaagattctaagatgaggtaatggtgcaggaaggtgatgaaggattttgctttgaggttagagaaactagcagagcagctgctggacttgttgtgtgagaatcttggcctagagaaagggtacctcaagaaggctttctatggatcaagaggaccaacttttggcaccaaggttgccaactaccctccatgccccaacccagagctggtgaagggtcttcgtccccacaccgatgccggtggaattatccttctcttccaggatgacaaggtcagtggactgcagcttctcaaagatggccagtgggttgatgtgcctcctatgcgccactccattgttgttaacattggtgatcagcttgaggt

SEQ ID NO: 1516 - DNA, 265 bp, Glycine max
acctcatatctttcttcctcttgcacttcaactcttggtcacttgcgggaagactgctcctcctggttttgtttgtccacctctgtattaaaccactgcatgcactacttcatagtacccaatacttaatattatcaaggctatatatagttttagttagttactacttactactagattaatatgtctttatctcttctattagggtttatgtaatgactcttatttcgttatatgtgtatgggtttacgctttgataatactt

SEQ ID NO: 1517 - DNA, 400 bp, Glycine max
acttttctcctctccggcaccatttttgttagtgcaatatcactaggcaagtgtcattaggatttaattgaggaggactaatttgtttatgcctaaagggtaacatgtttgcaatgcttgattaagattgcctaaaaaatttccttgtttttattgcaggtggtgtgggcatatcaaacatgatccaaaaaattgcaaataaagagtacatggggtttgaaaacctttgtacctactcagcctagatattagaattcggattacagattcaatttcaaggactatataattggcatttttttcagttcgaattgtttttttatcaagtcagaattttaagcagtgttatgtcaataattttaagtgatgaaaattaattcagcgcttagtttttttttgt

SEQ ID NO: 1518 - DNA, 562 bp, Glycine max
gtgtcattgttttgtattacatctgtttttgacgagtttctttgattttatatactatataatgcaggcggtgaagaagcttggtttgtggggtctctttacgcgtggtctccccctccgaattgttatgattggaactcttactggagcccaatggggaatatatgatgcattcaaagtcttcgtcggattgtaagtttacacaattgctagtcaatgatagggttccattctttcattccttcatcatggacgtgctaatgagattttttcccccttcccaggccaaccactggtggtcctgctcctgcagctgctccagctcctggttctgagctagcaaaggcatagaatgtccaatgatgacaagcaacaatgttgtacgaaacttagaaagccagtgaatagggaccataaataaatagaggactgctgaatgaagttgcttgagtggaactcaagcttggttggataatattcttttaaagttcagacattgtttccatttttcttatatttaagtattttgaatttttgggaggatggttttgctctcatcctt

SEQ ID NO: 1519 - DNA, 317 bp, Glycine max
cccagcatctgaagagaattctcatcagcaatgggataagcaccaagacccatcaaagtactagcaacaggaacaccagtgagctcgacaaaacgccgcaattcttcactagaattcaaacaaccaccaccaacatacaaaacaggtttcttagattccataaccaacctcacaataagctccaaatgattctcattgggagacttaggcaacctagacatgtaaccaggtaacctaattggttgatcccaattaggaatcgcaaactgttgctgaatatctttgggtatatcaattaacacagggccaggtctaca

SEQ ID NO: 1520 - DNA, 397 bp, Glycine max
tatggaatcatcatgcatcaatatcatcactagagaatagagatataaagagagagaaagtgtgagagaaagagagaaagagagaaagagagaaagtgtgagagaaagagagaaagtggagtcttttgactgagcctagcctgcaaaagccgtctaaggttgttgtctggttgatgataatgtttctttttaatgtctgaatacgcgttgaactttcaaacgtaccaccaccacactatttttttagttagccttctgatccattttcacccttaaccttaatcccaattcaaaggtccacttagtctttttccttttatttttttaaatgatggtttataaattgcattagtctccgagtgtttttattgcttgaatttcctctcctttatggagc

SEQ ID NO: 1521 - DNA, 499 bp, Glycine max
acgatgtttgcaatcacttccaaaattgccatcacgcagagcacatcatttagaagacgtgtcttgccatgtgctgccaagagcaaccccatgattcttaatgatttgaactgcctgtaggagaatatcttgttctgcggagtataattcatctttgcgctgtaaatagcagaaaaacaagataaacatgagatataaaaagtcgtacatgcaaatatggcaaaaattaaggtgtatcacagtattaaaggattgtctaacacagggattcagatgggcgaggtaccatatgtttgaggttgtatccaagagtcaattctgcatatgaactttctatacgggataagaaacagtagggaacatctttccctaagaaaacctttgcatttgatctgagcatgcttttcacatcatctgatatcgggggaatcttacttaaatcctcagtttgcagtggaattttggtaataatggcaagatattcagcacgggacttgtt

SEQ ID NO: 1522 - DNA, 380 bp, Glycine max
tctctctccttcttcttctttgcaatcaagaatcagtagttctgattctttcacgtgctcatcatcatcaggtgaatcctcatcagccccgtttccaagaaagcttttcacatcagcagtaaactcagcaaggtccgtatctgatggaagaaactcggaagaaaagttttccaagtccaaggcttcttcaccagcagctacaacctcgtccttcacttcattgtatatgctacaaagctcagcatcaaacaccggcacgcgacacagtagttgctcctcagtctcatcattaagcaatggctcttcacttccaagctcaggcacaaggggaagaagactaatagtgttattgaaaaacacttcttcctctcctcgttctt

SEQ ID NO: 1523 - DNA, 511 bp, Glycine max
atggtttcatgagcaggataagatgttgggaattacaggacaaaatgagttatggatttttttttgttttttcgtaggatgacataaaagactatctgacatcaaagggagtagagtgggaagaaagtgctgatttgttggaagttgcttctaagtgcgatgtggtttatcaaactcgcattcagaaagaaagatttagagagaaaattgaactttatgaggaggcaagaggcaagtatattgtaaatcaagatgttctagatgcgatgcaaaaacatgctgtggttatgcacccacttccaagacttgacgaggtaagcacatattgccatgtcatgtgatatatgttctcccgatacgaatgcaagcattaagattaaataaactaaattggccccttaacttcatgcagatcacagtggaagttgatagagatccaagagctgcttactttaggcaggcaaagaatggtctatatattaggatggctctcttaaaggtattgcttctg

SEQ ID NO: 1524 - DNA, 380 bp, Glycine max
aagccaaggtccagggttattagttctataagaaaagaagttacagtgttcactgatattgggttcccattgacgtttgaaactgtagtccaagccacaggaaacttcaatgcaggtaactgtattgggaatggaggttttggcacaacatacaaggcagagatatcaccaggaatcctggtggcagtcaaacgacttgcagttggacgtttccaaggtgtccaacaattccatgctgagatcaagacccttgggaggcttcatcatccaaatcttgtcactctgattggttatcatgcttgtgaaacagagatgtttctcatatacaattttttatcaggtggtaatctcgaaaagtttatccaggagaggtccacaaa

SEQ ID NO: 1525 - DNA, 708 bp, Glycine max
tctaaagacagttttcttgtgaatttctgtttctgctaccattctgtgctttactcttctgctgctatcattcatttacaaaggtcagctatcatggattgatatacttgtccaatctctttgctttaagctaatacagctttatataagtctcataacattgtattttctgcagaatcaagggtacttcagtacactttgcagaagctcactatgtgatcaagtcagacacctttattataggattagatcaaatggaccacttgcatataatagtatttcgacatcaacaaccaattcagtccatcaggttggttttctattctgtgttctagttgaggatttggatcctgccatgcaatgacctcacatgatggaatcatttgatgaaagacaagcacactgccctacatgggtggcttccccaaatccctgacactgagtcccacattctttcctgcacaggaagttatgtctatatgactatctatcatcaaatgacctggtcatgttatggcttcaaactagagaatgcatatcctctagttggatgcacttaatgcttagatttatgtattttcaacatactaatttttgtttctatggtgtctagcagctcttaaatggtgctcagaacaaggctcctgcatatttgggtggcatttctgtctgtgtctgttttgtggttgcagtggtgtctctgggact

SEQ ID NO: 1526 - DNA, 381 bp, Glycine max
gtttctggtattttctggtaaaactcaaggtgtctggctcaactttaacagaagcacctttaaaagatgaaaccacaacatggtacttggaaactggaagaccaacattggtggcagttctgtgaacagtcaaaactgaagtggaatttttcagtggaaaaactacagatatggctggatagttcaagtcccctggacttgaaagagagtgcttgcaagttctgtttgaatacttggcaaaaactccaagctcagatgtagtaagcttctgtgtgcacaggaattcaaagtagtcctgtggctgaatatcatagaccaaacctgggtcaagagctcttctagggttgatgtgtccggcaccatgatcataaggagttgaga

SEQ ID NO: 1527 - DNA, 387 bp, Glycine max
agttgcatggtacaccaagtacctgaacaaccctctaggaagggctgcttctcttctcatcacactcacaatagggtggcctttgtatttagccttcaatgtctctggcagaccctatgatggttttgctagccactaccacccttatgctcccatatattcaaatcgtgagaggcttttgatctatgtctctgatgttgctttgttttctgtgacttacttgctctaccgtgttgcaactatgaaagggttggtttggctgctatgtgtttatggggtgccattgctcattgtgaacggttttcttgtgaccatcacatatctgcagcacacacactatgccttgcctcactatgattcatcagacaaacacttcatcacggtcaa

SEQ ID NO: 1528 - DNA, 371 bp, Glycine max
tctcttgttaaattcacacatactagtattttcatcatcatcacttccctgtcagtctctgccttccattccctgtcgtattcttccccaatcaagctctctactctttactacccatttcccttcctttaaagtaactcgaaacggttttcctttcccatatgcctgacgccaaaagattcctccatagtatactccaaatccaaatcagcctcgatcagcctcacaacaacaacataggattatactaactattttcttgatggctcaagacatcctcagaatcatacccactctcctctctgcagcttcaatcgccgtcatggtcaccaacaaccaaaccgttctcatcttcgctatccgcttccaag

SEQ ID NO: 1529 - DNA, 369 bp, Glycine max
ttttccttgcagcattcttgaacggcatgcacaatctcgtgacgagaagtataggctacgcaaatcaaaagaactctctggttgttgtgagcagtaactctcattgctttttccacagaagccctgacaggctcagtcaatagttgcaagtctccaatgaaatgtaatctaacaccgtattcattgataagactttcttgtagaagtaactcttcaatcttttcccgcatcaattccatcaaggactgaacctcgttaggcttccttttgaagttatcaatgctgaatgcatagacagtgacatacttcactcccaattcataacagtatctaaggatggacatgagagcagtaaatccagccttatgg

SEQ ID NO: 1530 - DNA, 339 bp, Glycine max
tctaggttttgtggatatagcacttattccattcgacacttggttcaagacttttggcagcctcaacatagagagtgagtgccccaagtttgttgcttgggccaagaggtgcctgcagaaagacagtgttgccaagtctcttcctgatcaacacaaggtctatgagttcattatggacataagaaagaagttcgacattgagtaggttcatgttggattttaatagccatagtgacgtattgatcattcttggcctttcaactaaatagtatttgtgtagtaaattaaaggcacttggatgtaccaaacttcatgctttttgtaggagtgcgtaggttt

SEQ ID NO: 1531 - DNA, 553 bp, Glycine max
gagatggtcgtggcgtccaactcgtcgttccttttgccggcaaatgcatccagggctgagaggtgcgtgcgtcacttggcattgctgcgctacatgacttgaattaaataatttggattgtgttttgtaggtttgggaatgtacagaaatggtgggagcaatgaattgaatgtttctgcctgggatgataagccctttgaaatgcttccgagcggtaacaaggcttacttggatgagcaggatgtggtgacgtttcttgatcctcctaaggacttaatccctttcgacccatcttcctataatcccgctgcatacctatggtatcactatctattatgcttcctacaactctttcaatgcaatgccacttcactcactctccttcttcaggaaaaaaattgaagatattcctcaggaaaggcgacatcgacttctccgattgttgaaacctaggtatttttatttttcctttctcttttttctaattcttccgcattcatcttatcgaacactcacgctgccaatttttgtgcagacttgtatcaattgcttg

SEQ ID NO: 1532 - DNA, 629 bp, Glycine max
tgagttttctcacttggggtttagatccatctgctggatttcctgcaagataattaaaccaatgcataactaagcttaatcaagagatgctttcaaggtaaaattgggcagcactttaccattatttccagtggcttgctgagctgcatcgtttcccacttgatcattaccatttccggcagcttgctgcgctgtatcattcccctcttgataattagcatctctattattatcattttcattgccaccacctgcaccatcattgtggttttgttcttgaaactcagacagatcaatctcactggattccacactgcaggaaaaagtaaaataaattatcaccaaaaactatgtcccaaaataaaaactaaaaaagatcagcaagaaatatctttgtaccttattatggaagttttcagcagttttactgctagacgaacatgacgaggttgtacctgataccaaatgttttttagatcaaataaagaaaatatacaatcaatgcatataataagcctctgaaacttaaagcacctcattgtccaaatgacaccgtgcaatggcctctgacagtctgattaatgcctccaactgcctaactgtcatacggtatgcaaccctactcccag

SEQ ID NO: 1533 - DNA, 372 bp, Glycine max
tggaggcgcagcaacaagtggtgtcaggaatgaagtactacttgaagatctcagctactcataaaggggttcacaaaatgttcacctctgttgtggtggtcaagccatggcttcattccaagcaactccttcattttgcgcctgcagcaccatccagtaaagatttttgagatgcatgcatgctagctatttggagctaattaattatataataattaataaccatggcggtatttgtaattgcaagtgagctttttgattttcttctactaatgttttcctctactttttgtaatgggtatatctgtgggcagaacaacaaaaatcaactacgagttgaaatcttacttaccagccatatgtaccaaagaa

SEQ ID NO: 1534 - DNA, 1211 bp, Glycine max
  misc_feature (1119)..(1121): n is a, c, g, or t
  misc_feature (1155)..(1165): n is a, c, g, or t
tttgttcccatacctttgtcaacttctcattttaagtccctatacctaaaaactcattattttagtccctatacgagtgatttcttttacattttagtccttatgcctctattttgtggtggttttacactaccaaaaaattaacacacaaactaaaacaaacaaaaattgcttgtatagggactagaaagtagcaaaaagttggtgtaagtataaggatcaaatgattaattaaacctgtatgatttattttttttagttatttggtgatgtgggacactatttgtcacattattgtactgaaatttgaacgtactcatcataaacagatatttcaagtggcaccttctcttcacatggtagaggtacggaaggcaaaaggagatacattggagttccataaggtgtccttctatccccttctttgcttaattgctttactgcttgccacttcaaaaataactgttctattgtcaattctaacaacaattaaagaagcttattatatcagcagttggatgggaatcagagcatcaacgtttttcattttgtcgatattgacttttttttaccaataatttgtttctgcctagctggctagcttatacttcctatttgtttggtacacaattacatatttaaataaggaaaaaaaacttgaatcaagtttcttatatgttatatccttatcaatcatcatcaagttcttaaattaaacaatgacacattgaattttttccaatgattgatagcctacatgaaaatatgtggctgaattaggaaaagtaaagtaccaacatgtcattgtttgacttgagagcttgatgacaaagatataagaaactactaagttttgtcctttttataactctttaacttctgtgataggaatttatgtcctcttgttcttgaataattggagagaatctaattgaaattgtttgcttcactctctgcagttctacaagaaactttcaacaagcctggatgatgttgtttggaaaacagaagatgatatgcaaatgcgagaaacaaagtgatgtggatattattatcattgtctattaagtgtaattttcttcgtgtctgaggttttactattttccaatttcttcattnnntatattcctcccccgtaggtttgtttggacattnnnnnnnnnnnactcatttattgcataccatgctattatttttgaaagcatgcagag

SEQ ID NO: 1535 - DNA, 404 bp, Glycine max
tctttctcaaccaatttgtactcgtcattattattattataaatcaatagaaagacaggaaccaaaactaattaaaaaccacattcacattattcctccgaagatgacagtgacgagtggagaagaagaaggcgccgttggaggagttcagatccaacacaggagcagaatggtgctcccagattttctccagagcgtgaatctcaagtacgtgaaattaggttaccactacttgatctccaacctcgtaaccttattccttgtccctcttatcctcgtcacgctcattcaggtttttcagaccaccgacatcgaccacctccgccacctctggctccacctccagtacaacctcctcaccatcctcacctgctccgccgtcctcgtcttcggcctcactctct

SEQ ID NO: 1536 - DNA, 591 bp, Glycine max
  misc_feature (45)..(45): n is a, c, g, or t
ctctcgtactcttgctcctgtaacacatcaacttgccaacttacnaacaaataataatgtacacagggtaaacaacttaataatcgtgaaaaaacatacattaactacgtgatgcaattcactgatcaaataaataagcatcatatatgaggagcttaattaaatacttttaataacgaaaatctttattatgcgaattattgaagtgaagtttcaatttgaatcagagaacaaggtcaaaggtatttattaaagagttgcatcaaaattttgtgagtatttatgaaacctaaattaccgtgagagtgcgtgcacggagtctagccacagccttgatagcagcaaggaggtggtcctcctccacgatcctcttttgcctccaaaacttggcgatttctcggtttgtgacactctcttctgctcttggtcttgagaagaccctgaattttggaagtggaggaggtggtggtggtggtggtggtgctagtgaccttggaaccacttcttgcttcattattgtgactctgatgaaactcgatctgagctttattcacttattgtgaccagcgtcttcagtttgatctgtatatc

SEQ ID NO: 1537 - DNA, 530 bp, Glycine max
  misc_feature (420)..(420): n is a, c, g, or t
gtcttgagcagctatctttcaaagcttgaaacaggccttgataaagtgcgattggttttgcaatatgaaaagccagatatgcaaggcaatttctttaactccacaaagctatttctgaaatatgctgaagatgaaattgtaaggattaaagcagatgagagaaaagccttgtaccttgtaaaagaagttacagagtactttcatgggaatgcaacaaaggaagaagcccaccctctcagaattttcatgattgtaagagactttctgaatatcttggatctagtgtgcaaagaagtggaaaagatgcacgatagaatcgttggtggttctggcagatccttccgaatacctccaaatgcatcattacctgttctcaacagatacaatcatccaaagcaggatagaagcacaatagcctcntctgattttctcttctgcagacactgaggaaattgttgatgcttaaacttgcttttacactacctagacatatagcttgtcttttcttttcgttcggcctgaacacaaca

SEQ ID NO: 1538 - DNA, 726 bp, Glycine max
tcaccgggaggaaacatagaagaaacagactgtaagagattcaatgacacaaagtaacatgcaatacaggaaagttatccctctaactaaaacaaatatggaaaagaggaacttgacaacataacaacgattgtaggacaacaaagaaccaattgcaaacctggagtcctgaagtatcacaaggaggataaactcgcttaatacggtcaggaaatctccaaagattttcaatatgggatttagtccaagatgaattgaccatagctaggtgtgcacaagatcctacaaatccatacaagcagctgaatactgtataatagactattttgcaccttgaaagccaaacactgcaagaaaataactgttagactccttaaaatatgaaagaggtaaaataaagtgtgaatttagtgtatattatagcatagaagcgtgtatgcagtgaaggggaaggggaagtatggagaaggtgaattttcatatataaagacttcaactttaccaaattccataccaaaatactatttaaaaaatcaattcccttctataccctcaccctcaaaacaatttggataggctataatattcaaatcaatgaaatactgaaaagaaagaaccaataacatcattaacaagtgaggaatacttgtgaagtatgactaaactagaagtgacaaaagttagaaatgaaacctttttgtaattaaggcatcgttattatacatg

SEQ ID NO: 1539 - DNA, 364 bp, Glycine max
tgctgaggatttgcagttgcagatggggacgacgttaatattgaacaacagcagagtgtgatggccacgaatgatgatgaagttcaagagcctctccagcaggaggaggttcaagacttgcatgatttgcttttgagtattgcgaatgagcctttgatgtctcctccaccctgtgcaagagatggtagggactggaatgacgtggacatatttgatgatgatgaaatctcactatggaacttctcaatttgacgcgtacgtcattaagagtatgactgtatgcatgtttgatgataagcgaaaacacctttttgtgtgtatgcgattttctatatttttagggacctgttgtgtgtagataaat

SEQ ID NO: 1540 - DNA, 438 bp, Glycine max
  misc_feature (393)..(397): n is a, c, g, or t
  misc_feature (401)..(405): n is a, c, g, or t
  misc_feature (427)..(428): n is a, c, g, or t
  misc_feature (430)..(430): n is a, c, g, or t
catacctctccaaggcctcccaattggggtaggaggattcgtttggctttgcaaaccgcaaaagccattgacactcttcactcctcaacccctcccgtgattcaccgtgacatcaaatctgccaatgttctcatcgaccgcagctacaatgcaaggttaggtgattttggtttggccttaagaggccatgttgatgattacagactcaggtccactcctcctgctggcaccatgggatatcttgatccttgttatgtcactcctgataatttaagcaccaaaactgatgtttttagttttgggatattgctgttggagattataagtggaaggaaggccattgatatcacttattcacctccttctattgtggattgggctattcctcatatnnnnntctnnnnnagcaatatgccaaaactaaaannancagttttg

SEQ ID NO: 1541 - DNA, 335 bp, Glycine max
aaccgattggccagagtacaggttgccatcattcttaagacctaattaccccgcaattcctgcaaattattaccgctacactccccctgccaaaacaaccacaaccacagcttccaagccttgatatgagcacgatgtgcatgcaacttggtatatacattattgttatgattgttagcatttcaaataagaggttcatcaatatggccttgctcaagccttctcgatcaccaagtttaattattactttatggtttaattttagttttattccttagattattaattgggtggattcaatttgcgagatccttgttgatcccgtgatgtttctc

SEQ ID NO: 1542 - DNA, 535 bp, Glycine max
tcccgtagattgcacccattaggcccattagggttttatactttgtattatatgtgaaaacccctctctggagtttagctccagtgtctccgtctcttcctcctctctccgcatagctgcgttttccgaatcgaaaggtatgatctctgcccaaagggaaactcttcgtattttatatgtttcgttcaaaacaaaccgaatcttagtattttttatgtacacaggtgacgttagtaagtaacaatggtggagaaggccaagggtaggaaggaggaggttgtcactcgagagtacaccatcaacctccacaaacgcttgcatggctggtaatcctccacaacccttctttcaaacctatttagggttctgactctttattattcatattttatatctgtaattttattattgagataccttactggattttgtatgcataaacagcacatttaagaagaaggctcctaaagcaattaaggagataaggaagtttgctcagaaagcgatggggacgaatgatgtaagagtggatgtg

SEQ ID NO: 1543 - DNA, 722 bp, Glycine max
ttccaattccattcattcgttcattcccaggtacgtttttctcgcccagatctcattcccactcctcaatccaaaacttctcattccagatctgtgtaaacgctattctcttccatttccatttctcaattgtctttctgtattccattatcgatgttgcaattttcattcaaaattacactctcattaactaattttagaacatgtatgcaagttgttttcagctctttctgtgttgtatgctatggcatcttaattggttcgattgaataatctgttaggtctaccctagcaaaacaaaccttatactttcttatttccttggtcctttttgtagctttcagataggtttctgtgtgttaatcgaatagacctgaattatttattgtatcacaggttgtgatggcagcagcaccagcagctaccttcgctattggaaccaccggttccctcggccaaagaggaagctcgcttcctcaatcaaagtcctttgggttgaaattcaactctctgaatcatttgaagagcttctgtggcctcaaggccatgtcatccgtgagatgtgagtcggaatcctccttcttcggtaacaaaaccggtgctgctctacgggcgtcttttgcatccaaagctcaaaaggaaaacaaccacaactcgcagcctcaggcttcgtacaaagttgcggttcttggtgctgctggagggataggtcagccgctctc

SEQ ID NO: 1544 - DNA, 387 bp, Glycine max
aaaacccactcactattttgggttcaagctggatttgatcttagcaagcaagaaagaagctgtcttgatggcgaatcgttggtgggccgggagcgcgacggtgaagcccagtgaacaagacaacggtgacaacaacggtactcccaccaacagtgggaacagtaacaccaaagttaacgcggttctcgaggacgacgcaaacaccaacgagcgcgacggcgaagagcagaccctcagcggcgggcggcggccgcgtggcaggccgccagggtcaaagaacaagccaaagccgccggtggtgataacgaaagagagccccaacgcgctctgcagccacatccttgagatcagcgacggcagcgacgtggctgagtgcattgctatctt

SEQ ID NO: 1545 - DNA, 328 bp, Glycine max
gccccggcaccaataattttcccaacaaagccttctaattcgcctgctttggagaccatcacagaagaagttgctgaggatgatgaagcttccatgaatacccttctcaagtagtagcaaatgttgcaagatcaattatgaagcctcttttgaagaggcttcagcttatgaagattgaagaggatcaatcaagttgtggaaataatcactagttgttattcgctacaactttgtatagtcaattttgtgaaatatgtagttctctttttccttctttttggatgattttaatctatacatccctgcctttgtttaggctggagttggt

SEQ ID NO: 1546 - DNA, 324 bp, Glycine max
ggcataagatcctagattgctactatggattgtgctaataaaagtgggtaacatattttactgtctatacaaaattgtataccaaatgacgtccttgatgagttatacaagctccttgttcaaatctcagtgcttcgccttagtcatgaagaaggtgcagtttattttacaagtcttaaacatgtacccgatctttgatattagccttgttaggcttgaatttctctcaaattatggtgcactgacacattaaggtgtagtccattctctcgtgaaggacaaaagtatcatttgtgtaatcaatctctctcatgtttccttgat

SEQ ID NO: 1547 - DNA, 905 bp, Glycine max
  misc_feature (60)..(60): n is a, c, g, or t
cttactctctggacttccgatttaccagaggatggaggtatgagaatgattgaaacttgntattagatgcatttgagttttgcatagggaaagcaataaatattgcaccgtatgttgctgaataatgatgtcttagaggcagaagtgattgatgtacactttgtacaatatcattgcaactgttatcttccactcacttagtccccctcaaccttgtgaaacaatcaaattaagatgaatagaaaatgaaaaaaaaataaaaattgcatgctcttggattgtttatcatgaagatcaatgtcattgtttcaagagtggtgtcttcaactgagtcactcctaattaactgcataattatgtttcttgttattatttggtttataaactaaagtgatgctctcgtgcaggtgaggacaacataaaagctgaagaagccaaaccttctgagcctgaggtgtgtgcattataagttttggcttatgcttacatgattttctcgagaaatttgtgcaaagacattatattatagttgttaacttttaatacttaagaatgtgtaatgtagaaaataagtaaattcttgtatatgtaagaatgacttagggtctgtttggtttgaatttttttttttctcatttgttggtttttcaattaattacaaaaaacatcaccttttttttcacttaaggtttcaaagatttgtgtaagaataattttttctttaacgattgtttataataaacaaggtttcttatattgacattctactacttttgcagcattgatgtgattcagtagtcagaaatctaaggtactccccaagagggcatttttcagcttttcttgcaatggatttggaccggacaatagggactgtggtggccatttcataattcttgttctct

SEQ ID NO: 1548 - DNA, 371 bp, Glycine max
tcttgatgatgaccttggtgaatcatcagagtctgatgatgaaaatgaacatgatgacttgccgccatttaaacctttaactaaggcccaggtggaagagctgtctaaagctcataagaaagcatattttgatgagttggagtatagagagaagcttttgatgaagaagcaattgaaggaagagaaaaagcgacggaaaatgttgaagaaaagggcagaatcagcaaaagatctgccaagtgaccatagtgaaaatgtggaagaagaaagtggcggtgcagcttctgttcctgttcccatgccagatttggccctgcctgcttcttttgattctgataaccccactcaccggtatcgttatcttgaaaaaa

SEQ ID NO: 1549 - DNA, 450 bp, Glycine max
  misc_feature (441)..(446): n is a, c, g, or t
tttttggtcttgatgtggaagaggactaaaagagagccacccaatgcagaaatgctttcacaaaacagagtatggggagggtagatatatcatgtattcagctttatccctccctgcgttggagaagttgttaccaggatttgaatcctccacaagacggatgtggagactgattccgaattttggttttaatgtcatcaaaacagacggattacttgaaagtcatacttccatgtattagaggagtttaggtgaaagaatagagttgagttgtttggttggctgggaaaagaacatgatgttcccaatgagtttttgtggaatgatgtaaaattttattcaaggattaatatgaaatatctgtgataaggtcaactcagcgtctatctgagtgtaggtttatgtttttcttttcttgtaccagcacgctatttgaaattnnnnnngata

SEQ ID NO: 1550 - DNA, 370 bp, Glycine max
acagatcattcttcagtttggcaaggttggcaaggatatatttactatggactatagatatcccctatctgcttttcaggcttttgccatttgcttgactagttttgacacaaaactggcttgtgaatagtgacaatgagaggtatggtacaaagacaatagcattctatctccatttatgtattcactgcgaggtgaagctgcatggagtcattttacaccaaatggtttaactgtaaaggacagaacaacctttgctcaatatgttttttcttatatccttttccttttatgttagtcttcaacaaactatctgtcaaacatgtgttgcttacccgcagtgtaattggcttcttccaatggtaggctc

SEQ ID NO: 1551 - DNA, 406 bp, Glycine max
ccctataggcttctcttccatggcaaattaccattcttctaaatccttgcatcttccatgcaaaaccttatctctagttctcctttttgtttacttgctacttattggttcttgtgatgcaataagaataggccaaactatgaagctgaatgaaagaagagagattctcaagagaaagcgcaataaccaacatggttttccatacaaaagcatggttttcaacttcttccccaaagggccggtgccaccttcaggtccttcaaagaggcataacgcagtggtggattcaacacctaataattgaagtacatgagaagtcctatttgttcaatttttccatttttttcttccttttttttcgtagaattttttggttttgtaatatttatgggagggttgcaaggat

SEQ ID NO: 1552 - DNA, 716 bp, Glycine max
  misc_feature (697)..(697): n is a, c, g, or t
  misc_feature (700)..(709): n is a, c, g, or t
  misc_feature (712)..(712): n is a, c, g, or t
gctggtctcaacccgtatagtatacgattggtcacagtatgcattattttacacacactgattttattttttcaataaaaaattaacccattgaaaaaaattatgtcacattagttgtttcagtaattaaggtactaaatttactttcttgggcaggaatggccattgaggagtaaacttgacccagaaatatatggtccaccagaatcagcaatcacctcagaaattatcaacaaagagattggaggcataatgtctgtagaaaaggtttatagttcttcttaatcaaatttgcctaaagtattaattcaatgatgtgacatgatttattatttgtgcacaaactcatttctttattggggatttagattataaattacaaatataatacaattctaacatgcaggcgattgaaaaaaagaagctgttcatgttagactaccatgacatacttttaccctacgtcaacaaagtacgcaaactcaaggggaaaacactgtatggttcacgaactttgttctttctaaactcagaggggacactgaggcctctagccattgagttgactcgaccgccgtcatcttcaaataatacgggccaatggaagcaagttttcacaccttcttggcactcaaccagtgtttggctctggaggtttgccaaggctcatgttcttgcacatgactctggatataanaannnnnnnnnnccntttt

SEQ ID NO: 1553 - DNA, 504 bp, Glycine max
  misc_feature (483)..(483): n is a, c, g, or t
tagttattacaaacatgcattgttagcgtctacctgtaacattaaggctgttatgtatcttgtgaaaaaagatacactcagttaaatatcttttaatattaagccttccttcaagtcaatgacatggtttttctcttcctttttattctcatcgcttcatcagggaaaataaaacaaagatactggaatttctccgtaactcatgggctaatgatcgaagaactgagtggtcaatatggatggtgtactccaaggttgatatgcctcaccagtacatgagtaatggagttgaggggacatcattgtaccgtagcttacgtgggagatcatcaagtacaaggagatctaacgatgatgtaactatccagtatacactatataatttccataaacttcataaattatctgctgagttttaaatttatcattttattgtcttcatataaattggggtaacaaattgttcaagtattttatgtctcntttttccttttcagcctgttc

SEQ ID NO: 1554 - DNA, 448 bp, Glycine max
gactttggagggatgtgcataataagttcttgaggagaatgtgaattcatatacgtattgatcacaattcgtgtataagaagggatgtgctagttccctatggtacaagagattcatgaactccaatctcaagaacttatggacgtgatgtgctagtccctatggtacaagagattcatccaacaatgggaggggcaatagaactagcaatctgttagtgagactaacccaaaaattcactagggaggagaaagaaaatgtgagaatcactggagaccaagtcaaagataagactcaatccaaaagattaagtgaacaagatcaagtcaatgtaaaatatctctcttgataagcaataagttaatcaattaattaaaggtatataccttttgaaatatcaatacaataaaatctctgttgctcttttctagcattccaatttcccaag

SEQ ID NO: 1555 - DNA, 486 bp, Glycine max
  misc_feature (399)..(402): n is a, c, g, or t
  misc_feature (410)..(411): n is a, c, g, or t
tctttctactagcattgcgaattccattgaactccttgatgcaagtgctgttttccctctgctcaacctccttaaggagtgcaagaagtattccaagtttgcagaaaaagccacagcactgcttgaaatcctttccaactccgaagaaggacgaacggcaatctcaattgcagatggtggaatcttaacactagtagagacagttgaagatggatcacttgtcagcacagaacatgctgttggaaccctgctatcattatgccgaagctgccgagataaataccgggaactgattctcaaagaaggagcaattccgggtctgttacgtctgacagtggagggcacagctgaagctcaagatagagcgcgtgtgcttctggatttgctcagagattctcnnnngaaaatgnntcataaataatgctattagaatcgtgcattgcatttttttctgagtcactccgacaacagcacaaaattgagatt

SEQ ID NO: 1556 - DNA, 440 bp, Glycine max
cgcttctcagagtttttgatatggaatctttgctcttgctttatcatcctctcaatcccacttgattgcatcttacgctgcatcaatcccaatgctgcttccaagttcccacctatgaccttcactcttatgcctctgcattgctgaagcttctgcatttgatgatggccattattgaagggttcaggcgtgaaacctgaatgtctgaataatcttgataaacgccttgcaactgagttcatatctaggggagatgaatgtgcttactactattccttttatgagcactagtaaaaagcaaaagagagagagagaaaaaaaaatctagttatattgctcttgaaatagtatcatgcataaaaatggagggtcaatcatagttttatgttttataaatttattggaactttcatatgaattagttttgggggatttggtaa

SEQ ID NO: 1557 - DNA, 357 bp, Glycine max
ttctccgcgactgcggcagcaccggcctcagcccgggcagccgccccgacggacggcatcgtcatgccagccacaggagcgccgtagcggtgcagacccatcttgagccgccagaggaccgtgaaatcgtgcctctcgaaactgttgaggtcgagaagctccgtggcgatgcgctcgatcttttgcccacgcgcctccgtggagagagcgcgcgttaggttaagaagcctcgtggcactccttgtggcacaccttgcggcacagtgagacattgttttttcacctttgttcacgactgtgattatagggtattataccatacacagttaacaaaaaccattagacgttagatctggg

SEQ ID NO: 1558 - DNA, 346 bp, Glycine max
  misc_feature (336)..(339): n is a, c, g, or t
tgaatttgaaatctcgttctggctaattccatgttcattgtttactatacctcaccactccaagggtctcataaatttcttctgcttccaactctgctgcagaaaaagaaactgttggttctagatacaagtgggtttccagagtagaagtgaggctattgggcatgagataaacagcaagcaccatcatctacgacccttttgactatattataaacaacacaaaaaatggagagtgacttgagctgggagcagaacacgctcataaatgagctaattcaggggatggaggtagcaaggaagttgaaggcagacttgaggatgccgtattcagtnnnntcaagag

SEQ ID NO: 1559 - DNA, 468 bp, Glycine max
tgttctagaagattcatacaatcagcttcgcatgagatcaactcaagatttgaagggaaggttgactgttcatttccaaggggaagaaggtatcgatgcaggtgggctaacaagggaatggtatcaattgttgtctagagttatttttgacaaaggagcactgctcttcactacagtaggcaatgaatcaacatttcagccaaaccctaactctgtttaccaaacagaacatctatcttatttcaaatttgttggtagagtggtgagttcttttacaagtgttcttaatgtatgatgttggtcatatatgctttgttcttatccctttctacattatccaggttggaaaagctttatttgatggtcagctcttggatgtccattttactcggtcattctacaagcacgtcctaagggccaaagttacgtatcatgatattgaagccattgatcctgactatttcagaa

SEQ ID NO: 1560 - DNA, 498 bp, Glycine max
ggtcgacctgttaacagacttgctcttgtcaagagaagtcattccccaattcaaatttacaggcttggaaattcaaataaaactttatcacgcaataataagtaatatgtaatttacaatgggaaaaggttgctaaagtagtgggaatatcagttgttacaaattaacttggaagttggaacaaaacttcagtcatgaaattaatttccgcatgatagtgctaatggacattgcgcgttatcagtccctcaaatatagtatagaggtccttgttttctggcccaaataactcattagctttctgtagtgtttcctgcaatttcacacacacacatacaagtggcaattaatagaaatttagatatattgggagggaagcatggaagagggaatgaggcagagatattacctctttagtttgtttatgagaattcagttccttaacatttgccaaaaatgcaccaaactgctcataagataaacgactcctaacttggc

SEQ ID NO: 1561 - DNA, 322 bp, Glycine max
gtaagaaatttttgtttccctttctattgctaagatctcgcattttaacgtagtgtagaattataatcctttggtgaaaatcatttattgcttgctcaaactcaacatccaattactctatccataatcgtagattagaaacaacaacacttataaattaaaagcgatctcatcttaaacctcacatcattcgatagctcggttacgatgatcccaacctgctgagcgcttcttgagccacattcgactgtggctccaactccaaagcctctttataagccttcttcgcttcttctcccattttgtttccttcgtagcactc

SEQ ID NO: 1562 - DNA, 454 bp, Glycine max
cagggtattacaaggcaattgaagctattggcaaagcatccacattttatacttgggtgttggtgtctggggtgttctaccatctttataaccaatcatcttaccaagcacttgatgaaattagcccattgactttctctgtggggaacacaatgaaaagagtggtggtgattgtgtcttcggttttggtgttcaggaatccggttcggcctcttaatggccttggatctgccattgcaattcttgggactttcctgtattctcaggcaacatccaaaaagaaagcaatgaaaattgaaggtgaaaagagtagttagagaaaaagaaggaaaaaagaagcattacacagagaaaaaattgtttgattatttgagtgctactcttagccttgttatcacatatacacaaagaaaaaataaagaaagaaatgaacgaacctaaaccaacggcctct

SEQ ID NO: 1563 - DNA, 391 bp, Glycine max
atctccgtcaccaccgacgaggacctcgagaacatgatcgacgagtatgaccgcaccgccgccgccgccacctccgccgtcaaaccctctcgcatccgcctcttcctcttccccaccaaacccgaatccactcactctatccctgcccaaattctcgacacgtcagccaaatcggacgattggtttttgaatgctttaaacggcgccggattgcttaaccgcgggttttcggactctgcctctgttaattgccttcttggacttgacgacgaggttgccgggaacaacctcgaacccggttcgaaggacggtgtggatggtggtgttggcggtggtggtgcttcgcagggtggatctttcgggaacgggaagaatttgaagcaggatgttc

SEQ ID NO: 1564 - DNA, 327 bp, Glycine max
  misc_feature (259)..(259): n is a, c, g, or t
  misc_feature (267)..(267): n is a, c, g, or t
  misc_feature (270)..(270): n is a, c, g, or t
  misc_feature (292)..(294): n is a, c, g, or t
  misc_feature (296)..(296): n is a, c, g, or t
  misc_feature (301)..(302): n is a, c, g, or t
  misc_feature (308)..(312): n is a, c, g, or t
  misc_feature (320)..(322): n is a, c, g, or t
gctctttgtcaagaaggtcgtgagctccgtcgcaggttacctcatcctggctttaatgctcaaccagtactggttatgattcccccaggagagcagaccatgggacgtgaggcttgaaaatttcatccttcatcttggaagtgctattcatgcgtatattactgttgccttgtctctatataatttgatgttgttgaaccgtgttatgactttatcaaaagagggtcctgtattttttattttatttttattatgagancatgaaanatnatcgtaatttctgtttgcttcnnntnctgtnntgtatnnnnnaatagatnnnaatga

SEQ ID NO: 1565 - DNA, 1043 bp, Glycine max
  misc_feature (791)..(791): n is a, c, g, or t
tgttgtttctgctgttcttacatcaagtaacatcaaagaatcagtggtaggttcaattctgttgttggatccattttctacttcctaaccttaaactttttttatggttgttgtaagactaggtcctttgtttctgtggctaacattttatgtcattatttgataaatggtcgtattttcgttttcaggcctttcaaatgccatcgtttctcagaagaaaggctgatccaaaaaatgttgtttccgtcatattgggagggggccctggaattcaactctttcctcttaccaaacgagctgccacacctgctgtgagtaaatcattgtctttttggagaatagaaagatgaacaaaacacatttttaaggtgcttttgatgtcgttctcctaccaaaattaaagttttaacttggtaatctatattgacctttaaagcaaattactgaggtgaaactctacttttgattgtaagcaacactaaaagcacctaaggacctgtatctaagttttgtcacgaaaagaaagacttgaagttttttggagttccatgttaagaaggtactgtattcgtttgcaggttcctgttggtggatgctacaggcttatagacatcccaatgagcaattgcatcaacagtggccttaacaaaatatttgtactgacccaattcaactctgcatccctcaaccgtcacattttccgcacctattttggaaacggaatcaactttggggatggatgtgtggaggtatggtatcacagaatgtgatcgatggtgattgttagaggncttaaataattcatacatcattctctggttgttattttgtgttaagataagatatatttgtggaacttataaaatgataaaatattcaaaaaaaaattgtattatattactactagagatacagttatggctgtgattggtagagaagtataagccacatgaatgattttactatattttgggaagagggggctccagggcaaggattgagagcaattactgttttcgtttattataatttaatatgataaa

SEQ ID NO: 1566 - DNA, 629 bp, Glycine max
aaggagataacaaactagctacacataatcaaaactattgttaatgcacttaccttcacacgacctggtgtgccaatgacaatatcaacacctctcctaagcttaatttcctgaccttgatacggagctccgccatataaacaacatgaactcaatcccattgccccaccataaacatcaaaatcagcatgcacctaatgcacaaaacactcctcattaaaaagaatgatacattcaccctgaaatccacaggtacaatactcatgcatagaagtacatacctgacaggccaattccctagtaggtagaagcacaagaacacttggagtcctcccgaagccagtctttcttgaagcttttgttggaccatttattaaagactctaatatgggcaacacaaatgccagagttttaccctacattttcaccaaaggaaacaattgagataaaaaaataaataaacaaaacccttcacaccactcaaaaaccattcacctaaataaatctaatcatgcacaattccaaataacaaaacaacaacaaagcttaacccccactaggtgaagttagttaaaaaccaaagctttaggaatattattaaagaattaaacaaaacaaaaaaagacaaa

SEQ ID NO: 1567 - DNA, 602 bp, Glycine max
ttctttgcttcccatttttacacttgcacttgctaaaagggataaaccaaattaaattactgtgccttgtttcaatccttcaggtttttatcaacgtcccatggtggtatcttgctttctataccatgatcaatcccttcttgactcagaggaccaaaagcaaatttgtctttgctggaccatccaagtcccccgatactcttttcaagttagtctactgctcaacaatcccattgccaacttctcttctctctcttcctttcattatgacctcaccttctatgttttttttcaaacattaaataggtatatttctcctgagcaagtgcccgttcagtatggtggcctcagtgtagatttctgtgactgcaaccccgatttcactatgtctgatcctgtcaccgaaattcctataaagcctaccactaagcaaactgtggaaattgctatttatgaggtgtgcttgcatctgcaactcttctttcaattacattacactagactccctcatgcccatcaaaattgaggcttgtgattttgcagaagtgcattattgtttgggagctgcgcgtggtgggctgggaggttagctacaatgctga

SEQ ID NO: 1568 - DNA, 584 bp, Glycine max
  misc_feature (564)..(564): n is a, c, g, or t
acttattgcacatagtagtgcagttgcaatgggggctcctttatcagcatggccttgggataactttggaacatacaaggtacagaaaaatctagctatgtcatgcatgttggtgcttatttctttgttatggtaattttactggtacagacatgggttatgttatgtgagtgattgttatttgtttttcaatggatatgtagtatctattatatggaccgtttgtggggaaagtcctttatgaatggttctatggtgaagagcagtcctactacaacctcagctggtgccttcatttgctcatactaagtggtctcagaggtctaattcatgtgctctggggttcctacagccacatgttctttctaaccagaaatcgacggattgttcaaaagggtgttgatttcaagcagattgacaaagaatgggactggtaaaaaattgctatgaatttgtttctctctctatctctctctttcaattatttgattaaaattacattatgttgaaaatggtttcatacctacattctaatatacttgtttttttccgacagggacaaanttcttgattcttcaagcact

SEQ ID NO: 1569 - DNA, 560 bp, Glycine max
  misc_feature (206)..(210): n is a, c, g, or t
  misc_feature (212)..(245): n is a, c, g, or t
  misc_feature (252)..(291): n is a, c, g, or t
  misc_feature (293)..(301): n is a, c, g, or t
  misc_feature (312)..(319): n is a, c, g, or t
  misc_feature (321)..(360): n is a, c, g, or t
  misc_feature (362)..(370): n is a, c, g, or t
  misc_feature (380)..(384): n is a, c, g, or t
  misc_feature (387)..(393): n is a, c, g, or t
  misc_feature (403)..(417): n is a, c, g, or t
  misc_feature (419)..(419): n is a, c, g, or t
  misc_feature (430)..(433): n is a, c, g, or t
  misc_feature (446)..(464): n is a, c, g, or t
  misc_feature (480)..(480): n is a, c, g, or t
  misc_feature (482)..(488): n is a, c, g, or t
  misc_feature (496)..(514): n is a, c, g, or t
  misc_feature (518)..(522): n is a, c, g, or t
  misc_feature (525)..(527): n is a, c, g, or t
  misc_feature (533)..(546): n is a, c, g, or t
  misc_feature (552)..(552): n is a, c, g, or t
  misc_feature (554)..(554): n is a, c, g, or t
ttaatgacacaaggtgttcataatttctctgtgcaaagcctttaggccgtgatgcaaccagaagttttttgtacgtttctttcccattaacaacaacactgctttctttagaattagaactcaagctcgagttagaattatccatcctatctcccatgtaaactgaaggcatgtcagcttctctagcaaatagccaaaaaaaaaannnnntnnnnnnnnnnnnnnnnnnnnnnnnnnnnnnnnnnaaaaaannnnnnnnnnnnnnnnnnnnnnnnnnnnnnnnnnnnnnnncnnnnnnnnnaaaaatttttnnnnnnnntnnnnnnnnnnnnnnnnnnnnnnnnnnnnnnnnnnnnnnnncnnnnnnnnnaaaaaaaacnnnnnaannnnnnnaaaattaaannnnnnnnnnnnnnncnaaaaaaaaaannnnttaaaaaaaaaannnnnnnnnnnnnnnnnnntaaaaaaaaaaaccanannnnnnnattgaaannnnnnnnnnnnnnnnnnnaatnnnnnaannncaaaannnnnnnnnnnnnnaattananaaaaaa

SEQ ID NO: 1570 - DNA, 1023 bp, Glycine max
gctgttagtgctggacttgtcttcaatgtcagcaaattcttggtgcaggtgctctatctttggagggtttcttgccttgagcatgcttctgtctagcactggagggattgagagtggcaagtctctggctgcttctccccaagagttcacaaattccattgcaccaattccatcaaacatgcagtggttcatgcacagcccaagtgcaaagcctccacatttgaacttggtcacctggaatatatatagagttgacactttcaaaactgcaatgatcaattcaaagtgaggggccatctcttcaatcattttcagtcttgtaggtaagaaggaattcattgtttatcataagtatagggaaaaaggataagtgattaagagatgatgtgatggtagagtactgatacagaaatagattattattattaatattgtcatacatttagcttctcttacatcttaatttcaccccaaaaattaagtgaaaaattttccctcagatatagtaagtcaagtacttgcaaaatggataaactggctattagcatgaaaagataaagttgtactcttttgataaacattcacaaaccaaaaccaatttttagtcagggatactagcacccccttcgtttcttttcttttcttttctatttttaattaatatcaccgcttcagtttacctcaacaaaaatgttttgctgctaaccttataagtggcattcaaaatagctgctagatgacatatttttaatttataaaaattcctacaaagaggttgataaatgctagataacatatctctagtctctagtcactacacttgtgaactgaagtatttgctttttaaacacctcagggttatgtatcacaaaacaaactcctcagcgaatttaaaaaacaagatacaagaaaaagtcataaaacttacctgagcaaccaaaggaggcatctgaagaatgtgttttgcttcaggaatgtcataaacaagcataccaagagtcccagggtcaggctttgtgatgt

SEQ ID NO: 1571 - DNA, 380 bp, Glycine max
gattcagcttaagcctgactaatccaaagtagcttaaaggtttgactagaggaagcttcataaatgccaacattattgtattggaaaacaagtttcagcgaattagaaatttatagtggtgtaagcttacaacttgaaggtttttattaattattacagctcagactactatccattacagtattgttttggtaccgttattgttgaaaatcaagcagtatacataattagtttcaaacttgactccataagtcccttctgcattgatatcgaaatcattacggaagaattgtattaatgtaatcgctacatattattaccacattgcggccatacttttttacttgtgaatactatcccctcggcaaatatgactgtaa

SEQ ID NO: 1572 - DNA, 420 bp, Glycine max
gcatacatgacatatattatagtaatgacacacaattatacatctttaaaagtattttttttatcacaaaattaaagaaggatgctaacatctcaaatattcagccatagagtgggtgttttggtggtggggtatatcctctaggagcggccattggatggggtatttccacgaacagggacggcggcgctgccgcattggaaaagttttcggcctgcagcgtataattaaaggtgaataaatgaaagaagaaaagaaaggatattattagagattgtaaaactaaccgagttgaagaataagactaggttgggcagcacttgcaagctcaggagagatgagtagtaaaagtattgcaaaaagagcagcaaatgagatccatttggccattgctaaaatgcaagtttgagaggatggaac

SEQ ID NO: 1573 - DNA, 659 bp, Glycine max
  misc_feature (40)..(44): n is a, c, g, or t
ccactatcatcacaacaacaaaattgtaagctaatgagtnnnnnaagatatattactcaaggtttggccttatatgaacaagaaaactagaaatgtaacaattaataatatttatactaaccataacatgtgttattatgatatatcatattatcatagtaatcataaaaaaaaatattatcagcatagataattactaaatttgcattcctcatactaataatttaatttccattaaaaagaaaatattagttaaacgacaaatcattagtaaatatttccactggtctttttttttataaaaaaaattaattttagtataacataaactaaaatttatttcttatccggcaataatattttattttaattattctagatactgtagcatgtgtgagaaagagaaagaggattactgggaaattttgccataagcccatgaagcaaaagacccagacttctgcgcggcagcatcaatggtcggtgcgggggcatcgacggtcggtgctgcggcatcaatgacggagttaaccgttggtgcggcagcgtcaacggcggtgtccttggcctgccctgctttggttttggcgtcatcaatgaaatcatggccccaggaagtgcccacgcacacggcaaggcacaccaccaacacaacaaac

SEQ ID NO: 1574 - DNA, 792 bp, Glycine max
gagctataagtcaccaccttctagtttcactactcgattggagaatctctacctcacgatctcttttttctcttagaaccatcatgtcacaatctgatcattcctctgcttttaccacacccagattagttctcaagaaggttttggccaaatctcaacatgaaggggatggagctgttgttagaagaggcattggaaggtattcttaatcttggattttactactatgcattaacttggtttggtgggcatttcctttccttcttgtattttaaaactcctcttatgggtggtaggtgtattcatggttctattgatttgatttttgtatcaggagcgagttgaagaacttggatcccttcctaatgttggatcacttctcaggtatgtacatacatacatacatacaattgtgtttgtgtgaaaccttattggttgaagcctactttggttgacctccctttgtcctgtttctgttccttacgtctttgactttgcagtatctcccccagcaggatttccggatcatccacaccgaggtttttaactcatattttcctcgttttgctgttggaaactttgtctattattattctgtttccttatattttgatttccttcttgttttcaggttttgaaaccgtcacctacatgctagaggtacacatggttacatttaaccttaaattaaattgtgcctgttgtcttcggccaaagcctatatatttatttatggattccagggaggcatcactcaccaagattttgctgggcacaagggtacaataagaa

SEQ ID NO: 1575 - DNA, 385 bp, Glycine max
gcgtttctgctgtgctagggtttctgcatcttccacctccgtcgcgatgaaaccaggcttcatctgattccgatttcccttcgctccttctcctccttaacattcatcttcttcgattcctctacaaattatgattattattatgatgaactccatcttcgcctcgcataaccttcgcgtcttcggtcccggcttgaatcccttcgcaccttattgcatcgccaatcactcccttttcctttccctttcctctcgctaaattacaattccctttctttttcctctccaacttctccttctccgtttctccgaacatgtaaattcggaggacaccgtctttgattcggtctatttttttgggggttactttacttcggttacgcgt

SEQ ID NO: 1576 - DNA, 385 bp, Glycine max
aaaagccctcttgcagcaatgaactcactgaacggggcttcaacattgagagtgctagtaaccacagtaacattcctatccgccattctagcagcaaaggatccagaccctccaccaatgtcgagccctattctaacccctccacctcccaaggccaagacatcgtcaaccagaaaatcattcttactcttagccttaacaaacctaacattctcattgccatgaaccaaatcaaagcaaccaacgcactccctactcaacttcttaccattcaaacactcaaaattcttacaattaaggccactccagttaacagtcttattaccaacaggcttccaaagagaatccggaaaggggtacaaacctaccttggaaacagtctttg

SEQ ID NO: 1577 - DNA, 395 bp, Glycine max
cattggtaaacttgttaaaagaagctgaagtggtcactttttccatatttgagtcattgctgaatttcttttctgggtccacacaagcaaaacgaattagcagctgggctttggtttcaaagctgatgcacaacaaaagggtagctacaggctacgcacaaggagcagatgagaatgagtttgcaaaagtggatgctgcattgcagttatttgcctttaacatgtcaaccaagtcaaatgatgatatcagtgatttgcaaaagaagctagagaacttggggacttgcatacaagatcttgaagaaggacttgagtcactgtttaggcgtttgattaaaatcagagttgcacttctcaacatccttaatcactagctgaagaatctaaactggaga

SEQ ID NO: 1578 - DNA, 351 bp, Glycine max
atggcacattacatggttggatccaagcataactaaccaagacagtcgattccaaatcctaatcaatctggttccagtttgagttgcgattatggcaaaccaggcagtgtattcggtgtgggcgattccaccggaagacgtgggcgccagatgcgctaacctcatgaccaccctccgatccgagttcggcgggccccacttccacccccacatcaccgtcgtcggagccatcaaactcaccccggaagacgccgtgaccaagctccgatcggcgtgccaagccctgaggcccttccacgtcaccgtggaccgcgtggccgccggcagcttcttctaccagtgcgtgtatct

SEQ ID NO: 1579 - DNA, 384 bp, Glycine max
ttaagtctcaaattttaaatcatgaagaaaaaaaggcatgttttttggaaacaaggaacaaccttggaatcagaacaaactgagggtgcctcacaagttgcagcaaaacctccttcagaaaaaaaaaacgaccgaatttcccagtgaaaaagaagaagaaaaaagcatcaaagcacagaccttgatggactcgggggggggctgttaaaccctagattcttcttcccacggttttgagactgaaaggggggaaaaaaaggactttgcttcccttgagaactcccccaacacaaccatcatacacaaaaatacaaagcttccaactttaaactatatacatattatataattaattaaagtcctaagcaggaaaaaaaaaaccaa

SEQ ID NO: 1580 - DNA, 1053 bp, Glycine max
  misc_feature (42)..(52): n is a, c, g, or t
  misc_feature (86)..(90): n is a, c, g, or t
  misc_feature (757)..(757): n is a, c, g, or t
  misc_feature (880)..(890): n is a, c, g, or t
  misc_feature (957)..(962): n is a, c, g, or t
  misc_feature (997)..(1005): n is a, c, g, or t
aggcatctaacatatcttgtaacctcctacacaagaaaagcnnnnnnnnnnnaccatgtaatacaaaaacagtttctacaaaatgnnnnnatatttcctccatcatattttaaaacaagtttaaattacagattcagttcctatatctgacactgttttttggttttagtccttacaagacaactgtttataattcccttcttgctgtttattaaagttataatggtgttacaattttccacacagggaccaaagcaaaaaacggtatgtcaagtgtaggggccaaaatatacaatttttttaatgtaagaaccaaaatgaagtctaaattttttttcatggttctagaatgaaaaacactaataataagtatataccccaaatctaatcctggccataactttgtcagacgataggattcaatttgtaattttttttcatatagcaccaaaaatgtagattcaataaaacaaaaaaatggcataaggtgtgggaaccaaaatttataatttaaccaaataacaatatcaaagcacttgaatgcaagaatttgaagctgagaaaagagcaatataagcttacttatatattttccaggagaaaagcctgagggcttcttgaaaagcaacagatgagaaaatgagtattccaaaaggccaccaagctgttgtgttgagaggcaaaacccccctccatattccagacagcacaatcaaacttataagccacagcagtgtgctgcatccacaacagtaancatcatgataaaaaccctaatttgcagcattgcagagtaaaaaacaaggcaaatcaaaatagcaacatagagagggtcagtgaggtctgaattacgagtttgcatgaaataatgctggtgttnnnnnnnnnnnaaacggaattggagcgaaagcgagctacctggagagaacggtgagaatgaggaagggttttttggannnnnnagaaacgaagatggagagagagggtcctaacgctnnnnnnnnntaacccattcctgctgctaccgtcatcgctcgctctctaaggaacagc

SEQ ID NO: 1581 - DNA, 486 bp, Glycine max
ttctctgcaacctagtattgctctttccaacaactctctgctgttctattacttttttattagtattttatttctcctcttgttaatttttttgttgtttatgttttccaggtgctgttttcactgaaattcaacgcttgaatttcttggattttagtgtttggactttgatttgaaattgattggtaacaatagaatatgtgtgtttattattagttatttagttatataatactaataggtgagggagggtttgtggggggagggggttggagcatccatttgtggatgtgaaggaataggaggttgttttggggtgaaatgagggatgctatcaaggctgatggactttctgactgcctgctggcggcgaagaggatcctcctccgacggcaagggttccgaggtttccgggcggaaggaagggctgctgtggtacaaggataccgggcagcacttgtttggtgaatactcaatggctgttgt

SEQ ID NO: 1582 - DNA, 777 bp, Glycine max
aaaagtagtggctgtataatttcaatttcaagttacaactaagaaaaaacaagagggaggcaatccataatatagcatgggaattaccatgatgtggttgtacaatttgccagcttaagcttgtttaactagtaaataaacaaacttgggcaacatagtgacaccataaaaccactgcatgctactgttaattacagtatcaaaattatttacataatattcaagcaccatttagcatttgaccttcttattttatttttcaatgtagatcagacatagataaatgcatgcttaaaattaataccagctaaaggataattaagctgtactaccagcaaactcaatccaggccaaagcatgcttctccggtaaagagtggaaagtgatataccatgcctccaagtgctgcagaacatgtataataagcttatgataataatgataaaattatccatccatagcaagactaagaacttcagaacagaatggacagaatctcgtgtctgacaatgaacaatcatccatagagatacctgtacaacaacagccatttccttccgtgaataagaggcggaagagaaacatagagaacgttccgtatactatctgaaaggagaactgaaggttcagaaatttctggaagatcaaccaaaggcacagtcacaggttcaattctcctcatctcaacaccaccagaaaccttagaaccatgcccatcatccaatttcatttcaacattatccctgcgatcctgatggcgaaatccaccaattctgc

SEQ ID NO: 1583 - DNA, 452 bp, Glycine max
  misc_feature (360)..(361): n is a, c, g, or t
  misc_feature (364)..(367): n is a, c, g, or t
  misc_feature (373)..(375): n is a, c, g, or t
  misc_feature (377)..(380): n is a, c, g, or t
  misc_feature (385)..(422): n is a, c, g, or t
  misc_feature (424)..(424): n is a, c, g, or t
  misc_feature (427)..(448): n is a, c, g, or t
ctgatggggacgtttggttagcgcgccatacaagctggagttccagcgcgacaaggagttggtttccgtgtgcgacaggaagctctccaaacaggacgtggctcggttcagatccgcggtgaggaaggactactacttccagatgtactacgacgaccttcctatttggggcttcatagggaaggttgacaaggaagggaaggaccccagtgattataggtacttcctgtataagcacattcacttcgacgtcttctacaacaaggacagggtcattgagatcaatgtgcgcaccgatcccaatgcgctggtggatctcaccgaggatgctgaggttcatgccgagtttttgtacacggnnaannnngaaggnnnannnnttaannnnnnnnnnnnnnnnnnnnnnnnnnnnnnnnnnnnnncnttnnnnnnnnnnnnnnnnnnnnnncccc

SEQ ID NO: 1584 - DNA, 1448 bp, Glycine max
  misc_feature (355)..(357): n is a, c, g, or t
  misc_feature (359)..(363): n is a, c, g, or t
  misc_feature (366)..(368): n is a, c, g, or t
  misc_feature (596)..(597): n is a, c, g, or t
  misc_feature (620)..(620): n is a, c, g, or t
  misc_feature (733)..(751): n is a, c, g, or t
  misc_feature (758)..(759): n is a, c, g, or t
  misc_feature (769)..(772): n is a, c, g, or t
  misc_feature (774)..(777): n is a, c, g, or t
  misc_feature (779)..(782): n is a, c, g, or t
  misc_feature (785)..(804): n is a, c, g, or t
  misc_feature (806)..(808): n is a, c, g, or t
  misc_feature (813)..(821): n is a, c, g, or t
  misc_feature (824)..(826): n is a, c, g, or t
  misc_feature (828)..(829): n is a, c, g, or t
  misc_feature (833)..(833): n is a, c, g, or t
  misc_feature (839)..(841): n is a, c, g, or t
  misc_feature (847)..(851): n is a, c, g, or t
  misc_feature (867)..(870): n is a, c, g, or t
  misc_feature (875)..(888): n is a, c, g, or t
  misc_feature (890)..(890): n is a, c, g, or t
  misc_feature (894)..(895): n is a, c, g, or t
  misc_feature (900)..(916): n is a, c, g, or t
  misc_feature (922)..(926): n is a, c, g, or t
  misc_feature (928)..(930): n is a, c, g, or t
  misc_feature (936)..(937): n is a, c, g, or t
  misc_feature (939)..(942): n is a, c, g, or t
  misc_feature (948)..(952): n is a, c, g, or t
  misc_feature (955)..(959): n is a, c, g, or t
  misc_feature (962)..(967): n is a, c, g, or t
  misc_feature (974)..(977): n is a, c, g, or t
  misc_feature (979)..(986): n is a, c, g, or t
  misc_feature (992)..(1000): n is a, c, g, or t
  misc_feature (1002)..(1009): n is a, c, g, or t
  misc_feature (1014)..(1016): n is a, c, g, or t
  misc_feature (1018)..(1025): n is a, c, g, or t
  misc_feature (1029)..(1030): n is a, c, g, or t
  misc_feature (1034)..(1046): n is a, c, g, or t
  misc_feature (1048)..(1048): n is a, c, g, or t
  misc_feature (1057)..(1074): n is a, c, g, or t
  misc_feature (1077)..(1079): n is a, c, g, or t
  misc_feature (1081)..(1084): n is a, c, g, or t
  misc_feature (1086)..(1086): n is a, c, g, or t
  misc_feature (1088)..(1096): n is a, c, g, or t
  misc_feature (1098)..(1106): n is a, c, g, or t
  misc_feature (1109)..(1113): n is a, c, g, or t
  misc_feature (1120)..(1127): n is a, c, g, or t
  misc_feature (1129)..(1131): n is a, c, g, or t
  misc_feature (1133)..(1138): n is a, c, g, or t
  misc_feature (1140)..(1175): n is a, c, g, or t
  misc_feature (1178)..(1189): n is a, c, g, or t
  misc_feature (1191)..(1199): n is a, c, g, or t
  misc_feature (1201)..(1201): n is a, c, g, or t
  misc_feature (1203)..(1205): n is a, c, g, or t
  misc_feature (1208)..(1227): n is a, c, g, or t
  misc_feature (1231)..(1231): n is a, c, g, or t
  misc_feature (1233)..(1235): n is a, c, g, or t
  misc_feature (1238)..(1238): n is a, c, g, or t
  misc_feature (1240)..(1246): n is a, c, g, or t
  misc_feature (1248)..(1252): n is a, c, g, or t
  misc_feature (1254)..(1258): n is a, c, g, or t
  misc_feature (1260)..(1265): n is a, c, g, or t
  misc_feature (1273)..(1276): n is a, c, g, or t
  misc_feature (1286)..(1290): n is a, c, g, or t
  misc_feature (1292)..(1301): n is a, c, g, or t
  misc_feature (1304)..(1312): n is a, c, g, or t
  misc_feature (1316)..(1323): n is a, c, g, or t
  misc_feature (1326)..(1328): n is a, c, g, or t
  misc_feature (1334)..(1337): n is a, c, g, or t
  misc_feature (1339)..(1348): n is a, c, g, or t
  misc_feature (1350)..(1350): n is a, c, g, or t
  misc_feature (1352)..(1352): n is a, c, g, or t
  misc_feature (1355)..(1370): n is a, c, g, or t
  misc_feature (1375)..(1386): n is a, c, g, or t
  misc_feature (1388)..(1393): n is a, c, g, or t
  misc_feature (1398)..(1401): n is a, c, g, or t
  misc_feature (1403)..(1404): n is a, c, g, or t
  misc_feature (1406)..(1411): n is a, c, g, or t
  misc_feature (1417)..(1424): n is a, c, g, or t
  misc_feature (1426)..(1437): n is a, c, g, or t
  misc_feature (1441)..(1444): n is a, c, g, or t
aagaaagaaaaacaaagggaaatataccatcaacatcattgtttcattagctcacttataacccttctgattcatgatttatcttattcacaagccaatttggtgtcaaagctgctcaagcatattgcaaaagcttggaatgcagataaagggtaccgataatccatggtgaacatgtccttcccaactttgccaaactgaagaatgatcttatcgtgctccggtggagctggttgagatggtgtaggtgcaccagcagctggttgggtggcagcaatcaactgaaagtttttaacagacgcaactgttactcgtccacggaaattaaggcaccaacattgtaactgttcatcgnnncnnnnnagnnnaaagaaatagctgcagggttacatccgaagcaaagtaatgcaatcagaggactgttgctacagtcagggtgggtggtagagaagcttgaagatgattcatgtgtggtcacttatgttgttcaggtacatagaataaaaatgttcacgtttcttctccacaaacaaaagaaggtgatcttcaatgctttcttcctcatggctttgttttctttcagttggatcctgcannatggctgcccaagtgctttgtcnatcgatttaacacaaaactggttatgatcattgaaaaccttaaaaaattagcccaagcatgtcctagtgaaggtgaaatttgattactttgtaaagtttgagagaagcgatcnnnnnnnnnnnnnnnnnnnaaaaaanncctctcccannnnannnnannnntannnnnnnnnnnnnnnnnnnntnnnctttnnnnnnnnnatnnncnnctantatttnnnatatannnnnttttcttactctttannnntcccnnnnnnnnnnnnnncnctcnnacttnnnnnnnnnnnnnnnnncttttnnnnngnnntctccnnannnnaaaccnnnnnttnnnnntcnnnnnnccatttnnnntnnnnnnnntttttnnnnnnnnntnnnnnnnntactnnntnnnnnnnntatnntatnnnnnnnnnnnnntnttattttannnnnnnnnnnnnnnnnnttnnntnnnntntnnnnnnnnncnnnnnnnnntannnnnttatttnnnnnnnntnnntnnnnnncnnnnnnnnnnnnnnnnnnnnnnnnnnnnnnnnnnnncannnnnnnnnnnncnnnnnnnnntnannnttnnnnnnnnnnnnnnnnnnnnattnannnttntnnnnnnntnnnnncnnnnnannnnnntcattatnnnntctttaacannnnntnnnnnnnnnnctnnnnnnnnncttnnnnnnnnttnnntttatnnnntnnnnnnnnnnancnctnnnnnnnnnnnnnnnnctctnnnnnnnnnnnncnnnnnntcacnnnntnntnnnnnnactttnnnnnnnntnnnnnnnnnnnngtcnnnnctaa

SEQ ID NO: 1585 - DNA, 938 bp, Glycine max
  misc_feature (60)..(63): n is a, c, g, or t
  misc_feature (880)..(884): n is a, c, g, or t
gctgtgctttgtgccacttgtgctggttctggtctatatgttgactccataatggaaagnnnnggcataattgttaaagttcgttgcttaggtatattctttttcctgttctaacaaccttttgatatgtgctggctgcaagatctcctacgccttacttgtgtttaaactgtatttgctgcatctttttgttatttggtaatgttattgttgccaatagcttttttttgtgattgtcacttatgtgtagaagctattctctcgtggaacttccttgattttttggatgactaattttagcttgaacttttttttatggtttacttagatgaacaacttgagcttgggcttttgtgaggactttgaatgaaacaattttgaaaaattttaaacctttttgacatgtagagaattggtataacttgaactaaaacaagattgtatgatatgcggtgcaaacttgatgtaacattccactaattgctagattaaaaaggatgcatatgcacaatcatcatcatctaactgcatgatgctgtgcatctttattggtgcaaacagggtctgctgcagttggctttctgcaccctttgcagctttgatcctacagctgcagattgcggaatcatgtttataatgtataaatatagaaaatttcatttgcttgtgcagttgtattttcagctgtagatgactgggatccttattgatgaatttgcttttatttgacaactgtgctcatgtaggttgcggcggaacaggaaatataatgtgtgcagaatgtggtggacgaggtcatctgggacccaaatgatcaagtctgacttttttgaaatttgtaagtatttgtacctccagtatgtaatattttcgttgatannnnnggtaaccgtttttattattattattattatttttgtaaatcaaggagtcgttag

SEQ ID NO: 1586 - DNA, 373 bp, Glycine max
tgctttgcttcgttcctattccacctcacgttccttatctttcttcttcttcttcttctcaaccgtcgtcgattctcagtttccgattgcagaatttgatttcagaatccaaaaaaatgaacacgttaatctcaccgccttctacaaaccgttacctttgtggggtcccttactctttcctctctccgcttcgacacaacaacaacaccaaccttaaccttccgaggttccattccacagttgctaccaacttcttgtcacactctccggttcgggccacgctctccgcacgtgccacttccgatgaagtagacacgcaaacggtggttgaggaactttcagaggagaataaagtggaagagaacaccaacga

SEQ ID NO: 1587 - DNA, 377 bp, Glycine max
ctttgggcagacctacactgggaggcagttcaactactaactaacccttaattatcttttcaataatgttttagtaatattatatcatctcaagattacaaatcaaagaaccaagctatatatagttgagtattgtagatggattagtgttgtgggctagatagaagatgatttagcccccttttatttatatataaatatatttaatttgatttatatgtagcaagcatttgcatatgatgtgctggcttaatttatgctatgcctcagcaaatgggatacttgctctgtacgttgagaaagataaattgtagaaaagattgttgaactgttgaatgtaagctcttgtactttagttattgatgaatgaatgagtg

SEQ ID NO: 1588 - DNA, 413 bp, Glycine max
  misc_feature (42)..(44): n is a, c, g, or t
  misc_feature (132)..(132): n is a, c, g, or t
ataagcatggtttatcattcctctaaaaggcgaatgaagtannntcgttacaaataaaagcttaacaaataactgaaatgaaatgtgattattgaagttcaaacactggcacaaaagagggtttttttttgntttttgttttttgatgagcacaaaaaaaggaattattttttgttgtagcgagctacctcatcatcgttggggaagaaacccatgagtctcccagcggagttctggtaagcatacatgaacccacccatcacaccgatcaaaccccctgtcaccatcgaaggacccctaattccaggcttaatccctaacacaaaacacaaatttcaatttcccaattcgattcagaatgacacgtggcgatgaaagaggtgagggtactgaccggagaggtagccgacggt

SEQ ID NO: 1589 - DNA, 317 bp, Glycine max
gatcatatctcacattggaaaaaatggagatgatgattcgtccatttgccatgcctgcagaagacttccctccaccagcaacccctgcgggattctctggctatttctcaaaaagcgtacttgaacgtctagtaaatctttggcctttccataagcatggcaattcaaatgggaaatagttaacttgttcaatactttctccctctgcttcaatgttccaacttcgtgtttcttattgtacatgggaaaattctgatacaaccaaagtgacctttggctcctttggaattttttttcaagcaaacttcttccagcca

SEQ ID NO: 1590 - DNA, 718 bp, Glycine max
gcttgttgagctttacttcagctgctggaaacagtggctttcactttcagcagcctcctcaaaccaatcctattgattaccagcagccagaaccctttttgcaaatagggtaattaatgaaaatttcttttaagcatatgatcgatagttaattacaccaaaagttaaatagacaaacatactagctagtgttaataaatttttagcaaaggtaatgtgaaataaaattaaaatttcaagaacaggcgtggttatttgtccaacaactaacttgatcacacttcaaacccttaaacaaactcttgcaattaaaaccttgattaaatgaaatatgaagatgtaaacaagtttagaaatgtataagatacctttatttcatgataagttttgggtcaactttatgccatatgtcaaatttcaatttgttgtatgtgatatgttggtatccgaaaacagaaatacaaatgatagactttcaatggtcagaaattttaatttaattaacctcttactttgaataggtaccatcaatatgttcaatctgaggcatctaatgttccaaagagcatggcttgtgagactaacttcatgcagggatggatcctttgatcaatcttattaattgaattaagtatatgatgatttaccttattgtctatatcctttttagattttttgtgttttggctgttgttaaatgtacctttgtcaccagaaaa

SEQ ID NO: 1591 - DNA, 390 bp, Glycine max
gatcttgcaagttctgttctattcctgttccagcaagccatggcaatttcaggttcagagactcagagtccttcagtgaaaagcgtttctcaggtggaagttgagtgtgtgaaatgcgactcgtgcgggttcacagaggaatgcacccctgcgtacatcacgagggtgcgtcagaggtaccagggtcactggctgtgtgggctgtgcgtggaggctgtgaagcacgaggtggtgagatcagatagtctcatcaccacggaagaagcgctggaccgccacatcagcttctgcagagagttcagatcatctgcggttaccaataataaaacagagcaccccatcttcgccatgggacgcgttctccggaggagcctcgactctcccaggcct

SEQ ID NO: 1592 - DNA, 420 bp, Glycine max
tactttaggagagttgtcgtagacatcttcctttttaatttaataagcatgttacatgcaaacccaaaattatgtagttaccaaacaaacataattttgaattcaagtaggtgccatatagttcctttgattgtagttggctgtagactgtacagggaattcaattgcactgaactccatgaataccaattgagttggatgcttggataaaaatggctgttcaaaactctctccaaataactagaagtggtagtggtggttatgacgatgacgggcgtgctaaaaggactggtaaaaatctctaggaccattccatattcatatatatgaatttgactcctgaattttagttcttccatcaattttatcaggaactttatggagtgctgtggctcatatcatcacagccattatcggtgc

SEQ ID NO: 1593 - DNA, 354 bp, Glycine max
aagcgaccagataatatgcaagaggatgactgaaggtagttgaagactctgagttattactaccttcggggaattatgtatggttttgtagtgagttgatggtgcaggtgctatagttcctgggaaggtcttggtctctggataggtaaaagacctttgatcacattaatggggtatgaatgatgcattttgaggtttgagatttgaaatgcttttcaatgacatggtacttaacgtgggaggtaaaaatagggggctagagagaaacagctgtcaattttagactgacattattatagtttattccgttccttgagagcctcaaagaagcattcactactcgctgaaggtaga

SEQ ID NO: 1594 - DNA, 403 bp, Glycine max
caccgatgctacaggagcaggggacctttttgcaagtggatttttgtatggagtggtcaagggtttgtcactagaagaatgctgcaaagtaggcacatgcagtggtggatctgttatccggtctcttggtggtgaggtaacgtcggagaattggcaatggatgtacaagcagatgcagataaacggactgcccacgcctcccggtttatgcaaatgaatagtagcaaccgttgcccccttaatttgtgctgtcttatattttactgatttttaatgttgtttttcttattctattgacttctattattcatttcacacaatagtatggaagctagatatttttcagggaaattcaagcgggtttgagtctttaatgtacttgtgcttgggataagtatgaact

SEQ ID NO: 1595 - DNA, 693 bp, Glycine max
  misc_feature (687)..(689): n is a, c, g, or t
attcgttcggctcagtcaacataactataataattataactcctctctttctttctcaactctcacaacacaagaagatggcttctatctcacagggccttcttctcaccactgccatgcttctctccaccaccctgctttatgttgctttctccaggccttcatttcaaattcaccactctaacaaacccaccttgcgctcttgcttgtattcaggtaaattcctttcatttttctctctctagaaactagaaactgtttgctaaaacaattaattctacactattcaacgattaatttcttatccaaaattcattagattttgattattgttttcaaaataactattacaaatgctctctctcttcttccttttttttttaaaaaaaaatcatgttattcaacatttctctcaattttacattatgttgtatgcgttatatgtaccattttttcatcaactgtttaaacaatcttatttagttgcatattgaaaactcaaaacagcagtttttaaaacacaccttccattctgactgcggtatggtttacttacatacagaggaaaagaaaagggagagaaagaagaagaaaaagaagaaagtgaaatttgcagatagtgtgaaggatggaagagaaaggaatgagcaaagaagcaactgcagaagacaaagtggggaatgccannncagc

SEQ ID NO: 1596 - DNA, 596 bp, Glycine max
ctacatcagtctttgtgaactcgcaactgatgcgagaagaacaaattcagaatgctgtgaaatttctatcacacccaaaagttagaggttcacctgtcatgtataggcgatcatttctagagaagaagggccttacgaaggaggagattgatgaagcttttcagcgtgtgccagtaagctaggtttttctacattattttatcagtcactcaaaattttctagactgctctttcacgggcaaccaattgattatcagtttatcaatttcctgtatgctcatcttttttaatccttgcctttggttcaaatcacaggattcagctccaacagtgcagacaggtggtgtaaatcaaggtgaagcatctaatattgaagtttccctttgtacctttgggttaagacgttcagttaaactgcatgcgaaatctccatttaactagtttttcaataatgctggattgattcttgctcaagttacactttgaacatggcttattttaattctaacagatgggcaattgaaatcgtcatcaaacattcagcaacaagcccaacatcaaactttgcagccgggtttacctgcttctactggtgt

SEQ ID NO: 1597 - DNA, 357 bp, Glycine max
acttgctttagctggttagaggtgaggttggatagggtagttttctttatagcattgaaggcactgtccttaggaacaaagatggtaattccttcttcagtgttgttggcttggttttggaaagtgtcaatcactttagtggactcaaggtatccaaggaaggtgtgaaacggaccagcaacactgagtaactcagtgaggttcacgaagtctggtgccggggctggtgctggagttgggctcagagagggaggactagcagttttggcaaatgctgaactgaaaagcagcataatgttgctaacaatgaaaatcatagaaaactccatatcttccttggctactggtttatccaaa

SEQ ID NO: 1598 - DNA, 769 bp, Glycine max
actgtcgatagctgacctttttgcaagcatccttgcatttatccctactggatggggaatattatctgtgagttctgatttatttttgtatgaattttcttgtgataatagatgtctgtgtgttggaaagggttaccattgacagataggctgaccagaaaggcttagtgaaatgttgtaatatacagccaccggtacatcgactctctctggtggtttgagatctcacatcgactagagatatatccagtgtattccttataaagcttgggaagtccttaatttacaagccggttttgtgggcttaagttaggccctaaactgaaattctaagaccaactcttatttggtgcatgaggttgtctaacttttttttccaaatgtcctaatggaattcgtatatttaaaactggctattcattaccactttaattttattttattttttgcatcattgctgacatttgaagttaattccagcttctaacatttgtaaaattttccacactttcagttggcaattgcatggaagaagatagtttggagtctcggcatgtgggattctgtccgtgagtttgctagaatgtatgacgctggaatgggtatgatcatttttgcaccaatagcatttttatcgtggtttccattcatttcaactttccaatctcgccttctcttcaatcaagccttcagccgtggtcttgaaatttctatcatccttgctggaaacaaagctaacgttgagacttagcgcctttcatcttactct

SEQ ID NO: 1599 - DNA, 343 bp, Glycine max
tggacaaccctaatgaatgcaaggaggaagaaaaatagtaaccattatattgtataggttacaaccgagggattttgtagggctactgaatcactgatagtttcgaagtactgcttggtaagtatgaatacacatagcaatgcatattgtccagtagatggtggtcattatttcaacataagcctcttgcaattgataaaatacatgttgtattcggccattgtttacacatcccccaaatccatatatgtaactggataccgaaaacgttctctttccctctgctcatgtagaaaatgaaatctagttatagcttgttgtactcatactgttctgcaatgag

SEQ ID NO: 1600 - DNA, 404 bp, Glycine max
atatcctcacagcagcaaagataaaaagcactcctcacaggagatactttcaaaacaacacaccttattcaacacaccacactcctgaaatagtttcaaaaaactcaatacctaatgaccactgctggagaaactttgaaagcaaaaaagcactccactaaacaaggttttaacagtaatctttggcattcatgtcttaacaataaaacataactctcttgacgttctccttgagtgcaggcaatggtctcacagcagcattggcaccaggtacacgcgtgctacgccctacaccgcccatcccacggcctgcaacagcaccacttgtcatagagccactatccgacgtctctggttccatgtaaaaccttgcgcggaatgcagcaaggtgagcatagtaaaac

SEQ ID NO: 1601 - DNA, 774 bp, Glycine max
  misc_feature (685)..(687): n is a, c, g, or t
  misc_feature (725)..(728): n is a, c, g, or t
  misc_feature (765)..(769): n is a, c, g, or t
actttgttgaggctgaagaaacccttcttccaagccattagtcctatggttgaatggaggtatatatgccttgttatgtatcaataccatttacatcatttttgttcagttatttatttgttttggaatctggcttaaaccttttaagactgatcaaatcaattaagatgctttcttggttttgatttttgaagggcccggttgttcatcgattggagttggagcttttgctgagcatggtcctttcagaccaagtgacaacaatgttcttgagataaatgataaaagttggaacaaaggtgaaccttaaatccaatggtttgtttttattgagggtcaaaatatcaaatatgctcttttaaaaaaagcaaaactgcttgtttatttcatccttatcacagtggcaaatgtgctatacttggaatcaccagctggtgttggattctcttactctagcaatgaatctttttatgccttagtgacagatgaaatcacaggttcttttccccttcattttgtccgcaatggcatttaaaaactaacacaagaatcaaaatttaataagttcttaagattttatccactacttgtctttatgacatttctcaagaacctgacaatggttttgttcttgtacagctagggataatcttgttttcctacagcgttggttcactaaattccnnnagtactcaaataatgacttcttcatttcaggggagagnnnnggaggttagaatcaaatataaattaataatatattcnnnnngaaac

SEQ ID NO: 1602 - DNA, 1084 bp, Glycine max
tgttcttgatttagtttacatgagtagtcttgatttccctgtatacgcattgtaccataatgatcacaatacagctttcccaatatgagattgtatattgatgttgtaacctggaagaaaagctccatatcagtttagaaccaaatctcaacacacaattttcttcatggatagtggacacatggtagtggaaacagttaaatataccttactccactggcatacttcaccatcatcaaattccaaagtcaaaatgccaacaggatcaagctgaattgaccgaccccaaaatttactctttaagttgctatctccccaaaatttccaacctgtaccctcacagtgacatgcaactatcattggatgatgactgacctgtgagaaaacagaaatataataatttcaaaatggaaacagacatattctaaaggcataatcatatccattgttgaaattcaaattctattgcctttcattgagttctgtggaatttaagcacccaattacatgatttttcattcatcaaattaagtggagtagttttaatattctacttgagttcttccctcaaactgcctttatattaggaactcttttttccttttcatccagaaacaataggttctaacttcaaataagcatgattacagattactgatatgtaggaatttaaacaaataataaattgaaatacattatataacaacaacaaataacgaagtaacatttcacacacatagaccttttattctcgcaggtgaactttcaatggtaggttatctgtaagtattgcactaagcactcgttagccttggaatttcatgacctccctaaccgagtaacatccaaattcactccctaacatttttgtaccaaaagaataatatgtggctttcactttctctatgctacttttttaaggtatcaaacattacgataaatacaaacataaatgatcaaaataatcaagaaaaggatcatctattcaatgatatcaagtaaaccttctctgataaaaatcgaaagcctttatctggaaagtcagcctcatatgtttcccctagcaacgggttaaatggttgca

SEQ ID NO: 1603 - DNA, 641 bp, Glycine max
gctggaaacttgatctctcgtatggtcatatgtaaaattgtatcaaaaccacaacttggatgaatggttctgctagcattaacataactgatgacaattccatactaaataattaaattctataataatatcattcccatgacaaagcgtactgcaactttatccatttatatgtcagcagcaaggaagttaccggacagtgctacctgcgtggaaatatcgaattacttacgacgcccataccaaagaaatgacaccaaacagttgatgagagaaagtaccttctcgcccaatttgaaggcaggcagtcccttgtaagggcaggtactgcacctgaaagcatcccctagcccacactgcagaccaaagacaactttgagagcaatgccaattacgggagaaaaaatttgaaatagtattagaggatagatagacggtaactatttgcaaggagcatatcacaaaatcagcaagagaattgtagctcttatgatactagtcacaatgaccataactctaatccattttagacattcttattgaacacagccttggaaagcataagcaaactgcataatgcaaaagaaaaaaaaagaacacatacattgccacaagctgattgaggattattaatctgttct

SEQ ID NO: 1604 - DNA, 378 bp, Glycine max
gcacggagggagaaaggaaacactgcgcgacttcgttggagtccatggttgatttcgtcgtttccgcgctcgggaagaacgttggtgctttctcaacagagaaagaaagggaaactgagtctggaaagtttgtagtggtgaaaaatggggtgaggaagttgggagatgataaggttattgcctgtcatccaatgagttacccttatgttgtgtttgggtgtcatctagtgccaaggagtagcgggtatttggtgcgcttgaagggagaagatggggttcgagtgaaagcagttgttgcgtgccacagagacacgtcaaagtgggaccataatcatggggcattcaaagtgctcaatcttaagcctgggaatggtacag

SEQ ID NO: 1605 - DNA, 412 bp, Glycine max
ctgtggcaattaaaatgctacataaagcaaaaggtaatggccaagactttattagtgaaattgcaacaattggaagaatacatcatcaaaatgtagtacaactaattggatattgtgttgaaggctcaaaacgtgcccttgtttatgaattcatgcccaatggatctcttgacaaatttatttttcccaaagatggaaatatacatttaacatatgacgaaatatataatatagcaattggagtagctcgtgggattgcttatctccatcatgggtgcgagatgaaaatattgcattttgatatcaaaccccataacatccttcttgatgaaacattcaccccaaaggtctctgactttggattggcaaaactatatccaatagataatagcattgtgactaggacagaggc

SEQ ID NO: 1606 - DNA, 322 bp, Glycine max
ccacctcccatacttacaagctgttatcaaggaaaccttcagactccacccatcaacccctctttctgtgccacgtgctgctgccgagagttgtgagatatttggctaccacatccccaagggtgctacactcttggtgaacatttgggccatagcccgagacccaaaagagtggaatgacccattggagtttaggcccgaaaggtttcttctaggtggtgagaaggccgatgttgatgttaggggcaatgactttgaggtgataccttttggtgctggacgaagaatttgtgctggacttagtcttgggcttcaaatggtt

SEQ ID NO: 1607 - DNA, 606 bp, Glycine max
  misc_feature (34)..(36): n is a, c, g, or t
gaaccacaaaatgcataactaaaaaacataaccnnncccttgacaggccgttccattattaataccttgaactaactcctgagggaaatcattgaacattaaaacttgtgagagagagtcacgagtgaaatcgttcttcttcctgtcagagaatttagctatgtgcatactttgcctctctgatgacaaaacaaatcttgtaatgaaggtttaaaagacagcgaaataataaataaataaaaagataatgagagaatggttactcttggaggttttgtcctcgagaaaataaggagaggcttcccaataattttgaaggtgactatcccaacgaagcaactttttggtatcatcatgaatatcatcaaggttaacatcaggcaaagtaacagcctgcaacaagcgatgaaacttattagagtgtgatttggaaatgaaacagagaatggagaatttgagggatgaagataggtacctcaggaaaaagatcaaatggaacttgagaggcaaatgtattaaatccacctcctcgtccccatccccatcctccccgtccccgccctctgcctgacatctccactcaagtttggtctttgttctttggag

SEQ ID NO: 1608 - DNA, 323 bp, Glycine max
tagtgccagatgttttggtcttctcgtctttggaggagaagatgtcgttcacccttaagattgaaggaagcattaacaatgcaaatatagtttcttcgtctttggtttgggatgatggcacttttcaagtaaggagccccgtcgttgtttatgttcctccgtaagttctctgctgcgaacacttgtcaatgaagaagcaagcaacatgcatgaatggaaatgattaatgtgttatttataatcggtttgctttttcttcttccctttgaagtgttagtgaataaatattctaggtgtgttctaagccagaattgatggcaagt

SEQ ID NO: 1609 - DNA, 383 bp, Glycine max
gactaggttcgggatccttgactcctgatggtgttgggcttgcttcgcgattaggctctgggtgtgtgacacctgatggtctggggcaggaatccaggttaggttctggctgtttgacacctgacagtgctgggccaaccaatcaaaacaacatctctgtgcaaaaccagatttctaaggaagcaactcttgcagattcagacaatggacatccaagcaatgcaacattggttgatcacagagtttcatttgaattaaccggggaagatgttgcccggtgtcttgcaaataaaactggggtattgcttcgaaacatgtcagggtcttcacaaggtatactgaccaaagaccctgttgacagagaaagggtgcaaatagacacc

SEQ ID NO: 1610 - DNA, 392 bp, Glycine max
tttagagatggaagaagaaaaagcagcggcgtactacgacgagctggcccgtaagggcgagggagctgcgaggttcaagcaaggtctaggcttttcctcttcagcaccaaacgacgacgttccaaaaccctcctcctccttcctctccaaattcgtcaaagcctcctccgagtcggagaagcaagcgcagctccaatccatccacgacaagctcaagaaaaagccatcttccgagtctagggtttcgagcagcgacagaagcaggagcagagaaaaacgtaggaaaaggagcagaagcggagatagatacagggaaacgcggaggcgaagcaggagtagagagagacatagggatagtgaaagagggagacggaggagtagaagcgtttctc

SEQ ID NO: 1611 - DNA, 425 bp, Glycine max
ctgaaatgaatagctgcagccccgagttgtgagtctcaaggtcaagaatgaagcatccatcataaaaggaaatgaggctagaaatacataggatacaggttcctcaataagttatctcctactggtggcagcagtcttgcctttgcttaaatcagctagttcctcaataagttttctctcttctttgctcagttttttggggatttcaacttgcacccgaaccaattgatcacccctcatattctttttattcagcaagggaacacctttcttagccataacaagtgttgagcttggttgagtcccagctgggatttttaaatccaccatgccgtccacagtaggaaccttaattgttgtccccaatattgcatcaatataagacaccttgcatgtgtataaaatgtttgtgtcatctcgcttaa

SEQ ID NO: 1612 - DNA, 396 bp, Glycine max
atcctccagaacctttttatgtgcttggtaagagacattttgggttgctggatggcagataggatttttagatagggtcttttaatctttgtggtgggtatagtctactacataatcttgcacagtaactgctgactgtataaagtatagttctgttttatggtgtatagttattttgacatgccaagtcaggtatggagaaaatggtagagaagttctcctttttctcctctcctctcctctcctctcaagatgtcaaagggatgtttgatgcctgtgacttggtggtggtcacggattctagttataggaacagccttagttggtaaggcatggagctgcctttctatttgttattgtatattgaacaatatattttgaacagtgatttcaggg

SEQ ID NO: 1613 - DNA, 1315 bp, Glycine max
  misc_feature (50)..(54): n is a, c, g, or t
  misc_feature (56)..(56): n is a, c, g, or t
  misc_feature (1218)..(1221): n is a, c, g, or t
  misc_feature (1254)..(1263): n is a, c, g, or t
tacacaagtggagatgatcataatacgataattacttttatcagtgtttnnnnntngacagactgagatggaaaggatctgtgacactttatgtttttctttatatttttgtatccacttacagctgccaatgacaatcaaatgactttgtagtaagattcttcttctatcttagaataataatgtttatattaggggtttgatttgctacgtgacctaatttgaggataacgtaggttactttctgcaatccgtagaaacttcaatatatgtcaaatgagtggggtgaataagtcttaaaatgagcataagttagtagctttaaaagaggagttaaaaggttctccacattctttaaatagcttggaaaccagattcactggagccataacttctttttaacctttaaaataattgatattgtggaaatactagtatgtgctctgcatatatttatttattatcgtatatatttctttctctttgtgtatgcaggccacaactcccgaatatagagcatatcaggaacaagttctcagcaacagttttaaatttgcacaggtacattacagaagcgaacgtctttcctgactatttggttcttaatctgcaaagtggttactaatttctttttcatatacaagaagttttttatacaagaaattaacttcttgtacctaacactgaaattaaaatatgtcccaggctctaagtgagaggggctatgagctggtttctgggggaactgagaatcacctggttttggtgaatctgaagaataaggtaataggaaattgttttgggaattcatgtaagcctcagtggctctgaacaataaatcatctcatctaatgctggttgtttgtatttagtcataaaactgacatgaattattaatatactacttactgttgtggtttcattcaggagaaattttgtaacatcttaaaaggcatatattatgtcagatcaataaaagaaagcagtaatttatttcattctaaaggatcagtaaaatagactaatcttttttattattattatcattatttttaaaaaaatgtgcagggtattgatggctccagagttgagaaggtgttggaagcagttcatattgcagctaataaaaacactgttcctggagatgtgtctgccatggttcctggtggcatcaggatgggtacaagctctttgttgcttctattataatttttatgnnnnaattcacttacatgatttctcttgtggaattcnnnnnnnnnnggtcttacttctagaggatttgttgaggaggatttgttaaggtagcagagtc

SEQ ID NO: 1614 - DNA, 396 bp, Glycine max
  misc_feature (293)..(293): n is a, c, g, or t
ttttctcagaacctttgcttttcctaacacaggatgataatgtcaaaatgcctgtttggattaacgtttgcaaagttaagttgagttaaacttaagtttgcaaactgagtttgcaaaagtaacccaaagtcttttgcaaaactaggtatcaagacaattttcattacaaacacactcttgggtaaccaaacactaccaaaatgagttcactctccaaaagtacttgtagcatccaaaaatacttcttcaactgataaccaaacatagtcaaagtttgcatttttttttgtcanaaattggtaaaatgtattatatagtatcatgttttttactaacaaaaattacaggagtcattattaaatttcttgagacctcgaaacccgttcaaacattgaa

SEQ ID NO: 1615 - DNA, 827 bp, Glycine max
cttcataatgttaggttgtggggaaacacctgatcaggttgtgaagacaatggagaaggtgagagcggctggtgttgatgtgatgacatttggtcagtatatgagaccttcaaagcgccatatgccggtatctgaatatgttaccccagaggcctttgataagtatcagaaacttggcatggaaatggtaagtcttttgtttgtgtttgaattaacatattttggagaaagaaataatcattctttttgtgggtttgtgggagttattgaaaaagaaagcagttgtttctcataagtaattggttaccaaagtaattgtcagaatatatgacgaatatctcatactatcaatattttatcttatagaatattttgagcaccttaaggattaaactttctaatccatggtaaattcagacttgtcattcccttatttaatctttaggagttagcacaccccagtggctcctgccaatagcaatctttatctagcaattcatctggcatcctatacatcaagcgagtgtaataatggcacatttctctccttttaattgctgcatccagcatcatgatgatttgtggaaaaaatgtattaatataaaagctgcatactatatttaattatagcttgatcatgtgatatgaatgacgaataattctactttgtatgtagggctttcgatatgtggcatctgggcccatggtgaggtcatcatacaaggcaggtgaattctatatcaaatccatgattgaatcagatcgggccgctttccctcaaagctgacttcttcttgatccaccatcatttttgttatttacacact

SEQ ID NO: 1616 - DNA, 411 bp, Glycine max
ttctctctctctctatatataaagccctttctattccatattcctaacaattcaattcattcatccttcactactacaccaaattaatagaaattaaagatatatcattccacaaaacaaattaaagttagtgagacgtacccttattatggccaaagaaggtcttggacttgaaatcactgagctaaggttgggtctacctgatgcggagcatcaagtaagtgtggtcaataagaaaaatgagaagaagagggcattctcggaaattgatgatggtgttggagatgaaaatagctcctccggcggaggcgaccggaaaatggagacgaataagagtcaagtggtggggtggcctccggtgtgctcttaccggaagaagaacagcatgaacgaaggtgcttcaaagatgta

SEQ ID NO: 1617 - DNA, 358 bp, Glycine max
  misc_feature (223)..(223): n is a, c, g, or t
gactacaaatgagcttctagttaagaattttacagcaaacatttaggtgtgactatatctggagtctggattctgcagcacatttccttgattttagtgcatttattgtatttactgtctagctactttacaagaatggtatacgttgtattttagtaattttttgttgttgttacctattgtcgtatgttatgggtgactgattcattgcctctttaaaaanaaattataaggttaattcacgaattataagactaatggaaattaattaatcaatcgaactgttgtatttcaccacaaacatgttcccttgttctatgaagcacgatcaattggtgcgctgtagaccaatcactta

SEQ ID NO: 1618 - DNA, 349 bp, Glycine max
ggatagagcttttttcacaccacagctaaaagtgctggaatagagcccttccccttcttcttcttctcctccaaatcctccttctttttctcttctctctaccacacaaaaacccttaccaagttctttctttctaattcccttgataatgtaaaatcacagaaaaagaaaaagctactaaaaacttggctctaaacctttctttttttgaggaaaacctgaaaagttccacacaatgtcttcttcttcttcttctagagctttcttcttcttcttcttctttcttatcaacgtctccttgctcctcacactctcttctgcagcggatccattcgtttcctacgaattt

SEQ ID NO: 1619 - DNA, 370 bp, Glycine max
atctcatgcctcatcaccacaccatatgaataactgcctagttaaattaacaaatgaaaatgaatgtttggaaaaacataatttgaggaaagaagaatcttctagccccagctccagttctgccactgaagacaaccaacctaaatcactatccaccaaagaatcatcatccatttcaacagaagatcaggaggaagattctgaatgtggggacacaaatagggtcaccagctcaagtaaagcagtagtagatggaaagaaatctcttgagggcctaaagattttgcttgcagaagatacaccagtacttcaaagggttgctaccataatgcttgaaaaaatgggagctgatgttgttgctgtaggtgat

SEQ ID NO: 1620 - DNA, 762 bp, Glycine max
gaggagtttcaaatttggtattgaagatagaattttgtgttcatctggaaaagttacatataatagaaggaatgactacattctttccctcaatatcccattacatgaggcaactaatgaaggtgagtatttatgtcactagcctttccctatttgagaattaaaatgtcttcgggatctcaaatctagtacttgttttgtttgataaatttcagaagaattagaatcctttcacaaactgaaagcagagaaacttgcagaaggaaaggaaatgtaagttaagatgctcaggaatcttattatttcattcatatgtttctatggatgcttctgaccatatttattctgatagaaatgccaatgagattgtgcgcccaagggtacctttagaaacttgccttgtgaacttctcagctcctgaggagatacaagatttttacagtactgctttgaaggcaaagacaacagcactgaagtaagcattttgaagtttctaaatatattatattgcagtgccatgcttactgtaccagatagaagttacataagctatataatggattttctttagtttcatgaatggtttacgaaagtcattgactttgttgagtggatgacaatcacatttgtttaggcattatttggccaagataatatagttataaccttattgctgaaacaacatttattccataggactgcaggtctgacctcatttcctgattacctggtgttacatatgcggaggtttgttatggaggc

SEQ ID NO: 1621 - DNA, 390 bp, Glycine max
ctactttggacagtcccctcatttctgtcttccggcacatcaattctacttcggacagtcccctcatttctgtcttctggcacatcaattctactttcaaccgtgtctgaaatttgactttctacttgaggaatggttgatgaggtgtctgcaaatgacttgcagaactgatcaagacaatttgagtggcgataactagtgttgcacatgtaagggcggcatcccttctcatgggatgaacatatgaggagaactgcattgtgagggtgttccatgcacactggacacctagcttcttcccattctttaacattctcctctgactctttaagagcagatcttccaacacgactagagctacttgggtaaggtgatgctctgctactttca

SEQ ID NO: 1622 - DNA, 697 bp, Glycine max
  misc_feature (425)..(431): n is a, c, g, or t
  misc_feature (435)..(451): n is a, c, g, or t
  misc_feature (460)..(464): n is a, c, g, or t
  misc_feature (466)..(466): n is a, c, g, or t
  misc_feature (477)..(481): n is a, c, g, or t
  misc_feature (483)..(493): n is a, c, g, or t
  misc_feature (495)..(501): n is a, c, g, or t
  misc_feature (507)..(523): n is a, c, g, or t
  misc_feature (527)..(539): n is a, c, g, or t
  misc_feature (558)..(567): n is a, c, g, or t
  misc_feature (575)..(585): n is a, c, g, or t
  misc_feature (598)..(611): n is a, c, g, or t
  misc_feature (615)..(634): n is a, c, g, or t
  misc_feature (638)..(643): n is a, c, g, or t
  misc_feature (646)..(661): n is a, c, g, or t
  misc_feature (663)..(669): n is a, c, g, or t
  misc_feature (673)..(686): n is a, c, g, or t
agcactaaccagcaccacttccaatggcttcaaatcatgaagaagtgatacttttgggcaagtgggccagcccatttagcaacagagtagaccttgctctcaagctcaagggagttccctacaaatactccgaggaagatcttgctaacaagagtgctgatcttctcaggtacaaccccgtgcacaagaaggttccggttttggtccacaatgggaacccattacccgagtcacttatcattgttgaatacatcgatgagacatggaaaaataatcccctcttgcctcgagacccttatgagagagccctggctcgtttctggtctaagaccttagatgacaaggttagcaatcttgctttgttcttttcttccactattttgattattgcatatttggattagtgtttttttttttttccggannnnnnnaatnnnnnnnnnnnnnnnnnaaattcaannnnntnaaaaaattttnnnnnannnnnnnnnnntnnnnnnnaaaatnnnnnnnnnnnnnnnnnaatnnnnnnnnnnnnngggggggaaaaaaaatttnnnnnnnnnntttttttnnnnnnnnnnnaaaaaaaaaaatnnnnnnnnnnnnnntttnnnnnnnnnnnnnnnnnnnnaaannnnnnttnnnnnnnnnnnnnnnnannnnnnngggnnnnnnnnnnnnnnaaatttttttt

SEQ ID NO: 1623 - DNA, 371 bp, Glycine max
aggagttcggattaaaaagcatacttgcatatccaacagtatcattgggtggcattccactgttgggcaatgggcccgtgtggagaatatgactatccttggagaagatgtccatgtttgtgatgaagtttatagcaatggtggtgtagttttgccccacaaggagatcaagtcaaacattctaaagccagagattgtcatgtgaggttactgtcttaaattcatagcatgtgattaggaagctctaagtttgtgtctgaaatgtgtttgtttgtttcatttgtttttccttttttttccgcatcccaatccgtttctctttgttacgtattgtacaagtcaatttcgtttagtttagaatgagtgatgcc

SEQ ID NO: 1624 - DNA, 378 bp, Glycine max
acttgctttcttcctatgtccaaatagagacaaagtggtcacccctccaaaagatctaatcagctacgaaaattcaagaacatacccagatttcacatggccaagccttcttgaatttacacagaaacactacagatctgacacaaaaacacttgatgctttctcgaggtggctactagaaaaaaacaatccgaacaggggtgcccccacaaatgttccatggccaacaaaatctataaactgagctttaacttgcatctgcttgaatgaggaagatatgacatcatataaagtgaaaaagagggtgcttttggtgggtcgacttgtgaagaaaaagataacagaaacatcaaaaagggaagggctaatcatcagtaa

SEQ ID NO: 1625 - DNA, 359 bp, Glycine max
tgtggcgatcggagtcgttgcaggcgatgtagttggttggaaagattaattaattaattaattaattaacatttggctaatgaaggtgtacaaagagatatctaggaattacgtcccacagataacataagtgggttaagattagatgtgaatttattttagttcttggctaaagacttgttctttaatattcttttagcaaaaatgttgtttaaatgggaatctagaaatggttaaaattaaaatccttgctgtccttagtgaaactggagaatgatctataatagaaccagattttcaatccttttatgtttttctttttgttttattttttgtaacgatccctgtgagtttctgtc

SEQ ID NO: 1626 - DNA, 381 bp, Glycine max
  misc_feature (373)..(376): n is a, c, g, or t
cggcgggtttgttttgcagttgattcaagccaaagggaggttgaggaaaagtaagaaaatgttgcttccgttacaatgactgtaatgtatagttaaattaatactatcagctacatattttactttgggatgtgtgccacgtttgacgaactctgaaacaaacatgctcttattggttacttgctgagttatctgactctgatgatgaaattcgtggccctggttcacaggacgagttaaattgatcaagagcaggaacagagacaccgttttgcctgttaagatataagactctttccttgtacagtttttgcaccttttgttttcttagcgatttaggggcgaacaaagccccccaccaaagtgaaagaannnnctgca

SEQ ID NO: 1627 - DNA, 808 bp, Glycine max
  misc_feature (804)..(804): n is a, c, g, or t
gtgacccacgccactgaaacaatcaacctgttacaattttcaaatgttaggttagataagaaacataacacctgttaaagtaagcaatctttgtaaaactatgtgcaacagttcaaagcatcattattcattatgcatcatacattatagcttaccctaaaattcccaaaacatattttgccaggtaaccaagaactgttagagcccatgttgtctcagcctgtattcatgcaagcttagtcagagggaaaaaaattacacattgattatgcctgaattagaaagttagaaatttcattactgaccttttccccttgtggatacatctcttcaagaagctttacatcttcttctaattgaaacaactcctagaaaaatatgtgaaatggattagtaaataactactatcacgcaactatgaatacttcagcaactgtatactttctaccacaaactataacagcatgcatcaaattattacatggaaagcccaagctaacacctgtttcggaaaatttatatgataaatcaccaatatttgttgtttaccttctcaactcccttcacatttttacgaaactttctaccctttgaaccacttctttcttcctgatgtagtgcctcagctgctttttttagttctcttgcttttttacccagttcagtggcttcctacagtaaccagccaggaacaccataaatatagtatggcatatcatgtaaccaaatacacacataatcaacaatttaatatatctccttcagtaacaatacagcaccttgatatactgcgagcgagttatnacag

SEQ ID NO: 1628 - DNA, 470 bp, Glycine max
ggtgaggctgtacagccaatagaaaggtccttttgggctaaatacgtgagtatacaactacatgtttacatgctggcttgatctttaaagccataactataccttttttcccccaaaacaaaattataaatgtatgtacttctaaattaacattttcatctggaatctttctcgataccagtggatctacctgatccctcttggactcatagtaatgaatgccgtcactcaagctatgaatatgcctgaggaacaagctggcgggcaacctggtgctccaatacagcagcagccaggatctgcagtacagcgtggaccaagttctggtggtgtgcgtagaagatgataagtttgcttcctctacctcgcaagacattatttgagggcattggtaatcaatgtaatcttaggttgaccttttatgtagcattatttaataatcttaattgcatattagtagctctgtgccc

SEQ ID NO: 1629 - DNA, 713 bp, Glycine max
  misc_feature (625)..(626): n is a, c, g, or t
  misc_feature (638)..(639): n is a, c, g, or t
  misc_feature (646)..(647): n is a, c, g, or t
  misc_feature (657)..(657): n is a, c, g, or t
  misc_feature (659)..(666): n is a, c, g, or t
  misc_feature (668)..(670): n is a, c, g, or t
  misc_feature (672)..(672): n is a, c, g, or t
  misc_feature (675)..(675): n is a, c, g, or t
  misc_feature (677)..(679): n is a, c, g, or t
  misc_feature (686)..(686): n is a, c, g, or t
  misc_feature (688)..(693): n is a, c, g, or t
  misc_feature (695)..(697): n is a, c, g, or t
  misc_feature (703)..(705): n is a, c, g, or t
tgtctgcggatccaaccctccaggtttctttcctgtgctcctccgcgtgtggtgcaccctacgtcacgaggtttttgtagctaccaccagttcaccaccgtgagcaattcacatcgcaggtttcgaacgctttgtgctgcaaccgaaatcgaaaatcacagaaagaggagaagagagggagcatggctgatctctttacgtggctcatctccttcttcatccttattgccttaattgtactcgtcatttaccaggtcattccacaagccctaacttatgcttgttgcttccttgtgtttctttttttcgttttaatttcttgttaaagtcaacttagaagcaattttaagcgccccattttccgaagattggttctttagttcaagcattcaactgggtatatgtctacttgatccacatgcaactttgattgctgtggataacaaaaaaatgaagtcagttgatatttgaaaaaagtttaggaagaaaaagattacttaccaacttcaagagaagacacatgtgacgaaaattaggggtctgtgcctttgtgggttctcatctggtttctaaaagttttggacaatcttcagagtgaaggggatgtcttttgagtatttcttcnnaatatgttttcnntgggccnnatgcgtgtgncnnnnnnnnannntnctncnnntaaatanannnnnntnnnttttannnaaacatgg

SEQ ID NO: 1630 - DNA, 376 bp, Glycine max
tcttcggcattcggtgtgaggagactcagtgttctgatagcttggctacttctgatgctgaaaatcacagttccgaagccggtgttcagcttgtggaaagcttctcagcatgcagtgttgagtctgttcagccaactaaggtcgattccccccctagcagtgtgtcgacaaatggggtttcttccccttctgtgccagcaaactcagaatcatctgatgctgctgctgctgcttctaagtctcccattcaggagcaagtttcaggcaccaaagaggaccaaaatgtggatgccaaagatggtgagagtgattcctcatgtggggttcctattgattcattccctaagcctgttgtgagtgtgaacattgagcaaaa

SEQ ID NO: 1631 - DNA, 983 bp, Glycine max
  misc_feature (956)..(959): n is a, c, g, or t
ttttttcttagcctttttgcctttttcttaatgttttccttttcggtttgcttgtttagacagactcgcaatcgcaaaatcagagcgcaatgtcggcaaaggagctcgtgcagctcgaattcagagaaataaaatggtatttgtttcggtttctttgttcctattgtctcttgtgcgttgcattttttatttattttttcaaagtcactgattaggaattttttttgacagatacgagatcaaaaaagagctgctgttttgaaagaaaaacgagaactcagtgggtcgagaagtcctcctcgagtgatagtgagtgaatcatggctattcgttgaactgaattaacaatttgttttttggatactcattttacttatcttgtgttcgtcacaggttctcttcgccctctgtgcgtctgtggatttagaatcacttgctgatgatctcttgtcattattatctaaagatacgtgtgtggtgctgtcaggaaccgttgcttcttctgaatataggacaagaataacggtatatcggattgctgcctattattctgactataggacaagaattagtaattttattaagagatgttagtacatagtaaaaataggtttacgcttgtgttagataacattcttgcacgattcaataactttatgtagaatgcagtttttattgatcaactgttgaattatgactatctgttatgttgatgattgttagttcatgtcaaatcttacaaaaattgaaataccagaagaatataatcagatggtcattattttgatatattccaatggttcttatatgggtgtgcaatgcttccttggtatgtgcgttgtaagcactgagtcatgaatttggatgaatatttacatagatacatcagggattatgaagcttggaatttgttcatttttgtatgttagaacataggcctccacctggttaatcgnnnntaatcacaaaattgtaatctatgc

SEQ ID NO: 1632 - DNA, 273 bp, Glycine max
aagtaatcgaaagaaaagaaacaagtgttaaaccatgcaattctttggcttttgttccgcttaatttgcatacatgtatgctaattactcaaaggaatcccagcaagactgagaaccatcaaataataaaagaaatggaaaaactccacactgttatttcaagccctccatccccctaatttctccatttgacaattgaatcagttctttgccttgacagagttattctccttgatccttgctcgggtatccagcttaacaaagcgtttaaaa

SEQ ID NO: 1633 - DNA, 457 bp, Glycine max
tgtatcctgatttggacacctgtttacatgatgagatggcggttacaacctttaaaggacctcctagtgagtgttgtgggaatgggaaaatggaaagaaagccttctgggaggagacgtgtgtttgttcagactgaaactgggtgtgttttgggaatggaattagatagaagggacaatgcccatactgtgaaaaggaaattgcaggttgccttcaatgtcccaactgaggcaagctcgcttatatgtggggacatggtcttgaagaatgacctaagtgtggttagaaatgattctccacttctactcactaggacctttttacataggagttcatctaccccttgcctttcacctactggcagggatcttctgcagagggatcagagtggaccaattgaggttataggttgcaaccgccatctcatcatgtaaacaggtgtccaaatcaggataca

SEQ ID NO: 1634 - DNA, 464 bp, Glycine max
aaagaagctaccgctgtcactgcaggagaccttgacagatgcatttgcaaagattcctgtttcttcttttcctgcagttcctagcggaaaaggtaaggggttaaccataaaaaaagcattcactccatcactatcaccttatgcatttaatgtgaatcaatgatcttcatggccaaaagcactaacatgtaaaaaatactttggtagtaattgaaattctagcagacacacccgttggtgaagcagttaagattctatctgaaagcaacattttagcagctccagttaaagacccagatgcatctaatagttcagattggagaagtaggtatcttggcatcatagattattcagccatcattctctgggtgctggagggtgcagaacttgcacaagctgcactattggcaggtacagcaacagctgctggagttggtgcaggagctgctggtgctttgggagca

SEQ ID NO: 1635 - DNA, 369 bp, Glycine max
ctccccactctcactccaaactcaatcaactcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccgccacagccacagccacagccgacaccagatactt

SEQ ID NO: 1636 - DNA, 271 bp, Glycine max
atttaatagcacacagattaactcctaattaagttcacttcgcactacatttatacaagagaaggaatgaaacgaaagtgtccgcactccacacaatgaagctattagaagaaagacataagcactcaatcaaggtagttgatgagcacaagcagcaaaacaaagagcaagaactccacagaagcagcattagcacgaacagaagttgcagcagcagagaaacttccagtggtagtgttggtggtcagaacaagaaccatccaatcatcaa

SEQ ID NO: 1637 - DNA, 635 bp, Glycine max
  misc_feature (52)..(57): n is a, c, g, or t
  misc_feature (590)..(592): n is a, c, g, or t
  misc_feature (594)..(606): n is a, c, g, or t
  misc_feature (608)..(608): n is a, c, g, or t
  misc_feature (614)..(620): n is a, c, g, or t
tcttgcttctttcttccctgtccttgctgggaaaatcaccactgaaattggnnnnnntgcaaccgctgcaaagtggttcaacctctttgcaacacaacttcatcatgttcaaaaccttactgatagagtacatggaaccaagctgcatcaaggtgaagactggcatcacaacgagacagtcaaacactggacttataccataggtaattaaacttctaataactatattaatatgcaaattaaaatgggtagactatttttttctcttaagtttggatatatttttagtctctatagggccattttattacaaattagagaataatgattctgatatatgataatttagttttttttttttacaaaatttgaaaaaaagcataaactaatttatatttgcttacaatcataaaaattgctgtttttttaaaaaaaaaaattacttgattctttaaaaaattattcaaaatgacctataattcaatcaaatttatattcttttccttttttataaaattaaccttaaagaataataaatccttttttcctttttggaaccataaaaaaaaaaggatcttatttttgttccnnntnnnnnnnnnnnnnanccaaannnnnnngttacacctggttgg

SEQ ID NO: 1638 - DNA, 382 bp, Glycine max
ttccatggtgaaatgtcatcatggccttttatggctttagaggccattttcattgcctatttgtactcagttttcatcaccattgacacaattgtgagctgcaagttttacaaaagctgcaaggtgggattgaggggtgatcaggaagacaagcattttatgaggattgaattcccagaggaagacagttgtggttacttggtattgaagaattttgaagaactaccttaagtaacataaggtagcatattgttgtcatcaatcaatttggccaaggtttttctgcttattttctcaaaagggaaggagctacaagttattcaaaatatatagatgcatttgaaaattccttcatgttactgaaaccaaatcgagcaacaca

SEQ ID NO: 1639 - DNA, 360 bp, Glycine max
gatctggtgtgagatatttgtccatttagctttgattttcgtcatggagttatgttcaaacaaatctattgatttttttttcattttacatgatatccagagtttagtattatatccaatgctcaaatatccaatgattaattataccttcagctacaagaaagtacaaagccttttgtaccatatacatgtaattctaacttgcctgtttgcaaggattgggttcatagatacattcaaaagaaggggttatattggaacatgaatttagatatataattatgaactttttgtttgtcactgtagttgttaatcttgttgtaaattccataacaatattaatgactcgtggccaccaaa

SEQ ID NO: 1640 - DNA, 306 bp, Glycine max
ttaggtaaccaactagatgaaacacgtccaaatcctgcaatatgaaagcatgagttttcacttctaggaagccaaattactgcacttaaaaagcacctccacaaaaacacacttcattgtagacttggaatgttctgaagatgcaagatgcttagcttccattacttcttgccctgcttctttcctttcttcttatctctcttacttgatggccttggccgagacctctgttttgcaaccttcttgaaagatttcttattacttataggtaccccttgccttttatcagacacaacagaaggaggg

SEQ ID NO: 1641 - DNA, 606 bp, Glycine max
gtgatgaattcccgctggaagctccgaggattacacgtttgtgacataccatgtacctaacaacaagaccatcactaaggtttattatgatggcggtgaaggtggaattctaacacatggctactataatattaataataataacaacaacaacgttggtgttggtggtgttagaagaatcccaccaacgcaaactttaattgaagaagatgaacagtcatatcccacctcggattttctcagctcgtgtcacttgtgccgaaagaatctcgatggcaaagacatatacatgtacaggtacttcgaaattcaaatttcaaagtccttctttgctcaaaatttgatcattttatttattatttattcaattttttttagttatagacaaagttttaaaaaacggttcgccaccatgatttacaccgcaacgcatttaatatcaacaaaggcgatgaaacagatatttaaaaccttggttatgggatttaatttggactaatgatttgattttgtattggtgtgtgcagaggagagaaagcattttgtagcaacgagtgccgttcaaggcaaatatcgatggacgatgaacgcaaagaacggtgtaga

SEQ ID NO: 1642 - DNA, 365 bp, Glycine max
ccttgtagcagacaggctctctttattagttcaaaccacttctgctgtcatcattgcaatgatcataggccttgccgtggcttggaagctagctcttgttatgatagcagtgcaaccactcacaatcctttgcttttatacaagaaaagtgttgctctctacactctcaacaaaatttgttaaggcacagaatcaaagtacacaaattgcagtggaggcagtttataatcacagaattgtgacatcatttgggagcattacaaaagtgctacggctatttgatgaggcgcaagaggcgccgaggaaggaggcgaggaagaagtcatggctagctggcataggaatgggttctgctcagtgtctta

SEQ ID NO: 1643 - DNA, 770 bp, Glycine max
  misc_feature (734)..(754): n is a, c, g, or t
ctcagtaagttcttatgtttagaaagtgcagctgttggttggtggcatgaatttgtttgttagtaatattggtgtatttcaaccgttgtatagtgtttcaatggcatagactcacataactgaataatatgcatgtagtattctgatgatgtttttattgacaaattcaggtcaatgtggctcttatggggtttctagtcgagaaaatttaagtgaaagtagattgatggatctccttcatggttcagaatatgttcttacctatgaagacaaggacggagattggatgctagttggtgatgttccgtgggagtaagtgcattttctgacttagtttctaggagaatgtttcggattttcactaatttgatagacaataatttctaggacatatctgaaatgatcttattcttcttttcaggatgttcactgagtcttgcaagaggctgaggataatgaagagttttgaagcaattgggctaggtaggtccaacgttcgttttaattaatctgttatactctgctttccttcgtttatatagttgtagaattgagaaaacaggaaactcatcaatcaaactggaaaacagaatcctggtttggtaaacacaattgtactccatagttaatgctttgactttagtttcatgtttctttaattttattagttagttatttataatgtttttttagggcgagttatatataacattaaattgatatattgtcttaannnnnnnnnnnnnnnnnnnnntgttgcatatattatt

SEQ ID NO: 1644 - DNA, 418 bp, Glycine max
  misc_feature (382)..(388): n is a, c, g, or t
tttatacagaagcaataagaatggtcctaatcgaccacgaacagattaaatctatgatgatggttgcagttgccggcatgttgctcagcaattcgtcctacactgcgagctttttttttttatttttttaacagagctcgttggccccttcatcttgaaaagtttcttctgcagagtgtaaaaaggtgaacagagggtgattggcctcttgggtagcttctacaactttagcgcctcaaaaatgttctttgatgccacaatggcactatatttgattttacttgtaacttgtgtattatttcataattacttatataggattttagagtaaattaaatgttatatacgttgctgtgccacaatcatgtatggactgacgtgnnnnnnngctgtgccacaatcatgtatggactgacgt

SEQ ID NO: 1645 - DNA, 662 bp, Glycine max
  misc_feature (590)..(590): n is a, c, g, or t
  misc_feature (592)..(594): n is a, c, g, or t
  misc_feature (606)..(606): n is a, c, g, or t
  misc_feature (611)..(611): n is a, c, g, or t
  misc_feature (635)..(637): n is a, c, g, or t
  misc_feature (639)..(640): n is a, c, g, or t
cgaggatgaaggaggaccagaattggatctctcaaaaagaaggcacttaatgcatcctccaaattcaaacacactcttagaaagaagagtagcaggaggaaaagcgatggccgtgttagctccgtttcaattgaggacgttcgcgatttcgaggagctccaggctgtcgacgcctttcgccaatccttgatcatggacgaattgctccccgaagcctttgatgattaccatatgatgttaaggtaacaacctcccccacaagaatttcagtagcaaaaaaggtattacatgtaccaaggttttaaattgccgtccgtagtctcaatttcgttacattccttgatattgtgggaaattggggacaattggggctgatgcggccacaattgtggttgtgaatactccaaaaaccttgacttatggccgaaatggaccgattattaaaaccttgatgtgtagtgctgtgtgcacatgctaatgttcttgaaaaaaattaagaatggaaccctattttggtgttatattacttatgattttggacgaatgaacttatacctggaatttcttaattattgattttaaagattttngnnngcgagggagttngatantgaaaaggcaaagcatatgtggannnanntgctacaatgaaggagggagtt

SEQ ID NO: 1646 - DNA, 447 bp, Glycine max
taaacacattctgcatcataaacgcgatcaatcttgttccgtaaaatctttaattcatcatccatcatctggcacttaggaatttgttaatggattaattattcatgcaattctgctacaggatcatgccaatttcatgtctttgttgaatatggattcagagatgcttgaacttcttctagagttcgccccttcgtctctggtactagttttgccacgaatagaatggtgaagccacatatgctagagaatatgaaaaaggttcctggccaaacataaatgaatttttgttttcttcattttttgtcctttttgccttcttttttgagggaggagtaagtattatcacaaggagttgagacttgagagtaaatgcgaacctacccgcggaactccaactcatgaggaagttaaaagcatatgatacaatccaagaacacaaccagc

SEQ ID NO: 1647 - DNA, 507 bp, Glycine max
ttttacataaaacaatttttcaccaaaacagggtagtattatgttcttgaagaaaatagatgatacagataatcctgttgggctagccatggctcgttatatattgtagtgtatattcactatgtgaaaattaaataatagatctgtctatagcgctgttcagtcgctaaagggaggcaaaacatctatacattaacaaaattgagatcgaaaacagcaaagctgtaaattttcagcatttatagttcatcttaagacaacattcaatttgctctgcacctgttctcttactttccactgcattgacaaggggaaaaacaagtgttggtaactttcaaaacaaaatatgacaacataggacctagactagttatgattgcactagtatttctaattatatttaatacctgcagatcgtttatttcctcatcagtgagagaacgttccatagacctatatgcaatcctatagcagtggctggtcattcctttcttgttggtgaagttg

SEQ ID NO: 1648 - DNA, 361 bp, Glycine max
ttctgataacggctccatggagaagatgatgaaggactcgttggaggagtgcgagcgtgcaccgagtagcggcgagacaaaacgctgcgttgggtcgctcgaggacatgatcgactttgcaacctctgttttgggtcgaaacgtcgccgttcggactacccagaacgtgaacgggtccaagaagagtgtggtggtggggcccgtcaggggaatcaacggtggtaaagtcacccaatcagtgtcgtgccaccagagcctgttcccttacctgctctactactgccacgcggttcctaaggttcgggtctacgaagcggatcttctcgacccgaaaacaaaagctaagattaaccgcggagtt

SEQ ID NO: 1649 - DNA, 824 bp, Glycine max
  misc_feature (68)..(69): n is a, c, g, or t
  misc_feature (757)..(758): n is a, c, g, or t
  misc_feature (783)..(783): n is a, c, g, or t
  misc_feature (789)..(793): n is a, c, g, or t
  misc_feature (798)..(807): n is a, c, g, or t
tttatgcatgtcataatctgatgtaattgttctaactattttccaaaaataaataaaagctattgctnnttaatccattatcttaagtttacatcattaatttggataaggtttgtttgatttgacctgatacttttaattataaaagtcattccttactctcaatttgttattgttttttttatttttaaccttttattttgaaaatagtaaaaaaatattgttttcacaattttctatataaatatttaaaaattaaataaaaatatcatttttgtaattaaaagaaaaaatgtagaaaatattttcttgaagaaaattaacatgccttaattttctttgctcgggatcaacttctttcaattgcaaattaaaatccgacttcataatttgtgaaatgcatatataatttcaaaacataatgtcaatataatttgtttactaactcgatcgaggctgagtcttttaggtttgttctttcaaaatttgaagaaattttcagcaagcatgctcgaacacacccaaattctttaacatctgatgaattgatggggatgcttgtggcaaatagagttcctaaggattacgctggatggtaataataattctttcatatattagtaatattactgagtgaatttttttcatatattagtaatttacaagtgaatatataaatgaatcactcaagttgttattatttgatgtaggcttgctagctacacggagtggaagatcctatatgtttcttggcaannacaaggatggtttactgcacaaaanaactannnnngctgnnnnnnnnnnaacctcttttgaaaaat

SEQ ID NO: 1650 - DNA, 970 bp, Glycine max
  misc_feature (519)..(521): n is a, c, g, or t
  misc_feature (590)..(594): n is a, c, g, or t
  misc_feature (655)..(657): n is a, c, g, or t
  misc_feature (757)..(760): n is a, c, g, or t
  misc_feature (768)..(772): n is a, c, g, or t
  misc_feature (785)..(785): n is a, c, g, or t
  misc_feature (871)..(879): n is a, c, g, or t
  misc_feature (911)..(923): n is a, c, g, or t
  misc_feature (963)..(965): n is a, c, g, or t
agaagatctgctctacaatgccggagccaccgtcggcgttctcggcggcggttacgctctcgtccgtgcctttgatgaactcactcggagaaacatcctccaacaggtatacttttagtgggtgtttggaaaagattaataaacgtggatccaagcttctctctccacgtccttagtttaaaatgcgtaaaaactatgagattagcttctcattttcgtgaatcgattctgtagatacgggaaaacaaacatgctattagtttatttgatgcttgcatgcacatacacagtttccaaaaccgaatctgtctacaaagttcagataaatttcttcgtaaatatttataaaaatgaattgattttagttcgtgaactaaaattaactagtacacttttgcttttggagaaattaaacaagagaattaaatggcataatttgatcttaacttgggaaaaaaaaagtcccaattcattttatctttatattatttttctataaatgtttacaaagtaatttannnaatcagacccataaggtataagttaactaacacatgtttgtgttgccattggaatttctgtagcagtcnnnnnaatccaaatttaaggtataagttacaaaatgtatccttttgcaaacctaggatgtttgttnnncggtttcaattcgggttttgggtcttatttttttatttgtgtgttggtgcttagctatgatgtgactcattgggttagtgaaaattgattgggcagggtnnnngcagaaannnnnttcatatattgtntggcttgctttttctggtttcttggccaattttcaggtatcccatttcttcaattttttaatctttcatacgaggaaggtgtgtgnnnnnnnnngcattgattgctgctgctgctgcattctttgnnnnnnnnnnnnnattgctaggatagcaactcccctaaggctcgctactttgnnnctttg

SEQ ID NO: 1651 - DNA, 366 bp, Glycine max
  misc_feature (24)..(26): n is a, c, g, or t
  misc_feature (358)..(358): n is a, c, g, or t
  misc_feature (360)..(360): n is a, c, g, or t
  misc_feature (363)..(363): n is a, c, g, or t
cttaattttataataataaaaaannngctttgaggctataattagaagttctgaatcagaggaaattagtttctgaattatactgcatgataaattaagtcattaggaatgaagggttcgaacatttgaataacttcaaaatctcattaccaccattttaccataaaaaactaaactacatgaccaattggcaattgtcgattgaatcgaccctattcataaattttatatacgagaaatgagaagaaaaaaaaaaaacaagtcaatttaatgcgacaaattcacaactttcatgagttatacacacacaacagtgacatttatttaaataaattgctcttgaacaaaataaaccaancnccncca

SEQ ID NO: 1652 - DNA, 928 bp, Glycine max
  misc_feature (904)..(922): n is a, c, g, or t
tgcatttgagcacatccaatctccactacgccattgctttgctctaacaggtacaataggtaaaaatgtatttaaattgtgaatctagaaaagtatgatagctctttaaagtgtttagatggagtgatgtacaattacaaaatatatacatgtcttcactcttcaataatattacatgaagcttgagggagaggaattagttacccttttccaatgagagcaggtgtagaaacttgaggtggaagcaatgtggccaatggcaaacttggagctgtacttgagttcatgctgggataagaggggaagactccaggttttggatctgcaccggtccctaccactagatctaaacttgtatatgtttgctgctgatcatttgtctgcaaagtaagtaagactgtaagaggattttataactgtcaaaacagaattttgaaaccacagcagtggatcagaaattaactaaaaagcaaagtccttacagttcctacattcaatctcttgttatcccagtcataaaccaactcttcagaagctaaccgctttgtcccaagtgcttcacaccaaaaagtggaaacagcatgaagtttaacatcaattgctacaaattgataatcaatcttgatattctataaccaaaaatattcttataagtgcaatgagccccaagaggattatctatagacaacagagcaccataagagggtatgttctatgactagtgcactggcacatagtatctattgatagaagacacagcttaggaattttgcaactacaaggctacaatacaaaggaaggaagccataccaggtggaaaagcattgcattttttacactgcaaacaatttcaacattgaatcagaaaaataatgaatacttcaactcttgtataatgtaagcnnnnnnnnnnnnnnnnnnnagaatc

SEQ ID NO: 1653 - DNA, 405 bp, Glycine max
  misc_feature (391)..(395): n is a, c, g, or t
tcgaggagaactttatagtcactttctttggcgaggttgaggcctcgcacggcgagcacgatctctttgtggtcgtggtcgaggtagattacgtagggcggcgcgtggccgagcgtgtcctcgtaggtcacgcgcttgatgatgcagtcggggttgaggcggtggttgggggtacggagatcgggctcgtagttggcgaggatgaggcggcagacgcgtgggaccgggtcgaactcgtcggcggtggcggagggccacgtggcgctgtcgtagctgcccacgtaggtgcagcgcttccacagccaccgcgcgcagcccagcacgaacacacactccaccaccccgcatgacgcagacatggaaatggaatgtaactataaagtttttcttnnnnngcggtttggg

SEQ ID NO: 1654 - DNA, 387 bp, Glycine max
ccggaccaggtggcacaacacgataattcattcaagacgaatcaaagttaagagaaactaaaatatatatacattgaggtctctaaaaacccatttcccaggtcagcaatacattgaatcatgttgaaaagaaagccttggtgacttccctgatgatccagtcgcaaggtcacatatttatctacataattgggtcgctacaaaagactaagagtctctataacaatctcaaagtactaacctactactatatcagaaagttacagatcaccgataaatattaacataatactaagggaagtggatattacatacactatctttgttagcatagacaatttcatttatcaaaatatcatttcttctcatttgcacacagtcttaagc

SEQ ID NO: 1655 - DNA, 382 bp, Glycine max
attcctattcagtgataaatagaaaacttaagcaagaaagtcccttgatcacgccccttgataagtataattaattgacttgagtgtctaacaatttacccctaggcataaatatcattggttgttctcttcattcagaatccgattgaatttccccattacaatcaaatgaatagaatcatgcactcccgtaggcataaatatcattggttgcttctgatcgacgtgtgatatgtttgacttcttcggattgaaccccttttgttcttagcttcaaagcttctaagatttccctagtgtagttacttgtgaactcttttccacttgattagaattcaacaaagttcttacaaatcataagcaaacaatccaaggatcaagc

SEQ ID NO: 1656 - DNA, 146 bp, Glycine max
  misc_feature (140)..(140): n is a, c, g, or t
ataccagtgtttcgaacccatttgtgaagcactgcctcaaacttcgcaattcctcttcttatcgtcgctctcatgcttctgctattgttgtgggtgctacccctataaggtctcatgtcttcccctctgtttttctttcnatcctc

SEQ ID NO: 1657 - DNA, 1029 bp, Glycine max
  misc_feature (65)..(67): n is a, c, g, or t
taacaaagttttatcctactagataaaatctattacattaattatacatcaatcaactcaattgnnnattaaatcttcagaaatattatttataaaataaaaatgcatgattgtctattataatgggaaatagaaaaagggaaacgaaaaacccggataacacataatctccaatgtctacaaattagtagacaaaatgctgagcaactacaagatttattttcattgtgaactgaataacgctttgctaattatgcctgtggcttcaatatatcgatcaacgcatctagagatgcaactgctttcactcccaccgaggcttgaacctggttttgtaacacacttctcaaaacactttcttcccacagtctgcaaaataaatgacaatgagaaggtgactggaattgtagatagcagatgagacactgaacaaaatcagtacttaataattatccactgtttgcaaaataaatggcaatctccgggtattgtgccaacgctgaagacattttttcaagaatttgcaagtggctagagcaaaccaattgcacctcgagactttttcagatatttgaaagcaccagttatccacagctggtaataaaaaacgattcatgtagaagaaacatatcaatgactaagtgccattagatatgatgaggaaaccatcatcaatctcatatacctaggccaatcttcgcaatctacattaacaatagcaactaccaagaggtaaactattgttaatctttaaagggaaaatattgctcatgaaacagaagaaatgataaaaagaaaataataaacaattagagagattgtgcccttcatggcctaaatttcctatgcctctcctctactcccatgccggatatcccaattcccattactatttcctccttccacccaccgatgtcttctcctttctcctagcgtgacccctattcctcactcgaactactttcattgaaaaaaagtgaatagagctattaggttatgaatcagattatttcttcctagttctagccc

SEQ ID NO: 1658 - DNA, 570 bp, Glycine max
cagaaagaggagcacccataacttcaagaatcccagccgacgtgttaagtttcgtcatggccattctataggctttatccgggttgatcgtgagcctcgcacggatatacaagccctaaaagacacaacacacatataacaattagacaatgctgcatcccatacaccattcattcattcataacaagttccaccagcagcagcactttcaatccaaaatgaaggagcctagagcatgtattgaataataataattgaagtagcctagagcatgtgaaagaacttaacttacagtaaaagcaacgatagcagatgaaagggcaaggaagccatacttggccatgccttcggagagtccaacgaagaggttagcgatcccgaaaaggatcctccacagaaaagcgcagaggacaacgccaccggcgccccacagaaagagagtattcctcttgaagaacgcctcgatttgcagcccaattgcctcgcggtaacgcgagaaggccgaggtcaccgcggcggccggtttatcaaatgccttctgcgcaaagcctttgtcgaaattggatgaga

SEQ ID NO: 1659 - DNA, 685 bp, Glycine max
  misc_feature (56)..(56): n is a, c, g, or t
  misc_feature (58)..(58): n is a, c, g, or t
  misc_feature (659)..(664): n is a, c, g, or t
  misc_feature (668)..(674): n is a, c, g, or t
  misc_feature (676)..(676): n is a, c, g, or t
  misc_feature (681)..(682): n is a, c, g, or t
agtttgccaagaaggagcaatggaaggttgctactttcccatcttcccagtatagngntgccccacagtccaatatcaccccatctttgttaagtacaggttcatatgaagcaactactgttttaggcaattcgtagttggcagccaacaggattgccctaatacaataccatcctgcatcacccagagaaccaagagcatcaagatccgacttcacgcgaatgttggtgtttagataatcaggatcggctgcaaatgtaaagcaagtgcgaacctgtacaacccaaaacacaacaccgctcatcaataaacaccatcataaaatcaatctttgaaaacatatataccttcctctgtggaatgaatgccctttgagttatttattcagcagctccttttagaagttaggccaagcaaatatggcaatcaaaatactcaatgaactcttgcattgcaactgcagctaaaaactttaatgaatcccaatttatattaatcaagaacctccaaactggacaataaataaatggcacaaggaccccatttgttcaacagtacgcaagtctcatcacaattgtcgtgtaaaaaaaactattcccaaaataattgtcattttaactttatatcccttgtaatattaagattaagggtagacaacnnnnnntaannnnnnntntatcnntga

SEQ ID NO: 1660 - DNA, 439 bp, Glycine max
ttgcttcacagagatccgttccacgtggaggcctatcgcggcctcttaatgctgacttcagagacaaacaagccaacggaggaactattgaagagaatcgaagaggccgccgcgaaggtttgcgaggaacaagagagggattccgatgtgagggaccttaagttgttgattgcgcagataaaggttatcaatggggatttatccgaagcactgaaggtgtatgaggagcttgttaaggaagagcctaaggattttagaccttacttgtgtcagggtattgtgtattccatgctgagaaagaaggatgaagctgagaaacagtttgagaagtatcgtgctcttgtcccagaggatcatccttataagcatcattttgaggaaaatactcagtttttggagaggagaggagtaggtggtgcaaagagctgagattgagagt

SEQ ID NO: 1661 - DNA, 359 bp, Glycine max
aaaatggaataaaaataaaaatagaaactttaaatctactctgacaaagacagaggttttgtaccttaaagggtagtagcattcactcaacatcatctgaaaagaggttaaaaaaacaactcaaaatctccaactgaagtcaaagatccacagcttaagcaagttgaaattttcaaaataataataaaatgacaaccctatttgtttgcccaagaatggggttataaatcaagctgaactagcaccagttccaattagtttttttttttgtttttttgggcaaatttcttttcaaaattttcaaaattttaagcttttccaaaattgaaagcaaggaaaaaacataccggagggggtaa

SEQ ID NO: 1662 - DNA, 663 bp, Glycine max
  misc_feature (656)..(656): n is a, c, g, or t
tgactcatggcaaaaaagacaagccaaaagctcccccatcacagctcattttatatttgcaatctaggtcaatggatatgaaagaaaatcatcgcattataaaatgcatccgtgaaacccatcaagctcttcaaatttactcttcaattcagcatgcattgaacacttatggtccaggagtatcaaaggtttgtttttatttcatgtgtttccttaaacactcatttgtatatttttagttcctcctgcaattgaaaggtacctaggggctttaacttatttggttgagcagagtgcgtgaattgttgtaaatcccctgggacctgtatccgattcctatggattaaaaagaaaactgacactgaaaaactttcgcgactccaaacaaaacatgcttatgcatcatatatttgttcccaatgtttacagagttcttacttctgagtgaaactattttgcgttgttatttcagggagttctgaaaaataaagtggcaaagccatattcaccccatgttgatgcccgtagtgttgacctatccccccaacagatgcctggatcagtccctctctcctcaacttttggaagcagtgcccgtgactaggactatacattgttcatcacattcaacatagtcaagtccctatctaaacagnccctgtg

SEQ ID NO: 1663 - DNA, 1250 bp, Glycine max
  misc_feature (1171)..(1175): n is a, c, g, or t
  misc_feature (1210)..(1219): n is a, c, g, or t
gtctgtgcttgtgcttctatcatttgcatctttgttcgttttatagcagctgggattcgttttcgaatttcaaatacatggttgttttcttcttcgtcctattatatcatgtatgtttgtaccaaaaaaatatcatgtattacgtatgttcgttctatgtatgttgccaccacccatcatttagaattcagaaatctctttagcgttagttaaatatcgcactcgtatcaattctttccaactccccaagagcatagattatgctccttccatatttgatggatgcatcatgcatcaataccccctccctctttgttttaaagcaaaattgttggttttttatttttattttctggttgagatcaaagtcatgtagaacaagggaagagatgaggttggattttgcacccaaaaggtttatgatatgtctaattctttgtccttattttcacatttctgtcttcttctttaactagtaaccatgtggtttaaaattggatccttgctatcctcattctttcaaatattgtctatgttttaagtcaaaagggctgggggcatgtcaaatatataaaccattcagatagctttggaatagttagttcggacatggtctgtgatagaaagtttagtatactcgcaaattctaattattaaccaaacttttctctcatttccttcatgttgtgccagcagcatgagttctctcaccagtcttgctccactcgaagcagtgctctttgatgttgatggaactctctgtgattctgatccactccactattatgctttgcgtgaaatgctccaagaggtactgttccttttcttagacgaagaaaagttttaatgcaaaaatatttagaaaataattatagttgttctgttgcaatattccttttgtgatatttccaaataaccatcactaagtacatgatcaatagctattagtaaactaacaagaacctcttggtggttgtcagcttggttttaatggaggtgctcctataacagaggaattctttgttgagacattttctggcaagcacagtgatgatactgccttggttgtctttcctggtgatctggaacgaggtttaaagtttgtagaagataaggaagccatgttccggaggtaaaccatgttcactttcttttactttctctccacccnnnnnccatgtggtccatttgaagcctcagcagttaattnnnnnnnnnnctatccagattggcttcagagcaactgaatc

SEQ ID NO: 1664 - DNA, 385 bp, Glycine max
tttccagtgaagatttggagtaggaaactagatgttactgaaaagatgcgtggtaatcaaatcataatttaaagataacataatcaaagtgtaggataataatactcaaaaggccgtgcattgataattgggtgcagagaaattatattttgtgggagctatttacagaagttaacatgcattatgcctagtgggatccgaaggtgttctctccactgtaagtcatgtaaagaaagccatcttgatccttattttcttcataaatagcagacatcaatgcagctgcaacaacaagggatttagtacataaaatcattgctataaaggtaaaataaaaatcatttggcatgactggatacttaccagttggaggcagagtgttatt

SEQ ID NO: 1665 - DNA, 385 bp, Glycine max
attttgagacagctgctgaggagaccaaggctgcttcttagattgtgccatcgctaaatatctcctgtgttttaattttttcttcttcttgattttccattttaagtatttcaggtgtttggttctcctgtcatatactttaaacagttcaaatactctattaaatctgctttccttcatctaactaggtattcagtttttgactgcacctgtcatcctcaacaccgtttcagtttatcagcattattcgtggttcggtagttaatgtaaggggtattcaattcctgtcccgtctcactaatctggcttgatttgaagttagttttgatggatttgagttctaaaccaacgtgtttttggtacgagttggttatgatttgggtca

SEQ ID NO: 1666 - DNA, 413 bp, Glycine max
aggagcagcaaaaggcctctaagaagaagaaaaaacataacagaatatatatgaaggagcttgctttggcttttcttcttctaacagcctcagcaaggagtcttctctctgctcaagggattcacttctactttttgttattccagggaatatcattcttgttggttggtctagacttgattggtgaacaggtggactgaaagaaaaataaaaatgaaaaaatttgacaggacagtgtacttttacatgcacggaaaagcacaaaggtgcgaaagccaggccttatgaaattactgaagacacttatttgggggcaatggagagtgtagaggaggacggacccataatgctgctttttcttgctcatgctcctccctccaagctcgtaaatcaaatcccacccaatacgatac

SEQ ID NO: 1667 - DNA, 590 bp, Glycine max
  misc_feature (361)..(366): n is a, c, g, or t
  misc_feature (390)..(392): n is a, c, g, or t
  misc_feature (407)..(408): n is a, c, g, or t
  misc_feature (484)..(484): n is a, c, g, or t
ggtgatgacccggctcatgggctgagagggcgctatgtgagggcaaatagagcgtttaataaaagcggatcggtggttattgctggggatgaatatggggaggaagtagggtggaggcttagcaaagagatggaagggagtgtgctgaagtggagaatagggggagagttttgggttagctatttgcccaaccaagcaaagggttcttattttgaaactaggtacatcgagtggtgtgatgaagttgacttgcctcttattcatggaaaaacaacctaagcaaccacgcaatcatatcaaactttaaacccttctcacctaattataaccaccaaaagaggacgcacaagtttgtgtaaannnnnngggaggcctttggtttcttggttnnngcctgaaaagctaannttcttccaagctgaggtttgtccttgtccccccttttataatgtcaatattttgaatttgttgggtgttgttaatntggaattttgtttttttgggtggttgaatcagattgcgaagcgtagggataggctgctgaattacatgctttttctgaggataaccccgacattgccgaatctgtt

SEQ ID NO: 1668 - DNA, 292 bp, Glycine max
tgcttcatctgctccattatcgcgtcggatttcaggttggaagaagaatcagccatggcttcacaccaaacaaaggaaacctaacagtttgggtttggtttgatctgttattgagttggtgtgacaggaaccatcttctgatttgaactatcgagtaacttctctttttataatccctctgtttcgtcacgttacagttttgtgcattgaaagcgtttgattagaagagtgatgtatttaatgcttgtgagaataggataagattgggttcaggcccatctgccgcacgcgt

SEQ ID NO: 1669 - DNA, 706 bp, Glycine max
  misc_feature (56)..(60): n is a, c, g, or t
cattcttcgtcgaggtatgtggtgagtaaccaggactgagcattgctgttggaaannnnnatcttcaagggaggcctacttgaaattgttttcactaccgatgtggctgtgtcttggacagaggtaaggatgcctttgaaaggtgtaaggtcaatcttttgacccagaaattccacattttccggtatctctaatgagtccgtaagctgtggagtgccaattatgccttcctcaaactttatctagacaacatgcaagatgacaaaatgtcacttgtggagctaaatcaagatattaaactattacgatagtctaaacataaatgttaacaacacattcttttgaacacatcttttattattgattgaaatttattgaaaattacaaattagatggatccaacaactcatttaatgactctctctcccctactttttgtagttttcaataattttcaatcaataaaagggtgttagaaagaatatgctagagaatctcttgctaagactcctcatagtctaaatcaagatggtaaactaatatcatatgatagtcaaaattcaatttagtacaaacaaacctgcacacgttttggacttcgaacatcaaatttggcattagtactaattgaggtggtggccaaaggaccagcgaactgaacagagttttggacggtaaaattcagcgagtcaataatctgggataa

SEQ ID NO: 1670 - DNA, 349 bp, Glycine max
aaatttgtttgtctaataaccattttgaaggatccattccattagaacttggagaacttgaagatttaacttctgtagatctctcccaaaataattttattggtcttgttccatcatttgcaaattcttccgtggcatttatccatttgaacaacaatcgtttaagtggattgcccaaaagaatgttccatggaaaatcttctttagtgatgttagaccttagctacaatgaaatatctaacaaccttcaagatctgatacataaccttagttataaaaggttaaattttctccttttaaaaggtaatcactttatgggggatataccaaagcagatatgccagttgat

SEQ ID NO: 1671 - DNA, 713 bp, Glycine max
ccacacacgtgaaaaccttctatctgatttttcattttgttagagacaatgtttatcttatataaactggttttattaggtattttacaaggctgagttaggtgctaaccaaaattctctctgacttatgatctacgatttttcattttcatttcagacatcccatactgaccaatgatatagtcaaaataaaataaaatataagtgagagataacctttatcttataaactgattttgtagggttgaagtagatatttacgttcaaacataaaaatattctaaggtttttgcctaaaaataattgtaattgcagagagtagctagagacagaacaaaacctcaagtgtccaacttcctgcaaaccaaactgcaagatgatatccctgatgaggttctcaagtctggccaatctggcaccaatgggagggggtcctccctcacttaaatttggagcaaccacatccaatccatgacccaaggaaccaaataagaaaaactcagcctccaagtattctaaatttaagggaaattctaacagatcaacatctgattctgaagctgatgcacttgcaatgaacacagaagaagaagaatattcttgaaaaaggagggggaggactagagaggctagcaaaacaacaatagggactctgcctctagaaatttgaggtgccatgttttgttttaggttcttttttccaaagtgatgat

SEQ ID NO: 1672 - DNA, 704 bp, Glycine max
aggcaatatcatcctttccagaattagacagttcgtcatgaacaccattttggtggacttcttcaagtccatcagctggcaaaaggttgcttggatccatcatcaagctaagctacaatttacatggaaccaatgatcagcaacttagataatctaacacgagtgaaacaaaaatttgtaatcttacagaacaagttttacccttcatatgttgtttatttgaaaatttcatctttagccttgttagccagaatgatttaaaaaaatatctagaaaatcctcataattttctttactatccaaagaaccaaaagggattgtttccaatgtttctgaaaacaaaattttccagcctttgtatctaacggcaaggcaacttacccacttgaagaaagaaagatgggagtgatatgtaaaaacagcataccagtcaggtggtgtcatgagtttacataccagtcaaaatggtgaaagcaacataacacaagatgaaatgcaatatacaataaagattataaacagggcacatcaaagtcatggacattagggaataatgtggaacactctaggtagataaaaaaatgcatctaatctccacttggtggccaagtgcatgaagacaaattagaaagagggaccaaattgacttgcttataaagcacttcttaggtctaacgtctaagcaaccaaattgaaaaaaaaaa

SEQ ID NO: 1673 - DNA, 837 bp, Glycine max
atccctgcaaatgtacaagagcttgatcaaatcttcttgtcaatcattagaaaaaaagctaatttttttttaagtttttttaaaccaattcaaaacatcacacactaaatatggacacctcgaaaaaacaactaaataatgtaaccgagatggcacacaattcttaccgcgcgagtgaacctcattgacttgagatcattgcagtcaagtggttcatctggctttttcctctctcttatggccaaatgttctttctgtaacaaatattccacacgacttagcacataaaacataagaaattataagtgtaactattaatcatacctaaggaaccaagagagttttttcacttactctgagttcctcaagagctttgggatggtcatggaggtacttgactgccatcattgatgtagttgaaacagtttcatagccagaatacatgattgtaatcactagatcaatgatttcttcatcacttagtttgtatctactttcatctcttcccatcaagcaaccaagcatgtcatggtaggtttcatgtgatgctcttctttcctctaagagcttactcagaatgttcactatagtcttccttgcctgcaagaaacagtgaattaaataagcctatgacaaagtcttcttattatatgaagtagttataaattataataagcacaacaacgaaatagatcattcatcttcaatttccatgcaaactaacatgagaaaagatagtggtttcaaattctcccactaacaaaaactaacaattaataactaatatttgcggattaaaaaaaatgggtaaagatcaatgatcacacctgaatccac

SEQ ID NO: 1674 - DNA, 580 bp, Glycine max
ctgaggtaagacttaattttgggtactcgtttggggcttacttgacattcatttttgcacttacaatcattgacttgtataatatcttaggctatgcataattgtttttccataatccaagaagttgtgcaagaaatcaattgtttctgtgctttcttgtcatgatgtacttatactatattacatttttcttgtttcaggtctaattttcttggcaccaagtttataatttatgatacgcaacctccctacaacaatgctatgctgtctccacctggccgcagccgtaggttttcaaaaaaggtttctccaaaggtccctagcggcagctacaatattgcccaggtcacctatgagttgaatgtccttggtactagggggccacgaaggatgaattgcacaatgtactcaattcctgcatcatccatggagcctaatggcgttgtcccaggccagccagagctccttccccgtgcccttgaggattctttccggagtatatccttctcaaaatcaatcgacaattcaaccgagtttagcagctctaggttctctgacataatgggaactggcattgaag

SEQ ID NO: 1675 - DNA, 509 bp, Glycine max
cccctccgctcgccggagtttggaccttttgcctttgagatacatagctgctgacgtgtcagtcccggcgccggagaacagccggaagcgccggaagctggatcggtgcgtttcttccgcaagggagtgcgaaaacgcggttcagagttccaaatcgaaggtagctaaggctgttcggaattgttcttccaagattcttacgttggactcgacaagtccaacagtttacgaggggtgtctgaggtatggggtaacgtccgtttgtggaaggcggagagacatggaagacgccgtttcggtccgtccatcgttttgccaggaaaatttatctcaagatgataagaaagagtttcatttcttcgctgtcttcgacggccacggatgctcacatgtaaataaattgaattataaattcaaattactaatccttttattttactccgatctggttttttaattagtttttttttcttctttctataggtggcgactatgtgtaaggagaggtt

SEQ ID NO: 1676 - DNA, 477 bp, Glycine max
  misc_feature (399)..(399): n is a, c, g, or t
  misc_feature (403)..(403): n is a, c, g, or t
  misc_feature (436)..(447): n is a, c, g, or t
tgctgatatcttcgcaaatcatgaaatcgtaggttcaaacatggcataaaaaatgttgaaaatagaaaagctacatttcaggatattaaacaaggtcgatgcactgtgaatcatgtattgttggggaaccatgtttttgagacaactcaccatggaattcttttgggtttttttggggggaggggggagggggggatcattttcatcaaacaagcattcatataggtagctgtttgtactctgccaaaagttttggaatatcatccatgcgcaactgcaataggattaacgggagacaatgagaaaaataaaaaagagtattgtaaattaaacataaaaagggtatcaaagctatattttcagaatttttttaaaaaaaaaatgaaaaagcatatccangaanaaacaaaagcacaggtaaaagtgaatattaatnnnnnnnnnnnnactaaagtattacctgagtagcatttttta

SEQ ID NO: 1677 - DNA, 1184 bp, Glycine max
  misc_feature (1085)..(1091): n is a, c, g, or t
  misc_feature (1119)..(1131): n is a, c, g, or t
  misc_feature (1160)..(1162): n is a, c, g, or t
gtagatcagaactttcacatgagagcatgagatatatgatgatattataatactctggtattaaagctcctaataacttgaaaacccaaaatctgcttcattaataaaaccaaaataggggatacaaaagcattgtaaatttgcatgcatcaaatcgacagctggcattaagtaattcaaattcactcattgtgaacttctagtcttttaggcattcataactagtctattttcaaaattcaaacctaaactggccattgtactcactcggtctcatccattgtttcggtttatttacatttcaccaaattattactttccagctgaattcagccaaacctgtccactatattatatcattattcataaacaatactttaggcatgcagaaccacttttaccaggcacagacaaataacacaaagcaaacagcatattagcataccttctgcaatgtcatgaacaatagccattttaatgcacctgaaaaataaaaaacaagtttcagaaaacctacctcccatcctaatgttaacaggtgcattgcaaaaagaaatagtcattaataaaacatatatacagctgattcaaaaggaaggtggattaacttgtttcggtctacaccagggacatctgacgcaatcagagccatcaaactcattcgatacatatgatcggctatagattcaggattcttaacatcttttcgtacccaacctgttctctttgttgcctgtctcagataccaaacagaattcaaacaagttacagcactacaaattaaaagcaggaagaagaaaaaaaacgaaacagcacaagtgcaatcgagcttttatcagtgtgacacaacgccagtcaaataaaactgtgtttcattctcaaatcaagcttgggttaacacgcactgacaattttagcaatcaaaattaaacagccgttattatctctttaacttctgcggcatttctgagaaacgaataagtacataacttcaaaatacaaagctggtttacgaagaagcaccttgaggcggtggcagattgagaggaaatcaatggcagaggaagcagaaggagcgccgtcgnnnnnnnccgcggaagaaggtgaagcggccatgcnnnnnnnnnnnnngaaagtcgctgtggaaggtgcaacgggtnnnattaaggaaggcggcagaaaga

SEQ ID NO: 1678 - DNA, 365 bp, Glycine max
tcattccttctaagtgggacccaccttccaagtggactatcgttgagggtctaccagaaagaggactcgctgttaagcttgttggttaccaaaatagagtgtctggttggttcagtattgtgaaagttgctgatgatgcttcttcttcttctgtgggctataagcttgtgttctgtctatggccagaagaagaggtgatgattcacttatgtaagaatgttgggattcgtaccgatggtaagggaatcaggcgcttggtgctgtctgagaacactcctttagtcgttcagtttcagaaatttcgatctgcactggccctgaataatcatgtgctttctgccagtgagtgagagacatgctttggt

SEQ ID NO: 1679 - DNA, 979 bp, Glycine max
  misc_feature (912)..(917): n is a, c, g, or t
  misc_feature (923)..(926): n is a, c, g, or t
  misc_feature (932)..(934): n is a, c, g, or t
  misc_feature (950)..(952): n is a, c, g, or t
  misc_feature (958)..(960): n is a, c, g, or t
  misc_feature (968)..(968): n is a, c, g, or t
tacattggactccattgttgctggaaatgcgtggaaaggtatggacatgctgattttcaactcgtggcattggtggacccacactggaaaatctcaggggtatgcttgcttggtttatttagaatcaatcatcaataatagttactgcaaaaaatttaatgtctattaggataaagataaatacaaaatttcaacataatcttattacattaaaatttaacatgggagggtccattttaatgtagaattgcaagttcaaagtttttacagttagcatttgatagttgatactgctctgaatattacctcattcattcactgtcccttttgttttccgctctgaccaaacggcttttgatgatgttcatattttcaggtgggattatattagagatggacccaatcttgtgaagaacatggaccgtttggaggcctacaataaaggattaaccacttgggctaattgggttgatcagaatgttgatccctccaaaactaaagtcttctttcaaggcatttctcctacacactatcagtaagtaaccacttctctcttctttctctaaaaagttgattggagcaaaggcccaattttgctttgtagtttgttagatacgtatgattgagattagaacattagctaattttccataattatcaatagctaaaattcgtattcaaaattatcttgtttacaagattgatttaattgaaaatcaagcaaatatcaatgacaggttagacaaaatcacaagatgttaaatattgaagatcataaatataaaccgtttgtaatgaatattctagaaaactataaagaaattagaaaaaaatgggtgacaagttagaacattagaagcatttgatatatatgcaatattgaagaactgaaacgtatttatacgatatctnnnnnnctcaannnnggggcnnnggattggaatcaaccnnnaaagannnctgtagtngagagcttcaa

SEQ ID NO: 1680 - DNA, 706 bp, Glycine max
  misc_feature (30)..(31): n is a, c, g, or t
  misc_feature (480)..(481): n is a, c, g, or t
  misc_feature (497)..(501): n is a, c, g, or t
  misc_feature (515)..(516): n is a, c, g, or t
  misc_feature (518)..(518): n is a, c, g, or t
  misc_feature (528)..(530): n is a, c, g, or t
  misc_feature (562)..(562): n is a, c, g, or t
  misc_feature (564)..(566): n is a, c, g, or t
  misc_feature (568)..(575): n is a, c, g, or t
  misc_feature (581)..(581): n is a, c, g, or t
  misc_feature (592)..(601): n is a, c, g, or t
  misc_feature (605)..(613): n is a, c, g, or t
  misc_feature (616)..(636): n is a, c, g, or t
  misc_feature (641)..(641): n is a, c, g, or t
  misc_feature (643)..(645): n is a, c, g, or t
  misc_feature (650)..(654): n is a, c, g, or t
  misc_feature (656)..(656): n is a, c, g, or t
  misc_feature (659)..(662): n is a, c, g, or t
  misc_feature (667)..(670): n is a, c, g, or t
  misc_feature (690)..(692): n is a, c, g, or t
  misc_feature (699)..(702): n is a, c, g, or t
aaatcgcataataaccgtcctaagtttatnngagagaattttgcaagtgtgagaaacatggcatctcgtcaaaacaacaagcaagagcttgatgaaagagcaaggcaaggagagactgttgtcccgggtggaactggtggcaagagcctggaggctcagcaacaccttgctgaaggtttaaaatcaattttatatatatatatatggaacattaattttaattattttcgtatattttttttataattgtgttgcatatccatacaattattcatcataacacttacgttacatttctcctaattttttacttccttcaaattagttttattcatcatctatcatatctgtccatcagatttttgtctatattattcttcacgtaatttgttcatcatcttcattgaaatcattatcattatctatatcatactagtccatcacatttttatcgatttttcttttttactttcttttccnngttttttttttttttnnnnnaaaaaccctttttnnancccccaaagnnntttttttcccaaaaatcccccctttttttttncnnngnnnnnnnnaaaaantttttttgggnnnnnnnnnntttnnnnnnnnnttnnnnnnnnnnnnnnnnnnnnnggggntnnnttttnnnnngnggnnnnctttnnnnaaaaaggggggggggggggnnngaaaaannnnaaga

SEQ ID NO: 1681 - DNA, 459 bp, Glycine max
  misc_feature (373)..(374): n is a, c, g, or t
  misc_feature (417)..(417): n is a, c, g, or t
  misc_feature (440)..(441): n is a, c, g, or t
  misc_feature (447)..(448): n is a, c, g, or t
gctgccgcagctactgatgccccaaaaccttcagcacaagaattgaaggtagtgttaagctttgtcattggactcataattactttcaaatgacacgatccttaactgccattttctgttttgtcatttttgtgtgtggtggtggttggtgagggttgggggagggtacacgagggttagcgattggggcttaaggaaaggggtagtatgaaccttcatcctcatcaaggatcaggcatgtgggtgccatcatgacaaattcccaatggcatgtggaagccattttctgacactaaaactttttagaacatgttatccagtgcagtgtggaagcccaatgatattaaatttaaaagcggtaatgctctttctnntaatataattagtgtacatttacaccattcctttgagttcccnttatctatttttatccattttgnnacaaanntggggaggatt

SEQ ID NO: 1682 - DNA, 622 bp, Glycine max
gaaacaagctgaatttttttgccacagcaaaaccagcatgcattccatctactgctgcgctaatgatccctccagcatagcctgctccttcaccaactggatatagtccttttaccgaagtgcattcataagtgtcaccattgcgtggaatttggattggggaactagtcctagtctggaaccaaaacattgtttagcacaaacaaataacagttctgaagcaaagtatggataatcacttgctttatgcagaagttttaatcaacaacagcagactgaaccaggaagcagaagcagaggaataatttgcagaagtttggtaaatccataaatacagtagaacacatttatattagaccaaaccaaaatgaatagcatgtatttttattacctctacaccatgaaggagagcatcattgcagataaatcctggtaactggaaagttaaggagtctgaattaaaaaaatgtccatagtagttttgctggataaatttataaaagactatggaataataatttgaaggacatgggaaactgcaaacctccttgtcaaatgttacaagtgaatgtttcaaagcttcagttacatgaatgggaaatagttgatggaggtttgctac

SEQ ID NO: 1683 - DNA, 296 bp, Glycine max
tcatcaagcatagccgtttaaagaaactcagtttatggggttgcactggcttagatgtgagttttatatttagactaaagagtaaagacctttacgctcttctttccaatgcttctaatctttgtatcttctttttgattaatatgcaggccctatacttgaactgcccacgactcattgatctgaatctaaattcttgttcaaatttgcatcctggtaatcatttcatgctcctgttctttagtaattatcatgtgaaaatttaattcagcacttcaagagttcctttacaatgg

SEQ ID NO: 1684 - DNA, 425 bp, Glycine max
gtgtatgatgtagtattacacaaaccccaaaagttgatagcacaatacactaaccaatgatttatatgtacaagttcttggcttgccatgcattcatcccaccaactgtagaaataatatttgaaagcaagatgaaatcatacacttagcacacaaaataaagctccttcaatccgatttactttttgaggttgatttatcttcttttccaggctgcactagaaatttgaatgtccacactgctaaaatagttgcttctatgggagcaagccaatatacaaggaagtgctcctttgttatgtgatcgcctcgagcatatgcccatcccattacctgaacaagtcaaacaaggtttcttagcaataaaacaacaaaggtttcttctattctatggttcacaaaaccaaagtttttttttttttttt

SEQ ID NO: 1685 - DNA, 368 bp, Glycine max
  misc_feature (252)..(253): n is a, c, g, or t
  misc_feature (258)..(258): n is a, c, g, or t
  misc_feature (264)..(264): n is a, c, g, or t
  misc_feature (268)..(273): n is a, c, g, or t
  misc_feature (294)..(296): n is a, c, g, or t
  misc_feature (322)..(323): n is a, c, g, or t
  misc_feature (334)..(337): n is a, c, g, or t
  misc_feature (340)..(345): n is a, c, g, or t
  misc_feature (348)..(349): n is a, c, g, or t
  misc_feature (359)..(364): n is a, c, g, or t
tgttattatttgagaggacaaaactcccaagacaaattctagcatagaaaatagattgtcctctaaacatgaagaagaatattagctagaaaatttacaaagaaatactatataagaatcacattgtccactccagatccaaactataatgacaagtcttaattgaattagcttaagaaaaccttagaactcactgtcttaactgcaggtggcacaaaaaagcatcaaaaagaggaatatgttggcaacccnnactantttatntacnnnnnnattgttagttgcaatttctgnnnattggtgcattgagaaattgcttctnnattacgaaaannnnacnnnnnngannggtgaaatannnnnnttac

SEQ ID NO: 1686 - DNA, 615 bp, Glycine max
tgcagcgcacggcgttggcgacagatgaaccacggcggcgctccggcgacgcggagggggagaaggtgttcaaggggagcgaggtgttcggtgacacgtcaccaaattacttgaagaccattttggccctggcgttgtggctcggaaccattcatttcaacgtcgcgttggtgctcttcgcaatcttcttcctctctctccacaaagcacttttgttcgtttctctttcctttggtttcttcccttcaattatacacacgtgtatatttacacgtgtctctctctcactgtgtgattaaaatgagaaggttgttatgtcaggcttttcggtttgcttttcgtgctcatggtaattcctgttgatgaaaagagcaaattcggtcgaaaattatccaggtacttttataataataattattattattatttattattattatttgctttttatgatacacagtttaagtatcgtgcttttgtgtttgaataaaaaaaaaagtattttttccgaagaaaaaaaaattgggtgtgtttcaggtacatatgcaagcacgtttgcgcttactttcccatcacgcttcatgtggaggacatgaaggcctttcatcccaatcg

SEQ ID NO: 1687 - DNA, 379 bp, Glycine max
tcgtagatttcttctgtttttttttcttcttctttattgtttgttctacatcagcatgatgttgatttgattgtgttttctatcgtttcatcgattataaattttgataatcagaagattcagcttttattaatgcaagaacgtccttaattgatgattttataaccgtaaattaggtctaattagagtttttttcataaagattttcggatccgtttacaacaagccttaattgttgattctgtagtcgtagattagggtttttttcatgaactacttcagatccgttaaacaacagccttatttgttgatacttcagtcgtttttcaagaaattgttcagatccgttgataaaagccttattcgttgattctgtatg

SEQ ID NO: 1688 - DNA, 699 bp, Glycine max
ttcaggtgtgtgtccgaatatacaactctgatattccattcatttgttaagtttattgattactttactttttttataggtaatgacaacattcatgccgccgcctcctgcttctaccttcctagctttccatccccaggataacaacattattgccattgggatggaggattcaaccattcacatctataatgtcagagtcgatgaggtgattgctatctctaactagttttatcgttttgatatttactctattatttctaataatctcaccattttttccccttttgggggtatgttccaggtgaaatcaaaattgaaaggccaccagaagcgtattactggtttagctttttctaccaatcttaacatactggtctcatctggtgctgatgctcatgtaagtcttttaactgttctcctttgatacaattttcaaagtggatgcacccttgtgcaagttttttgctggcttgctgcactcaataactttggggggttgggtgtcttttcttttttgggtgctcaaggttaaaatacctgtgttttactcatatttgtgcttctattacgtttttacctgctcaaaatttttactttatgggttttaagaagttctattattgtacagctttgtgtgtggagtatagacacatgggagaaaagaaaatcaattccaatacagctacccgcaggaaa

SEQ ID NO: 1689 - DNA, 392 bp, Glycine max
ctgcgcgcatggatttggttgaggagggcttcgactctcttggcgtcgcgttggagcctgaggtggaagagctgctctggggttttgttggaggagagggcgtctatgtggtggaggtggaggtgaagtgagagcgagagagtttcttggggttctgagagggtttctgagaggatgtgtggctcagggagggtgtggaggggcaaggtttcggtttggatttggaatgcgccggagacacagaggctgatggccagggttaggaagagaacccaattcccttcttccattcttgattgttgccaccagtctcactcagagaataaataagcaaagttcattatgacgttgcctagggtagcctaacaccctcttcctcttctaaaaaaaaa

SEQ ID NO: 1690 - DNA, 684 bp, Glycine max
aaatgcattcttggttttacaaggtattggattcttcacgatgtgaaaacatgatattttaagtatccagcattatcctattgttgatttctctctttgttctcattcttgtttacagaatcacggagaggaaatatcattgcgccttcgaactgatgacctcaaaggttttaggaaatatgaaagtatcaagaaaactctactgcatgaacttgtaagctataacacgcactggaagtatcatttttcttattgatcttacgtatttttttttattgatcataaaatagaactgtctatttgataaatggaagttattgaattaacttaatgttttatttcaggcacacatgatatactctgaacatgatgtgaacttttatgctctgtataagcaggtgcgtgcacttgcttaaatgttgggctgtcagtccattattattattattattattattattattattattattattattatctgatttagtgccttatgatgatttaatttgtttctttgacagttaaatcaagaagcgtctagtttagattggactagatctgcaagccacactctcagcggagtaaggaatactgcgatctatgaagacaactttatagcagagactagcagtaatcctcagaagcttggaggtaacaggacagatcagctaataagtgcac

SEQ ID NO: 1691 - DNA, 530 bp, Glycine max
  misc_feature (59)..(63): n is a, c, g, or t
gatggacgattcaaacagcagcaacgaaagaaaaactaccgtaagagaagcgctccaannnnnaaagatgaacttcctcaatctcaaagcaacaatgaatccgacgacgaacgagaaagaaggtttctctctcatttcaattccacaattctaatagggaaaattttatatcagggttccgatttcactgagccaattacattgaacagaatggcattggaggaaattaagctcctccagaagcagagggaaaggaaatctggaattccagcaaaccctagtttgcaggtgcagagtggaaccggcggcggtttagcagctaaagccgccgaaaagaacgacggcgatggcggtgacaaggacgagctcgttcttcaagacaccttcgctcaagagaccgctgttatggatgaagaccccaatatgtgtgtaaattatattaatattgtgtttgtggctgtggttgttgatgttgttgcaacttgtttgttgaacagggtgaaatatattgagcacgagttagcgaagaa

SEQ ID NO: 1692 - DNA, 378 bp, Glycine max
ctaaggagactgctgcaactcctgataatgcacaaacatataatactaatctgataaggcatgttatcaacaacactggtactcctgcaaagcctggagaggagctagatgtttatattttctcgttgttcaatgaaaataggaagcctggtttggaatctgagaggaactggggattattttatcccgaccagacaagtgtttatagcctagatttcactggacggggtgcagttgatatgaccactgaggcaaatataaccaagtcaaatggaaccacatggtgcattgcttcgagtaaggcctcacaaattgacttgcagaatgccatagattgggcctgtggtcctggcaacgtggactgtacagctatccaga

SEQ ID NO: 1693 - DNA, 367 bp, Glycine max
atctcacttcttttcatcaccatctcaccctgctaatgatgggcaaatgcaagtaatcatcacatgcatttgattcatttgaacgactagtgactactgaaaacaaattttgatgttcgtcatgctaaatagcatcgagaatatatagggtaatatgtaaatcatgaaacattaaaggagtaattcatgatgatagtcagatggaatgaaaagagttagtagtttggtcatttatttttgtgcaattgctgcaaccaataacaaaatgagaacatgcacagctgaaatgttcaatcctgcacttctggcttctttgcagtgcctttaaggtaccaccccaaagccccaagaattgttacagtaccag

SEQ ID NO: 1694 - DNA, 549 bp, Glycine max
tgtgggtttctgatggatgatgccgggcatcgtgaaaatggaaggcacaaagcagcagatcaatataaatctgctcagggacaggtatatgaaaatacatttatgctcatggatgaattcattactaatttactattctattttgcacaaacaatttgtaattgcagcatatactccctgctaagaaaggtactgattttgataatatttgtctggatgttgcattgcagtggttgatgcaacatcagccttccatgaagcagattatggcaattatggctgaaagagatgcagccattcaagaaagaaatctggccatttccgagaaaaaagcagcatatgctgagcgcgatatggcattcatgcagcgagatgctgcaattgctgaacgtaataatgcaattttggaacgagataatgcaattgcaactcttcagtatcgcgaaacctctttaagtagtggcagtatgccatcatgccctccaggatgccaaatttcacgtggtgtgaagcatatacatcatccccagcaacaggtacaccatatac

SEQ ID NO: 1695 - DNA, 729 bp, Glycine max
  misc_feature (63)..(63): n is a, c, g, or t
  misc_feature (65)..(66): n is a, c, g, or t
aataaagaggactctcccgtccacataatcttttagaatcccagctagttctttccccctttnannacatccatctcagaaaatttccattgtttttccttccaggaaactacatttcatggcttctgaatgtagttaacatacaatgaatgagtgatgtgcaggtatgtatgagagacagaaagttattcttaatataattgagtgaagattgacatggagttccaaattgtttacttctgttcgaaactcgaaaagtaaagactaagaaatgctccaaagaatcaaatggtacacattcaaacagtcacaaaaatgtattcacaaccatcagaaattgaagaaacaatatttagtagtacttcaaaataacaaggctaatcgtatgtaatccttagcttctcctgcggcagaaactaacgattttaaattgcaattgtggttttgttgtgaaccttgttattgcggaaaagacaaatgtggttgggtagccacaattgcggtcgcaatacagtcacaaagacccccaaacactggcttctgtacccattttttaaaaccttgcacaggtaagtttctggcgatgccgtatttccatggccagaggcttcaattcaacaaacaaaaccatattcccaagcatgctaaactttcaaaaaataaaaacagctacagtcaccatcactgctacatttcaacaatcaagttgtgtgccacaccaccaaatat

SEQ ID NO: 1696 - DNA, 330 bp, Glycine max
ctccgcggcaacgagcggtgcaaacttgccctacataacctccctgacgaggtttatgagaaggagtgggatttgatcatgatcgacgcgccgaaggggtactttgcggaggcgccggggcgcatggcggcgatattctcggcggcggtgatggcgagggacaggaagggatccggtgtgacgcacgtgttcttgcacgatgtggatcggaaggtggagaaggtttacgcggaggagtttctgtgtaggaagcacttggtcaaaggtgttgggaggctctggcatttcgagattcctccaatgggtaataacactcgtgactacgcacgt

SEQ ID NO: 1697 - DNA, 341 bp, Glycine max
tggggagtagcaatcgagcaccttcagctatgcctgacacagaggaaatgaatgatggtgtggagctcagaatcagatttagtttctgagtctcccatggcaacatttgaaagtaagaccgcaatatgttagagagggggtctctaaccatattcccgtaatctccagaagcatgaaaagatctaagtgtcgataaatgtaaagatgagggcaagatttttctgattctttcctgaactcttactgctgaatcaaaagaatgaactctcactggttgtgacacccttctaaaaggaggactatcatgttgattcggccgctgaatacttccagctgggacg

SEQ ID NO: 1698 - DNA, 372 bp, Glycine max
ttcgaatccgttattatatgtttgctctcatttttgttgtttttgatgttgaaacggtttttctttatccttgggcaatgagtttcgatgtattaggggtatccgtatttatagaagctttcatattcgtgcttatcctaattgttggttcagtttatgcatggcgaaagggggcattagaatggtcttaattcttgactatttagacaattagattagacaattagaaaaaaatattgagacaattatgaattccattgagtttcccttacttgatcaaacaaccaaaaattcagttatttcaactacattaaatgatctttcaaattggtcaagattatccagtttatggccgcttctctatggtactag

SEQ ID NO: 1699 - DNA, 659 bp, Glycine max
tcctcatcatggcataggcatgtggagtctgtccgtttgcatccacaagggattcccaacacttcaacccaatctatagcagcacaaaggacccacatgttaaacgcgaaatacaagaatgaaggttgagaaatataatcatacagttaaaaaacagcattaaaaagtatgctaaagtgaaaaacaacatggaaattcaactataatatattttagttttcagtctgccatctcccctgccccctttcctaaaaaaaacaagaaaacaacaaggaaaagaacaagtgatatttacccacaataactaccacaggaattcagtgaaacccaattaattttattctttttccttcggttactcagaagacaacaactgatgaggcccatttcttccataaggcatagtactagaatagggagaaaaaatttacctcctgtgggtcacttgttaaagagtcaacgacactctcagaaccagatgtgcctgctgccaagtgcaagggtgtaataccaccaggaccctcaagattcggtggaaatacgtatttcctggatgtaccatttttgcttggtatagaatagtggatgagcaaatcaaccatgccaacgtactttcctttcactgctctatttaagagttggattgcattcaacatctc

SEQ ID NO: 1700 - DNA, 326 bp, Glycine max
tcgatgattgatgatggttcgggcgtcggtgaaggtgggttccgccaagttcgtagtgatctgcgtggggcttttaggcttcgctctcgtcgccgactttctatgggcctctacctcttccactcttcccacctccaccaaaccctccgcatttgtggttccctccaaccacaataagaagaaatatgagaatgccactgcttctggaagattccttgccgcggcttacgccgatttggatgcgccgcagctcaagtggcaaaagatggctcctgctcccgtccctcgccttgacggagccgccattcagattcgggatctcctct

SEQ ID NO: 1701 - DNA, 316 bp, Glycine max
ccattttctaaggcaacacacggggtaggcacttctgaagcttccttaattcccatagcaccaattactagcagggtaaggccaaccactcgggtgccccaagtttggataatttcaatgtgaagtcgatcttttaagagcaaaaatattaagccaaagataacttgaccggcatcatggccacaaccccaaagggctccaacagcagcactctccatttgggttcggccaattgacaatggagccaaagctgcaaggtggtcaggccctgatagtgtgtgcaagcaaccggcaaagaaaccagtccaagcactag

SEQ ID NO: 1702 - DNA, 805 bp, Glycine max
cggcgacgtttcctcgcaattgcaatggaaactccctcatcactaccacgcagattcccctttccatttcgtcaacctcccttcggaacaactcgctcgaaacatcgctacccgaagtcggttatttttccctcgaatgaaattttcgtttttgatttgtgggtctgttttaagttttgatttttaatggtttttggtttctggggtggaaatttttgcaggcatacttgtgaaggggatgtatgagctgtggggtgaagggagtagctatgaggagttgaaggagtctgtgttgagttaccctgatgaaaggaagttgccgtacttggattctgatagcactttcaagataaccgttgattgctttgggaaggtcattagcttggaggagcaaaaggagctcattcaagggctctcttatatccctttcaaggtggggtgttcttttaatctcattggtgtgaaaattatgatcttgtgaatagctttggttggtattggtttggaagtgttgtgaaatttgatatgtgaccttgaatgtggcaaattattaactttatgcctgctcttgtagttacgtggttcagcagtgcttttttagtgtttgttgagtaggttgattataaataatctcttgaaatggaatttgtatcattgctgttcactgccatttcattggaatgttttctaatctggatgagcatgatggaaactacattgcagcttctgctagatttttgtcttttttgactggatgctttttaatatctactaaattttcaacaatatgtacctagattttttt

SEQ ID NO: 1703 - DNA, 370 bp, Glycine max
tctcagttgcataattggtgaggtgttgaaactgaacttttcatattgtttcttctcaaggtcattttgtggtattaggcggaagagtactttaatccttttgctatggctccttgtggatatgtttgcatattggagtcgtccaattttggcgttgaacagatttttttgatgtatatagatccttgatctgcacccatatagatagaaagaatcacattttgtaatttaccatctggacctcggttttgttgttcctgcgggtcctctattatttttagtatctaggttctcaataaaatattccttcattacacgtgttggtgtgagtgaccgagtaggtgagaggacgagagtgacagtgacaata

SEQ ID NO: 1704 - DNA, 801 bp, Glycine max
  misc_feature (784)..(786): n is a, c, g, or t
  misc_feature (788)..(788): n is a, c, g, or t
tatttcttgtagtgaaaaagttgttagctaaaagaagaccaagtttttggtgttgtagaaggaagagaagaattaacatgaaaattcagtgtgacgtgtgtgagagagctccagcaacagtgatttgttgcgcggatgaggctgctttgtgtgccaaatgtgacgttgaagttcatgctgcaaacaagcttgcaagcaagcaccaaagacttcttcttcaatgtctatcaagcaagcttcccacatgtgacatttgccaagtaattatgcacctcaattatatttgtgtatcttctaattttatgataaaaatcatctctgagttaattcatgtgctacttttatgttgagcttgttagttgttaccataactttgtgtgtgactgccaataacccttttgtttgccaattgaatctatttaagcatcaagtgtagaattcttttttgtttcttaaagacattaatagttaaatggactttctgctggtgcatggtgagaatgctgcttgctgttttctacatccttgtgaaatgtattacgtagacacttgtagactgaattatacccttgacactgggatcttgagctagtttaactgatgagatctggattaggatatttcttgtatagtgtatgagttaataccttccctgaaatgggggaaaaaattgtctgatgaaactgatggatattgtaataagttacatataattattgctcattttgttctttcctatctccttcatataccaacaggacaagccagcattcatattttgtgnnnangacagagcactct

SEQ ID NO: 1705 - DNA, 1016 bp, Glycine max
  misc_feature (39)..(39): n is a, c, g, or t
  misc_feature (416)..(420): n is a, c, g, or t
  misc_feature (434)..(434): n is a, c, g, or t
  misc_feature (729)..(729): n is a, c, g, or t
  misc_feature (960)..(966): n is a, c, g, or t
  misc_feature (1003)..(1004): n is a, c, g, or t
aatatcaatgccatcaacaaagtaagctgcacacatgantaaaaaaaatgtcacagtttattgtttagtgatagttgatttcagggataggacaatttgttcaataaatgtgtggagtagtagttgtttttgtttacttattatacctttgacattgccatgaccatatatctgtaactgatccaaaggtggaggaagctgtgatgggtggcaattgtcatagtaaggccaagaagcaatggaattacaacagatattggtatatggaatcccagattcctcaaccacacgcctaaccagtcgcttctccttgtacattgttagacctggctccacaggatctgctttgtacacatcatgcccaaactctgaaggcaaaaacctctgcaacattgcattataacaagtaagagatnnnnnactaaacattgaanatcatttggttaaaagttagtaaataaatagtaatgatttaacagtgaagagacttgtgctgtttagatgccgttgaacataatatttggtagggtctctccatatgaaaatcacatcaatacccctattcactattatgagatataagattggttgagtggctggaaaatggaaaaggatgaagggagaaagagagattgtagtttcgaatccttttaattgacatttctaataaaactaacaaattaatatttgcccataaaaaaacattattcactacattacttcgtactnttcggtgggataaatcacacagtaaatggactttttttcaatagtataaagtttatagacatagtaactcttgctacatgaacggttttttgtcattaatttgtttcgatagttacaatataataaagaaaaaacattctgccacaaaatgaaacgtacttaatttattatttatatttgtgtcggtgcatgaaccaactgttttcattttttaaaatgtaaaaaaaagannnnnnntttccatttaataaattactagaaaagagtaaaattnnccttaatagtct

SEQ ID NO: 1706 - DNA, 348 bp, Glycine max
gtttgcaaacatgaaggagcaaagaatgagagttttgtcaatgcagaataatgctgtgcaacgcaatggaggtggaaataagaggctcccatggagaagaggccgatttggcaactaagttgttcacacaatggggaatttcatgatatcaccttttgaacctatgtcctggcctgctgcgtcctgactcctcctgggttgatgcaagtgaaaaatttctcgagtgcagaagaaaactctagattccccaccccctagttggatggattatctttccccctttcattcgaatggacttcttcatttgctcgtccgttgtatattagtgtcttccgtggcttaatgttt

SEQ ID NO: 1707 - DNA, 994 bp, Glycine max
  misc_feature (937)..(940): n is a, c, g, or t
  misc_feature (973)..(979): n is a, c, g, or t
  misc_feature (984)..(989): n is a, c, g, or t
catcttacactctttctctccattcccattgctctgcgccgctgctctcttacccggaagtatgcactttcaaacacttttcttcttcttcttcttattattatatgtgttggaatttttccttagttattagtcaatatttattgtttatgcggatagatctggaggtgattttttatatatgtccttagaatctgttacggaatgttgtagacacagcaaataatcctttaaaagcgtaattggtgacttaatattgtagacaaagcggataatcatttaaaaacatcattggtgacttcatgattcttttcaacccctcagtacctttctaatctaattctttagatgggagatgaaaaatcataggaataataaataactaatataattgtcttcagcacgatctttatgaataaaaaattctaatatttagaacaatcaatggttgccatttttaacacttaacaggtgaagcggtaacatctgtgtttgggcctttcgttgagctcgtcaagtcgtggaatctcccagactggctcgtccattggggccaccctggcaacatggtaagtaacaatgtccgttcagtagagcggaaagaaagtgaattgagatgaaaacgaaggttttgaattaaagtagaatgtaaaaaagtgggtctcacatcatctttaccgttaccgttgattggtctctttctctgcaaaccaacgcacacttagtaaccaaatccattatagaaacaaagaaagaaaggacttgtcaaatgaatgaattgctcttttgaccctttcaggccgttgtgctctttgccatgggtggctacggtacctatctgggttttcgcattcgttattctgataatctggtatgctgtttaatccctttaccattaatttcactacttagttaggttggtattatagattttgannnnaattttttgcaggaggaaaaggctaaggccaannnnnnngcatnnnnnngcttt

SEQ ID NO: 1708 - DNA, 833 bp, Glycine max
gtgaaatataggttgttgtccttttctttcatttaaaaaaattgggtgttcattttatgtgtatctccagacaactcaaggcaaaggaagcacttatttttatgatttacacttttggattggaaagcatacaagtcaggtaagcttggactttgctttccttcttctccatcctacattttgcctaattgatcttgcattgctatttttctccctcttagaatgaacaggcgagtagaatgtggaaccttgtatagttgtgcctttttgaaaaatttactatgtcatggttgttttatgtctctattcactttcatcatttttcccctttcctgactcctttttaactagtatttagatgtgttgagttatttggaaagggcaggggttaccatggttcatagtcgtttggaaatccttaaaccaatctctttgacaaaataatagtcttggttgacactgattttacttgtaggatgaggctggaactgcggccattaaaactgttgaacttgatgctgctattggagggcgtgcagtgcagcacagggaaatccaagggcatgagtctgacaagtttttgtcatactttaaaccatgtattataccattggagggtggagttgcatctgggtttaaaaaacctgaagaagagaagtttgaaacatgtttgtatgtatgcagagggaaaagagttgttagattgagacaggtatagtgttctctattattcatgaacgtcataaattcagtgcgcatgaagtttgacattttggtttgataggtcccttttgcaaggtcttcgttgaaccatgaagatgtattcatactag

SEQ ID NO: 1709 - DNA, 373 bp, Glycine max
gagcaaccagtgcagccggtacacggtacccaagcctcatcggtgctggtatccagaaccataaaaaatagttggttcggcgaacccagtttcactcggaccacgtagctaccaatcccgaaggcttggcccgaagcgattggggctgcggaaatgggctttctcctcaatgaggcgtcgaggctagacaagtacacgactctttctgggtccttggaggccatgtcgatgatgatgttctcccacgaggttgagtagttcttgaaaggcgagcaattgccgtagatgggaatcatggtgatgtcggagtcgtcgtcgtcgtgttgagaagcgcatggatcgttggcaatggctatgatggagaggtgaagta

SEQ ID NO: 1710 - DNA, 441 bp, Glycine max
aagttgaaccagggcataacagaattttcataaaataaaatggtatcgaaattaagtatgcttttgctttgcctaaaaaaaagtccaatgttgaggagggaagaatagaaatacaaaaggaacaaatttcagtgtttaaacacctttttttctatttcccatcgtattccgtagtcctttgcttctcaagagttactttacacgctgcagtgtcctaaattatgcaaaagaatctcaagttatgatttagacttgtgggggttggaaatactttcttccttatccaataaccattattttggcactagaatatacatgaattatatagtctcacttttgaaggcaaccaagggagcttcttgctacaacctcactatttccttcataagagcaacaaaaaagattgactacagaattagtgcccatttgaggccctttggg

SEQ ID NO: 1711 - DNA, 350 bp, Glycine max
ataattactatgcatcagaagctcccaataataaggactgaatatgcctcgccatccacccatgcctctctgctactatcatattaccttattatttacagtcatgctaccttaattactagtgtaagacccatctagggttatcaaatcagttccatatatatatatacatatatatatatatatacctatatctcataaaatataatgaataagttcttagttgttatctcacgtactttatgttgataaaatatatatgcttgctaatttgcctatatggatcggatcatcttttctcaaacttaggcccgcatatgttcttaataaacataccaatccacatctac

SEQ ID NO: 1712 - DNA, 392 bp, Glycine max
aaaaatgtttatatatttaagtaaatcaaacttctcaatgctaatataagtggtgcaaataggactaaaacctctgcggatgtaaagagtgagaagcaacatgtgtatcactaaattggaggaaaggagtgaagaaaatataaaagatgtgtattacaacatgcatctgaaacaaataaaaaagcatttatgtacccccaagaaaaaatgcatttactttgtacagcagtactacttccactcactctacaagtaccctaatgcatctccactcatattgtcactcgccattattgagcaatcagacgcatcatgtccatattgagcacacaatggcatggagaactgcctgcgtttcctagtgagatccactacatctctcgctcttctct

SEQ ID NO: 1713 - DNA, 469 bp, Glycine max
ttcgtgtaatcttcacaccaaaagctttggtatcaaatgtgcaatttaggaagaatgatgatgagagtcatcattgcacatgcactcaggaacaggatacttggtgacatccctcccagacttgctagtcctgagttctggctgacctaatgaatcctgatgcaattccttgataatcctattgaactctttttcagggagggaagaatttagaaaataggggagcatctgtcttttgtttggtgttatatatttcttgtgtcccgcataggcccggtgaccctgaaataacatatagtttcaatatttagaaactgtcgcattaagactgagttattacaatataattatagaaacggccatctatattttatctaatcttatacctgaagtgcatggcccatattgcctccatgagatggcatgaaaacatcactcttctcagagactatgtaatcaatggcagcca

SEQ ID NO: 1714 - DNA, 1005 bp, Glycine max
  misc_feature (969)..(971): n is a, c, g, or t
  misc_feature (985)..(989): n is a, c, g, or t
atgatgtgctatatatattattcccaaacaaatgtcagtggattgtttgaatttatgctgtaggatgaactaaggagagaattaggaatggatgaggatctccctgctgtattattgatggggggaggtgaaggtatggggcccattgaggctactgctcgggcacttggagattcattatatgacgagaatattggggctcccgtaggtcagatccttgtgatctgtggtcgtaataagaaacttgctaataaactgagttctattaattggaaggttcctgtgcaggtattgttacccttaaaaaatttccagaaccttgttaatgttttttgaatcggatattaattgcattgtttgtcagtgttgcactttctctctgttttttttcctgcatatgcttaaattttaagtttgttagctgtccatgatgattgacttttgcagttttgctagtgtgtggaggttctcttacatgatgaactaggtatctagtcttagtatcagatttctcttatgcaatgtttttaaaaccagaatggtcattgaactaatgaagataatggtttacagttcattggttcaaccctgattgaaccagggccaaactggtaacaatattgcatattaaacattggttgagaacaagggataaaatttcttaattattgtgaattggttaaaagggtcttatacataggggtagtattagtttttcttttcatgagatgaggtagaattttcgggttttgagcttccatattaagtattttgtttggggacagcgatgcttcaattcgatgatgagcatagcaattagtgattcagcattgtatgtatctccatggtagcccctgaattgttttatttttacccatatttaggtcaaaggatttgttaccaaaatggaggaatgcatgggagcttgtgattgcataattacgaaggtttgatcccacaatcctgacnnnagttttttttaccnnnnntatgacagcagttgat

SEQ ID NO: 1715 - DNA, 379 bp, Glycine max
ctaaggttccttaacctaaaatacctaccattcctaacaaacagtagcactaaagctttaaaacatatattttatagaactagctagtttcctagctatattcactactacatcaaaacacacacacacacacacactaaaacaactacaacaaaacacttcttcctcacaatttttttagttttttaggtaattttaaacttagactcatctatttctatgccttcctcttcagcacgttctccaccagacttgtccatggtgctgagtcctcctttgcgtcccatctcttggtacccttctctccccatctgttccttccttgtctgccctcctttggtccccatttcatgatacccctctgaccctagctgctgct

SEQ ID NO: 1716 - DNA, 383 bp, Glycine max
atcatttggcacaggggagctttccttcatgtaatatcatgtcttcaggaaatggaacccggaacagtgacatgacttatcctaatggccagaacagggacacaaattcttccaactccagtgattgcatggatatgcattcagatagtcctggtcatgatttttcatactgatgctgtcatagttagaacaaggaacaaaaaagaggtcatttatgaaatctgtggtcataaatgcgtggtgaaaaatgtcaaatttattgtggataaacttcaatttatttgtgtagcattgtcgtccagtttgaaagcttgaacatcagcttacatgttaaacagatagttcttgaaaaatgttggccatttcccaagcgatatatagta

SEQ ID NO: 1717 - DNA, 341 bp, Glycine max
ttgaagaagcagtggcttcaatttcatacttaattcccaccctaattaaagcacttaatcttccatgattgccaaattaattaagtagcccatggtgtccttcaaaaaccttgtcatagtaatttttcttttcttatttttgaaagaagaagaaaaaaaaaaagggataaaagcttcccacgccctttccctcccccaaaaacaactgggtaacgttagccgggggaaaaaaaaacccccccaaaaaattctcccaagccaatttcccaagctccttggggaacccttccacccccccattccccttggtggaaaaaaaaaaaaaccccccttcccaataa

SEQ ID NO: 1718 - DNA, 725 bp, Glycine max
  misc_feature (415)..(417): n is a, c, g, or t
  misc_feature (432)..(433): n is a, c, g, or t
  misc_feature (435)..(437): n is a, c, g, or t
  misc_feature (462)..(464): n is a, c, g, or t
  misc_feature (482)..(482): n is a, c, g, or t
  misc_feature (484)..(495): n is a, c, g, or t
  misc_feature (498)..(498): n is a, c, g, or t
  misc_feature (504)..(510): n is a, c, g, or t
  misc_feature (514)..(514): n is a, c, g, or t
  misc_feature (516)..(518): n is a, c, g, or t
  misc_feature (520)..(520): n is a, c, g, or t
  misc_feature (523)..(529): n is a, c, g, or t
  misc_feature (531)..(533): n is a, c, g, or t
  misc_feature (536)..(536): n is a, c, g, or t
  misc_feature (539)..(542): n is a, c, g, or t
  misc_feature (547)..(553): n is a, c, g, or t
  misc_feature (555)..(556): n is a, c, g, or t
  misc_feature (558)..(566): n is a, c, g, or t
  misc_feature (570)..(573): n is a, c, g, or t
  misc_feature (576)..(577): n is a, c, g, or t
  misc_feature (579)..(579): n is a, c, g, or t
  misc_feature (581)..(587): n is a, c, g, or t
  misc_feature (592)..(596): n is a, c, g, or t
  misc_feature (601)..(608): n is a, c, g, or t
  misc_feature (610)..(611): n is a, c, g, or t
  misc_feature (613)..(624): n is a, c, g, or t
  misc_feature (635)..(638): n is a, c, g, or t
  misc_feature (643)..(647): n is a, c, g, or t
  misc_feature (649)..(654): n is a, c, g, or t
  misc_feature (656)..(657): n is a, c, g, or t
  misc_feature (659)..(663): n is a, c, g, or t
  misc_feature (671)..(694): n is a, c, g, or t
  misc_feature (696)..(696): n is a, c, g, or t
  misc_feature (701)..(702): n is a, c, g, or t
  misc_feature (709)..(712): n is a, c, g, or t
  misc_feature (714)..(719): n is a, c, g, or t
  misc_feature (721)..(721): n is a, c, g, or t
ctatgtttttttgttttgtttaagtaattaagtttgaatcatgagtatgtggtaagagttgctagtgtatttaataaccgagtgatcatcataaattatactagttatcgtgttaatcacaatagtcaacactgtttgtgttgtctataggatccatttgtggtccatgaaaaagtttatattcatatgattaatataaggaagtatttgctgtacgaaattcaggactataattaatatgaatatgaccttgctaaatttgattcctttttgggcacatctttttgagatcatattagttgggtgggtgagatatccttttgttggcatggattcagccatggggtcgtaatattaaatcacctccatctaccactctcagaaagaaaagaagtgcccaaaaaggaatcaaatnnngcaaggtgatagtgnnannnattatagtcctgaatttagtacagnnnataacttccttttaatantnnnnnnnnnnnnaancttttnnnnnnncacncnnnanatnnnnnnncnnnaantannnnattcnnnnnnntnntnnnnnnnnnaacnnnnaannantnnnnnnntaatnnnnnttttnnnnnnnnanntnnnnnnnnnnnnaccatactccnnnnttctnnnnnannnnnntnnannnnnactaaacnnnnnnnnnnnnnnnnnnnnnnnntntcttnnccgtctnnnntnnnnnnanaaaa

SEQ ID NO: 1719 - DNA, 741 bp, Glycine max
  misc_feature (701)..(701): n is a, c, g, or t
  misc_feature (711)..(713): n is a, c, g, or t
ttattgtgttgtacaagtacaagttcaatttcaatgtattctctatgttccttgaatactctttgctagcatttggaggtctcgtttttccatgataaactgcaaacccatttatgttgaattttaggtttatcattagtgtttgcttggttgtgaatgatttatgtgagttctcttttggttctgcttgtgaggtcttaatttgaaatttgaaccaagttatggcatcttcccactgtgttgagcgtgacttgatatttgaactgagctatttttctcttaaagtcattgatgcaatgaaattgatttgagtggctagctattagctggtttgggaatgacattttgtttccactcttttaatgactaatgtcacattccttgcgtagtacctgtgctgcaccctttatttttgggtagatgctgaatgctgcagtttgttaatattacctgtttttactcatgacatattcaggttgaagtttattagttgaataatagaacagtccatggctgaagaaatgacaatggtagaacctggaagaggtaagaggaaattttttaaaaagcaaggccataaaaagtcaagtaataaagcaaaagtgatgccaccacaacatggacagaagaaagttaaaatagacaaaaaaatgaagaaacttttccgcaagcgtgcacgagagtataattctgatgatgangatgaggagnnnactgtacctgctacctcagagcctaaag

SEQ ID NO: 1720 - DNA, 383 bp, Glycine max
cgcaagggaggcagagattgagcgtatgatatgagagagaagacggaacaaaatcaagggcggagaatgccccatggctgacatcatgtcggttaacactttattcagacaacactatactcattaatcaaaatcaaatgacctaaccactctctctttttcccaattttcgaatctctctcctccatggacccaacttcgatccctccccctccggccaccaccgtccccttcactgtcgaacccagcaatcacgtgacccccgccgacaacaccaacaccaaccaccctccttacgatgagatgatatacacagcaatcggggctctgaaggagaaagatggttcgagcaagcgagccataggaaagtacatggaacaagt

SEQ ID NO: 1721 - DNA, 469 bp, Glycine max
atatctactaatatctacatcgagaacccttatttaattgataaatattagtagatacgatagtaattaacagaacaaagtattcgagaaagcacaaattcctttatttatttcttccttcagggttcgggttccatattagcaataatgcagcattcaaataaccatataacacagatgacaagctaatgccacatacaagataatccagatccagatgtctcaattacaatagtcctgctcccatcactgagaattcagcctctgaaaatccaccaactggtaaagatcacctcgcctttgcttagttacaggcagatttgtcctgaataatgttatgaaagcaattaatacgattattatgacgctcaatcaaaagcaaaacatgcgaataaaagaaaaccttctctgctccaatattgaataatcaatttctgctatgatgattgcctcctcatgttctgtagta

SEQ ID NO: 1722 - DNA, 366 bp, Glycine max
gaggttcttggaggccatagagaagagagaacaagagcgtgtggtgagagaggaagcgtggagaatgcaagagatgcaaaggatcaacagggaaagagagattctagcacaagagaggtccattgccgcagcaaaagatgctgctgttatgacatttttgcaaaagatagccgaacatcagcaacaagaaactatcaatcttgaaccagcattgaataacaacagcatcactgttgttccacagcaaccagtgccacaagcaacaccaacatcaactccaacaccacaacaagcacaaacaacaacagttcctgaggccccacaagtgcagccattggtcccacaactacaacaacaacaacaaca

SEQ ID NO: 1723 - DNA, 220 bp, Glycine max
tcttgataaaatacaaaggctaggagtagtaaaagaaactcgtcccttacaagaaattgaatgacaattttcagattatatgtactcatcagaatatagaaattagaagagtcatatataaatttatcggcccaaaaatgcaacacgatccttttgtactgcctgtgttaggttgatatcgaagagctcacaacgtataggcatctccatctcatagaac

SEQ ID NO: 1724 - DNA, 877 bp, Glycine max
  misc_feature (56)..(62): n is a, c, g, or t
  misc_feature (819)..(825): n is a, c, g, or t
  misc_feature (861)..(866): n is a, c, g, or t
aggagcaagggagttgtgaagcacgttttccttgcaaagttcaaggacgacgtcannnnnnnagcggattgaggagctcatcaaggactatgccaatcttgtcaatctcatcccacccatgaagtcattccattggtatcatcttctttatgtcttttcttttctttctcacgcttgcaatgcaattcaacaacccacttagatcagggcaaaaaacatcaacgtctacacaaaacacaaacggggtcagcaaaaagtaaaccccattgaccgtaaaaattgaatttttaataagttcattcaaatgggtttgcccaggttagccaatgaatgagatctaagttctggtgagcagagtgagtggatgtggaatattaattgggttcgatttcaaatttaaaaattggaagcaactatttgttgcttgctttggctttcaacatagaattagaattcattatggaaaaattgaatctaatccaaagacaccataaagagtgtttggcaaatttacaattacaatggctcaggcaaggcctaaaggaatagaaggtttggatttttgttaaagtttacatgctgtcatgttaagaaagatggaacttgtattgcattgcatcttactttccaagaatttgcacttgaaccccttctagtggcttgagcaatatctctaatgcccgtatatgaactatgtatggtaggggcaaggatgtaagtgctgaaaacatgcatcaaggcttcactcatgtgtttgaatcaacctttgagagtacagaaggcattgcagagtatacagctcatcctgcccatgttgannnnnnnactttgttcctttcctacctggacaaagtcattgtnnnnnntataagcctac

SEQ ID NO: 1725 - DNA, 771 bp, Glycine max
  misc_feature (508)..(510): n is a, c, g, or t
  misc_feature (655)..(730): n is a, c, g, or t
  misc_feature (732)..(768): n is a, c, g, or t
ttacgtcataaatcatccttctctgccaatgacttcttttggttcagaagagaagagaaaagtacgaggaacaggcgcatacttccctaatatggtatttataaagtttatagttattaaatttggacacatacttcacacacacacagactagttttctagtgttccccagtcatctaattgctaagctcataattttgcagacttctcgtccttacagggacaataggccaatgccaggaaggggaaggggtcaagcaccaggtactcatggacatctgcagagacacacccgtaacaatggctttgccctagctccacaagagatgaatttgtctgcggaaggaacctttgaacatgctctagaaggatatcctggtcttggtagtactaaaatcagatcatctgagacctatttccctcaaccttctacatggggatcacattatgctaatggtttcgttcattcatctgagaaacatgaatctgtacatgtgagccctcagannnatgaatgaacgaaaccattagcataatgtgatccccatgtagaaggttgagggaaataggtctcagatgatctgattttagtactaccaagaccaggatatccttctagagcatgttcaaaggttccttccgcagacaaattcannnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnaag

SEQ ID NO: 1726 - DNA, 1309 bp, Glycine max
  misc_feature (1250)..(1256): n is a, c, g, or t
  misc_feature (1295)..(1300): n is a, c, g, or t
ttatactcgatgtaagttcgtttattcgttttatttgtgtttcaactttttgaaaccccgtgattgctgggaatatatatagaaaaggggggaaatttgtgactttactttgttcaattgaaagcttctaattaatgagctgacatggtaattaataggatgaagttgtgaagctatcgccccatgcccgtgctatcagagatgtagaggatgaagaactgtggagctttttctatgggatgtctccttggcaggtaatttgataagacttgctttatttgacatactgagttgtttggaatctagtgcaatgatgaagaaggatctaattgattttactttacagtttatactgatggttgctgcaagttcagttggagaggaactcttttacagggctgctgttcaggtttgtttaggagcttctgcctctggtttttgattgtatatgccaagagatgtctgaaaaataatgtttggataagcttaaaattgggaataatgaaatgtgtattttgggtttgatccatctataatagtactatagtataataataccctgtaaatagttttgacttctataaaatcttctatcattaaattcattccatagttcactgggttcagaattttctatttgaaaagttagatatattgactgataaaattttacagcatatgactcccctaatcctttgaataacataatattgcaattctttgcttgtattgatttccttttctaattaatgattattcagaatggagaaaaacctttcttttccccttccagtatctgtatcttgagatcgatgaaagaatatcactcatgctgtatttggttcagttcaaacttgttcagtggatgaataactagaattttatgatgaaaacatcttcattgtgaaaaataaaataaaaatggtaggctttgtaatcttgtttccgtgcataataatttattcttgcaattctacagggggcattggctgatatatttttacgaggcagtaatcttataacagatgttcagggaatggcatcattggtatgtatttgtaccatctttttagttttcctttcttatgttataagggtgagccttggtgcaatggtgagtgtgcttccttataacatggtaataatgagttctagttgcggaacaagaagccccgtaatggtgggagcctcatgcacttgataacccattattccttttcctttttatgctacaagtataggaagccagnnnnnnnttctggtgactaacttgtgatttgtatggtaaaatgtannnnnngtgtgctgc

SEQ ID NO: 1727 - DNA, 330 bp, Glycine max
tataatcctgattggtgaagtgtgagagagggagcagcataaggcagttaggcactcttgcagcggatctcagctcgaacgaaacgaaaccttggttcctttctctctgtcctcactcgagtgcgcgtctatgccaaagagagtgagtgagtagggtttcaaattccaatcggaagaaatcggaatcggaaaaaatgggaggtggcggcggcgatcacggccatggacacggacacggtgatttcaggaacaaggtctggagtatgagcggtggcccttactgtcgcccaaagcactggaagcgcaacaccgccattgccatgttcggcg

SEQ ID NO: 1728 - DNA, 397 bp, Glycine max
gtgaagtgaagtgaagtgtatataaaatactttggaagtgtcgtgaagagccaataacggttttttgtgtgtttctttctctctcatgttgtagtatctcacttgtgtttttcattcgtttctgaaccacacaaacatcaccaccgaacaatgccgacggggttaccggcggcgaattccttagtggcgccggacgaagaggggtgggtgtgggggcagatcaaggcggaggcgcgccgcgacgccgagtcggagcctgctttggcgagctacctctactcgacgatcctctcgcactcgtcgctcgagcgttctctgtcttttcacctcggaaataagctctgttcctccacgcttctctcgacgctcctttacgacctgttcctcaacaaaaaaa

SEQ ID NO: 1729 - DNA, 381 bp, Glycine max
ttttttgtgtgattaaaaaaataccatatggtaaccactgtttctggcaagctaagtaaaataaaatgtgaaagataactatctatcttcaaatggtaatcacagtaattactaattagcatccttggctcaacaagttaatacgttctgcaggtattcagttaaagacaagtaagaaacaagttccgggaaacaagttgtgggaaacaagtctgatatccttctaacaaattaatcaacctcctcgcatatgtgcaccaagctcgccaaactgatcatcagcctccactgtatcttcagatagcctcacagcatccagcttctgcttgagaatttctatggcatttagaaccaattgagaagctttaaccgctccagtag

SEQ ID NO: 1730 - DNA, 396 bp, Glycine max
  misc_feature (386)..(391): n is a, c, g, or t
cttttgactctcttctttatgttgccatgctccgccgtcgcagttgtccgggagaacacgtgcctttccaccagacaatctcttggcggcggagttggcggccaaaaagagtaccgccatgtcggtgggggtgacaacggagttcactctcctcattgggaagaaaatatacacgttgccagactccaactcttcatcagcaccgagagcagagaatcttcttcctatatgcaaagaacgagaattaacgaggaaatagctggggtgttcgagcatgagctccgcagccttcacgatctctctgaattgcttcacttcaccggtgggaatgatgaccctcgtggccttggagttcttcatcaaaggaggcgccaaagtgcatgaannnnnngttgc

SEQ ID NO: 1731 - DNA, 579 bp, Glycine max
tagcacaccatgtgtcatttatgcgaccctatggtttgtttgatattgctgctgtttcactggctaattcattgactctcttcccatacattgatgaaatatctgagaagctggactatataggcataaactactatgggcaggtttgctttattaaccttgaaagtgcactgtgcatgatatctggcatactcacatgacaattctgacatttatttcaggaagtggtttcaggtgcaggcctgaagctggtggaaaatgatgagtacagtgaatctggtcgtggggtataccctgatggcttataccgcatgctgcttcaataccatgaaagatacaaacatctaaatattcccttcatcattactgaaaatggggtttcagatgagacagatttgattcgccggccatatctcttggagcatttgcttgctatttatgctgccatgatcatggttttgattatgaattaaatttttatttgcttaaaattaagtttttctttcataaacaccaatttcatgttaggtttcatgcaatttttgtacagggtgtgcgtgtacttggttacctgttctg

SEQ ID NO: 1732 - DNA, 726 bp, Glycine max
ttgacgatgattcaccctcataaaagatgacttgagctttagccaatctttcttccagctcctctgtgctaaactcatcagtcccaccaagctcatcaaaccccacctaataacacacataccaccataatcatattgcctgtacagtggtactaaaaattttcaataagcacttctaaggaaagtaaaatgaagtaagcttctttcataatccataagctaatctacagaagttctctcatttagattctcccaaggcagaatttaacttacgcacaagttaattttaacttgtgagaaaattttaattcatttcacgttcttattttcttctcttatatcggcttattgagaagtttatccaaacaagcctaaagaaataaatagccgaaaccttatctaacattgatggcaaacaaacaaatatgagcaagtggttgctatcatatacataccacataatcatcgactttggcgtttttgatgagggcaagggttggaagaacaatgatcttgagcttctcagcgagaaaaggactcttctcagcgttgagtttcacaaaccgagtctcgatatgctgctttgccaaaatatttaagtgtttgtccataacctgcaaaaaaatcgcgaacaacaacattgaatcctccttttcttctatatataaaattcaatcagcgttataataagtcatcgaaattatgaattgaaaatgaaaagtgagt

SEQ ID NO: 1733 - DNA, 373 bp, Glycine max
caagaaataacgaagatgactctgacgagtcacataaggataatggaggagggtcagaaaacccacctgctgaatatgagataaatcctactagcccagaaagctcgggatccggtaatttagacaagcagcctctcgatagttcagagtgttgccatttgtttcctggtggattcacaagggaaaagcacattgtgcctccaggaactcctttacatttcgtgtgggaatatattgttttttttcatcttcttcacatccgttcactgtgcattatatggaactattctttggaatttaggcaatttgtgtaagttggaattcttttggatatactatatgcatcatgagaaccaagtgcgtgaaacaaagt

SEQ ID NO: 1734 - DNA, 1070 bp, Glycine max
  misc_feature (997)..(997): n is a, c, g, or t
  misc_feature (1025)..(1036): n is a, c, g, or t
ggcatgatcttgaaggacgagctaaaggtttgccttaggtcgaaaagaaatttgtcccaacagttaagcgagactgaagggaatatgtgggccatcatcgataagtgcaaagagaagctaaatctagcggcgactcacgaagagcaacagctagaaaagtatatggcatattatctgtttgtggaatgttggaagcttgatttctttgcaaggttcttctattaatttccatgcattcttgtactataattgggtaatgacgaggcaaagaactccttgattttgcatatcctaaatatgtttgtgcttgtgtttgtatggatgaattaattaatgcatttgtgatgtgtcatattctgatggcaattcaaaaaggcttcatcttctcgaattacgggatctgtgggtgtggagaaggcatcaaaaggagataccatttcttttgataatgcaagaaattctccaggacagtatgatttatcaagaattaatcatttgcatagtagttttgttcctgaagatgttcctgatgctgcttccgagaaagacctggtaggtccccccccctctctgtttggtcttggggtgacagggtagggggagattgatctgttaggatttataatatattgattttagtgttcctgtcctgtatgatgctgatactgaaatccatctgtatattccagggtaacgagtttttcaagcagaaaaagtttaaggaagctagagactgctattcaaggagcattgccttatcaccaacagctgtagcatatgcaaatagggcaatggccaatatcaagctcagaaggcaagcttatgttttgttaatttatttttaaagaattctggcttactcatcaaaatattcacaaaatggtggattttatcattagtgggattttaaataaaagaaaataattttttccatttactgtaagttgttatatggtctatcacctgattgattctcttgaagggatcttctttttcnaaagttgatctgtttttttcctcacctnnnnnnnnnnnnctagattccaagaggctgaggatgactgcacaga

SEQ ID NO: 1735 - DNA, 610 bp, Glycine max
  misc_feature (19)..(20): n is a, c, g, or t
  misc_feature (53)..(56): n is a, c, g, or t
actcgtctatacaaatatnngatcttataactagtaaaaattagaatgaatgnnnnttttccaattttgcattgtaacaaagaacaagagacacttgttttatttaggttggaggcagccttgacttttaattgaggaagataaacaaatgaatgcaatttcattcatcgtaatcataactaccatcatcatcatctaactccacttcagcatcatcaaatgaagtcataagtgtgaggaacacaacaactgcaaccaactgtgctaccacaaaatatttggccttccttttgaaggttttctcctcctgtgttttctcccttttgggcttactcttcggctttgaacctaatttttttaaaaaaatgacaaatcaaacttcatgaagattgacaggacatgagagtttaaaatagcaaatatatacatatttctggccactgtatctaaataaaattattagagagaaggattctgttctagttatctatatgattcgagtactgcttatgcttgttaacacaatctcatcaagcaaaactaaaagagaagtctgcatttacaaaatccagaaaatatcttacttgaatgacttttagaagcagatgat

SEQ ID NO: 1736 - DNA, 765 bp, Glycine max
  misc_feature (118)..(118): n is a, c, g, or t
  misc_feature (761)..(762): n is a, c, g, or t
atgatcggcttccaaaagaattaaatgaaatgaagattggagatgacaaaggcaaaaacaacaatgagaaggtatatattgtgattcattttcttgttttcttttgatgtttgtgttngtcgtcaccgtgatacttctatatatgtaaaatcatttatgtatccattgcaaagtagcatactagttagtttttgtaaagctgttttttttcttcttaaatgcaatcactgagtatggtaaatgattttctttgtgcaggatatggaagcaactattgtgagtggtaatggaacagaaaccggtgaaattattacaactgctattggaggtcgagacggacaaccaaagcgggtattgatcccatgagttcctttattcctctgttacttccccttttgtaaattttatttcatggaattagattctgaaaaccccttttcttaaattcagtatttatgtattacactacttggtatatgttattataaggtgatatcacctgtattaatggtttagcatgaaatattttttttacatagttacttgtattaatgggttgctatgaaatatttttgcatatataacttgatttttgcctggctcagacaatctcatacatagcagaacgtgtggttggcactggttcttttggtgttgtttatcaggtattgatatttattttgcagtatttctttactcgtaggaattgatcctttgcttcactgttctatgggtttatctagttactttctttgcttatnnact

SEQ ID NO: 1737 - DNA, 355 bp, Glycine max
cctttatttctcacaaaaatggaggaacgtagtttgtactcactagtgtttcttgtgcttgctttggctattgtgaacaaagtgcatgggcaagggacgcgtgtagggttctattcgagtacatgcccacgcgctgagtccattgttaagtccacagttacaacccatgttaattctgatagtactttggctgctgggttgcttcggatgcacttccatgattgctttgtgcaaggttgtgacgcttctgttctcattgccggttctggcactgagagaacagcatttgcaaaccttggtttacgaggatttgaggttattgatgatgcaaagaaacagctcggggctgcctgcc

SEQ ID NO: 1738 - DNA, 384 bp, Glycine max
atatctctccgcaatggaaactgtgtgtgaaaggattggtgtaacagaaaactgtacacaagagggattccaaaaccaagtgctgagaaaagggtgtcaaaatcttggcctcaaagttgactatgtgccaagaaactcctcagggaatcactactgtggctcatgtggttatggctgtccgaaaggagagaaacaagggactcaagctacatggcttgtagatgcagttgaaagagatgcagtaataataacaggatgcaaagctgagaggttcttgttggaaagcaacaggagtggaaatggcagaaagaagaaatgtttgggagtgatggcaaaagcattaaacagcagagtcacaatgaagttacaaattgaggccaaggt

SEQ ID NO: 1739 - DNA, 727 bp, Glycine max
  misc_feature (467)..(468): n is a, c, g, or t
  misc_feature (488)..(489): n is a, c, g, or t
  misc_feature (492)..(493): n is a, c, g, or t
  misc_feature (503)..(503): n is a, c, g, or t
  misc_feature (524)..(530): n is a, c, g, or t
  misc_feature (539)..(543): n is a, c, g, or t
  misc_feature (552)..(554): n is a, c, g, or t
  misc_feature (574)..(577): n is a, c, g, or t
  misc_feature (582)..(586): n is a, c, g, or t
  misc_feature (588)..(589): n is a, c, g, or t
  misc_feature (591)..(597): n is a, c, g, or t
  misc_feature (600)..(616): n is a, c, g, or t
  misc_feature (618)..(618): n is a, c, g, or t
  misc_feature (621)..(631): n is a, c, g, or t
  misc_feature (633)..(634): n is a, c, g, or t
  misc_feature (638)..(639): n is a, c, g, or t
  misc_feature (641)..(649): n is a, c, g, or t
  misc_feature (651)..(660): n is a, c, g, or t
  misc_feature (662)..(667): n is a, c, g, or t
  misc_feature (671)..(672): n is a, c, g, or t
  misc_feature (675)..(675): n is a, c, g, or t
  misc_feature (682)..(686): n is a, c, g, or t
  misc_feature (697)..(709): n is a, c, g, or t
  misc_feature (721)..(724): n is a, c, g, or t
tcagagttaccttaagtaactcactaacattgtgctaaggaaaacacttgttagaataaaaaagtactatttgctgtcaatttttacattctaataatttgacagatttcctgtaaatatgtggtacataagattgtgcatggtgatgccccccttctttgccttcagatccagctttgggaatttgtcctttttatcttctgaaaaaaaatgaatatgctcttttatcctatagtattgatgcatatgggggattaaaggtggagatattccacatgattttaaaataaacaaggtcatgctactgtgacttagcatgtgccttttattgagttggggaccaattttgtgtggttcagcagcaatccaaataaattgcatctaggtcccaaactttctaatttagttagattttcatttttatgtgatattaatccttcttgcttgtgcagctattgtgtcgggtnncaagggcactgcacaagacnnaannaaaaccctcngggaagctggggtcacagttnnnnnnncccctgccnnnnntggagctgnnntgctagatgttttcaagcannnnggctnnnnncnntnnnnnnngtnnnnnnnnnnnnnnnnnanttnnnnnnnnnnngnntacnngnnnnnnnnntnnnnnnnnnnannnnnnatgnnggnttatttnnnnnttttcttttgnnnnnnnnnnnnntgcattaaaatnnnntca

SEQ ID NO: 1740 - DNA, 437 bp, Glycine max
agttcctcaacctttgtgagacaactgaagacattttacaagcctcatcacacgctgagcttcccttggctatttcagtgaatggtggaaacctcaatgaggtttccttcagcattctattggctgaaaaatggctcagacacaacgttcttgcacactaccctgcctcaaatatcaccaccattgttgtggaaaccactgctttttgccaacaagaccaccaacacaacaacaacctcgctgtggttctgtcttctttgaagaatgtctaccactctctcaagagatggggtttggagaaagacattaaagtctctgttgcttttaatctggactgtttgtctctaaactcagtttctcttaacaatgatttgaaactggtcaaacccctcatagagtttctccaagaggtaaactccacatattctgtgatccca

SEQ ID NO: 1741 - DNA, 1249 bp, Glycine max
  misc_feature (326)..(328): n is a, c, g, or t
  misc_feature (345)..(349): n is a, c, g, or t
  misc_feature (538)..(543): n is a, c, g, or t
  misc_feature (546)..(547): n is a, c, g, or t
  misc_feature (565)..(568): n is a, c, g, or t
  misc_feature (583)..(584): n is a, c, g, or t
  misc_feature (591)..(592): n is a, c, g, or t
  misc_feature (618)..(622): n is a, c, g, or t
  misc_feature (624)..(633): n is a, c, g, or t
  misc_feature (636)..(639): n is a, c, g, or t
  misc_feature (641)..(642): n is a, c, g, or t
  misc_feature (644)..(648): n is a, c, g, or t
  misc_feature (656)..(658): n is a, c, g, or t
  misc_feature (661)..(668): n is a, c, g, or t
  misc_feature (675)..(676): n is a, c, g, or t
  misc_feature (678)..(683): n is a, c, g, or t
  misc_feature (703)..(704): n is a, c, g, or t
  misc_feature (717)..(722): n is a, c, g, or t
  misc_feature (729)..(730): n is a, c, g, or t
  misc_feature (743)..(744): n is a, c, g, or t
  misc_feature (746)..(748): n is a, c, g, or t
  misc_feature (755)..(758): n is a, c, g, or t
  misc_feature (762)..(764): n is a, c, g, or t
  misc_feature (774)..(782): n is a, c, g, or t
  misc_feature (787)..(809): n is a, c, g, or t
  misc_feature (812)..(812): n is a, c, g, or t
  misc_feature (814)..(814): n is a, c, g, or t
  misc_feature (818)..(819): n is a, c, g, or t
  misc_feature (825)..(828): n is a, c, g, or t
  misc_feature (835)..(839): n is a, c, g, or t
  misc_feature (841)..(843): n is a, c, g, or t
  misc_feature (845)..(845): n is a, c, g, or t
  misc_feature (847)..(854): n is a, c, g, or t
  misc_feature (856)..(863): n is a, c, g, or t
  misc_feature (865)..(867): n is a, c, g, or t
  misc_feature (874)..(883): n is a, c, g, or t
  misc_feature (889)..(894): n is a, c, g, or t
  misc_feature (896)..(898): n is a, c, g, or t
  misc_feature (904)..(916): n is a, c, g, or t
  misc_feature (918)..(921): n is a, c, g, or t
  misc_feature (923)..(939): n is a, c, g, or t
  misc_feature (946)..(946): n is a, c, g, or t
  misc_feature (948)..(953): n is a, c, g, or t
  misc_feature (955)..(956): n is a, c, g, or t
  misc_feature (958)..(958): n is a, c, g, or t
  misc_feature (967)..(979): n is a, c, g, or t
  misc_feature (983)..(985): n is a, c, g, or t
  misc_feature (991)..(999): n is a, c, g, or t
  misc_feature (1002)..(1007): n is a, c, g, or t
  misc_feature (1009)..(1009): n is a, c, g, or t
  misc_feature (1018)..(1018): n is a, c, g, or t
  misc_feature (1020)..(1029): n is a, c, g, or t
  misc_feature (1031)..(1035): n is a, c, g, or t
  misc_feature (1038)..(1039): n is a, c, g, or t
  misc_feature (1043)..(1055): n is a, c, g, or t
  misc_feature (1060)..(1061): n is a, c, g, or t
  misc_feature (1065)..(1079): n is a, c, g, or t
  misc_feature (1083)..(1099): n is a, c, g, or t
  misc_feature (1101)..(1111): n is a, c, g, or t
  misc_feature (1113)..(1124): n is a, c, g, or t
  misc_feature (1132)..(1142): n is a, c, g, or t
  misc_feature (1148)..(1150): n is a, c, g, or t
  misc_feature (1158)..(1185): n is a, c, g, or t
  misc_feature (1187)..(1204): n is a, c, g, or t
  misc_feature (1206)..(1213): n is a, c, g, or t
  misc_feature (1217)..(1222): n is a, c, g, or t
  misc_feature (1224)..(1225): n is a, c, g, or t
  misc_feature (1227)..(1229): n is a, c, g, or t
  misc_feature (1235)..(1235): n is a, c, g, or t
  misc_feature (1239)..(1241): n is a, c, g, or t
  misc_feature (1244)..(1245): n is a, c, g, or t
gaatgcctccgcggcggtgcacggcggcgtattcggcagtggcgcagatgggcagcaacacgagcgagagcgacgcggaggagctggtgatgcggtgcctctcgtgcgaggaggagtacgacgtggacgactcgggaacctgcagggagtgctaccaggaggccaacgaggccgaggaggagctccgccacgagatcgaggagctcaaatccaaagtctccttcctcactctcccctctcccaatcttaacgcttccaccgccgatgtcgtcctcgttcccgtcgacgactccgacgacgctcccattcccgctcacaaaaatgcnnnatatggagagtatgctnnnnnaaggtatatttgaattttgaagtatatgtcagtaaaaagtctgtgatccacgatggtagtgactaaggttggtattgtattgtttgtttccattgcagagtttgtgctgatcgtcatttgcatggtactccttatatgtacggtactccttatatgtcgactgattgcaatgcatgctgtgagaattgnnnnnntgnntgctgtggttgcacttgnnnnagaggttctgaggannaagcagnnctaccattattattcataatgggttnnnnntnnnnnnnnnnctnnnntnntnnnnntggggatnnnttnnnnnnnnaataagnngnnnnnntgataggacaacggatatgnnagcgtcattatcnnnnnnttgcgannaggatgctaacanngnnnccatgcnnnntttnnntttttttaannnnnnnnnaatannnnnnnnnnnnnnnnnnnnnnntcntncctnntttctnnnntttttcnnnnntnnntncnnnnnnnntnnnnnnnncnnntactttnnnnnnnnnnttttcnnnnnncnnnatttannnnnnnnnnnnnannnncnnnnnnnnnnnnnnnnnattttcnannnnnntnntnatcatcccnnnnnnnnnnnnnctannnatttcnnnnnnnnntcnnnnnntngttcttttncnnnnnnnnnntnnnnnctnncctnnnnnnnnnnnnntccgnngaannnnnnnnnnnnnnntttnnnnnnnnnnnnnnnnntnnnnnnnnnnntnnnnnnnnnnnntacgcttnnnnnnnnnnntgtttnnnttccctgnnnnnnnnnnnnnnnnnnnnnnnnnnnnannnnnnnnnnnnnnnnnntnnnnnnnntttnnnnnntnntnnncccccncatnnnacnncccc

SEQ ID NO: 1742 - DNA, 615 bp, Glycine max
gtttccaacggtacaacggtagatgatgggaacgctatctacgcaatttcgttccatcaaacgcccaaattcaaaccctaaactatccaaatcgtcatctcctacaaaatcagaaattaaattcaacgctaaaccaaaaccaaaatcagagtcagagtcagagtcatggtctgtttatctcatcctctccaccaaccatcctatcaaaacctacgttggaattacaaacaatttccctcgccggtaattttcattttcaattaaattgtagtctaattgtcatcttgtccaatgggtgctgaattttattttattactttccttttgatgttttgcatcgcatttctgtgatgcgacgtatcgtactttttgtatctgtgtgtctatgttttttccccattaaaattagtcagtgatctgattagttttggggttagatttgtttccgagggaaattacaatacttctgttctgtagtgtaaaatttcctaggattctgctaagaaaattgcagtttgagttgtgacactagttaagttagaggttaatcaatgtaaaagtaaatcactattcagtaaaaaaaaagaaaagtaaatcactattcagtaaaaaaaa

SEQ ID NO: 1743 - DNA, 525 bp, Glycine max
atgcaggtatggctcttcagatgttcaccatatcttttgcatcttattcctttattgtcttttactccttagtgaatctatttattgattacggttgttattttgttgtggtttcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccattatgatgctgtttagaatattaccaagatgttgttctctttagcaaacttcgtattgctcattattttaggatgcgaaggtgtgacacctttcatttgtttttattctaaagcctcggaatcataactctgata

SEQ ID NO: 1744 - DNA, 1052 bp, Glycine max
  misc_feature (377)..(377): n is a, c, g, or t
  misc_feature (433)..(433): n is a, c, g, or t
  misc_feature (475)..(475): n is a, c, g, or t
  misc_feature (478)..(479): n is a, c, g, or t
  misc_feature (497)..(498): n is a, c, g, or t
  misc_feature (510)..(510): n is a, c, g, or t
  misc_feature (512)..(512): n is a, c, g, or t
  misc_feature (515)..(515): n is a, c, g, or t
  misc_feature (517)..(519): n is a, c, g, or t
  misc_feature (527)..(527): n is a, c, g, or t
  misc_feature (531)..(532): n is a, c, g, or t
  misc_feature (540)..(540): n is a, c, g, or t
  misc_feature (543)..(543): n is a, c, g, or t
  misc_feature (560)..(560): n is a, c, g, or t
  misc_feature (562)..(563): n is a, c, g, or t
  misc_feature (565)..(565): n is a, c, g, or t
  misc_feature (570)..(572): n is a, c, g, or t
  misc_feature (584)..(585): n is a, c, g, or t
  misc_feature (604)..(610): n is a, c, g, or t
  misc_feature (625)..(627): n is a, c, g, or t
  misc_feature (629)..(629): n is a, c, g, or t
  misc_feature (631)..(631): n is a, c, g, or t
  misc_feature (633)..(634): n is a, c, g, or t
  misc_feature (636)..(641): n is a, c, g, or t
  misc_feature (643)..(644): n is a, c, g, or t
  misc_feature (647)..(651): n is a, c, g, or t
  misc_feature (653)..(656): n is a, c, g, or t
  misc_feature (658)..(666): n is a, c, g, or t
  misc_feature (669)..(674): n is a, c, g, or t
  misc_feature (677)..(677): n is a, c, g, or t
  misc_feature (679)..(681): n is a, c, g, or t
  misc_feature (684)..(689): n is a, c, g, or t
  misc_feature (691)..(693): n is a, c, g, or t
  misc_feature (695)..(697): n is a, c, g, or t
  misc_feature (699)..(710): n is a, c, g, or t
  misc_feature (712)..(724): n is a, c, g, or t
  misc_feature (726)..(758): n is a, c, g, or t
  misc_feature (764)..(787): n is a, c, g, or t
  misc_feature (791)..(802): n is a, c, g, or t
  misc_feature (805)..(813): n is a, c, g, or t
  misc_feature (815)..(826): n is a, c, g, or t
  misc_feature (830)..(845): n is a, c, g, or t
  misc_feature (847)..(850): n is a, c, g, or t
  misc_feature (858)..(869): n is a, c, g, or t
  misc_feature (892)..(899): n is a, c, g, or t
  misc_feature (906)..(910): n is a, c, g, or t
  misc_feature (921)..(926): n is a, c, g, or t
  misc_feature (928)..(931): n is a, c, g, or t
  misc_feature (939)..(944): n is a, c, g, or t
  misc_feature (946)..(948): n is a, c, g, or t
  misc_feature (951)..(952): n is a, c, g, or t
  misc_feature (954)..(959): n is a, c, g, or t
  misc_feature (962)..(979): n is a, c, g, or t
  misc_feature (981)..(982): n is a, c, g, or t
  misc_feature (984)..(994): n is a, c, g, or t
  misc_feature (999)..(999): n is a, c, g, or t
  misc_feature (1003)..(1007): n is a, c, g, or t
  misc_feature (1009)..(1009): n is a, c, g, or t
  misc_feature (1011)..(1020): n is a, c, g, or t
  misc_feature (1025)..(1032): n is a, c, g, or t
  misc_feature (1034)..(1038): n is a, c, g, or t
  misc_feature (1040)..(1044): n is a, c, g, or t
tccagacctagaaaagaggtacaattgttgaagtgatactctttttgataattcatggacaaattaatctttggaaattgttatatggtggaaatattttattcattgctaacatttttaatttgacatctactgtaaaggtcaggaggccatcaaactttgcagatttctattcttatgctttccaatattgtttaacaggtaaactttgatgggattttgtgtacattaattttaatcttttttttctttcttttcttttgttctttcatgttgaagttgtttggactttggagttttttttttttcaaatttaaaaaaatttttcaaaaaattgggaaaaaaaaaaaataaattcctctgaacccccccctttnttttaattttcccctaaccaccaatttgaaatggaattaaattggttaaaaaaatnctaaacaactctgcctatttataccatcctttggaacctttnttnntcaaaaaaaaaaaaattnnaatttttttccncnaantnnnatttcttnaatnncccaaatncanttttcccaattttgccnanngnaaaannnaaaaactttaannaaaagagcttttgggaatnnnnnnncttgttttgggttcnnnantncnngnnnnnntnnacnnnnntnnnnannnnnnnnnggnnnnnnaangnnnttnnnnnnannntnnngnnnnnnnnnnnnannnnnnnnnnnnntnnnnnnnnnnnnnnnnnnnnnnnnnnnnnnnnncaaaannnnnnnnnnnnnnnnnnnnnnnncccnnnnnnnnnnnngannnnnnnnntnnnnnnnnnnnngaannnnnnnnnnnnnnnnannnnaagaaaannnnnnnnnnnnttttccccaaaaaattcccaatnnnnnnnntgggttnnnnntattttaattnnnnnntnnnnaaaatttnnnnnntnnnaanntnnnnnnttnnnnnnnnnnnnnnnnnntnnannnnnnnnnnnaaaanttgnnnnncncnnnnnnnnnnaaaannnnnnnnannnnngnnnnnaaaaaaaa

SEQ ID NO: 1745 - DNA, 391 bp, Glycine max
  misc_feature (53)..(59): n is a, c, g, or t
gtcgtagcatgccgttcgcgcgatgcaacagccagattccggcgccgctgccnnnnnnnattccgaccgggagaggcacgcggtccgccgcgaacgagatcttcagccagtttctcgagaagacgctgcagatcccggagctgacgctgccgggaccgcacctcccgcccgcgccggcggagatcgacttccggtcgctgactcttgtctccaccgatctgatgctgcgctctgccagggagttcggcgcgttccgaatccggtgccacgggatctccggcagcgaactcggaaccatggcggacgaagccgaacgcgtcttccagaaatcgcgaaacgtcgtcgtcgtggagcgcaacggaactggcggagagatgattccctgtgttcg

SEQ ID NO: 1746 - DNA, 381 bp, Glycine max
  misc_feature (374)..(374): n is a, c, g, or t
tgtgcagtatgttgatgctggaagacttggaagaaaacgaggtattggtgtgtatgaatatagtaaagatccaaggtctacaaaatcatcttcccgtctctaaaatgtttgtttcacttggaagaacaatttttcaacacccccattttaattaccttgtgtctgactgtgggggtggtgcacacggctgaagttgaatacttgaatgtgtcttctatgtcttttatgcatacaaacaaaaagaaaattgcaggaactaatagtaaaacatgcatagttaaatctttatgcatagttaattttattttgttgtgtttgactgaaaaattctaaacctattaacttttgtctatatttcccaagctgattccaanactaaat

SEQ ID NO: 1747 - DNA, 842 bp, Glycine max
aatttgataacttaacaggaatgagaaatgaaacgtttaatgagagatgaccattttaataaggcaatctaattattgacaaggattagcctaagcaaccttggaatgtcatcaacaccttatccaccttccatcagaagaactccttgcaaaagtgcgaggctgtttcttgggaaaggtttctgtccagtgtggatgctcgatcaaataattccactgcctgaagatgggaaatgtgattattatctcctgtgagatactttagcaaatataaaggtcttggaaacaatgggcagcatatagatttagatatcaatccagtagtctactcagatgtgcataaaaaagaacaaatggttttaatcttacaaaaactttggctcttcttgcagagaaatatatcagtgaagagaatcagaacccaaagtttgaatttcatcattgaagagaaatgaggataaaccaaggcaaataaatggaagggtttgaagttttacagttgaaattagagtactgaagggaatccgaccttaccaccagttgcagctacaagatttttgtatttttttttcagagaaacagtataaattagattgtttaattaggtatgtaagactgtctaggtagcatttataaaagatatttcacaaaaaataaaataaaatagtgattcaaaaaactgcatcattataagacaataacaacaatatttttatcccactattgatcacatgatgtcattgaactcaatttaaaaccaaattattagggatattattcaccatgagattccattcaataatttcctccaatatccccatcattttaagactgatgaattt

SEQ ID NO: 1748 - DNA, 364 bp, Glycine max
gtagaaaaaaagttgaaactgcagaggatttggagaaaaagaaaatgaaagttcttatgggtggggcagcagcttcagcagttaagatatgtgctatatgtaacgtggtgtgtaatagtgagacggtttataactatcatcttgcaggacaaaagcatgctgctatgcagaagaaagcatcgggtcatacacaatccaatgccggttgaattttcccttttttttaggaacatcacttgttttagcaactccattctgcatttgaatagaatatcatccattgcttaatttttagtttgaatatgaaatgtgcagagtatatatacatttgtgcattgtattagaagttgagatgcctcacacc

SEQ ID NO: 1749 - DNA, 402 bp, Glycine max
accctttaaattcatcataaaatataatttcaacacgtacatgataagaccaatcaaacatgaataggagccaatatgccttgcaattcactgcatcataaatgccacaatagaaaccaacacagaagaacataaggtcaccccagaaacagacaaagcaaaccctgcaccagtctccatttgcgatgtgggtgcaatttctgattgtgccacagttttggtcacgtaaaacgtgctcaaaaccattgctgcaataaaaaaatgagctgcacagtctccaagttttgccatatttccacagaatatgttatgttactgtgaaaacgtgaccaaagagatgactgaaaaggattgaactggtttggaattttgagttgttcaatggcacagtcaagagttgag

SEQ ID NO: 1750 - DNA, 391 bp, Glycine max
agactgttgagccaattccatctgttgaaccttcccctgctgctaaggcccttgagcccaatgctaccattgctggcttcaccgactaattcatcaactttttttgtatttgctttggcctttgtagtagtatgatttaagttactgaataataataacaagtggggactatgatgggttttgtagtggtggagtttctatttaacgaaaagcttgacattattcagttagtggtgtttaagcaaatataatgaataaggaaaggaagtataattatgtttgccatcatttcattatattttcgaattgtggttgtgtttgtataattatataataatatcatttgttgtatattttataaacacgtgccttttaagccgacgcctatagt

SEQ ID NO: 1751 - DNA, 790 bp, Glycine max
  misc_feature (481)..(481): n is a, c, g, or t
  misc_feature (496)..(497): n is a, c, g, or t
  misc_feature (516)..(518): n is a, c, g, or t
  misc_feature (526)..(527): n is a, c, g, or t
  misc_feature (529)..(530): n is a, c, g, or t
  misc_feature (532)..(533): n is a, c, g, or t
  misc_feature (536)..(538): n is a, c, g, or t
  misc_feature (543)..(543): n is a, c, g, or t
  misc_feature (553)..(553): n is a, c, g, or t
  misc_feature (555)..(557): n is a, c, g, or t
  misc_feature (562)..(566): n is a, c, g, or t
  misc_feature (569)..(572): n is a, c, g, or t
  misc_feature (581)..(586): n is a, c, g, or t
  misc_feature (592)..(598): n is a, c, g, or t
  misc_feature (600)..(616): n is a, c, g, or t
  misc_feature (619)..(625): n is a, c, g, or t
  misc_feature (627)..(635): n is a, c, g, or t
  misc_feature (637)..(653): n is a, c, g, or t
  misc_feature (656)..(663): n is a, c, g, or t
  misc_feature (667)..(680): n is a, c, g, or t
  misc_feature (682)..(686): n is a, c, g, or t
  misc_feature (695)..(705): n is a, c, g, or t
  misc_feature (708)..(708): n is a, c, g, or t
  misc_feature (710)..(716): n is a, c, g, or t
  misc_feature (720)..(722): n is a, c, g, or t
  misc_feature (731)..(735): n is a, c, g, or t
  misc_feature (737)..(745): n is a, c, g, or t
  misc_feature (747)..(747): n is a, c, g, or t
  misc_feature (753)..(762): n is a, c, g, or t
  misc_feature (764)..(766): n is a, c, g, or t
  misc_feature (769)..(774): n is a, c, g, or t
  misc_feature (776)..(787): n is a, c, g, or t
agttgctcatgaattcattattgacttaagaggctttaaggtaggtccaactgatcattgcagtttttttttcaaccaatcaggattattcatattctgcttaattgtaagctatctctatggtagaatactgctgggatagagcctgaagatgttgcaaagcgccttatggactatggtttccatagtccgacaatgtcatttcctgtgcctggcacactcatgattgagccaactgaaagtgaaagcaaggtatgattacaatctggaatcgagtgacctcttttctttgtactttctatcatgtaaaattttctttaattcaactaaacatcattgcaggccgagctagacaggttttgtgatgctcttatttccattcgacaagaaattgctgagattgagaaaggaaaggccgacattaacaacaatgttctaaaggtatgtgagactatatgagattgttgttttgcctctttgntattctcctctatcnncatgatataatcagaaacnnntgactacnntnnanntgnnnggcgntatacttgtncnnntgaannnnnatnnnnatttccaannnnnntctagnnnnnnngnnnnnnnnnnnnnnnnnctnnnnnnncnnnnnnnnncnnnnnnnnnnnnnnnnnaannnnnnnnaaannnnnnnnnnnnnnannnnncccctttcnnnnnnnnnnngtntnnnnnnnaaannnaaaaaaaannnnnannnnnnnnnancaaaannnnnnnnnncnnntannnnnnannnnnnnnnnnntcc

SEQ ID NO: 1752 - DNA, 683 bp, Glycine max
  misc_feature (623)..(625): n is a, c, g, or t
caatctcacaatagacatttgcttgtgaagctgaggtgactgggccaggcatgcaggttgacctttgtagtccagtctaaaaacagcagctcctccctcactagatccagctatcaactttggagtgtggatttcacaaaaaccttcagataataagaattgtctaaacgcctgcccaacaaaacaatggaaagttaaacaaagcatttgactcagaatctaactgcaaatgcatttcttatgcaagtgtctcagtaatcagtaagcacttatatcaataaacttaaatttgaagcaaccccaactggtgccaaagtgattaaaaagtaaataattaaactcatcaaaatagcatcaaagataatatgctttacatttccaacttgagactgaatgcggaaaatcccttgattagctggcgttcgcacatcaagcaccctaaagttcagacgtgtatcctgattaacacgaacaagttgctcaccagcctgcacccattaaaactcccattaacaagcacataaagcaagatcaaaataataacagtgaattcctcaaacaaacaggatacatcaaacaaacaaccacccaaacatctttactcaaaatacctgaagagccgnnncgatttcaacttcacttcgagcagcatcctcaagattaataggcagagtaggacagcc

SEQ ID NO: 1753 - DNA, 754 bp, Glycine max
  misc_feature (692)..(699): n is a, c, g, or t
  misc_feature (746)..(749): n is a, c, g, or t
ttctctcttctcccttccatccatccagacaaaaaggtataaggccccgccagataagtgccctatcgttgaaagccttaattaattaatttatacatataatgctgtacataatatacatatatacatccctgctgaaaatggaggaaaaggttccccccaaaatagtacatgttagattagtttagtgtacaaaagtggataactgggtgggtgacaggtgtatccgccccactcctgaagagctggagaattttggtactccggacttcactatatacaatgctggacagttcccgtgtaatcgttatactcactacatgacatcctccactagcatagatcttaatcttgctaggagggaaatggtcatcctcggcacacaatacgccggggaaatgaagaagggtcttttcagtgtcatgcattatctcatgcctaagcgccaaatcctctccctacactccggatgcaatatgggcaaagatggggatgtggcactcttctttggactctcaggtatagtatcagccgatcaccggttgaaatcggtataatgtggctccacacagctaccctaccatatgttccttcccctcttactactactcagccatactcaatactccactgcttgttaattatcaactatgttgcatgcttacacatggatgttttgtgttatggctacnnnnnnnnccatttttctacaatcctaatggatccctttgttctcttttttactnnnntgtta

SEQ ID NO: 1754 - DNA, 372 bp, Glycine max
gtgaatgggaggtacattgttcagaagaccaaagatagtgaattgggaaccctcttgggagaagattggatcagaaaacacgctgcaaaagttaggcaattccatgtgcactatcaaagaagctcgtggaataagctattagggattctgaagttggatagtaatgggtcaatgccccatattaacttggcaaagtcaatgaaggagaaactcaagtcgtttaacacagtttttgaggagatatgcaaggaacagtcttcatggtttgtctttgatgagcagcttagggaagaaataagaatttcgcttgagaaaatcttgcttcctgcgtatggaaactttgttgcaaggtttcagagtgttcctgagctt

SEQ ID NO: 1755 - DNA, 733 bp, Glycine max
ggaaagattacctacattgcaccacctggccaatattccttacaggtttgtgttcttggacttctttgctattgtatatccagttctatttctgttagaagataattttttagtccattatttcttttattatttcagttttctttttttagaatgatatttgtcgcttctctttcccttttgttcatatttttgtgatgatggcaggattgccaagcttacatatgtgttcaacatcttctattctcacattcagtagcttctctatattttctgcaatttatgattttaatctttctataattttcaggatactgtattggaacttgagtttcaaggtgtcaaaaagaaattcactatgcttcaggtttctagccatttattttgttcatcatttcactgtagttgcttcattgaagtattggtattccttatgattatcctacattacaacttccttgcgtgtactttacccattttcagacttggcctgtacgtacacccaggcctgttgcatcaaaacttgcagctgatactcctcttcttactggtcaggtaaactcagttgttaccaagtgtctcctccatgatctaattgtgatagccttcatgcttaatgacttctgttttttacagcgtgttcttgatgcccttttcccctcagttcttggcgggacttgtgccattcctggtgcttttggttgtggtaaaacagtcattagtcaggctcttt

SEQ ID NO: 1756 - DNA, 393 bp, Glycine max
agcaacgcttcaaccatcctaagctccctcgccaccaaaaacctcgaccccaccgacgtcgtagccctctcaggcggccacaccataggcatcagccactgcagctccttcaccaacaggctctaccccacacaagaccccgtcatggacaagaccttcggcaacaacctcagacgcacgtgccccgccgccaacaccgacaacaccactgtgcttgacatccgatcccccaacaccttcgacaacaagtactacgttgacctcatgaaccgccagggcctcttcacctccgaccaagacctgtacactgataaaaggactaagggcattgtcaccgactttgccgtcaaccagaacctcttctttgagaagtttgtgttcgctatgctcaag

SEQ ID NO: 1757 - DNA, 365 bp, Glycine max
  misc_feature (22)..(24): n is a, c, g, or t
  misc_feature (52)..(55): n is a, c, g, or t
agacgattcctccgttttgagnnnttgggtgctgctcaaactagatgcttcnnnnctggcagttggtttttatagcctgtttcatcttgtaaatgcctacactggaatcgtgataccatgtagaataaggctagtcttgcatattgttttgaacaatgtttacaatttacaaacatcatccatacgcaggattatgcttccgtgaaacggtcattccaaagacgtgtttgaaacaaataggtctacatcaaagttcatataggttaagctttatttgaaggatttcgatatttgctatgctctaattatggtgcagctattcacagttcgaacgtctgtttagaatttagttttgttgaaatgcc

SEQ ID NO: 1758 - DNA, 382 bp, Glycine max
ttactggacttaaacatgctctgtcattaacacagacttcacagcaaaaaacccaacagcagaaatcaagtcccacaaaggattcaccggttatttctgatgataaatctaacctcttagaggatgatgccgagggtcaatctggcaaggatgaagacgatgaaagtgattctgaagaggattcatgctcagaaagtgaagtagaggatcctgcggatataaaagctgctagaaaagaggctaggaaagagaataagaagaaggtgaaggaggagaaaagagaagcacgtaaaactaaagttcctaaggctgttaagaaaagaaagaaaaagttggctaaagcgaaaaagaccagatagatagttgtagttatatgtaattg

SEQ ID NO: 1759 - DNA, 988 bp, Glycine max
tcacgccgccacgacgattccgacggcttcgaaaccgccagcgacaccgatctggccggtgaaggcgacgacagtggggccggcatcccggaagaacagaatcgcaccgaacagagtcataccgagaagcagacggagcaagagccggaacacgatgctcctcggagcagcgaatcatccgagaacaatgccctgatcagtgaagaagaatcgagacaggttcggttttaaaattaagggttttgtgattaggtctttctgattgctacaatagtttttattttttttctgcatttatgttttttttcttgttgtgtaatgaattttaattggaatgctataaccattttttggccgtgtattggattgctatgcttatgctaaggttattgatttttgtaataatagttactttaaaagtaatatctagactaatttctaattagttcccagcaggaaaggattgtataatgagaaatactagtaatatattaacattctttattgttggttgaaatttattgagaatcacaaaactgtgcaggactcactccttatttagtgagtttctgctgatgattttgcagtttctaataaattttaatccaagagcagagatcatgataagttgataatgagtgtgtttatgtgttagagaatttgtagtgtaattagcattcctcttgtataatatttggctcgtgtggttgattgtgtgactaattaccgattgacatgttctattattggagcactatgggttgtgtgcagataaaaatcttgtattatgcgattcagacacatggattcatcaaactatgaaattggtatataactgtatgttaatccctttgtgcatgtaaagagaatattgaatgctattcatttatgagacagaaagcattgaatcaagcaaatgaagcaaaggtagaagggaataagctttttgtagaagggaagtatgaagaggcattattacaatatgaac

SEQ ID NO: 1760 - DNA, 315 bp, Glycine max
tcttcttcttctcgttcttcttgctatcgttccctccactggcactgggactagttttttctttcttctcacctttttcatcccccatcactctcacccctttctttctaagaaagaaagtgagaattgagaaatggtatgaaaggaaaagagagagagagagagagagaggaatgaacacgaacttgttcgatctgggagggttcgagaatgttcggcggtatagatctcggcgcgtaggttggtggtgagttacgaagtggagtgagagtggggagaagaagaagaagcgtgagagagggttatttcaaaaat

SEQ ID NO: 1761 - DNA, 414 bp, Glycine max
tcttctccttcaacgccgtggaagaagaatagagtctgagtctccgttatgttccgcagaatcttgtcccatcatcgcgcactctcagcctgcgcccacaatgcaacaacgcgctcactcgttactcgccgcacccccaatgttccaccaccacccaccttcctaatcacaggatcaaggcccgtttcttccaaaacatcccaatccaacgaaaccggtgaaaccaccaataaggtcagtgagcgagtgagcgagtcaattactctgcttccaaattaaaacctattttgatctatttgtttttgtaggctaaaaaggatgtggcaaacgtcgaggatccctttagtgcccctacttataacattcctgagaagcctgtcacgttcgtggaaggggcttcctacagtgttgtca

SEQ ID NO: 1762 - DNA, 635 bp, Glycine max
gcatgtccacataccagctcacagaggcataggcatctttgtccttgtcctaagtattcttcaggtctgccactgactcatgtcatgtatcatattcaatgttcagtcttctacctatcactttgttaagtattgtttgtgtgctaaatataagactcgagctaaattaattaatttttttaattcttgcgaattaattaaaaagtcttatatacatgacggatgcaatacaatttttaactgatataaaattaggcttgatgatttgagatatatgctttccatctaaagtaaaatttgaactgacatttaaagctatgtgagttcagatattggcattcttcttgaggccagacaaggattccaagtatcgaaacatttggaatttgtatcacagttggtttggaagaatggcacttttctttgcagcattgaatatagtcctggggatgcgagctgcgggagcagggaatgattggaaggcaggctatgggttccttcttagcattgtacttgtcgcagttatcgttctggaagtcttggcgtatttgaaaaggtcagaaaagcgttctcttcctcagactttccaaatggacccagttggagatgctaacttcccaaccaatctaactaaa

SEQ ID NO: 1763 - DNA, 1185 bp, Glycine max
  misc_feature (21)..(21): n is a, c, g, or t
  misc_feature (56)..(59): n is a, c, g, or t
  misc_feature (61)..(61): n is a, c, g, or t
gcatcttgagcaccttggggnattggtgctgcggctgccggtgcttatgccttggnnnntnattatatatcttccttcaataatatattttgttcacgatcgtttatttaatttgaaatagatttatatattacttatgtgagatgattcacaccccctttttatatattttagctttaaaatgttaccttcaccagaataaataaaagaagtgcaaactctttggtaatcgagggaaatatatatacctcccccacatatacatcatcacttagacttggacgtatctaaatcggttaattttaatatgtttatatgtatgcgtgtgcattaataattttcatatttttttttgtaagcattttaaagccttacatattgaaaaaattgtcattaatttgtgttttggacatgaattaatcctatcatcttgaatcatgtccacaaataatttcaatttgacattttctttttaaggcggccaacatatatacatacttgatctttgtacttttggattgtgatgctttaataattgtggataatagatataaaaatatattatagctatatagtattatttctctctacccactgtgtgtaactatactgtctatacatctcatgtggtttgttttttcttaaatgaaaattgttggggtcatgggtgtatagagtatagtacttttatgacgccatcagaagagaaacaataaaagttcataaaaaattaggtgtagaaaaagatggaacttaagaaagaaaaaagagagagagaaagtgattaagtgatgtaatatataatgagaaatgaagaaaaagataggaagacaaataaagtaaaaaaaagaaagaaagaaagaaagatatataacaaaaaattgaaatgtatattctaatatgtattgaaaacaaaattgatccctttttgctgcaatggttaattttatgacagcatgagaagcatgaggccaagaaagacccagagcatgctcacaggcacaaggtagaagaggagattgcggcagcagctactgttggtgctggtggttttgtcttgcatgaacaccatgagaaaaaggaagttaagaaagaagatgaggaagctcatggaaagaagcaccaccatctgtttggctgaacatgataaatattcatatataattaatattcaagctccaaacg

SEQ ID NO: 1764 - DNA, 1134 bp, Glycine max
  misc_feature (538)..(541): n is a, c, g, or t
  misc_feature (1035)..(1037): n is a, c, g, or t
  misc_feature (1071)..(1081): n is a, c, g, or t
  misc_feature (1115)..(1116): n is a, c, g, or t
gacttcgatttggcgacgcaggagatcgcgaagggcgttagggcagaggaatggggcttgatcgacgatgcgcttctccactaccgtaacgcgcactcgatcctcctcgaagctaattcaactcccgttccgtcctacatcacttccaggtactcacaatttcacgccaattaattgtttcttcgatgcaaaagtagggtttctgaatgagttctaataatatgaatgtttttttgttgatggaatctgtggcagtgaacagcagaaggtgcaatcttatcgagagaagatatccaaatggcagagtcaggtttctgagagattgcagactctcgctagacgagctggtagctcatctgctaatcaggtatgaatgtagttggtgtttagattttcaaagcagaatgtgttgtttgcagagttagtttttgctttgttgttctgaaatttgaggttgagattgcaaagtgtcattgtaaggaacacattaactgttaaaactgttacctctgttccatgatgttttagactttttttnnnncataattattgattattgatgttgtacatcaaagtctcgttaattaaactaccgagactgtgtatcaactgacatgggtttgtttcagtgtaaacggttgtcttgagtttgagctctgagcctgagtatgcagttgtgttaagaaaaaaaaggtctgattaatttattgattttcacttatatatcctatttaacaattgttactgacttacaatagtaatttataaccagtaatgagctattaaataaggtattttaattcaaatctaactattattttttacatatattaagtgcttcttaatctgtgttaaccttaaatatcaatagatatggaatggaggcagtgttttgtatcataaatgaggggattcggattacttccatgtaggcagttatagttgtatttttaggaagtaattatgttggccaatgttcagagttcagagcctttggacttttcagcaaccctgttaaattacaatcatcgagtnnncttacttcatatttgtcatagggtactaattttnnnnnnnnnnnaacctttaatgtttctttctttttcctcaaaaanntgcagagcacctcaaaac

SEQ ID NO: 1765 - DNA, 355 bp, Glycine max
ggtcgagctggcgtagattactatatccgaccggtcccaacaaccccatgtgatgggcgtgggccgtgtgtggttggaagtggctatgttctcatagcaaggtcatccaaccacacttgccctcttagtgttgcggtggtggagggtttccgtggcctagcagtcacattcaaactagttaaccctaaaaaaggggtcattagggtttctactgacttgaacatcaaaacctccctaactaacacaagttgtagtgagtccacggtctggaagctagatgcctttgatgattcaactggacagtggtttgtgaccactggtggtgtgttgggaaaccctggcaaggataccatcg

SEQ ID NO: 1766 - DNA, 739 bp, Glycine max
tgctacaaccatatatctacaccatacaataggtgactttgctgaggcattggcagcaaaaatgcctggaaaccttaaggtctgtttttcttgctcctcgaatatttgactgtatgattgcattatgcctcccattcttgaagttccttataatatagttttaaattgtgagtcataaccgcaattgcagctgcaatgtaaagggtttttgacccagtgcaaccgcaattgtggtcacattagccgcattttccttgctcttagtgttcagttttttaatgtggctagatttcttttgacaaggaaaccaggatcctaattgatgacagttaaaaacatgattttaaattgcaggttgtttattttgtaaattctggttcagaagcaaatgaattagcaatgatgatggcccgtttatatactggtaatctcggtatgatttctttgagaaatgcatatcatggggggagttctagtacacttggtctgactgctctgaactcgtggaaatacccaattccagaggtttgtctgtaaatttaattataattttcaattggtaggatgatcatatatggaaattattcttaacaatgatttaaaccttttagggccatgttcatcatgttatgaatccagatccatatcatggagcctttggtacagatgctgctagttatgcaaatgatgtccaagaccatattgactacggaacttcgggaaaagttgctggatttat

SEQ ID NO: 1767 - DNA, 407 bp, Glycine max
catgcttacgtggccgttgtttggggatcaattcttcaatgagaagttcattgtgcaggtactaagaattggagtgagagttggggtggaaactcctgtgaactggggcaatgaagagaaaagtggggtcttggtgaagaaagaacatgttttgaaggctatacaagtcttaatggatgagggaaatgaaagggaagagagaagaaaaagggctagagagcttgcggagatggctaagaaagctgtagaaggaggatcttctcacttcaacgtaacccagctaatacaagatatcatgcaacagtccaacaaagactagtactaacgatcatcttcggttatcaaaggcatattaatatatatacactatttcagaagaagttcctaattagcttgcagagggttag

SEQ ID NO: 1768 - DNA, 392 bp, Glycine max
  misc_feature (371)..(371): n is a, c, g, or t
ctcagctttgaaaaattgaattgacacagcaatatatctgacatagattcacaatcaaacaaagattacaagcaaaaactagaaacaaagaaagagggaaagaaaaaagaagcaacaaagccatgagcttgaacattcaaaataaatattgacagaaaaatttgtagttgaggaagagcacttgcacaggtgtgactgaaagcaataatttctttcaagtgattcagttaccagaaaggaaatggatactctacagcagagaagagttactgagaagtgaactagtcttctaacttttgctttagtgtgccctttttagacttctttaactcccatggtggtaggcaacctttatagtgagagtgcaattnacatggtcaacgaatcatcag

SEQ ID NO: 1769 - DNA, 349 bp, Glycine max
  misc_feature (288)..(289): n is a, c, g, or t
  misc_feature (340)..(343): n is a, c, g, or t
attaaagagtacactcgattctgtgcatgaagagcaagggtttatagctgaacatgttcaaatgttagatgttgaaatagatgcagcggcttcaaaagttgaagacaaattttctaatgacggatttgataaagctgaagcacagagggaagacgccaaacttgagagctctagtaaatcaataatttcctgtaaaaacagcaatggtaatgatgaagatggatctggttatgagatcacatctaacagtatgctagattctgtaggtgaagaaaaaagactttctgnntgaatactttcagaagtctgatgcaattgacataaatgcagagactacagnnnntgaaga

SEQ ID NO: 1770 - DNA, 573 bp, Glycine max
  misc_feature (532)..(532): n is a, c, g, or t
  misc_feature (547)..(547): n is a, c, g, or t
  misc_feature (549)..(551): n is a, c, g, or t
  misc_feature (553)..(553): n is a, c, g, or t
  misc_feature (557)..(559): n is a, c, g, or t
  misc_feature (570)..(570): n is a, c, g, or t
gagcaaattctattgggtcttatcggcgaaggaactggtattgctgctaaggtgctaaagtcaatggggatcaacctcaaagatgcacgagtggaagtagaaaaaataattggaaggggtagtggatttgtggctgttgagattccatttactccccgggcaaagcgtgttttagaactttcactggaggaagctcgccaacttggtaaacatctttttcatcttcttccattctggtgtaattgttactaaataaggtagaagtgatttggcaaaaagcatttgtatcttcaacagaagattttcctcctttttatccatctgtcttttcttattagttttctcaatgtttctctggtgtaattgttactaaataaggtagaagtgatttggctatattgggtctgttatgtatttctattttactcaagaagtcatcttatgttttgactacttatagaagaggaagaacaaaggatggagtggaggattgaataacctaccctattattatcacactgcaagttacagnaaaggggagaaaaantnnngncccnnnatgatgcaaancac

SEQ ID NO: 1771 - DNA, 230 bp, Glycine max
tgcagatcttatcgaggagatcatcaataagcagagtccttagagtaaacatgtaccagataaaaaattatttctgctagacatgcatagttttatatattttagtattgcggggtagtttagtctgaagtgttttatatatttactgcaagtctgtaaccaaagaaataaagtagattttgctccttttcccaatatattttgtgcccgtggtgttcgatttcgaatta

SEQ ID NO: 1772 - DNA, 1107 bp, Glycine max
  misc_feature (822)..(822): n is a, c, g, or t
  misc_feature (826)..(828): n is a, c, g, or t
  misc_feature (830)..(834): n is a, c, g, or t
  misc_feature (840)..(1102): n is a, c, g, or t
ctccctgcatctagcattgattggctacttctccatcaggtaagctgaaatgatctataaaataaaattcaagctttttaccaatatacttgttgaaaatttatgctgggagtaatactgatgaatgaaccaattccttcatctgttgcccatactaactcttcacagcattgttgttgcttatagcaaatgtgatgataacttagggtataggtaatatctattggttgaatcactattgcaacttgctatgatttcttcaaataggtggacaaagtggatttgctatacattttgcatttttatgttggcaccctagatggacagatggtggctgttgtgttatcatttacttgctcaacttgttggtatcaagttcatttatatgtttgttttctagtaaaaagaatgtaaaatatcatttatattgaaaacaattcattagcttgtagaaaggtgatgttacatgcatgttgtattgaaaacagaatatcattttagttaacttgggaattgcatggcatacttcataatatcttgtagaaaggtgatgttacatacacttagggggccttcataataagtgcaggcaaaccagaggattattgacgcagttgccactcggttagaactcccctcagaacgtgtgatatcaaatttggccaattatggtaacacaagtgcagcttccattcccttggctttagatgaagcggttcgaagcggtaaggttaaggcaggccagactattgcaacggctggcttcggtgctggtcttacttggggttcagcaattcttcgttggggctgaatgcttttctntcannncnnnnntgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttt

SEQ ID NO: 1773 - DNA, 370 bp, Glycine max
tcagtggaggaggccctagagattgctcgggaatccttgcaaggcgaagctgctgtctagtaccgatcttggtaacatcattctgtaatttatcttctcttacggccagattatcagtgactatctgtcatcatctgagtagggattgctcctataagagaataattttcattatattctcagtcacctgacattagtaatggtttttaactggaatgtctaatttggatttgatctggtgccataaggtatccttgaattttctcaataatttaagatagcctttgcctttacacgttacttttattttccagcaatgtgatttttgttcttaacttactacctacaacccttcttctgaagggactcc

SEQ ID NO: 1774 - DNA, 434 bp, Glycine max
gagatctctgcaaattccctcgtgagttctcaatcaattacaactttagttttattgctctggtgctgcaggaaacttaattgcatgcgatatatataactcacaaaaattcaagtaatatacatatgtatagtgctaaatgaaaagagaatcaaattgagttgattttttttgggtgatgaatatttttgtgaacaagagaaatccgagaccaggtgtacgacgagaagaataacatcgtgaccatcgcggtggtttgctgtaaccctgagaagctcagggacaaaatttgctgcaaaggttgtggtacgatcaaaagcattgaaattgttgagcctcccaagcccaaaccaccacctcaaccagaaaagcccaaggaaccagagaagccaaaagagccacagaagccgaaagagccagagaagcccaaagag

SEQ ID NO: 1775 - DNA, 413 bp, Glycine max
aggagttctattcccttcctttcaatctaaacaagtacttcccctctgtttaattgtgcacaagagctcaatcaaatatataaaggtggtctcatcatcttcaccacggtctagttctaatatttaatttaaatcttgttacacgccatagctctatgaatagtccatcctattatatttatagcattttgtaatacatttattttattgctcttgtttctgtaaatcctgatcaaacaagtggattgacgtagcaaatgcgcatggttaaatcctcgcccccttcatttttgttacgttcactttagaatgccccctccatgcaatgcattttgtactcaattgtctattgaattatattgtactgtttattaatctagacataaacccgcacagtgcgggtagataagcaa

SEQ ID NO: 1776 - DNA, 550 bp, Glycine max
  misc_feature (542)..(542): n is a, c, g, or t
atccatctccaattacacaaaagcgaacattgggatggttgaaacgctccttgatccatcggaaacattgaattttccccacttcccatgagctataaactgaaatgtgacatacatcattaaaaatagcaagttatgtttgactatatcaggattaaactctgttgtttgttagtgaaatgactattagttttaggctttcaaaaaggttcattactaaaatgattgtgagctttgagctttcaagatggcataaaaaaatcaattatgtgacatggcattgtagccagaagagataaaattactcaccatttccatgcgttattaagctgtccagatgaaagagcatgcatttcacaagggagggaactatcgatccagatgtcactaaaacatttacatgctttgcattagttgagtttgagctggtgttagcaaaagcaatagaataaactgcatctttatcttcacccgaacactccttcaaaaaggtccgtgctacaatataatcaaacaagaaagctataagtaatacaggtcgncaacaaaa

SEQ ID NO: 1777 - DNA, 327 bp, Glycine max
gtgttgggcatagtgctcacgaggtatacatgtcatatgctgatgtattttgtctttttggttggttcattgtgtgtaaagtacttgttatgtttgcagaagcaagtctgggtccataaatcttcttcagggtcataaaatatctgcggtatgcctttttgaaattattttgtctcttgtacctgagataaagtgcttattgcactggggggattagtacctcattcttatattgtttttgagtgttgtttacatccaatattgcaattacctttctaatgttataaacggattatggacactctcagtcagggcatcattcctgct

SEQ ID NO: 1778 - DNA, 590 bp, Glycine max
caagcagtcttagcataccaactttaccagaaaaaattttctggtccaagatgggaacgcttggagaatagaggtgccaagaagcagaggttgatgtgggcttcaacaaatgtgaaaaatccatcttaccctgacacattttatgttaattctcttattggaccagatacagtaagttatatcggtttccttatttttttaccttgactggatggccatgtgggctaatatggattaatgttggtgtgaaaaagcttaaagttgagatcattcattaataggttgctgaaataaccttgcgtttatttggtgcctctatagatttcaaccttaccagtacaagctcttcaagcattcatggaccatggtattctttcaagaactcttgatgcaaaagtatcagaggctcaagacatttacaatgcaattgagaagttggggattgattggagttctgttggatccgaactggaacatgaggtgctggattctttcacaaaaagctttgacaatgtgcttgaatgcatgcaaaagaaggctaagcttagggatttcagcagagcatatgaaccgtgctttcaggataacta

SEQ ID NO: 1779 - DNA, 341 bp, Glycine max
actaccttctcaagtccacaaaagccaccgccaccacggccatctgatgtaaacatcaactctgctttataccctggggggcctcctgtgcctactcagtcacccaaacttctaaggtttgttgacacaactgaaatgacaagaggacctcaagatactcctggctactgggttgtgtctggggcaaggcttttggtggagaaggctaaaatatcactgaaagtaaaatattcccttttgactgtgatacctgatgaagagagggtaagtttttgaaattatcaaatgagggtcgttggaagataatctcatcaggtaaagttcaatgagataggcgtgtg

SEQ ID NO: 1780 - DNA, 926 bp, Glycine max
  misc_feature (851)..(856): n is a, c, g, or t
  misc_feature (909)..(922): n is a, c, g, or t
agactaaagtatgtcaactgcatttcatttggcccaattaactaaataaataaataatcatgaacctgctctaaatacaaatagggccatgatcttagctactttctctcctttcttgctttctctttttttggcacggggctggcagtgggaaggagtaatttaataaccatcacaagtttatactgcttggctctttattaacttcattcgacaatcattaaaatacattcttattcaatgccaaactgtaacttttaccttttgtttgtactgtaaactttttttgggtctatttttcttttttgtttgtgcaatttaacaatagttgaaagcacaaggcatatttttagatcttgaagcatttattatccaaaacacaatgtttcattgatatattttctgtttatatggatttttacaagctcaagtctccatcatatttgttttcccactgtcatagtttctcccctgtagatgacttattagtcattatgtttgttgtagttggaatgcaacttatgaaagtttgcttgggactagacaacctttctccaagccaatacctttaactgtaagtgtcctgtgtatatttatggttccttgctgggatttttgaggtgagaatgcaaaattaccaattgataatttgattttcactaaataggaaatggtcgaattcctggtggatgtttgggagcgtgaagggatgtatggttgaaacttgagaggttaaaatgctgagtgcctttaagtttgtttatactttcgatggtgtatttgactcctgaaaggctttcatgtatagttgtgcagagaagattaaaagatcaaacacaagtttttctggnnnnnntttcaactctaaaggcaatcctttttttttgccctcctgtaaatgactgtatnnnnnnnnnnnnnntttt

SEQ ID NO: 1781 - DNA, 857 bp, Glycine max
  misc_feature (835)..(835): n is a, c, g, or t
  misc_feature (837)..(839): n is a, c, g, or t
gatggttaagaacaggggatatttgttacattgacaatgatggattcatatttattgtggatcggttaaaggagctcatcaaatacaagggatatcaggtaattactaaattacgaattctagccagttacttaatccattattgacaaaagggatatcagatgtagtatttactatttaacaactatagagacctgttttatagaggaaccaatgggaagataatcgcaacactaacatacagttgggatacgaatattgtgaatcctattgaaggtcttgatgatgttttaggttcctccagcagaactagaggccttgctactgactcatcctgctattttagatgccgctgttatcccgtaagtctttcagcaatttcatctaccacacctgattaataatgaatatatagaaggagaagagcacttgaatcggagcagttctgagtggtgaatgtttttgtaatgatcaggtatccagataaggaagctgggcagcatccaatggcatacgtggtgaggaaggctggaagtagcttatcagaaactcaagttatggattttgttgcaggacaggttagttgggtttggaaacagtcttcaacaatggcgacttttttatataaatcataagatagtaaaaaagattatgaaaagtataattttccgctaataaaaatatttttaaagtttcatattaaatgtttataggatattggttaacatttaattattattgaatatctgattgctggagttcaactttaacggctgaacagtgaacattataaaatattgaacattccgtgggttacacttcatacaggtggctnannncaagcggattcgaaaagt

SEQ ID NO: 1782 - DNA, 320 bp, Glycine max
ttgcattttggtgtgaacacattcactgacagagaatggggcactggccaggaaaacccagcaatcttcaatccaacggggctcaacaccacccagtgggccactgtggcagcagatgcaggagtttcattaatgatattaactgcaaaacaccatgatggcttttgcctatggccttccaagtacactgaccattctgtcattagcagcccctggcaaggtggcaagggtgatgttgttcaagactttgtcaatgcagccactgcacaaggaattgatgtagggatctacctttcaccttgggatagacatgaccctag

SEQ ID NO: 1783 - DNA, 358 bp, Glycine max
ggaggaatcggctgcggtgatcagaagggatggatttccgttgcatggaaggctgcttgtttcttccctggtatcgcctttttgatcctcacaaccttgaacttcctattgtggggaagtcacagcacaggagccattccattttcactctttgttatactgattttgctttggttttgcatctctgtgccccttacccttatcggtgggctctttggagcaagggcacctcacgttgagtatccagtccggacgaatcaaatccctcgagaaattccccagcagaggtacccatcatggcttttggttctcggtgctggcaccctcccattcggtaccttgttcatcaagctcttct

SEQ ID NO: 1784 - DNA, 829 bp, Glycine max
ctccagcctgatccaaaccaaaacaaaatccctttaaaaccctagtctcgcaatttcgaaatttatcactcactcagtcactctcatcatccactcatcttattctcaggttcacctctctcatgctctagtctccttgttagatttaggatttcgtatgattttgttgctttactctttagctgttttcagtgtttattcctatcattagcgtgttcaatgaattttgaatgtttttgcctctgcaattacgagttctattttcaaaattttcaatgttagtcagttttttcagtcaagtttcctctccatcatagcaatatgaaccttgctatggtgtttgaatttttaaactaattggtctggttcacttgtttcactattgaagtcattcatgttaacaatatgcttgatgtatagtctaaatatgtggtccccttctgcgtagtcttgataatgttcatttgtgagcagaccagaaaagagaagaagaaatggtgttaggcgtgagagagataagctgcagcggagagccagtccttgacagtgataacggggaggagttgatgcaggtgcaaccgggcatagacatagtcctcggcgatcttcctcgccagtcccccggcacgctctatatcactaacaagtgtgctctcctctcctctcattcgcaatttctcttgtattgttgtgtgttctattcacactttggtctcacttacacacaggcaagtaatatgggtgagtgatgtagacaagactaaaggatatgccgttgatttcttgtgtatatctctccatgcagtctctagagaccctgaagcctacc

SEQ ID NO: 1785 - DNA, 767 bp, Glycine max
gctagtgttttgtgatggccatggatgcaaaaggcataacttgggttggaaacatattccagaagtttgaggacatttatgtggacgtggaagacacaatgttggaggtatacctttgtcatcatttatccttaacctaacatatgtttgtttaatatgagaaaagatacctcaagttatccccaattggacatgccaatacctgctataaatgtcattcaaaacctaagatctttgactgctagtagtggaggtatagctcttcatctttgacttgtatgttcaaagtgttttacctatagttgttgtaagtttagttagcactatattatttcacttagagttgaatcatgagagcagctattattaaatttgtcttggtctttatggtaatctgtgataacctttcttaaattccttttatatatatgatgtcaattgtgtagtgtaacactagcctggttgaactattggttttgggactaacagtgaacttaatcccatactttctgtttcccttttttggggatatgaaaccgttaagtacatagggaatcagatgcagactgttggggaaagtgttaaaaagatctattcagatgtcatgcaagatttacttcctccgcctttatatgatttggatgaaacatcagcctctgagttgccaatagatcaatatattgacgctggattctctaataagtcatttcaaggttccaagaaaataactgtaaaggatgataccaaccaaacaactgaggattcaa

SEQ ID NO: 1786 - DNA, 403 bp, Glycine max
ttggaatttggtagttctctaaaactcatccactgaagtatttcaaattgatattacacatgcccaccattcacaggagacggctcttgttgccttttttcctttccttatgccgtcgaaagaatggcctataggtggagctaagctgtctctagcaacataggaactgcctataatgcgcagaatataggataaaaagtatatgttgtgtaacatttttttttaaataaattgaattctatatgttagtccaacctctatctagaggtgttgggggctcctgaccttagcatcgcagatactgtgaactagttggtctctcgcagtaatgggagagttggaaagccttttagaccccatggaaagccttctctaaacaaacttgctagtaagcaccaagcaa

SEQ ID NO: 1787 - DNA, 321 bp, Glycine max
agtacatagcttagcttaacgatgcatgggtagataggcagagtgggactaaacttggttattgaaagttgtccaaggtcctctttaaatttcacttattttttgccccctctttcgtctgtttgtacataaatcctacgtggggtttgaggtatagatggagtctaattatttagtaggggagatagcaaacatgatttatgaggatattttctttcattttttctgaatattgtttagatgaaattatacaaattgaaacaatggaagatataagcagatatgatcttttctaatgcccttctgttgccaaagtataaa

SEQ ID NO: 1788 - DNA, 569 bp, Glycine max
tcgaaaacccaaaaccctgtttggcgtcgcggccatgtatttccaagtggtcgttctcggcggtggcctttccaagaagctcctccctctcgtttctcaggttccgaactcgaatgcttcaaaccaaacaaattttgatgctattctattattctgaagcgcttatttctgtttgcaggagcttccgaacgcgttgcttccggtggcgaatcgccccgttctctcctacgttctcgagtacttggagcttagcaacctcaaagatctcattgtggtaatttcatttttttgcaatcttttagatgttattggagagggtaaatggtgaattagtaaatgaattttttaactgtaggtggttgaaggcgaagaagcggttcttcatgttggggcttggatttcgggggcttatgctgatcgcctccacgttgaggtaatcactttttggatattagaaaatttaacaaacatgattccttgcctctatatatgtctcactagtgaccacaagcataaggatatgtaggttttatttggatacacttaagtaagttataggaggaaaaaaa

SEQ ID NO: 1789 - DNA, 454 bp, Glycine max
atatttgagagggccaatttctcccccagcatcgttggtgtatcatcaagcaacatagaaccatcacaccccttcacaaaagagtaaaagtaaaattaaattaaagatactaaataaaatcaaattactagtacgtacgttgacaaagcaatcatggaactggaagcgcataacagaggcaacacttctgggttccctcataagggccttcttcatcacatctcggactatgagttccgcttttggacatgtttttgagtaaaacccaggtcggagatccgacgatgccacccaagctatgtgcagaagaaggaacatcagaaacaggggcatggccatggtcatgtataacaaacaaagatggcaccttgttttgattttccacactggagtggagagtgatcggaggagagagggtggctatatatggttactcactttggagtttggaaaa

SEQ ID NO: 1790 - DNA, 519 bp, Glycine max
gtgttgcagtgtcattattcaagaggtgcgtcctttatctttttcctataacatttaagttaggcatactttagtactagttctgactacgtagtttgtccatgttaccctaacgtgtaaacttgtgaattgaagctattggaattctttcattattgattactttctgtccatggcagtgatgtacatttgtcggagaaagaagcagaaatatccacaatagatagtaatgggggtggcaacctttgtgacactttagctgaattatcgttgctgaaggaaagaaacaactcaatggaaacggagctgaaagagttacaacaaagatactcagaaatgagtctcagatttgcggaggtagaaggtgaaagacaaaagcttgttatgactgtacgaaacctcaagaatgccagaaaggcccaaatgactactagttcatgatatctgctgtggaaatagtataaggtgaataaattaatgtgtacactggcaagatatgtatgtatttcttctcctttc

SEQ ID NO: 1791 - DNA, 1465 bp, Glycine max
gagcaacaagagcagcatgatcacctacaacacaacaacgttcgtgtcagagcttgtgacatgcctctccctcttcagagccgtgcctttcgatgtgcacgtgatctcctggattctatgccaccaaagaagcttgatagtaaacgcctggccctcacacttaagaaggttaccttttttgtttcgattgtttgtgtgcctaagtatcttgacttctttacaagatctgtttctgggttctgatcttttgccgcatacatagtatgaaatcttgatggctaattaggaaggtttcgaaattatgaaaattggtctgatgtgacaaacagttatcttagctcacttatggctattcttcttcctctatctactgttttatgttggtttttttatcttgatcactaagtccttttttgtttgaaattttaaaaatctagttggcataatcaatggtttatggaatgtgtctaattgatttggggtgttgatattactgtcagatgcatttgatctgtttttgttttttgtttttctttttttatcttatttgtgtcaattgatttggtaaagaatggtttgatcttgcgtgctacatgagctctgtagctatcctacagtatacaaacgtagcttggattacaagagattgaaaatggcacgttttgttggtttttctttgagtgtacagatgcgcaagagatgatattgagcagaatcagcagttgcctttttgaggcttcaccaattttattggagaagacttgaagtttcaataaatggaaagtatgagtatcctgaagtgtgtatggtacctctgcggtccaattatgattaaattatattttttatgtgaactgtgaagaatttcaagtatgtaactttgagtatgaaaaaagcctgataagcatggctatagatttgttggttatgatttaatgaatttaggtggcttgctacataggttatttgtgatgtcaaaaacgatagatggtccctcatttcattgatgggggctcggggatagtaaacgatcattaaacacactctattacatacccttttgaacacattatttattattgattaaaaattataaaaaaaattgtgagtctccttgtttaatgaatttcactcatgattagtataatagagaatgtgttagaagcaacatgttagaaagtgtgttgctaatactactaggatgtgacaatccgagtaagaagtaacacagtggatgtgagagagcgtgggagattagatgaatctatataacaccaacattggctatttacttacagacactgctcatttttaaattgaaagtcactttgttgttcatttacctgtttctgactttatttgacccctgcttgagtggttcataacaaaaacattctggttttacaggaatttgattcttcttatggtccagcttggcactgcattgtgggtactagttttggct

SEQ ID NO: 1792 - DNA, 381 bp, Glycine max
tgagtatcttcatgaaggttgtaatcaacccattattcattttgacatcaatcctcacaatgttctacttgatgacaacttcactccaaaaatttctgattttggcttagccaaattgtgttccaagaatcctagtttggtgtccatgacagctgcaagaggaaccttgggatacattgcacctgaagttttctccaaaaactttgggaatgtgtcttataagtctgatatttacagttatggaatgttattgttagaaatggttggaggaagaaagaatgtagccatgtcttctgctcaagatttccatgttttgtatccagattggatccataacctgattgatggagatgtacatatccatgttgaggatgaatgtga

SEQ ID NO: 1793 - DNA, 379 bp, Glycine max
cattatcccttgcccaatccaacaaccgctacgtctttgacacacatggcgaccctcttgaaactgacgatgaatattacatcaggccagccataacagacaacggagggcgtttcacattgatcaacagaaacaggtcgtgccctttgtacgtcggtctcgaaaacaccgacacgccgcagggctacccgatgaaattcaccccttttgccaacaaggacgacgacgataacgtgagggtgaacacggacttgaaagtgacactggtgcaagtttccacaacgtgtgtgcaatccaccgaatggaagttgggtgagaatgacacgaggagtggaaggaggctcatcgtcactgggcgagataatgggatacaaagtgc

SEQ ID NO: 1794 - DNA, 1106 bp, Glycine max
atttgagcttctttccacattaatcctgcaaacgacaattacatgtataatggcactgttcaaagtagtgccattcaggtacacaaccttaacttgtctgagataatattgttgagagcatgttatcctatcattgtatgttattcttaatgttttcatttctaacttatatttcttcggttttgcttatggaagaaggacttgactagtttggagaaaattgaagaaggtttagcgcaagcacgggcctcaattcaggaatctatcctatcaaggaactatacttcacaaaggagagaaagttttgtccccaaaggatccatttaccgaaatccccatgcttttctccagttaagtaaactcaaaatttctgagccaccttcaattaatttatctttttattaatgactgtaattagtgctactacttaaccgtagaactagcaattaatgttaccacgtgctgtctttcatttaacagttactccgtagtactactagtatattattcatatctcatttatttaccgcatttattgtaatattttttaaaaaaaaacttaaatacagtttcttacgtgttgttgtgttgtttttcaattaaaattagaacacttgaataatctacataataaaaatctacattaaaggattaagtagattatagaattgaaaactatataattaaagaacaatgtaaacaacacttaactaaactatacctaagttttgttaaaaacaataataattaaaaagcatgttaataaacaacaagtgcccttaagacgccagagaagaaatcagaagttaattttttaattaaaaaatgtaattaactgtgtacctttccataatttttaatgaaactgtaacaataaaaacctttttactgaggcaactgatccacgagaccttttttttatcacattaattataaataaaaatattggacaaatatatcattacttcaaacgtattaattggagttagtgacagcaagaagaaaacgtacgtaatggggtttattgacaaattctattctaatataaaatgttggcaacaggagccacatagagatggtgaaaagattcaaggtgtgggtttacc

SEQ ID NO: 1795 - DNA, 883 bp, Glycine max
  misc_feature (862)..(864): n is a, c, g, or t
tggatttgttaagtttcccacttttggattgaaagcatggaaaaattcgtatgttcctttgtctttattcaactagcaatagtctctgaaccctgaaataattgtctatctttactgactaaagtgtttcaatttggcagattttattttgatttcagcatgacttatgtgggagcaggaatgatttgttcccatcttgtaaatttatccttgcttcttggtgctgtgatttcatggggcattatgtggccattaatcaggggactaaaaggggaatggtttcctgcaagcatagcagagagtagcatgaagagtcttaatggttataaggtctaaattttgttataactaaaggattctatcacagctatataatatttagtttagttctttcaatttcattccttgattttttcttttgcttgctgcaggtttttatttccattgctttgattcttggtgatgggctttacaattttgtcaaagtcctctatttcactgccacgaatattcatgccaccgtgaaaaggaagaaccccgaaacttgtaagtataaatggcctcatataacttttccagctcacaaggatgtccgtcaaatccttaacatactctataaagtcttacctatctcatctttctttttcccatgtaataaaaattgctatcaatgtctcaacagaccaccaacaaaagaagaaagagaaacaaaatcaacagtgtataactaaatgaacaaatatttacacttgttcggtgtcaatgcatgtaatatagcctttcagatttggtatttagcaagctagaaatgttctaatatggagttggtttatgatatcagtgagttttgcatttgcctgtnnnatctaatttttttgttact

SEQ ID NO: 1796 - DNA, 680 bp, Glycine max
  misc_feature (54)..(58): n is a, c, g, or t
  misc_feature (466)..(466): n is a, c, g, or t
  misc_feature (623)..(629): n is a, c, g, or t
  misc_feature (667)..(672): n is a, c, g, or t
  misc_feature (674)..(674): n is a, c, g, or t
tggctgcctggtatgttttctccatacagttgcataatgcataatttaatttgnnnnntatatagaagcaccctattttgatgattttataggctatgtgccatctttgaaaggacaaataagagaaatggtctatgtatatgtgcattattgacatgaaactttgaatatgaactatatcttgttataatgcttaggttggattatcagcttaactacaatattttttctaaaggtaccttattatctaaatgaagcaacaggttgggggttggaaatacctgaactcaagaagcaattggaggctgccaagtctaagggcatcaatggtagggctttaattggtataaatcctggcaatccaacggggcaggtgagcttgaaggaattatgtagttttaggtgatgtttcaaaaaacttacgtggagcttgattgggttaatgaaaatgacttatgactcccanataaactccttttactttatttcaatttttttattttatttctatgagttttatgctcaaatttatgtatgttataatctcctgtgatgaaagcttatttaagctgtactcttaatataggaggatgcttactgcctagaacgcgtgaagctttgtnnnnnnntttgataacttggattttctgtcatgcctccaggttcnnnnnnangaaaat

SEQ ID NO: 1797 - DNA, 370 bp, Glycine max
tgcgcgatgaaactgtatcgacagtgaacgagagagaccaacttcttcgcatggttaagagcttgaatccaaaacttgtgacagttgtggagcaggacatgaacaccaacacctccccttttctcccaagatttgttgaaacctacaattactactctgctgtgtttaacacacttgatgcaactctccctagggagagccaggacaggatgaatgtcgaaaggcaatgcctggcaaaggacatagtcaacattgttgcttgcgagggtgaggaaagaatagaacggtatgaagtcgccggaaaatggagggcaaggttgtcaatggctggcttcactccatccccaatgagcacaaatgtgagagaagc

SEQ ID NO: 1798 - DNA, 750 bp, Glycine max
  misc_feature (741)..(745): n is a, c, g, or t
ctgcgatgactactataaattaacctacccttgcactcctggcgcagcatactatggccgtggtgccatcccactttactggtattcatatcttgagatatcttgaatatcccttaatttaatcaccatgtatgtggggaaattattatatgtggcacattattaaatttttttcataaattgaaaaaaatgtaattgtgccatataaaaattgatcagaatcacatatcacacatcacatagtgttacctcatctaataatttctcttgaatcttatccaccattggagtatcattatatctatttgcttattttcacaaagttttggttgtgttcccaagaaggtagtaaatgctttatacaagtctctacttgtttgtgcaagtggttagttagaagcattttatgcaaagattttaccaagttttgaacaattaatgatcaaagtccttgtgtttctcttccttgataacaggaactacaactatggaaaagccggggaagccttgaaggtggatctgttgaaccatccagaatacatagaacaaaacgccactctagccttccaggctgcactctggcagtggatgaccccaccagagaagcacctaccatcaccccatgatgtctttgttggcaactggaaacccacaaaaaatgacacattgtccaaaagggtacccggatttggtgccacaataaacttgctctatggggatcaaacttgtggtcagggatcnnnnnatgag

SEQ ID NO: 1799 - DNA, 417 bp, Glycine max
tttctctctctaaaatggcggcagcttctagaagatcaagcggaccagtcctccgaacactctcgccggcgggaaggtttcgcagttcccggccaccgccggcgaccaccgccttcgcgtcctcaacttcaaccttctccgcacggtccaccgctttcttccagaaccgttccggttctcccacacgtgacagtctctacggttcttcttccggttcggttctctccgtccggttcggttcaatttctccgaaccgctccatctccgtcgccggtgccggaaggcagagtcaccatcagaagcgaacctgcatgtgctctccgacgtcgcatcccggctcgttccggtgcagcctccacaaaagcttcggctcgcgctcggcagtgtcggcggcgccggcgtcaaatcggttgaaca

SEQ ID NO: 1800 - DNA, 536 bp, Glycine max
  misc_feature (477)..(477): n is a, c, g, or t
  misc_feature (479)..(479): n is a, c, g, or t
  misc_feature (511)..(513): n is a, c, g, or t
  misc_feature (531)..(532): n is a, c, g, or t
gcatattatgctgctccaccaccacgcacaagacaaactggattccttgagggatggttagtacttagttcccactctctctctcctctcttttttcaattagttatattgtttccttatttttatcattatcacgaggaacacaaaaaataatttctatttttttaaaatgttgtcaacttctattcatttgtgtaattgacactattcttctcgtttcttgttttctcagtcttgcagctctgtgttgttgctgcctcatagatgagtgctgctgtgatccctcaatcttatgtatcatctgatgtgatcaaaattgctgcaagtaggaaaaacaaaatgaagaagatacaagtacatatatatgcagtgtgatgcttccagagggcttcagttagcattatgtttagttgaatagtagtcttacttttatccagaactagaacttatgtttgtgcttgattaacatggtttctntncatcttggtctttggtgtggttgtgcatcacnnngtgatttgattgtaatgnnaaag

SEQ ID NO: 1801 - DNA, 526 bp, Glycine max
tacttttcattgctgacaaaaggcttcttaaaacatggattctcaactccttggctagtcactggaacctgagcagctactttattacccgtgctagaagtaggagtgggtggtccatgcaagaaggcacatctgtcaccttttaagcaaagtcctttttggaagaaaaagcaaggtacagcttgtttactggaattatacggtgcatgtgttgcagatgctgttggaatctgtgatggggatacagatggtccaccagtcactgctgcctgtgttcctaacaagccatcaagaggctgcatgcaaaaacaaaatgctgttagcaaaagccgtacaaagaaagaataacagaggaaaatagacaaatagtccaaaaattgacatgaaagtataaaaaattggtgctcataaagacactcaccggatgacgaaatggacatttgggattcaagcaattgccactcaaccaataccgacagtccctaggattaacacgtgcatactcactatggcggtactcacattc

SEQ ID NO: 1802 - DNA, 800 bp, Glycine max
  misc_feature (777)..(777): n is a, c, g, or t
  misc_feature (779)..(779): n is a, c, g, or t
tcagtaagggtagccgtgaacgtgaatggtcggggaagaaacaaaggtttgagttgcaacgccatgttcggtctgggcgtgcctgaactggtcgttattgccggcgtggccgccctcgtttttgggcccaagaaattgcctgaagtcggccgcagcatcggcaaaactgtcaagagcttccaacaggtaccatttcatgttaaagccttcttagttcttgctctcatattacatctcttttggcttttcatctttatgaaacggaatattgtgtctcattactactgctaactcatcactcgcttccccatccaattaagacgtttaaacttgttttggagatcgcacgatttttagtgatgtagttaaatcgagcaactcccacctctttaagttagtttttgggattgaattaggcttaaactcaaactctatcattaaagtttatgttagtaattgcaaattttacgcgtgagcgaatgtgttctagatcccatgtggacacaaccgagggataatcatcatctcattatccagtttttggatttgagtgagatccaaacccaaattgtaagaaccgagtgagggggaaaagtaaaaataaaatataaatgggaggaagaaaccagacatttcagtttcagtcaagaagaaaccgaatgggttttacaatgtaggaggccaaattatttgtggattttggcattgacttcatcgtgaatgagtctattactacgtttcaagtgttttgcacattattgctattaagctttttgntnaataaatggtgtaggctgcaa

SEQ ID NO: 1803 - DNA, 387 bp, Glycine max
ggaaaggtcggatccatcaactatttttgattgtttattctgacagatcgagtgataaagacctcaggtttagactggtgaaatatacaggaaaaggtcagtagttttgcagatatatctggagttggaccatacaatctaaagctgatttggttataatcacttacattagattagaccaccatgccggtccctgatgacgggtcttgtgactagatatgtgaaatggagaataagaagacgggcttctgcatttccaccaggagagagctaaggtcatatacttagagctgagctgttcgttctttttgtcaagcaatagttattagagcaacggtttcgagtatttatagtcacaggcactctcccttgacatgtgtaaaaaaa

SEQ ID NO: 1804 - DNA, 537 bp, Glycine max
tctctctctctctctctctcaccgttatggatattattacgattcacaaatcaattccaattcgctatatactcctctcgctgaatctggatattattacaagcttcgcgaaatctgttcctttcgctatatattcctcttgctgaatctggcctttgttttttaatttttttatttatttttagaatgataataaatcgtttctgtggatgatgaatctggagttcattgaatgtttaatttgtgaaatcgtgtatgtttatttgtattgaagctctttgattgaatgattgacctagcgtcgtcgctgatagcgcctattgaatttccataaacctagggtgctgaattgatgagcaaacacggagtcaacgttccgagaggcgtggctgtttcctctgttgaagaggccagaaaggtcatcaaggaccttttccctaatgaaaatgaggtaacctatgccacaacttgatgctcacaaataacactaagaagtgaatttcagaattgcaaactgttctttgtttttcttaattc

SEQ ID NO: 1805 - DNA, 1236 bp, Glycine max
  misc_feature (1172)..(1174): n is a, c, g, or t
  misc_feature (1224)..(1226): n is a, c, g, or t
ctgttatttttgtcccaagacagccacctagagtgtataagcaaagaatccttattagcatcagcaaaaaatggcttggctgttaaacttcttagtaaaggaaaggaggtacctgacgagccagtagttgacgacaaaaggaaccgacaaaaaggttgactcttttatttttatttatttcgacttgcacaaatcacattacttctttttgacatcaatgtcaaattgaacctgatgatagtattccacaggatgggaaagaatggttctacagatcttgtttcttggtccatcgaaccttttagaacctaatgcaagctttgaacagatgtcacaaaagttgattgtttcacctattgtgaagactctggtcttcagtaaagttcctgagaaggtaatactctctctttttgagacactaagagctattaattaacaactaactgttcaaccttataatagtttcttttactttattctgacctggatgaggttaaatttatgcaagacacatgcccttcaatgtaatgcacctggatgttccaaagtatgatatatccttcaatttaaaatgttcaaattgcaaaattttgaaaatgtaaaacatgtgaaaacaagatgatacttttgtaattattaatgaaaacacgtaatctatgaagaacaaattcctctcttgttttaagtgtcacaatgtccgacatgtttcggacacctgtcatacacttcttcttgttaagagtcaaattaaaacaatttattagttgccttggacacttaagttgacacctctacacagttcacacacttgagtcaacacttctatatggatggacacactaatattattaaaaaaatattcatttttagcttttaaaaaactttgcttaaaatataatataaaatattaaaataattcctcaccattttagtgaagcttgtagtcttagaaaacactttcgacggtcggtgaatataccatcaatttagatcttttattatgatacttatattttagatatcagtcgtgttggagtgtccatttcttcattgtatccagagtctgtgctttgtagcatgtcatgatatcacaaattgttatgtgtgataagtttgttaatttttgtaataattactttaaaagtcatatataagatgattaaggggataannntagatgaaaattgcattattatgattcaggttagagagtgggttgatagnnnctcgcgagat

SEQ ID NO: 1806 - DNA, 819 bp, Glycine max
  misc_feature (761)..(762): n is a, c, g, or t
aagtgtatgaaggaaagtaagtcaacctttatttttatttttttttgcttttaattttcttggttctgtttttggattcagttttggtttttgaatccttctgccatgagaattttcacctttctcttttgttaagatttattagaaagtttgttttgatttctgaagtcagctctaccttggctctcttttcttgttttcccttttgcatctcccattaaatctgtctagatttatgtacaatttcacattaactttttgtatataatctgtttgtttagaaaaatacatattctgcatccattattgaattggaatagaggattacttgatgactttgtgccttgttgttggattttcttattttgcagatataaaaatcagaatgttgctgttaagattattaataagggtgaaaccccagagcagatttctaggagagaggctcggtttgccagagagattgccatgctatctagagttcaacacaaaaatctagtcaaggttgttatcccagaacacttctctttttctcaagcttgattatgttgtgtgtgtaaacatcgatatatacacttattgggattggcaataaatagttactaacattaactggttctcaaattatatttataaactgggtaaaaatatgtctcacaatagcttatacatttgtttgatgccagtttattggggcctgcaaagaacctgttatggttattgtaactgaacttctcttaggtggaacattgcgcaaatanntgtggagtatccggccaaagtgcttggatgtgcgcgtagcagttggattgctctgat

SEQ ID NO: 1807 - DNA, 363 bp, Glycine max
gttcaaccaggtagtctttttggactcattaccaaagaattcttgcctccagccgaggctccatttccacccttgacagaatctgaagtggcagagccacctttgcctcctgttgctaaaatagccccagcttccagcccgaatgccggaaccaaatcaccacagggaaattcacagcctaaagtcactgtctgcttcttcttgtccactctggccgtgtttatagcttctcttctgctttgagtaaaatcatctctaaacttccttctaaggaaaaacaaaaaaaatatggagaaaaggttgtttttggtggtttcaaccctctatttccacatctcttctaggattgagtggcattgaaaa

SEQ ID NO: 1808 - DNA, 733 bp, Glycine max
gtgttgctatctttggtatgggagctctcttgaggatattttacttctttcttacgttaataattgtttcttatttttcttttccgtatattttgcatgctgttgtgattctagtactgactactgattctggttttattttttaatcattattttaatcttagaatttactactctgttttttggtcgagaaaatgaattgttttatttaagagtgatggcttactactcaaactgagtagtagaagcactactgagaatccaattttgcattttgcatagatctaggatggagtttgtgcctggtaaattaggtttgtttattaggttagtcagacactgctgcttgatgatgcttttgtgacattgttttttatgtaatacacaactgcaggtatctgtattctttgacattattttcattattcaacattatgttctgtatcgtggtaaaaaatcctccaaattggagatcactacagagcaagaagatcaaatcagagagcaccttgtcagacattctgatcaatcatcaccagagaatgtgtaagatatgacttacttcataatgtatattaaacttcccattgtatgttatttgtatcaaaatccaattaggatgtttttcttatcccatacatcaggggcaccattttgatgggagcttcaataaatattgtataagttttaagaattttaggccagcattcttttatactattttgtattacaa

SEQ ID NO: 1809 - DNA, 814 bp, Glycine max
ggtttcttcttcaaaacaaaatgtctggaaccgtgattgttttcgactttgacaagaccattgtcgatgtcgatagtgacaactgggtcatcgacgaattgggtttcaccgatttgttcaaccagcttcttcccaccatgccttggaactctctcatggtaagcatttggtgtcacgtctttgggtttttcttttttcagtagataaaacttggttgcaatttgtcgcatgttctcagtattgttcttcaatcaaaattagacttttccactttgatattattgacgtgaaacactaattctaatgcgggaacaatactaaaaatatccaagaattgcatctaaattgtcattatttaaaatactctgttttgtccttttttgtttattttttttattttaaatttgcaaaatgtatggttttaatgaaatgaataactgagtcttctgtttttcggttttggatttataggacaggatgatgatggagcttcattcaaatggtaaaaccattgaggacattgaagaggttctgcgtaggattcctttgcaccccagagtgattccagctcttcaagcagctcatgctttagggtatgtaattatgcatctcttatccttacacaaaattctgtttctgttctttttctttttataattttattttaacaatctaaattggagaggaaatttatggtggcatttgtgtttcaggtgtgatttgaggattgtgagtgatgcaaacgtgtttttcattgagactattctgaagcacttgggaataagagaatacttttcagagatcaacaccaacc

SEQ ID NO: 1810 - DNA, 501 bp, Glycine max
  misc_feature (47)..(47): n is a, c, g, or t
atggccacttggtcatggcgacactcaggacagaccaacccccaaantgattgaagtccttagctctgttgttcagattgctgcgggaccaagctatatcttatccgtaacagaaaacgggacagtatattcctttggatcaggtgctaatttctgtcttggccatggtgagcagcatgatgagttgcagccacgtgctatacagaaattcagaaggaaaggtattcatattgtccgtgtatctgctggggatgagcatgcagtggcacttgattcaaatggatatgtgagttttcattgaataagatatattttcaattttatttgctatcattggtttgaattatttaagggattgtgggaattactattacgattttgttattgatgatccaggtatatacatggggcaagggatactgtggtgctttaggccatggggatgagattgagaagacaactccagagttgttgactagtctcaagaatcaattggctgtt

SEQ ID NO: 1811 - DNA, 387 bp, Glycine max
caagagctgatgctctggaatctctgctcgaattatgtgctcagctactcaagcaagataaactcgaagagcttgctggggtgctaagaccatttgggaaagaagctgtctcatcaagagaaacagcaatatggctagcaaaaagcctcatatcttcccaaaagtttaatcctgaaacctaaggtctggtcataaatctatacattgttgtaagaaatgtgcatttcaaatgtcacatgagtttgttcctttcgagatttgttgcttggttgaagattggagactggaagatagcatgccacatgttctttcttggtgtgttaaatggttatagtaaatgaattaaattattcttgttaggttggatagtcatttgtgcttgaggag

SEQ ID NO: 1812 - DNA, 1086 bp, Glycine max
  misc_feature (1064)..(1065): n is a, c, g, or t
acacggctatgactggagagatgacattgaggggtcttgttctacctgttggtggtgtcaaggataaggtaaaattctatatctttttaacctttgtcaactttttgagacaggacaaatgacttttaatagaatgaattcagagcttaggtggtgtcaagtataaggtaaaattatatatctttttaacctttgtcaactttttgagacaggataaatgactttttgtagaatgaattcagagcttaggcttaaattaagtaacataataataaggacagaaaatatagtaaaatgaaattctaacaagaaaaataagaaataaaagtaaaatacctgtgatgggataatatgaagggaaggcttatatatattttaccaaaagaaattaaccaattaccaagcagaattatacgaacccagtttgccattgcaaatggaattaatgtttttgcagagttagtttgtcatttgtggcttttaatgtatggatcatatgatcaaacatatttctgacagtaaaagattaagactgtaaaaggtggtatgaagtgacttttttcaatgtttcacagatattagctgcacatcgttacggtattaagagagttattctacctgaaaggaacttgaaggacttggttgaagtaccatcgtctgtgctatccaatttggaggtaattctgcttccatgttttgcagcattgttacacagttttatagtcatgtttcctactaatctagacaagtatttggtaattggtatttaaaattcaatctctatttcactcctaactaatatattttcaaatctacagtatgccttgtataggcctattttcattttctacatttttatggggctcaatcagttccttggtatctcttatcaccaatgtaacaaaaaaattatctcttatcatcactgaaatgaagcacaaaatcacacttcccttttctaactttacagatcctgcttgctaaacgagtggaagatgtgttagaacatgcttttgatggtgggtgcccttggaggcaacactcgaagttatagcagcatcctnnatttgcaggacgagttagtaa

SEQ ID NO: 1813 - DNA, 310 bp, Glycine max
gacccctttcacttgactgggatgccttcaactacctactcatttggaaagtacgaggagagatgggcgggaaggaattatgtgtcttagtatgtgtattgtcttattacatgatgaacccaaaccttttgtacagaatgactctagtattgtatttgtatttcctatactctcatctttgagtttctttgtttgtttagttaaacttgactgtgtacgaataggaggactacatgttttctatgccataagaaacttttatgtaagttgtatgctgtgtactgcacgattatcaccttcctgtgagcta

SEQ ID NO: 1814 - DNA, 640 bp, Glycine max
taagcaaatgcctctttttaataatgttgccttattattttggaatttgtattgccattgaaactgaaatattcagtttcaggtttagacctgatattaaaaagtactaacaagtattggggaattaacgtgggttagatttggcaaatatatagtcctaaaggaatcactttccttcacctgaaaaatgatgtttaattattttttatatttcgaatagtttcggattgcattactttggcttaaggcaaggcaatgcacttttttcctaatttacgttttcattggtggtagacagagtatttcggggtgattgtgtcacaaggcaggtatatgaggaaggagccaaagaagttgctctttcagttgtcagtggaattaactgtgagtatatatttttatgctggtttgtttcttaaacgctttgcgcactttgattgatataggtgtctatatattctttcagcaagtatttttgcatatgggcaaacaagtagtggaaagacatacacgatggttggaataactgaatacgctgttgcagatatttttgactatataaagagggtaattagactactattatattgatatatgcctgtttaactcttggctttcattctccaccagagatcttgtt

SEQ ID NO: 1815 - DNA, 555 bp, Glycine max
agagagggtttcgttccgtttcaatggggagcgaagagcagaacggcgaattctacctgcgttactacgtcggtcacaagggcaagtttggtcacgagttcctggagttcgagttccgcccagacggcaagctccgctacgccaacaactccaactacaaaaacgacaccatcatccgcaaggaggtttacctaacccccgccgttctccgcgagtgccgtcgcatcatcgccgagagcgaggtacgtaaccctaatttatcaacaactcctccttcttgtcgtttttccaattagttgtcgttttcctttgcttcgttgttgttgttagttttattagaatttagtgtgaggcaaatgttaattgttagtttgttttgttgtgtttagttggattgagtaattattcgtttgtttggtgttcagattatgaaggaagatgataacaactggcccgaaccggatcgggtggggcggcaggagctcgagattgttatggggaacgagcacatttcgttcaccacgtcgaagattgggtctcttgttgatgttcaga

SEQ ID NO: 1816 - DNA, 352 bp, Glycine max
  misc_feature (344)..(344): n is a, c, g, or t
ttcagattgaaacaattgtgatagcccctggccaaaccaccaatgtgcttctaaatgcaaaccaaaaatctggcaagtacttggtagcagcttctccattcatggatgctcctgttgctgtggataacttgactgccacagcaacattgcactacacaggcactcttgctgccacccccacaattctcaccaccccacctcccaaaaatgctacccaaattgccaacaacttcatcagctctcttagaggccttaactccaagaaataccctgtcaatgtcccattaacagttgatcactcacttatcttcactgttgggttgggaattaacccttgtccatcntgcaaagc

SEQ ID NO: 1817 - DNA, 232 bp, Glycine max
ggtctttgatcagttgcaaaatcactatcagaagctggacactggtttgctcagcaaaatccccaagggaaagctcaaaggaaagaagtatgaatagattcttccttacgtaaatggtttgattttcaatatccctttctctaacttgtgatggaattgggaaaggctgaaggatgtaatgtaaatagggaacaattctatgtaggggtctttagaatttgttgtgtctcat

SEQ ID NO: 1818 - DNA, 374 bp, Glycine max
taggatgatatcagctgaagcaccagtcatctttgcaagggcatgtgaaatgttcatattagagttaaccctgcgctcttggaatcacactgaagagaacaaaaggcgaacacttcaaaaaaatgatattgctgctgctatcacaaggactgacatctttgatttcttggttgacattgtgcctcgtgaggacttgaaagatgaagtgcttgcatcaatcccaagaggaacaatgcctgttgcagggcctgctgatgcccttccatactgctacatgccgcctcagcatgcgtcccaagttggagctgctggtgtcataatgggtaagcctgtgatggacccaaacatgtatgctcagcagtctcacccttaca

SEQ ID NO: 1819 - DNA, 937 bp, Glycine max
  misc_feature (351)..(355): n is a, c, g, or t
  misc_feature (361)..(365): n is a, c, g, or t
  misc_feature (369)..(372): n is a, c, g, or t
  misc_feature (431)..(432): n is a, c, g, or t
  misc_feature (440)..(444): n is a, c, g, or t
  misc_feature (533)..(533): n is a, c, g, or t
  misc_feature (590)..(590): n is a, c, g, or t
tctttgcaggtgtgtttcttgcatgttctaaaatcgaagtgtcttctgtataatataaaatcatttgtgtatctttgtctaatagtttacgttttgggggataattagttcatagataagtgctaggaacacattctctaagacactctttttaacatattctctattattgattaacatttattaaaaactaaaatgtcacgagtgaagtttattaggcagggagcgagacttacagaattgtgattttcaacaaatttcagccaataatagagtgttactatcatttcacttagttcataatatgttatcagagcctctttgaccaagtggtctagagtttaatttttnnnnncctccnnnnntatnnnnaaaaagaatccatacacaagcacaaggtaggcaagcttgtgtattgtcatcactgcaanncaaatagnnnnntgtgtgaggggacttgttggaaatataatataaaatcattcatatattttctcctaatagctagttattgaacaggtctagttcatgangcttctattttgtgcttctgttaagtttttctttaatgcaactgtaggtcactagtngaattggatgcaagctttaacaacttaatgtgtctgccaacgaacatgggttttggacttgttaaccttgagaagctcttgatccatttgaacaagatacgatttcttcccgcctccattggagaaatgaaatctctcaggcatcttgatgttcatttcaatgagcttcatggcctacctcaatccattgggaaactcacaaatctggaatatctgaatgttagcagtaactttagtgacatgacagagctacctgaaacacttggtgatctggtcaacttaagggagcttgacctcagcaacaaccaaatccgagctcttccttactcgttcggtaggctgaaaaa

SEQ ID NO: 1820 - DNA, 397 bp, Glycine max
atcatgcgtatttgaatggtcaatctttgtccttcagggtcaccaccactgatggagagaccagagttttccaagatattgttccagcaagttggacattcggccaaactttctctagcccagttcagttctaagctgattacaaataaaccaaccaacggctgaggcgtgcttttttattttattactggagctgcccgccacccttcttctggttttgattattcccatcaactccaagccctctatcaaggcataaattgttatcaataataacaatcaatcaccatcatatcatcataagcttgtatatcaaataaacatctttcaagtttaaattaatttatactataaattgttgtaatatcattatagttgaagttcaagctgtgccgcg

SEQ ID NO: 1821 - DNA, 392 bp, Glycine max
agccagaggccattgttacatggcctcatgaagatggcaggggtgaggccctacacggtggagattgagcccgggaccgtgatgagtttctgggtcccttctgaaacactaacgaagccgaagaaaaaaaacgagaagcccagaatcagctcgaagcccagcaggcccgcggtggttctggtgcacggctttggcgccgagggaatcatgacatggcagtatcaagttggcgccttgacaaaaaaatacgcagtctacgttcctgacctcctcttcttcgggggctccaccaccgacaaaccccaccggtcgccggcgtttcaggcgcagtgtgtggtggcggggttgaggaagctcggggtggagaagtgcatagtggttgggtacagaaa

SEQ ID NO: 1822 - DNA, 972 bp, Glycine max
  misc_feature (864)..(872): n is a, c, g, or t
  misc_feature (919)..(926): n is a, c, g, or t
  misc_feature (963)..(965): n is a, c, g, or t
cttttcaacaaaaacttaccaaccctgccttggaaaacaagattggagatcatgcttggtgctgctcaaggactagcttatctacatgaaggactggaaattcaggtacctcataggctcatattatccacaagttgaaatgaaattgttgccacatatatcactaattagcttagtgcctgccattttttattttcctatgtatactttaattgtatatttgaataccaattttggttgttaatctttccatttttatgttgggaaggtgatctaccgagattttaaatcttcaaatgttctattagatgcggacttccacccaaagctctcagattttggtctggctagagaaggaccacaaggtgatcagactcatgtatccactgcggtaagttcaatgcacatacaaattctcaaagtgcttgttaatgtctctttcatattttaagcacctaatcatagggacttcacatgcatacattgctatcatgcaccactcctcaagccttcgtgatttattccctaacttgtgattttagcaacattgcaatgatcccatccaaggttttaactagcggttgtggtcacaatttcctcgtgtttttttattttgcgggaaattgtggacaaatgcagcagcctatgaccacaattgcagcctgagagatgcccgataaattttaacattgtagacttgtagtcaaaattgcagtcacaccattctttaggacattgtcttatctattcattacaacaatcatagaagttatgaactcatgagtttgtttacaccaatgatttattcttacttctattttttgcattcttttgtcattaggtagttggaacacagggttatgnnnnnnnnngagtacattgaaacgggtcacctgaaagttcagagtgacatgtggannnnnnnngttgtattgtatgagatcctcacaggaagaaggtcannnaaagaaa

SEQ ID NO: 1823 - DNA, 603 bp, Glycine max
tttctttacttctcttctctccaactcaaacatttatttcttccttctccgacaagttctatatcttccttcctttcattcatctctcgttaatcaatctttactcttccctctttggtttggtatcaaccgtttctttcgtgttttctctagtgctacggaacccaaccaaggtaattcatcttatccaagacgcacttgacttgactattccaaaccaactctagtttttccttccctatcgccacgaaaggagaattttcttttctttccatttcactcttatttcaaataatcaaggtttttggcccgatttgggtttagcttaaaattgttgtaatgaagaaacccttttgttttctgaaatttctttatccatattcattcatttcattttcagttagtttgaaggttattgtgattggttgagtatgacttctcagctgaggaatggaagtgggagttcgagctcaagtttgaacagcatatttctggaaacagaggatgaccaaacaattgcaagcatattaacagaggacgaaaatctcagggcagagaacaagcttggaaagagactttcacatttagattccattccgcaca

SEQ ID NO: 1824 - DNA, 432 bp, Glycine max
cctcacacgataatgccaggatgttggttattggtgctggcaagatgggaaagcttgtgatcaaacatttggtggcaaaaggttgcaaaaagatggtggttgtcaatagaactgaggagagagttgctgcaatacgtgaagaactgaaggatattgagattatctacaaacccctttcagaaatgctcacctgtgctggcgaagcagatttagttttcaccagtactgcatcagaaaacccattattcttgaaagaacatgtcaaggaccttcctcctgcaagtcaagaagttggaggccgtcgctttttcattgatatctctgttccccggaatgtgggttcatgtgtctcagaccttgagtctgtgcgagtttacaatgttgacgaccttaaagaggttgtggctgccaataaagaggatcgcctaagaa

SEQ ID NO: 1825 - DNA, 480 bp, Glycine max
aaaccttccaactcgtcgacgatcacaccatcgaccatgtgatttcgtggaacgattctggatcgtccttcatcgtctggaacaccaccgctttcgccaaggatttgcttcctaaatatttcaagcacaacaacttctccagcttcgttcgccaactcaacacttatgtaatccaatcatcttctctatcaatttcttttttcctttttttactttttataatttttgttaatttgtagggattcagaaaagttgtacctgaccgctgggagttctcgaacgagtatttccgaagagacgagaagcggctcctctgcgaaatacagcgacggaagatcctcccggcaacgccgccgacccgagcgactgcgactacgaccgcggcggttctatctccgctgccgctatctacgattccgccggcgaagctgatcgtgtcgccgtcgaactcagcggaggagcaggtgatttcgtctaact

SEQ ID NO: 1826 - DNA, 370 bp, Glycine max
ctagtaggattgtggaaacaaaaactgattctgatatttctgtcaagcaagagaacactgtgtctttgtttccttctgaaaaaggtgctgcaagcaatattgataaagataaaatttcagagaaaatgaacagtgatgaagaccagcagaggcctaagaagaaacaagaagaggattgtccgtatattgatttggaggcaaatattgaaaatcaagaaacagttgctgcaagcaattttagtagggatcaaaattcagtaacaattgttgttgatgaagatcagcaaaggcccaagaggaaacagaaagatgatcattatattgacttggaggcaacacttgaagatcaagaaacaggtgctgtaaccaa

SEQ ID NO: 1827 - DNA, 444 bp, Glycine max
cacctttctcctttcaagttaactgtgaagacaccttggcaatggcagcatcatcactatctcacttctaaagtgttggtctctgcctctggcaacacccaaattcctaatactgaacttcttcaacgccctactcctccagaccctctcgatgacgctcgtcaggctcgggtactctctttcttattcatactactcaacttttcttctcatctttcatgcaacgctcattcttactcatcatataaccactttctaatacttgatttctgcaatgaagtagagatcgtcagattggaaggctgcaaagacatatcaagatagtaaactcatctataatggtagagtggaaggttttaattctggaggcctgctggttcggttttattctattatgggctttctcccattcccccaattgagtccagtgcatgcttctaaaga

SEQ ID NO: 1828 - DNA, 394 bp, Glycine max
aacagaactgttctttgaaaagttttcaaatgctgttgttaagttgagtcagttggatgtgttgaccgggaaacaaggacagattcgcgccaaatgctccgtccccaacaagaagaaggtggtcacctctgtggtggaagaagagggagtggatttaagcgctcagatgtgagattaattaaggaatgtttgtttgttaataaattaatgaccatgtttcgtagtagactagtaatgtgatgtacgtcagttacataaaaggagtttctcccgtgttactacctgcattcctgcaatccttaatttctatgtttagaatgttttttatgacatgttattgtgttcaaggacagttttataaaatgagcccctcttggttaagggtttggattgt

SEQ ID NO: 1829 - DNA, 826 bp, Glycine max
cattggtgcttctgccaaggctggcatggagaaaaccaaggccactgtccaggagaaggtattccatccacttctactttcaattatcttttatataattaaaatttataaatacttatgttaaaaaaaattactggtttttttagtgacatgataacacattatgctttattaacataaaattgatacacagataatcataaattgaccttttttgctaccatattacacagattatcatcaagctatatacactttttcattttctgatcacattacttgaattgttgtcatctgacatgtttcatgaagctaaatagagtaattcactttggacctttattcatgtgtgattttgagacaaagtaagtgaacaatttaagacattcatagtttaatttaaaaaatggatatggcattaattttgttgcattttaactacaaatatatagagagatttatttgtttattttaacgatagaaagttttactttggaaaaagcttttggacatgcaagtgatgtgtttttgctttaaccaggcagaaagaatgacggcacgtgatccgatgcaaaaggagttggcaacccagaagaaagaggcaaagatgagccaggcagagctggacaagcaggcggcgcgacagcataacacggcggcgaagcaggctgccacggcagggcacatgggacaacccatggggacccatcagacgtcagctatgcccggtcatggaaccggacagcccacgggccatgtcaccgagggagtggtgggctcacaccctattggaaccaacagaggcccgggtgggactgctacggcc

SEQ ID NO: 1830 - DNA, 377 bp, Glycine max
ctcaggagcagcaatcttccaacgccaagatggttctcaatcagtcgctggttccttcaccgccaccggcggtgatttctcagccgtcgtcttcttcttcggccgcggtagatccgtcatcggcggtggttgatgacgcgccacgcgagtcggaggaggttaaggcgccgcagcagaaccggtgtatgacgtgcaggcggcgcgtggggctcacagggttcaagtgtcggtgcgggatgatgctgtgcgggacccaccgttacccggagcagcacgcgtgcgagttcgacttcaaggggatggggagagagcagatcgcgaaggcgaatccggtggtgaagggcgagaagctcgacaagatctgaaacgaatgaacg

SEQ ID NO: 1831 - DNA, 372 bp, Glycine max
gctgtggagaggcttgctaggaaatatttgaggaaccctgttgtggtcaccattggcactgctggaaaggcaactgatttgatcagccagcatgtgatcatgatgaaggaggccgagaagttttccaagcttcataggttgcttgatgagcttaacgacaagactgcgattgtgtttgttaacaccaagaagaatgcggatcatgttgccaagaatttggataaggatgggtatcgcgtgactactttgcacggagggaagtcgcaggagcagagggagatcagtcttgaagggtttaggaccaagagatataatgttcttgttgctactgatgttgctggacgtgggattgacatacctgatgtggctcat

SEQ ID NO: 1832 - DNA, 249 bp, Glycine max
aagatcttcttaaggcagaggaacaagctgcaaagtatagagcaactggaacagctccaaagaaactccttggttgtttctaatgcttcaaatctcaagcattgtggggaaagaaaaagttattttttattgtgtatctttggttattaaatatcattaatacaagtgtggttttagtttacatgttggagatttagcccatgttcatttattatgtgtgcaaacctgacacattggcgtgtatatacc

SEQ ID NO: 1833 - DNA, 327 bp, Glycine max
tttccttactattgactctatattcaggagatggagagagaagtctaaatttgtggcgtgatctcaccagatttttggttcacagagttttcagctgccggatgatatatgattctgattctttagtttcatttgatctgcttgctgttatcatattcgggttacattgtgttttgttaggctatatgtacagattgtgatatgatttaggataataaatgttgttttctttcttttcttacatattttttcctatgtactttgtccttccttactattgaccctatgtttaggagatggagagagaagtctaaatttgtggcgtga

SEQ ID NO: 1834 - DNA, 366 bp, Glycine max
caattactcccactctggaaatgggttcgctacccgattttgacactctcccccctctgagctcgaggatttcaacggtggttccagcaacccctcgagaagatgaaaacggtgcgtttcaactcaactacatggacctcctcgtgaagctccattacatacgacccgttttcttcttcacttccgaagccgttcaaggcctctcaatctccgacttgaagaaacctatgttcccgcttctcgacccgtattaccacgtttcgggtcgggtcagaagatccgaatccggacgcccctttattaagtgcaacgacgccggtgttcgcatcgctgagtcgcactgcgacagaaccctcgaagaatggt

SEQ ID NO: 1835 - DNA, 998 bp, Glycine max
  misc_feature (948)..(948): n is a, c, g, or t
actctcaagacaagtgtacactaccttagatctcaccaactcggtggcccttgtctctgtctctggaaatgactacggtcgttacatgctaacaaatggctccctggtaaatcattattttgagttatttattctagctagtcttcactttagagaattttatttcttcttttgagagaaaaaaaatcacagcatactcttggtttaattattaatttttaggcattgtattatttacaccatgtccagtttagactctttcctttctcccctaaattttgattaaacattattcataaataaaaataatcattaaaagtcataaaaacgtaagtaaattcaatatattttagaataaaacagaaggctcattgtgctcacattttcaatagtatcatcttctttttagtaggcttacttagatttaggtgggttaggtatacaattattctgggaagaaaattcaccttcacttttaggtccaacaattgtcaaattctaacaatagcccaaggaaataaaccaaagtatattaaacaaaagtcatattataaataattaaattttactaataagtgtccttaacattgattaataaactaaaataaaaaaaaatttatcctaaaaattattaaaaaaacgaaaaaaaatcataaataaaaatttttacatatcttaataatttgttaatcaatgtcataagaaaacttgttagcatttacataaataatttagcaacttaatcgtggcattcttaatttgcatgtatatatgtatatgtagggtttaccatctttcgtggcctcagttgttaatcaaacaagaagcaatcttattcgcatcaaagggttgggggtgaagaaaatagtggtgggtgctctacaaccccttggatgccttccccaggagacagccacaagctcgttccaacgttgcaacgccacctanaacgccctcgtgcttctccacaacagcctcctgaaccaagcaggaccaag

SEQ ID NO: 1836 - DNA, 399 bp, Glycine max
cgccgccaaatttggaattcctaggctcgtcttccatgggactagtttcttctccttgtgtgttaccacgtgtatgccattctatgagcctcatgacaaatatgcttcttctgattctgattcgtttctcattcctaatttcccgggcgagattagaatcgaaaagacaaagattccaccttatagcaagagtaaggagaaagcaggcctggccaaattgttggaggaggcaaaggaatcagagttaaggagctatggggttgttgttaatagcttctacgaacttgagaaggtttatgcagatcattttaggaacgtacttggaagaaaagcgtggcatattggtcccttatctctatgcaataaagacgcagaagagaaagcacgtagaggaaagga

SEQ ID NO: 1837 - DNA, 401 bp, Glycine max
aatccccagcaggaatagcatcctaggtgttagtttacaggagacttatagcaaatcttagaagactttgtaacatctgtaactttgtcataaccaaatttcagccaaatgattatagcatgtacttaaaatcgacaccttagacttgagataccccacaactgttggatgttggaagaccccatgccaaactgtttattgtaagaatagatcttgttctaaaatagaagatggactgaggtgaggagattcaagagattccacttcctgattctggctttgccttggggacatgatttttatagttaccttttacaactttacttcaatgaggctctgactaaaataatgcattgaaacttatgaactggaaaatgaagactggagaataaagcaaacgg

SEQ ID NO: 1838 - DNA, 345 bp, Glycine max
cctaaccccattacccaaaatctgtttttttattttttttcctgcaacactctttattggatcatcttgtatttcattcctcctttacaatttcctttcaaaaaaaattttaaaaaatattaaaaagtgctcttttttgtgaattttgacccatttggccaccgacagatttcgatcttctccgtgccaaagttgtaatcttttcgacttttggcgaggtgggtcgatccgatttcgctcgaatgattgttggtttgatctgaaaaaggaaaaggaaaaaaaaaattgggttatttcggattcaagattttgtccttttttgaaatggtctatttccatagctca

SEQ ID NO: 1839 - DNA, 509 bp, Glycine max
cacaccgttgcagatcttttggcaacccaaccaaggagtggcagggaggctagagagcttcgtcgttcctccagttcaagctctagctcggtattctctctttctttttcattaatttacacatgttttatagcttgttcaaacttccatttagatcaaaattcattctatttagcccttacgtcttttgaatatttcatcacatgatattacttacatacacagttttggataaatgttttatagtctgaggatgatgggcaaggtgggaggaggaagaagggagtgaaggataaaataaaagagaaactaccaggggtaggaggagggaataataataaggagcatgcacacacaacaactgctccaaccaccgccactaaccaccctgctgatcagcatgagaagaagggcataatggagaggatcaaagaaaaattgcctggccaccacacccactgaaaacctgcgttacattaccatatgtttgcgcctgtctgtcttatata

SEQ ID NO: 1840 - DNA, 650 bp, Glycine max
ctctttctcatccagaaatgcggattctcagaatccgaagccttcaccctccgagttgatctcttcaaaacctacggaagcacccttgccggtttaagagtcagtaataataacacatcaatcaatgtcttattacaagctctaacacaccaatatccccatctcaactctgtttccttcttcgttactttgcaggcactaggccatgatatcaccgcagaggagtaccatgggtgagaaccatttaattaactatctttcctctgatcgtcactttcactccaaatgtcgtctaaactttttccttcttctcactccaaccagtttcgtgcacggaaggctaccttacgactccatcaaccctgatcatcacttacggaaccttctctgcaccatcaaacagagaaaaattgtatgttgctactttataatggatattttctctcccatctttattcttagtttcttatcttgctgttttttgtttcctaggtttttactaattcggacaggattcacgcgatgaggtcgttggatagacttgggatcaaggactgtttcgagcaaatcatatgtttcgagactataaacccgaaccttccatattccacccgacccgatgaattcctcatcctccttaaaccgtctct

SEQ ID NO: 1841 - DNA, 378 bp, Glycine max
atttattgccccctccatcatccaacaccagtgaacaattgccaccatatccattattcccacctggcctcattccgggaatggttaaaaagatgcagattggtagcggggtcccatattctcctttgagccctttggatatcccaactataataccaccatcgactgtaccaccatcagaaattcttcaaagagtgtcaaatttttttaaagaaattggagaggtaaatccttctgagggccctatgaattcagattcaagagatgatgatgaatatgatagagaatatgagagggagcctccagtacgaaagggaggtgcttgcatacctccacccccaaccttgcaggttgatccagagacgggaacctatgctg

SEQ ID NO: 1842 - DNA, 582 bp, Glycine max
  misc_feature (515)..(521): n is a, c, g, or t
  misc_feature (524)..(526): n is a, c, g, or t
  misc_feature (535)..(536): n is a, c, g, or t
  misc_feature (547)..(556): n is a, c, g, or t
  misc_feature (558)..(559): n is a, c, g, or t
  misc_feature (567)..(567): n is a, c, g, or t
ctttgacctaaaatggagggggtaagacaggaggagtaggttgaaaatttggagaaggtattacccatatgtaaaagaaggctaatttcaagaaaaataaaagaaaaaaaatttgagaagttgatcttttaaaataaaaatacaagttttaagtaagagatactattatacaacctttctgaaggctaataaatcggctaaacgtgatgcttctctatgtttatatccttttttcatccaaccaagtttgctgcattcaaagaaaaatgtgaattggcaaaactacctcagcccaaaatccatgatctcaataaatgagagtactgttacttttaccgaaactgttgctgataatatagcatcatacagaattccaacttactagttgtagagcatgccaaaaactgttctcctcactggattgagttcttccactgctttcttgatacctgaaacaaatttctcattcattgaaacaaaagtgtaaacaacacacttcttctaactcatttttnnnnnnnttnnnatttattannaattataaaannnnnnnnnncnnaaaaattntttagtttctaataa

SEQ ID NO: 1843 - DNA, 1624 bp, Glycine max
cataaacttgatttctttgcttggatttaatatattttgttttggttctcgtaaggatgaggattcaggagtaaccaattgtaaatgtaaatgtggttggtttttcttgattgagattatgacaaattaagaataataatcacttttacagaaggacgtgcgcttggggctgctgcggctgtttcattgagcagcaaagtgcctcttttttacggaaagaacggttctggaaatggatccgcttcttcatcatcatcatcatcatggatttcaggagctcttgctcttcctgccgcaggtttcctcaatactcaataataataacactgttgaaacaattacattcactttttccactactgtttagtttcatcagatttaactaaactaattttcaccaatacatccttgtttgtttcatcatatgcgtttttattgtaaagtgaagaggagccttgtccattgctgtctctgtctggggatcaggttaagtttttggattattacttcccttaatatcccctacgttttaaactttttcaaaacttcaatcaagctagcctctaaagtaatcaatccttgcttattcttttcattttcaatccaatcctgttagtttttaacaattgacacagattccttgatctccaccatgaactgtataacattttaacagataaatcataaatcacttggaaaaaccaaaaccattttttcattctgtttgcctttgccgtgtgtatcagtcctcctacaagattgcattgattataatatatacattagtattttaatatcatagtagtttacaccagttagttaactttgaagtttgaacaaagtctcaacgatttgctatatttgtcggtggtttctcgatgttacacaaaataaaatactattacactgtgcgtcctttaaccagatattttcaatctgctgctaatttgatttgatttgttttgtctcgtagcttacatgttccaagatcaggaggtgcaggcagctgaggtacgcttgatatttccctaactgctgcatttccttgcttgcgtgctgtttttccttgacacgattataacgtgcaaaccataccataccatgtgtctactttttcttacccagctggagcgcactttcattgccattaagcctgatggagtgcagagaggcctggtaaagtgaaaacttcatttcttgcacttctttatcatttgtttgtgaaacaacgggaacatgctagtgcaaattgtctgcacattttgcaatatggtccccactatgataaattattacatagggtccttatattttcaagtctcaactaatctccacatgatgatacctaatgatttgttattaattcttttttaaattaaaaaactcaactatgtgtaacacatatattagttgaatcatggacaagactatttaataatttctctcccacttccctgtctgaggttttgttcaggtttttctcaccatttgttttctctttatttcagatttctgagattatatctcgttttgagcggaaagggtacaagcttgtgggaattaaagtagtgattcctaaaaaggaatttgcccaaaggcactatcacgacctgaaagaaagacc

SEQ ID NO: 1844 - DNA, 766 bp, Glycine max
ctgagctagcagcgtttgggtgctgatgatttcattgtcagctccaaccctaaacaattacaggtttgtaatgcaattgtttgcctctacatttcacagcattaaaaaagtatatatatggtttgatgcatttgggctttaggataataaatgggtgaaggctatgtaaacatgatttagtttctctggtgacactcaggctgcaaggagaagcatagatttcatattggacactgtttcggcagagcactctctgttgcccatcttggaattgctcaaagtcaacgggaccttatttctcgtgggtgcaccagacaagcccttacaattgccagctttcccattgatatttggtaaatttcccttcctgtatttgctaattaattaaggcaaagctaactagtgcaaaagaaaaaaaattcttattggaattacaaataatttctttacattctccaatgatttttctaataaatgttttttctttttagttcattaatcaatatccttaaaaacacacttggtgaggaagatccattaattaattaccttttttagttggttgatttaaaaaaaaatgatgaacaaatgttgattaacattggtgaaatgcaggcaagagatcagtgaaaggtgggatcatagggggaataaaagagacgcaggaaatgttggaggtttgtgcaaagtacaatataacgagtgacattgaattaatcacaccagacagaatcaacgaggctatggagcgccttgctaagaatga

SEQ ID NO: 1845 - DNA, 348 bp, Glycine max
agccaaccctttccatccggaaggggagatctttgttgagtacttgtcacttcacctttataacttgaaatacgcttctcaaatttgtaatatactgctctctcagagatatctaggttctcagatacccaaggagtataagaataattaagataaccaagcttttccatgacccgacggtccaactcacccccgctaaatatctccatgaggtaacttgcctaaattaatcaaaataaaagaatgggaacatttgcaaacttgtaagaaaaagttgaataaggaaccaataatttccaaatatggcaataatgcacaacatgcatagattaggacatgtgtgcaaaa

SEQ ID NO: 1846 - DNA, 335 bp, Glycine max
ttctcttgttggaaccttcctcgccgtggctttggcttaattaattaaacctcttccgatgagaaatttttttatgattcgtccactttgaaggaaaaaaaaatgattatttgattttggtcgtggacggaccagatcgatctatttgatttcttctttggtctctgttgagttactctgtttaattatcttcttaattgtgttggtttcgttggtgtttgttcattgctacataattttgtgattctttgtttcccggcttcatttgttttatctagatgaccatggtttcaatgtacgtttaatcatatgtagaatgtaaaaacggttcattc

SEQ ID NO: 1847 - DNA, 406 bp, Glycine max
aggaaatactagattttgatatactattatttaataattttcctactcgactaaaatgaaaaaaaaaacactaaaataatgatatcactaatattattagctgaattttttttgtttgttgaatctttagttgactgaatttagtatttgactaaaaaaagaatcatatcacaaactaatttgcctgtaactcattgctttaatttgcttttaataattgtcagcaagtctagatttttaatgattagatagatagctaacaaaaataccacactggatacatatgaaatcaatattaagtttaaagagatgcaatacgcaatcgatttgattaatgaatttcaaatgttctgcgttaatttattcaattaccttttaaattgaatgttttcattcctgggctctg

SEQ ID NO: 1848 - DNA, 355 bp, Glycine max
aggaggaggaggaggagagagaagaagagaaaaagaagcataagcaggctcctccttctctcttccctattagtgtgagaaaggggtttagtggtgaaagagtgaagagagatgagtggagtgaaggggcagtgtcaaccctacttgaggcctatgaggccaaatgggtgctaagaaacagagccaagctcaagggccatgactgggaggacgtggcccggcacgtgtcgtcacgtgccaactgcaccaagtcaccaaagacttcaacgcagtgtaagaacaaggtggagtccatgaagaagaggtacagatcagaatcagcaacagcagatcatgcatcatcatcttggcctct

SEQ ID NO: 1849 - DNA, 569 bp, Glycine max
tatttcggcttacaataagcaattggtgaatactttttaccctatgtacttttttacttcttactcatattgtatataattgtttataatttattgaacttgttattttgatgtgttaggagggaaagaattcagaggaagacgagtctgacaagtcaaagtctgaagtcaatgatgacgaggaagatgaggtagattgatctaattggttattttgatttgtgcctttgtgtatcttattgtataattaatgcgttgtttgttttattctgtaggaggaggatgatgatgagtaaagatggtgatacatgatgaagcgtaggtggatgcgggaaaagaaaattgttttgcatagttgttgggtttagaatttcataggatggttccctacccacatccttttctgataattagtttctgaatttttattttgtcctccctcagtaggtttagattagtgcacaatcgtaattagggtttaatatcatgatcctgtacttaaagtcaatgttatgatacgtttctattctattctcgaagaaattccactgcctctttcaatttctaca

SEQ ID NO: 1850 - DNA, 408 bp, Glycine max
tcattattattgtggcagtgataactcaccagtgtttctaagcaacatggcttcttcttcctcttctttgtccaacattttggagtcatcttcagtttctgggagtgaattcgggtgctggaatccaaccctttcctggtctgatcttcccactaccaatggagcatatccttaattaaccaccgcatgcagtaactactttcctcttttttgttcactgttcaaattatcttttcgagttagatatatagaactccttaatctatagtttatagatgttaatctgtatcctagctagagtcttttctcgtgtttgtttgcttcggggtggtggataaggaatatggatgtgtaggtaccattagatttttttttcccaactcagcagcgtctttctatcatttgctt

SEQ ID NO: 1851 - DNA, 412 bp, Glycine max
  misc_feature (172)..(172): n is a, c, g, or t
tctcgcccgtaaacagtgcctcgtcaccgtcacgtgcgaccccaaaaacctcgagcacatcctcaagcttcgcttcgacaactaccccaaaggccccacgtggcagtccgccttccacgatttgctcggcgaaggcatcttcaactccgacggcgacacgtggctgttccancgtaaaaccgccgcactggaattcaccactcgcactctgcgccaagccatggcgcgctgggtgaaccgagccataaagcacaggttctgccccatcctagccacggctcagaaagaaaaccaatcagtggatcttcaagacctcttgcttcggctcacttttgacaacatatgcggcttggctttcggccaagacccgcaaaccctagccgcggggctcccagataacgctttcgctctc

SEQ ID NO: 1852 - DNA, 254 bp, Glycine max
tctcatataaggggactacaatttcaccacttgcagtggacttgaggtgcagcgggctattcccatgccaaggtgttacaattcgagacattgacctcaagattggactcaccccaaccacctcaagatgtgtcaatactcgacctctctttggaggcttgctaatgccccctgcatgcgcatagcttcctatccatccatcacattaattttcttaccttacttaattaccagctctgttgttgagaaaaaaa

SEQ ID NO: 1853 - DNA, 715 bp, Glycine max
  misc_feature (42)..(45): n is a, c, g, or t
aaccttacgggttcagccatggctggtgctcttggtgggttnnnnttcatgctagcaatattgtgtctgctatctacattgccactggtcaggatcctgcccagaatgtggagagttctcactgcatcaccatgatggaagctatcaatgatggcaaggaccttcatgtttccgtgaccatgccctccattgaggtacccactgtttctctgatcttaaatggtgttgtcctttttaggtagagtattgttcatattttatgtagtggatatttgtctgaattagtagatgcaagtgcaagttgtagtcccattacacatataagcacgccttgcacgttgttgtattgacacatgatcaaggtaatgggctggtggttggtccttcgactatctctggaccttgcatttaactcctagaagaagatatcatcaaaatctaagattcagtgccctcaatatttatgtgaaattggttttacctcaaaattgattctttcattgtaattgttctatgtctgcattctgtttttctctccttggatggtgaaaggaaagcatttatttctttgcagtgagtattgtacatggcatacttatccaccatgtgttgatatttctttgggaatgaattcaacctaacctgttttattcttaatataatttctcaggttggtactgttggaggtggcacacaactcgcatctcagtcagca

SEQ ID NO: 1854 - DNA, 398 bp, Glycine max
atctatctaattacttaactaactataaccaactaaatcaatctctataaataaataaaaaaataaaaaactaaatcaatctctaatatctgtaatattgttcactaatcacagctaattcaattcccatgcaaagctggtatgacatttgattctatcagatagaaacaaatattccactgtaataatgcaggatcttggatccaatcttatttggtaagtacccaaaagagatggagatgattctaggaaccaccttacctaaattttccagtaatgacaaagcaaaactgaggcaaggactggatttcattggcataaatcactatgcaagttattatgtacgagactgcatatcatcagtgtgtgaatctgggccaggagtttccacaacagaa

SEQ ID NO: 1855 - DNA, 481 bp, Glycine max
aggacataactctatcagtctaactcctccttatggtggggtttttggtgtcatggagaaaatcaagcaaaacagtgcttttgcatttggggcactttggatcatcctcagagagcatcacatacatgaggcagcgagggcaacccacaagaaccatggaagtggcttcagggctgttagagtaacttttgtcctcttggttcagctccgacgacacgcacgagctcggcggtgacgtcggcgacgccgtcgccgatcgtgtcggtgactccagtctccgatcagccctcggtggggacaggttcagcttcaagtcaagctttggaccactttcgtttctgcgactcatggctttcctctgttttctacaaccacacaagaaaaaaaaagaataaataaggcatgtaaatataaataataaacaaaagggtctaatcatatgagcatagaaagaaaattggaagaagagggcgagggtggt

SEQ ID NO: 1856 - DNA, 394 bp, Glycine max
acttgaggaaggatctggtgaacctgtgaacaagttaatgacctcatggacaaagcagaagggatatcctgttgtatctgttaaagtcaatgatcagaaattggaatttaatcaggttccattgcatctgacttttcatttgatttttgtatgattatgttcagagacaaaatccatcacatctcgagtgtaagctttgtatgtttattgacagtcgcaattcttgtcaagcggtgctcaaggagaaggccattggattgttccaataacattatgctttggctcttatgatgtccacaagagtttcctcttgcaatcaaaatctgaaacacatgatgtcaaagatttccttggttccacacacaaaggtttaaattgttggattaaacttaat

SEQ ID NO: 1857 - DNA, 398 bp, Glycine max
caccaccaccaccaccaccaccctcaaatgttaattacgctcccaatttttccccaagtagtggtggaatggcacctagttatttcaacatgccatcatcatcatcatcatcatctggggcaggtcctaggccaaggggtcctccaggatttgcaattggggcaggtgctggagcattggctgctggggctgttatgtttggtgataacttcatgtcaggatttgatgttccttctggttttggaggtgatccaactcttaccattgcaactgatcctcttttctgaactagaattaagcacttttgtaattattattatgttgggctgcacatatatatggtcattgtgccatataaaagagttctagctacatgctttgggattaacactaacctg

SEQ ID NO: 1858 - DNA, 558 bp, Glycine max
cactatattgaaggagaacaggtatctgtttgataattttgatggtaatctgtctaggagattaattattgacaaaatattgttttgcagggctctgaaaagctttctgtacatgatattaataatgtggaagatagatatgagattctgttgggaatgaaggaattagctagcaaaggaatggctgctgaagcagttgaggaagtcaatgctatcgattccaatttctttgcccagaactcaattttgctcttccaactcaagcaggctagtggcttctatttattgatattcttttctttattaaatttataagagagtgccagggaatgtcatagggctctgcatagtgttaggaatgttatcttttaatgaggattcctggtcctggctataggttgaattcctcaagttggtcagctctggtgattataatgctgctttaaaggttgcttgcacccatttgggtcctttagctgccagtgatcctgctttattaaagccattgaaggaaactcttttggctttactacgacctaatgaagatgctcttggaaa

SEQ ID NO: 1859 - DNA, 380 bp, Glycine max
  misc_feature (345)..(345): n is a, c, g, or t
  misc_feature (351)..(353): n is a, c, g, or t
ctcttatttgagagaagaatttacataagcccagaaaaaaaatgttatgctggcatcttaaactagggacaagaatttacatctttgcttcacttagcttaattgatttctgtcttaattagctgttgtttgtatgtatgcaaatcaaagccatcttctaaccggaaataaaatacaattaaaaggtagtattttctactcattctaaggatgttgaaaatggattataactagcattgcatttgttttcacagtttaaaagtgtaatctcttgcaatcccaaaaacaaacttttgaggggagtccaatgaccactatagatatccataagaaggtcagagacantcatgnnngtctcatcatttaccgcaccatggcac

SEQ ID NO: 1860 - DNA, 398 bp, Glycine max
gcaaccctacattgcagattgggtaatatatgatcaattaattacttttctgtaatttgtgatttgaactataattttaatgtgccccttttgttcagtcctgattacaggtacaatgatgtagcttcagatcagataactgccacaactcaacctcaacaagtgagtggctttattccagggtggatgctgtgaaattaggctcagtattcagttggagacataaaagcaaacaccttacaaaagggcaaagccaaaaatgcatcttggtgttggcaaggtgtaaatgtaaccctgcttctattattattttggtataagaaacagatgtgttgtgacttgttcaaacttgtgagaacctttttagccatagacatatggcaatttataacattcgg

SEQ ID NO: 1861 - DNA, 397 bp, Glycine max
ataaattccatgttatgtgggtagagccttaatttccttgcttgctattgtaattgtatgctatgctttgacttaatcgttctgaatcttcttctataaaccttaattgttattttttcaggccttcaatgggttactattattgtaaacccaggccttgtgatactcatactcccaatgttgttctgatcttggccgtggccttgattcttctatgtgccccaaagttcttctcaggtgaagcagaggaagaagaagatgaaacgaataacacctcaccttttcaggtaccaataatcatagtactcatcctgcttttgttgtcctttttgggaggttcaagcagaagaagggtttgtgtcaagccaccatattgtcagtgtacgtatgcctgcta

SEQ ID NO: 1862 - DNA, 374 bp, Glycine max
agaagttttcagtcatggcagaccttaaaactcatgaaaaacactgcggtaaggataaatggctttgttcatgtggcacaacattttcaaggaaagacaagctttttggacacattgctctattccaaggccatacaccagctattcctttggatgaaaccaaaggaatggctgagccacctgatatccagaacagagaaagcaacaataaggtagaaagtattaacttctgttttggatcaaattcttcaagtgaaaatgtagttcaaaacatgatggatatgaaaggtaataatgatgatcccatgaattatttctcatcattgaacttcgaaggctgtaactttggggcgtttaatgaattctcccaacct

SEQ ID NO: 1863 - DNA, 750 bp, Glycine max
gatgaactacatctgcttcccacaatcattggtgtccaaggtgttgttttatgtaaatcgggttccaattatttcccaattcaaggtaattttttcttagatgcaactctgactatgttttatttacaacatttctaatctacgttgtcaataaatgtttattttcatttcttgaaattgaaattaattactaaataccaataatgattgggacatatgactaacacaagtggtaatgacttatatcatttaactaataattaagtgatataaaatttgaatcttgtagattttagttatgaaataaataatattggaaaaaaaaatacccacttatatggtacactagacgggaaaaaaaaagaaagaaagaaaagaaactaactaattaatttatttatgtaagttttggacttttttgggatgcatatttgttatttaattgtatttactatgtgtgaggggtgcaggagcggttgcaagagttacatgtggatgggagaatgagcttgggtacgagacaggtcctatatcagtgttgagtcatgtgacagatagtaaaggctatttctttgctacattgtcacttggggagcttggatcgaaattgaagatcactgagtgcaaggcatacttggagagttctccattggagacatgtaaagttcccaccgatgtcaactacgggatcagtggtgctcgtctttcttcttatcgcctccttgagaataagatgaagttgtacactgt

SEQ ID NO: 1864 - DNA, 375 bp, Glycine max
cttgtgctgctattccaacaaacttgccttgccaagcagcatcaccaccacccaccctgttattcttcatgtggcgaaattcacaacataacgtatccatttcgactaaaaggcgacccaatcagctgcggcgatcaagattacgaattagattgcgttgaaaacgtgacagtaatgactctattttcagggaaattccacgtgcaggaaataaattacaagaggtacgagatccggttgaccgatgctggtgtggtggaggacattgcttgctcaattcctcgttatttctttaatctctacaatttcacttacatcggtggtcttaactattctgcatatggtccgttaagtttctcggggtatcctcagtat

SEQ ID NO: 1865 - DNA, 962 bp, Glycine max
  misc_feature (902)..(904): n is a, c, g, or t
aggtaaggttatgaagcttctatatatcttatatgcatatgacactattattgaactcctctatatcttatttaacaggaacaaagttgtcagaagacagcaggaaatatggtgcagaaaatacatgtaccagtggtaatacactgtcgagagctgcactaagttttgcgcaagcccatgctcaaattgagaaggagcgtggaaacttactaaaagctcttgggacacaggtagtatatacatgttgatatgtaagtatgcttatgtgtggagtgtttatgtatgagttcattgagcagtacttgcaattgcaagattataaggttcaaatctgacttcacagaagtaatgatggggatttccccctaactgaactggtttactggatatgaatgagatttacagatatttaagtacatttaatctaatgaaaaaggaatatggaggccatattcaagttcaatcgtgaatagaatttaatagccatgctcgtatactgagttcatcaatctcacgctatctatactggtggctcatattattgatttacctagtgtgtgttgccatcttagcctaataactatgtgattgaagtcatggtcaatgccgattaggttgcagagccattaagggcaatggtggtgggagctccattggaggatgctaggcatcttgctcaacgttatgacagaatgcgacaggaagcggaagcccaggtattcgagtatttatctttcatttaacttttcaaaacttgttggacatcctttttcatttgtcacctgctttttgtagtctgtcttctgtgtttcagtgcatgtttcattaatgattttattttactattttgtggtgtaattactctgtcttttgaacctagacaggctattgaagtttctaannngcaggcaaaagtaagagaaatgccacccaatgagagaatgctagaaatagaagcagcg

SEQ ID NO: 1866 - DNA, 402 bp, Glycine max
cttgtctccatattgagggatgctggggctgccaattctactgatcaaaggaaacctccaaatgcatcaaagcaactcaagcagactgtcagtgacataaagcatgatgtacaatcccaactccagcagacacgtcagactggcatgagggtccagaaaattgcaaagaagctgaaaaagctccacattagtggcctgaacaatgcgataacctctgctactgttgttgccgttcttattgctacagttgcttttgcagccatcttcacagtccctggtcaatacgttgaaggcaaaacacatggattttcacttggacaagcaaatatagcaaacaatgcagctttcctaatattttttgtgtttgacagcctggcattgttcatctctctggcagttgta

SEQ ID NO: 1867 - DNA, 414 bp, Glycine max
aatggctgatattctcgtaaacctaacgtctctggccaccgaaatgggaaggctagtttcagaaggttacgttctcaccgttttggctccaaacgacgaagccatggcgaagttaacgacggatcagttgagcgaacctggcgcaccggaacagataatgtattatcacattattcctgagtatcaaaccgaagagagtatgtacaatacggttagaaggttcggtaaggttagctacgatacactgcggttaccgcacaaggttctggctcaagagtctgacggctccgttaaattcggtcacggcgattcctccgcctacctgtttgatcctgatatttacactgatggtaggatctccgttcagggaattgacggcgttcttatccctcctgaagaagaagaagaacgcac

SEQ ID NO: 1868 - DNA, 342 bp, Glycine max
ggtgctggacttacgccggtgatggctcaagacagccaagtgagcttgagttacaacaagcattccaccaagggaagtacattgctggcatcacaaagaagctcaagcaagctgcataatgttgccttgccttcatattagatcatactattattattaaaccataccacaatattgcttgaaaatcattgtccaatttttagacttgaaatatattgagtttttttttcctgtgcttgcaagtattttttttttctttctaatcttggtaaaggaaatgctttgtatgagtgttacatgttgcagtggatgttgcaatttgttaaatgagaaaagtttgtg

SEQ ID NO: 1869 - DNA, 654 bp, Glycine max
ggatttgttcttggtgggctttctgagaagtatcatggaatgtccaatttctgggtgtcagaccgaattaatgtatgaattctgtctcaagctttgttttctcgtgaagtttcttattgtaagttgaaacaagaattccttgtaatgtatctcgaataaaagagtgtgaggaatgtagaccaatacgagtggagaagcagaataacttgcccttatctttggcaatgataacatttggccaacttacgactacattatatttcattgtcaggaaattgattcggaagccatgcagattgtcaactcgtgttatgaacgtgcaaaagaggtatgttacgatggaaagaaggattaaagaactttatgcttctcttgatttagtaaaaaagtctcaatcccattttgcataacacttaattgtcacaactttgttttgcacatcagatcctggagcaaaatagaacgctgatggatgctttggtgaatgagcttgttgagaagaaaagcttaaccaaacaagagttcttccatctagtagagttgcacggctccctaaaaccaatgcctcccagcatacttgacatacgagttgctaagtgtagagaattccaaaaattgatcggtagtggaaaggaaacgagtttgagtagccac

SEQ ID NO: 1870 - DNA, 987 bp, Glycine max
  misc_feature (937)..(938): n is a, c, g, or t
  misc_feature (949)..(950): n is a, c, g, or t
acccttctatgaatttcactcaaaattttggatttttatgtttgaattccttttccccttattagagaaaaagtaggactcggattgtaattgtatgattgattcatagatcatgaaattaaacagtggaagaaagtaaaagtgggaactttttgagatagaagaagcaagacaataatggtgtatttgtattgtattgtagtgtatgtaaatatgcatgtgatgtgatgtgttatgcagggctaatgacatatgtaaggagtcaaagaggcagattatcaatgttgagaatgttttcaaagctcttgaggaaactgagttccctgagtttgtttgccctctaaaagcttcccttgaaggtatatgatcctggcttgttaattactttgttctttgctgttgtgctaactaaacaagcacgatcagctagtgtagtgagtaatatttagttcaaagctataaagaggagctgtaggatctgttattttattcctattgggtacatatgtatagtaggagactaggacaagatatactattttgaagcacccaagacactactttgtaacatttgcattagtaatatgtctaataagagttatgtaatatattttattcatgatggaaaaagaaaatatgtttttgttttgatttttctaacgtttgcacttagcatggcaggcagtttattttggaagaatttattcactgtatctgcatagtttctagcacaccttgacacattttctacattgcataacagagtttaggaagaagaatgctagaaagaaagtcgtagtgtcaaagggaaaggaagatgagccgaagaagaaaaggaagttggaaggtgagccatctgataaaggcgaaggttctgagaaaggagaagataatgataaaggtgaggattccgataaaggtgtgagtggtgatgacnnaatgattcaanngggatgaaggcaattgtatttgttatgactgagccag

SEQ ID NO: 1871 - DNA, 397 bp, Glycine max
tcccaaaacacacaagcaaacaaaacaaaaacaaaccaaacctgagaaaattaaagaaataagaaaccccaccaatagggtctcacatctctctaacctctagaacacaccaatactacgaaaatatatcaatgttccctgaaaccgttcgacccagtcaccgccacgtgcacaacctccttatttaattattattcacacgtgaccgcgttcttccctaattacttgttaataattattttatattgcaagaaccaaaccgggtacggatttcccgacccgaccggagacgctgctttcccagacacagggcaaacggccggcgccggagctagccggaacaatctcgccggaatcgtggatgcgggtgacggtgagggcggtgttgaagtactat

SEQ ID NO: 1872 - DNA, 766 bp, Glycine max
tagatcgacgaaggatcaaggctcgtcaccgttgataaactcggtggccccaccgagggctatgatgatctcaccgcctccttgcccaccgatgattgccgatacgcggtttttgacttcgacttcgtcaccgttgataactgccgcaagagcaagatcttcttcattgcatggtgcttcttcatctgtttttcattattactattttaaccctctttttcttagtacttatcctatgttttattgctgttgatccgtggttttatgcatacaaacaaaacaaaagtagccaacccagtgtccggtggcgctattttaattatgagttatgtcgtctctgacagttgtagtaataatgttgaatataatggctcaataatttatgcggaggaaataaaattaaagttctttttaggtacaattatatgatgatttcagatggtagggggggacccgagtgggggattgatttgctttaattatctaatatgcatgattgaatatttgaattgaaatatttataatatatgatcaggtctccaacagcatcaaggattagagctaagattctatacgcaacttcgaaggatgggctgagaagagcgctggatggaatcagctatgaactccaggccaccgatccaacggagatgggattcgatgtaattagagacatagccaaatagacaggcagagaatcaaattaaatacgagtgctaattaagttttaatccttttatctcttcagttcagatgtggttccaca

SEQ ID NO: 1873 - DNA, 593 bp, Glycine max
gcttcagcagtagcatggaatccgaatccaagaacgacacccaagtcgctccggccttaatcgccgttcaccccgaccaatcctccgtcgccgtcgcagtgggcccgcacctccgggtcttcgacctcctgtaagcaacccttcccaactccatctctctcacttcaactcagttacattatgctgataaacccacagtagcggttctgcagcttctttaaccgacgactctgatggcgccgtcccgttccacaaggacaacatcagagccattcgcttcggcgcaaaaggaaaactcttcgtgtccgcaggtgacgataaaaccctcaaggtctggtcaacacagtcctggcgttgcatcaccaccgtgtaataatagccgctctctctctccctctctgtttcgtcacacgcacactttcaatttaataatttagttccttcgttggtattttaattcttacaataggtcctccgagaagagagtaactgcagtagcaatcagcgacgacggaacattcgtgtgcttcgccgacaaattcggcgttgtttgggttgtggatctcgatcctccgttacacgatgataagaaa

SEQ ID NO: 1874 - DNA, 1410 bp, Glycine max
  misc_feature (48)..(50): n is a, c, g, or t
  misc_feature (1355)..(1360): n is a, c, g, or t
taaaaaaaggtatctgccttttatttgtttgagaaaatgttggaattnnnttttcctgtctttttaattcatctgttttttattgtgggatggtggtgtgaatgtgatagaaactgaatcagaattgtgaatgtaagtatgaatctttattgataaagcctagttcccaaatctgccccaatgtgggtacagtaccaagaactgaaactatacaaagaacagtaaattccctggatattcgagagatccagaactctccctagccacagtaccaactgatcaactccctttcttctcaactccttcttagtttatgctattgggctgctaacataaacccacccttaatgtgcctaatgagtagcaggcccattaacataaccccctgtatttcttagattaactaattactaacataactaactactaatgggggttatctaacaaattgtatgatttataatgggtggtctagagtgggaaatgttatgtcttgctgaaagcttgggatgagttgaagatgactggtagtttctttgcgcaaatgctgagcaggtttgagatcctcggtattaagttctaaaaggatgggaggatgatgttgaacctaatatatggaatgaacaactttttttgatttaaggaagaactgagattcaagggttttttaaggttgtgcgaagtttattcttttcccgttctgcaagttatctgcattgtgtagaatttgaaaagcatacaaaaatggacatgcaaagccctgtttctggaaatcatttcgtagcaacaatttcatgttttatgcattgatctccaccagtttaatggattgtggaaatgaagttattttactatttatttatttgacagatgtcttgtttttaccaatatctggtctaatgggtgcaaacatgaaaacaagagtggataaaagcgtttgtccatggtggaatggaccttgcttatttgaggcacttgacgctattgaagttccactgcgagatcccaacggtcctttcaggtattgcatttctgaccatcttggccccctcttgaggtcctttataatttgtttattatgtttgaagttcaacttttttgctaagattgagggttctgacttgtgcaggatgcctattattgacaaattcaaagacatgggaactgttgttatgggcaaagttgaatctggcagtgttcgtgagggagattccttgttggtcatgccaaataaggttgattatttatttattttttgggttgttgtgaactgtctttatttcaccattcttatttgttgaacatgaactgaaatgggtgtcaaatgcacatgaacctgcaggatccagtgaaannnnnngccatatttattgatgaagatcgtgttaaacgtgctggacctgggaaaat

SEQ ID NO: 1875 - DNA, 402 bp, Glycine max
gactcgttcaacttcacgaggtcatggcgagcaagtccaagatctacatcgccatggagctcgtgcgcggcggcgagctcttcaacaagatcgccagaggccggctccgggaggaaaccgccagactttacttccaacaactcatctccgcggtggacttctgccacagccgcggcgtcttccaccgcgacctcaagccggagaacctcctcctcgacgacgatggcaacctcaaggtcactgacttcggcctcagcactttctccgagcatctcaggcacgacggcctgctgcacactacgtgtggcacaccggcctacgttgcgcctgaggtcatcggaaaaagaggttacgacggcgccaaggctgatatttggtcttgtggcgtaatcctctacgtaa

SEQ ID NO: 1876 - DNA, 584 bp, Glycine max
tgacatgtggcatgaaattggagggtcctttagaattgaaaagcagccatcaaaggttatggtttatgtgcaaggtcctgcttctggtgtggacttaatggttgctggacttcaaatttttcctgtggatagacacacaagatttagatatttaaagatccaaactgataaggtgacatcaagttttcctttatatctcattttattagtcttagagaatagcttcagaaacatatggaatgttcctaaattgctttgcacttgaactggtttgaatgaataacatttaacacaaaaaagaaaaaagaaattagatcaagtgatatgcagataatatcctctagaatttgatgcataggcatgatgccactatatagattaacaaatttaccaataacctgtacaaaggattggtttatgtatgatatgagaagtgtttacctccttcctgtttcaaatggtcctatatgaccttccaactcgcatatttcatgagctctaaaatctgctcgagattactaaagagcataatttttcttgtgaacaaaacaaaattttccatggcaggaaataaatggtacatg

SEQ ID NO: 1877 - DNA, 416 bp, Glycine max
tatgggtatgtttgggccccactcttactctttgcacatattaattgattttttaaaacacgtaatttgcaaattttcctaattttttttttgtggtcactttttgcagatgactgttgctgaagctagagaagtttgtcagcattggtggatgaaggaagcattagatatactggttcaaagaatcgtgtcttcacaacaacgaaaagaagatttatacagcatcggatgattctctaagttttaaaacaatttagtctaggtgggcctaggtcagattgccaagattttgaatcttcaaacattgagagttgttatacagaggattgatttagggagaggaacagaattgtagataaatatggaattgcaattcaatttaatttacacacttatagaacttacgactagactcc

SEQ ID NO: 1878 - DNA, 744 bp, Glycine max
tctggttttgggacccacaggagccattggaagacacatagtttgggcaagtgtaaaggcagggaatcccacttttatattggttagggacacccctgcctctgttaacaagccaaggcttgtcactgctgctaatcctgaaaccagggaagagctcattcagagcttccaaaattctggagttactctaatccaggttggtgctttcatttgattagcaacttctatttgaaactgtttcgacctcaagtctgctaacatcattaggtatttgagaacttaatatatctgtttaatggaatgtgcagggagatatgaacgatcatgaaagtctggttaatgcaatcaagcaagttgatgtagtaatctgctcatttggtagactactaatagaagaccaagtcaagatcgttgcagcaataaaagaagctggaaacgtcaaggtgcgcactttgctcccttttattgtataaccatttcgccgttgggtgtaaaattatggtacactaaatgtgtgtttggttccacatccaagatccatgtttagagcaaaatcacatcaaaagtgatgcaaaagaaactattagttgcgttggagatccacgtttagcggtttctagcttgtttccaaacactataactttatattacattaaaattttaaactatggtcagtgttaagcgctgattcttaatttcttgtgtcaacagagatttttcccatctgaatttgggcttggatgt

SEQ ID NO: 1879 - DNA, 403 bp, Glycine max
tgtgggaaactggaggaacagagggcaaaagagctaaaggactcaaatgcaaccaagaaagaagaattattgagaagaagaaagaaacaaggtgctactgaaggtgagtcctccagtgttggaggtcagggtgaaatatctgcagaagaagctgctgagcaagcagctgtcatgagatcacaaattcacctcttctggggtaatatgcttttcgaaagatcccaagttgaatgcaaattgggaatgactggatggaaggaaaacctggatgctgcaactgaacgctttaagcttgcaggagcttctgaggcagatgtttcgatggttctaaagaatcattgctcaaatggagatgcaaaagatggagatgataaaaaggttgagaacccacagcacaataaga

SEQ ID NO: 1880 - DNA, 951 bp, Glycine max
  misc_feature (58)..(59): n is a, c, g, or t
tggggcagcccagtgaggtgtgtatcctaaaacagtttataggctcattatggccacnntttctaatatcactagaaaactgttttttttcctcccttattttctaccatttttgaggtgggtagggagttggagcaaagaaagcttgtccttttttgtgcatcaaaataacagctaaatttcagctaaggtcttgttaagtgctacatgatagcaaagcaaaataagtctttcatatgtttggctagattatttgcttgcttatatgaaaggaaaaaaacaaatatttagtggacagagcatttaattaagttgacacttgcaggatctaacgtccaggccaaattaccttgtaaccttcactgttggctatgatcagaaaaataatattgatgcagctgtgaaaaaggtcttaatcagttcattcctctctctgtttgcatatgcttgtttatgtgtcttttaactgaaaatttgcttgaacagttttcagggaacttcactatcctgctatttcattatgatggccgaactactgaatgggatgagtttgaatggtcaaagcaggctattcatgtcagtgttcacaaacagaccaaatggttaggagctaagcggttaattattttttagataataaattatcgttgtagtttttgcaagtattagtgttcaatgcttacctaatttcaattatgttattatattgacaattttggtttttccctcttaggtggtatgccaagcggtttctgcatcctgacattgtggcaccatatgactatatattcatatgggatgaagacctgggtgttgagcattttaatgcggaagagtgagtattggatatgagagggatatttttttaaaagattttatttatttttaatcaaattaaaatatgcctctcttatttcaagtgcaggtacataaaactggtgaggaagcatg

SEQ ID NO: 1881 - DNA, 922 bp, Glycine max
  misc_feature (39)..(39): n is a, c, g, or t
  misc_feature (853)..(853): n is a, c, g, or t
  misc_feature (909)..(911): n is a, c, g, or t
ttctagatcacccagtaacaattctagcaaagcatggcnatgatgcttctttggattcaggctctgaccaagtgggttcatgcacaacaaaggatatgcttggcgccctttacttacagtactctgagaactctccaccttaccagcgggttccattttctgagaaggtatagcctctaacttcttatcagcaaatgtttttatgttcactctcacacacacgctgcatgcatgtctgttgaataatattgatgtttcttgtttcagataaccgagttagctaaaagccatccaggattgatgaggttgaagagtgtggatatttcccccacaagttggatggctgtttcatggtgagtagaattagttttgttgtactgaaaatttgttgttcttgaagatgaacactagctagaacttggaagtaagtgcacctggtgataattaattggccttgctctttaactttagtaattcgtagataattaaaataaaactgtgaagaaaagccttaaatttttcagttagctttatatttgctggattatttttgttgcaattttgttgttattcaaatataacttgtagttgataaaaaggtcactgtctctgagttgtcacagatgctattttatttttagtttacttcgagttgaaattaattgatttgcggagacaaggttgaatttattgtattatttcctagtgatatataaatgatagtatatattatttcttgcccaacttttggttctgtgtgtttttcataatcacgtgtatatttaaaaagcttttaatcaatttgtttttccttatattgtgaagttttacatatacttcctacttagatctnctagtttctgtgatacaaagatctcacattgactcgttatgaataggtatcccatnnnattctgtacgg

SEQ ID NO: 1882 - DNA, 375 bp, Glycine max
tgaagtggttactgcaaaatcaaaacaaaaggatcatgcttgaacttctgaaaaaaaaagagaggagtttttcctaaaaaatccttgaaggaggagctgtcagtgcttgtatattttgcctccatgtagatgtgtgatcatgttgggaaattgtaatcaaaattccataatcctgctcactgatactttcaccatctttttgggttctgattgctgcaattccttctcacaatgcccgttggttatatgattcccttccctccctccccccaaaattgtgtaagcgcttcaaggaaattgtattttgattatcagcttagaaatcatcaggtgattgggtatgccttttaaatctaaacccaactgctatggctc

SEQ ID NO: 1883 - DNA, 521 bp, Glycine max
  misc_feature (480)..(480): n is a, c, g, or t
  misc_feature (494)..(497): n is a, c, g, or t
tgccgggctattgagaaggtcttggagtgtattaaaatgtcatgcccaaatgcaaactatggctgcaaagagacatttagttacagcaggaaaaacaaccatgagaaggaatgcatctatctaccatgttcatgccctcttactggttgtgattttgttgcctcatccaaggagttattcctccacttcagccatagacatgtaggcttgggaacacggttcgcatatgataaatttttcactgtattcttaagtattaaccagagaacaattgttcttcaagagaaaaatgatggtaatctgtttattgttcacaataaccatgagcatctggggaacatagtccgcattagctgcattggccccaagtccatggcagagtttcagtatgaagtcttggctaggcatcaaaaaaatgatactcggccatggacttgggaccaatgcagctaatgcggactatgttccccagatgctccnggttattgtgaacnnnnagcagatgaccatcatttttctct

SEQ ID NO: 1884 - DNA, 407 bp, Glycine max
atcagaagaatgggatgtgttttcaggctgcggtgaatgatgggtttaggaacgcttcggtgaagcgtattggaattagcagggttgattcgtaaatattatcatcgaagaatggaacaacacaagtagagatgaggaaaaaaactaagaacctgtttttttccctgtttttttttaatcaatgttcttaggcaataattttggttgatgtacagcgagacagaactctcgatccctaaagaggctgaatggaaattggaacgaaagagggagatagatgttacccattagataaaatctgaaatctctgttgtaactttttttatcctctctattggtcctgttctcttttgaaaacaaaaagaaaaaataatcttggaataaacaaattcctccaaatctccttg

SEQ ID NO: 1885 - DNA, 473 bp, Glycine max
  misc_feature (61)..(61): n is a, c, g, or t
ctttcttcgtccacccgcccgaaaccctagcggacctcaagcggggtgccgaacccggatntgtgcaggagatccccacggtggacctcgccggcgtggaggacttccgcgccggcgtggtggagaaggtccggctggcggcgagcaccgtggggttcttccaggtggtcaaccacggcatcccggaggaactcctccggcggacactggcggcggtgaaggcattccacgagcagcccgcggaggagagggcgcgggtgtaccgtagggatatagggaagggcgtgtcgtatatttctaacgtggacctcttccaatcaaaagccgccagctggcgcgacacaatccaggtaaacaacacaatgaacgtcgagctctcttcctatcatttaatttcataacttaatttttttcagattaggatggggccaaccgtagtggattccagcgagattccagaagtgtgtaggaaa

SEQ ID NO: 1886 - DNA, 329 bp, Glycine max
tgtggaaacgtgagtgccagcatcaatttctcatccattcatcagccaattgcttctatcccttgtggaattccctttgattcaacaacagcatattatcatcacaaccttttccaacattttcaccctaccaacgctggcacagcagcgtctgctgttacttctgccaatgcaaatgcactaactgcactgccaccaacagcagcagctgagttctttatttggcctcatcagtcttattgatctaatcaaaactagaaatcatcttttgttaatttcctggttatgctaacaaatcaaaagctatagtctctggcacagtttagctg

SEQ ID NO: 1887 - DNA, 346 bp, Glycine max
  misc_feature (61)..(66): n is a, c, g, or t
gggtttctactacacgcggattgcgtattatgcttacaaaggatacaaagggttctctccnnnnnnacataccacccgtgtagctctactagctagccatgtctcatactttaggttcacatagcttcctcttgtacagatcttccatggttgtactctatgttctttctttctggtgttgtgttttttgttttgtctgactaatgatgagtgtttagattgtaatttgtgattgctatatatcatatactggcactttctatggttgcaatttttattttttttatgttgtggcaattatcctgctgatatccattttttttttttgccccccattgaaaaaggg

SEQ ID NO: 1888 - DNA, 394 bp, Glycine max
tagctatggaatgacaagcgcgagagagaaatgtatgacaactttggggagctttatgccattatcaaagccgctgagaggcttgagaaggcctatgttagagatataatctcaccccaggaatatgagttagagtgccagaagctcatagctcatttcaaaaccttagcttccacccttaaagacactgtgcctagcattgagcgatttgcagatacttacaagatggagtgcccagcggcgattaaccgtcttgtggtttccggtgttcctgctacggtggagcatcgtgcgactgtggctgcctctgcttccacctcggctgctattgtggccgagtgcgtgcagaattttattacttctatggattccttgaaacttaacatggtggctg

SEQ ID NO: 1889 - DNA, 533 bp, Glycine max
  misc_feature (402)..(403): n is a, c, g, or t
  misc_feature (416)..(429): n is a, c, g, or t
  misc_feature (433)..(433): n is a, c, g, or t
  misc_feature (437)..(444): n is a, c, g, or t
  misc_feature (488)..(489): n is a, c, g, or t
  misc_feature (494)..(502): n is a, c, g, or t
  misc_feature (504)..(504): n is a, c, g, or t
  misc_feature (515)..(517): n is a, c, g, or t
atcactcagtcatcggcctattgagatgtggcaaaagatggtggaggaattgtcacaaggtcattctatacttgattctaatattgaattacttacatgcttccaaaagctcttgcatgttttggaagataatcccaacaacaaggagtgcttcatggacttggggttatttcctgaagaccaaagaattcctcttcctgttcttattgatatatgggcagtgttatatggatttgatgatgacggcatagaagcaatggacatcataaataaattagactccatgaatctggttaatgtcttagtagcaaggtacaatgactagttattttttcttcccagccacttaatatatatatatatatatatatataacgagaaattgtaaattattccccaaannaaattattcaatnnnnnnnnnnnnnngtgngagnnnnnnnnatatctttataaaatcaaccaaaatgacaattttggagtgaatnnaaagnnnnnnnnncntacaatatgcnnntctatacttattttta

SEQ ID NO: 1890 - DNA, 646 bp, Glycine max
  misc_feature (8)..(9): n is a, c, g, or t
ccattgcnnttggtgtggcagaaggtttggctttccttcatcatgtggcaatcattcatcttgatatctcttctggcaatgttctcttggatgcaaattccaagccgttggttgcggagattgagatttcaaaacttcttgatccaaccaaaggcactgcaagtattagtgcagttgctggttcctttggttacataccaccaggtatactactttctggcatgcaattcctccatctattcttcctattaacttttatagtaaatagtctttacactatcatctaataatcacaaatcgtcatgtatggttagtttgttgattttacaatattacgttaaaaaaccataatgatgatttttaattgattgagagtgtaaaaaaaattatactgacattgcataaaaattaaactcttaacttttattatgtttagcatgcttcatgttacatttcttctgtaatgcagaatatgcatatactatgcaagtcacagcaccaggaaatgtttatagctatggtgttgttctgctggaaatccttacaactagactaccagttgatgaggattttggtgaaggtgtagatttggtgaaatgggttcatagtgctccagtaagaggggatactcccgagcagatattgg

SEQ ID NO: 1891 - DNA, 688 bp, Glycine max
  misc_feature (267)..(267): n is a, c, g, or t
gaactaaggtccttcacatcagcagttttaacagtctgagataacaaagtggcatactgatcaaagctatccttcatgccttgccgagccccattttctatcattcctttcatcatggtgctttgtaaaaaattcattcgccacgatacaaccagacgcgaacactgttctcctgtcggaaactctggtccaggtgtaatcacatacagtacttctaccctaaaggtgctcccatacataacatctggagtgctgacactgactagnacagcaaagttcttcacatcagcttttaaatagtctgagataacaaagtggcatacagatcagcaggtttactaggagccttgacgtaagtaactaatcttttgaagattttcccatcattctcaaacttccaaggtcctatttcgagtactgtacgcgaacactgttctcctgtcggaaactctggtccaggtgtaatcacatacagtacttctaccctaaaggtgctcccatacataacatctggagtgctgacactgactagaacagcaaagttcttcccatcagcttttaaatatgtgtgttcctcataggctttgacagccttaattaatttactaggagccttgaggtaagtaactaatcttttgaagatctccccatcattctcaaacttccaaggtcctatttcgagttatgt

SEQ ID NO: 1892 - DNA, 894 bp, Glycine max
catcatattcatctgcaatatggtacaatgtagtttcatatgttatttgaagtactaacagaaggtgaatagaacctgattttagcacaagttgttcctcacaatagttgcttgtgtagatgacatgtattcaaatttaattaatagttgctcgtgtctttcctcagtttatttagtattgaatgtcatacaatgtaagtgcaatcataccagtattaatgcatcagatcccaacaaaactctacagttaagtgtgcttggacgaaagtagtactaggatggatgatctcctgggaaagcctcatcttgcacctctttaaaaaaaatgtcatcatacattgtaattcaaaccaagaatgagtctccagcctgcacatctggaatgaaagatttattgttgtagcttatgttctatacttaaaacttggagcaggactacctattttcacagtaaaaaataatggtgcatggatttttggcaaatgaaatgttttgttatgtgacatacacaggacgaaagcttataggggggagcaactttggagggctgaaagaaactcaggaaatgcttgatttctgcggaaagcacaacataactgcagatattgagctgattaagatggatcagatcaacacagccatggaaaggcttagcagagctgatgtgaaatatcgctttgtgattgatgtggcgagctctttctcaagtttttagaatccactgtgattctccaactctttgcatcatgtgtcagtatttttgaagtagttaagattggtggtattaactagtctataagatgttgaactttaaagatgagagcatccgctcttcaattaataatactttgggttttgaatttacattatgttccttcatcttcatgaagtcgt

SEQ ID NO: 1893 - DNA, 447 bp, Glycine max
ttacctcacattcagaaagagcaaagtgaagtaaaaaagaaatcaagctcaagggcctcttttacttacttaaattctgataatagtgattctgaagaagaacttactaaacaaaattcacctagtcttgcccgtcctgttagtggaatatctcgaaggacatcagcttcttctaaagctgctacaggtttaagctcaagagatgctcctttatccaaggcttctgtgactcctgctacaacactcggatggaaatcttcaaggacttcttatgagagtaataatcaaaatgcttcaaccataatgaagagctctgaaaataggacaggacctaagtctggatcagccaaaaacaaagcatcagagccaatttcagaacctaatagatccttggatggggaaatttcgaaatcatctgcaagggtgcaacctttcagttctcctaaa

SEQ ID NO: 1894 - DNA, 383 bp, Glycine max
gatgaggatagacctgaggaaagccaatacttggcagcatggttctggcatataaaatcagataagaagaaactaatggctgctatcgatcctgcccttgatgtaaaagaagaaacatttgagagcgtctccatcattgctgagctagcagggcactgcactgcaagagaaccaagccaacggccagatatgggtcatgccgtgaatgtgttggcaccgcttgtcgaaaaatggaaaccctttgatgatgacaccgaggagtattccggcattgattatagccttccccttaaccagatggtgaagggatggcaagaggcagaaggaaaggacttaagttatatggaccttgaagacagtaagagtagtatccctgcaaggcc

SEQ ID NO: 1895 - DNA, 623 bp, Glycine max
aatagtcttaataatatgaatgtgttagccattactgattattactactgaaagtaagaataattattagtaaatcatatggacacccaaattaggatccgctagcattatggcacatgtgacaatgactgtatcataaataggatccattattaaggttgaagacatatttaagtatgaaagaagttctactttccaacttagtttgagtaagattgtttatgtgtatcaattggctttggcagatcattttggtcaggagcagcttcaaatgctgtggtggttgaggcagatgctttcaaggagagtgacgtcatatatagagcccttagctccagaggtcaccatgatgacatgctccaaactgctgaattggtatgcttctgtgtgaaccatgacctccatgttattattatcatatcttcccactaaactgaccactattgtatgtgcagcatgtgactaatgttatagaaatccaaaataaattttaagaaattgtcattcacgtaaaggtccttttgcaatttagctatgatgaaatggatgacatatattagatccttaattgtaacctatttttaactgatgattgcatctaatttatcaaaatctgaacaggt

SEQ ID NO: 1896 - DNA, 976 bp, Glycine max
  misc_feature (48)..(49): n is a, c, g, or t
attgagaatgtttaatgttgttgcttaacttgaaaagttactgtggcnnttactaaacttgttcttgatacaacagaaactgaggcatggttcattgattcttttgaggaatggagaaaggccaaaaacctgagcaattttatactacttggacattcttttggtggttatgttgcttccaagtacgcacttaaggtgaatttctttctacattgtgttaaaatgacttgtttggttttcttcttttttagattgttgttctgatgtatatcttaaaacatatatatagcaccctgagcatgtcaatcacttgattctggtgggacctgctggattttcatcagaatcagaaagaattacaaagttcttatcaacatggaaaggatcaatcctgaaccaaatatgggaatctaattttacacctcagaaaatcatcaggtagaattacagtatccctattttttccatcctcttttatgtatactctatcatttttcttaagctagagctatgaaggaaacatcattcagaaaatgaaaaatatctagacagtaggacataaaagccacttctttattatttcagttcttttgcctgctttggtgtacatagggttgggtttaaaattgtttttttattactgtgtctgattatttaatcactagatgcatgaacacccaaatcttaaaaatgttttcaaataatttaagttttcattgagattatatttcatatctgatgatagtatgcacaatacattttatttacattttcaggttaatacttcttattctttgtctttgtcatcttttctaatggcattgttactgaagtagactactatattgacttaaattcatattctctttattgagtgatggggggggtaactgtctaatatttttcctcatattttatggccagaggtttaggtccttggggtcctgatatggtcctcaagtataccaggccaggt

SEQ ID NO: 1897 - DNA, 856 bp, Glycine max
  misc_feature (850)..(851): n is a, c, g, or t
gtatgtaatgtattagaacatccccttgttaatttttcattttctaaaacccacacgaatgtccattctaacttcaacacttaatcatgttttttttgggggggttaagaagtgaattgggagacatggaagaaaatgaatggcagatggtgcaaacgaaaggaaaccaatttgtggtgaacgaccaacctttctatgtcaatggattcaacacatactggttgatggtatttgctgctgatgagtccacacgagggaaggtcactgaggtgttcaaacatgcatcctctgtgggtatgtcagtttgtaggacttgggccttcaatgatggccaatggcgtgctcttcagaaatctccttcagtttatgatgaagacgtattcaaggtcagtgctgctaaatttcctacttgttattttcagtactttttatatactacctctgttcctatttataagacatagtcaacaaattttttcattcctttttataagacttcatttcatctctggtacattaattaatttttgactaaaataccttgaattatctattttgttctcctatgaagattggagaagatgaatagtttccaataaagtgaagataaatttggaaaaatattataaatttaatgataataaccaaattaattaactttctttatatgcgtgaattaatcagggacagagggaatactcctaaaaacaggattatgattttgacttctatagtatatatgatgaaatcgttcttcaccattgtattgtggttattgatgtttgaatgatgatactggcgaatttctagttatctgtgcagctaaataccaatgctgatgtaatttcannttatt

SEQ ID NO: 1898 - DNA, 386 bp, Glycine max
cacaaggggaaaaaaatggtttgaaactgtacacatttaaaaaaaaatgaaaaaagggtgaaaaggtgtcaagactcgactattatagggaaaggaacagcctctgatgaatacaacagtttccggaagctcttgtagagatgatgaagccttgagttgaaaaaagaaaaattccttatcgaaggatttaagaagcatcactgagtgagagaaaaagaaaataaaaattgttcactctgtacttaatctatgtgttgtggtgagaatggtagttgtttggctcctctctccaatgcatctctccacattctgtatctcaccccaagcttgtcgtaggctactgggaaattccatacgtttgcaccattgttcattctctcttgcta

SEQ ID NO: 1899 - DNA, 665 bp, Glycine max
tatgaggaattttagggacactttcgggtctttgcttggtgttatcatcacagtaaggttctatgatgatttttggatgttataatacaattaggatttgaattcccagctattactattagatgtttgttgtaatttgtgtaacactgttttgttttgcagggtgtacagattggcatgggtcctggtggtgaactaagatatccttcattctcttcacaggagccaaatttggcttggcctcatgaacttggagagtttcagtgctatgataaggtaggctgaagattcagatttaggcatgactttgtagtttgtggagttttagacttgttgctttgtgtaggttgtgggagactggcgattacccatttgcatactctatgatgttcagtgaatagtatcgtatttaactttgttttttcttgtttgccatctgccagtatatgcttgcttctctgaatgcctctgcaagaaatattggaaagcgtgaatggggaaatggtggtccatttggtagtggaagtttgatgcaaaatccggagcatactgattttttcaaaaatgacggtggctcttgggacacaccatatggtaaatttttccttgaatggtactcagatatgttgctgctgcatggggagaggatttgtagggaagctgaa

SEQ ID NO: 1900 - DNA, 1219 bp, Glycine max
  misc_feature (58)..(63): n is a, c, g, or t
  misc_feature (1163)..(1165): n is a, c, g, or t
tctagtgatgatggagatctgtcaattctcagggttacttgatttttgagtatcttgnnnnnngaccctccttacagccgtgagcctttggctgataaggtgtgctaacttactctatcctacggaattttggtcatttgttattcctgttccttctttgttgggctgtttgattatattttcttttatgtggttgatagataatggatcttgcttttcaattccctgaactagtgacccttagaagttgtgatatactaccatcaagttggatatctgtagcctggtattcttctttacttatgtgctttcatattcagcttacagatacacacaagggactgatctgttcttatgttttgcttgtaggtatccaatttacaggataccaactggtccaacattaaaagatctcgatgcttgttttctgacataccattctctttatatgcccatgggaggtaagatggatttttcatttacgatttagtgggttttgctatataacgaagtttgggaaagataagaaaacactgtattacattaagtaagttttcttacatgaataaatttcatatttttgtggttgttgtgttaggacttgggatgttggtattaaatcagcaatcttttgttaccatatgtacaacaactaagcccttttccactaggaagtgtagggattggctacatgcaatgtatgagtatatgacaccataaatttctatcttgtgtatgttacatatatatgtaccattaatatggaatagagctgtgtatatgcatccatccgtaacataataagtggttctaagataaaatgctatcttaggacctttccttagactatgatacatgtatgtaatggataagatgcatatttgggtttcacaatcttccttggtttacgattatatgaatatggctaatgtcttggcacctgctaattgtgatttttcttccattgttttctttttacttgatatgtatgattagttggggttcttcatcattttactacaattacaaatattgtgtttttttttaatcatggcaacatgtttctttttgaagtgcatattgccaattataggcgcatactgcatagtaatgaaattgtgagatgccactggtgataaccatgatccattacatattttgcnnncagttgatttattgagacaagcattatttttttcaggttcacaaagagtacagg

SEQ ID NO: 1901 - DNA, 905 bp, Glycine max
  misc_feature (901)..(901): n is a, c, g, or t
atcttcaacccaggtttgtttttaacttcccattacaatggatttgatttaatctaagcatggaattaaatttctagttttatcctccaggtagctaaaagaagaaagggtttgttgaactacatgctttttctaagactgactccgaccctgcccaacacatttattaattttgcttctccaattgtggatgtgccttatcatattttcttcttggcaactgttattgggctgatacctgctgcctatgtcacagtcaaggtatgtagctatggaaaaaacaaatcttatttagaaattatatttgtaaaacaaattttacaataatgggagaaaaagagagaggagagagaaaagtgtaaaatttaattactaattaatgatgtgatagtgatagagagagatagaaaaaaaaatgatatacagattgttgtacaaatagctaactcgtttttattattttttttgcacttcagtttttgcaaattgagttgttgtgctaacagcagattaatgctctcaattggaaactgaaatgaagttcacactctagtttctgctatagctttctgtaaatactccgcatgttggataatttcctctgccttttcccttttgaaaagggtcctattatcctaatgaatcatacacatttttatttcaactgttactgtgattgtatttgagtttctggctggttttgttatgcaggctgggttggctcttggagagttacaatccgtgggtgatctctatgatttcaactcaattgctactttgtttctcattggtgtagtttcagtcacacccacactaatgagcaagaacgaatcatagcatttcagaagccaagaatctttgtgaatgaaggaagcccttgttctcctgacaactaatatcngctc

SEQ ID NO: 1902 - DNA, 380 bp, Glycine max
attcgccagttgagcttgaagtgggacaatcgttgcgatttgctgcatcaacaagagcgtacatattaagaaagaatgatgcagctcttttccctcggcctccaccacctacagagattaatttcccaccgcctcctgacccatctgatgaagaagctgttgtagcttataatacgctactgaatcgttatggcatcaacaaagctgatctggtgtccaaatctggtgagtctggtagttcggtaagtggcaaaaataaagattaccaatctgaaagaccatctaagagaattaggaaaacaagagttgccttcagggatcaagttgggggagagttagttgaggttgttggaatttcagatggtgcagatgtagaaaca

SEQ ID NO: 1903 - DNA, 328 bp, Glycine max
gcttacttgccttcttctgttgattggtttttcaataatggagccttgttgtaccgaaagggcgtgtccacgggagaggccattgatgcagctggctcaaatttgccaggtgggggaagaaatgatggggagttttggatagatttgccaagtgatgataaaagggattttgtcaaacatggggacttgaagagtgctaagctttatgttcatgtgaaggctgctcttggtggaacttttactgatgttgctatgtgggtgttttgccctttcaatggaccctccactctgaaaattggaattacaagtagggcttttagtaaggttg

SEQ ID NO: 1904 - DNA, 387 bp, Glycine max
gggccccacaggcggcgattctgagtcatgactcggtgggtgggttcgtgactcactgcgggtggaactcggtgttggaagcgatttgtgaaggggttccaatggtggcgtggcctttgtacgcggagcagaagctgaatagggtgattttggtggaggaaatgaaggtggggttggcggtggagcagaacaataacgggttagtgagttccaccgagttgggtgaccgagtcaaggagctcatgaactcggataggggaaaagagattagacagaggattttcaaaatgaaaaacagtgccaccgaagcaatgactgaaggtggatcctcagtagttgcattgaataggttggtagaaatatggagggagcattaatggtatagaa

SEQ ID NO: 1905 - DNA, 599 bp, Glycine max
  misc_feature (50)..(51): n is a, c, g, or t
tcatcagtaaactcctgcattcctccaactaagaattgccatactagagnncctgctccagacctgtttctctttgcagatttgtagcttatgtctaaaattgttttgtacattgtttttcgttcaggcatcgtaaaatttatgtctgacaatccatactccgagaacaagactggcttgttcaatatcttatcaccatcttcgatgtgggaaagcatccacttggagacaaacttcatgtagtcttcaaatacctgatgatgaaacctatgcaaaggtttttaattaaaaaaaaggagttaatttataaaggacatgataaaaaagaataagcaatatgaaattatcataagatttgggatgtgtgcttctgaataaaaatcaaatgtaatatcttaaaggtcttggatgcaaatttcaaacaaattaatgctgagatagttgattacttcaagacaaaaacatgagaaatttagagcacaaaagctcccattctgcaggttaagttatttggaacttccaaagttcagttcctttttttaagagtctaattacctgttaggtataacatcttgtatgtacattaagatggaaaaaaa

SEQ ID NO: 1906 - DNA, 376 bp, Glycine max
ggtacccgttgcgctgaggagcgcggcgaagccctcaaggctggtgtttgaatgcattgggaggtttttccttcaggggagcaaagcttacacgaagaactcgccgatggttcccgcaaggcaggtttcggtgctggttttggagcactacttgctctctggctgcgttgggaatgagaaggacgtggaggcttcattgaagagggaggcggattccgccgcggttgcgtggaggaagaggatgtttgttgaagggggtttgctgaaggcagctgaggttgatgccaggggtttgattctcttcgtcgccggcttcgggattcccagtgttttcaaggatgaggatatatacaacttggtttgtgtcagcaatgag

SEQ ID NO: 1907 - DNA, 848 bp, Glycine max
  misc_feature (49)..(52): n is a, c, g, or t
  misc_feature (711)..(711): n is a, c, g, or t
  misc_feature (747)..(751): n is a, c, g, or t
  misc_feature (757)..(758): n is a, c, g, or t
  misc_feature (773)..(778): n is a, c, g, or t
  misc_feature (793)..(794): n is a, c, g, or t
  misc_feature (800)..(804): n is a, c, g, or t
  misc_feature (806)..(821): n is a, c, g, or t
  misc_feature (826)..(827): n is a, c, g, or t
  misc_feature (832)..(840): n is a, c, g, or t
ggcatgctcaaatccctcaataatacgctcactgttcagtgctactttnnnngattttgttgaagatcgagctcgagaacttatgcatgatgctgttcgtgtaattgttggcagaaagtaagtttgttgcaaaacatttacaaacatggtgctcctaagcattttgttagttaatacagttttcttcacattatttagttgatgtctaattcttttatgtgcatcaggaatatggcttctgaaacaataaagcaaaaattggtttttactggaagtgaagaaggaaaacttctagcaattcgtcaaagctttgccgaggtaaattgctaataataatgcttctgataaataacaccagtctcagtccaattttctgtcagtatattgtttgaaaagaaattagaattgtcactgcaattaactattaatatgtatttcctattttgaagcctgatgtttgttttactgattatgtgctgcatatactatatataattaaacattctgcttattctgggtttggtgttagataatgtgtcatgtacatgatataaaaaatgacttggaatgcttattgctgtatcacttttggcttcactttggaacttgcggaaagcctataatgttgtattccctcctgagtcattcctattagtatttttaagtttgtttccttttttgacctttttatttactgcaacatcttgtagngtctaaatcctccggtattggttttcctccaaagcnnnnngcgtgnnaaggagctgtgcagnnnnnntgcatttgacagcannagagtnnnnntnnnnnnnnnnnnnnnntctcnngcagnnnnnnnnntcaatcca

SEQ ID NO: 1908 - DNA, 489 bp, Glycine max
actgcatctcttcctattatacctctttggtcttcttgttttagcatttgaatatggaagaaagcttctaggaagcttaaaaccagctcaagctggaggttccccctcatatattgaaagtcaataactccttttgttaataggtaggtaactatgattattttcttttctgcattataataattgatttgattactttccttataaagatttgttgaggctggaatccttaactcctactcatttcaggtgtgtattgtgtaatttgataaaccctcaaactcaatgataaagattacacgaaactgagtctcatgcatgcggcaatgttgacttcgttttctcagctggtaactggggtttctctcaagcagccagaaagcacgagagaatccttgatttgtgctacttgaggcttgcttgacactaaaatatccctttattgacaagatgaattccatgtgctccatggagccttcaaagcgggac

SEQ ID NO: 1909 - DNA, 387 bp, Glycine max
cccccttctctctctcggtcctaattcatcattgttccacaatttccacaatgtccagcagtggcagtcacggtacagaaggctcatcaagcaacattcccatagagtatcagcagcagcagcagagtccagtgacacttagccgctatgagtcacagaagagaagggactggaacacttttggacaatacttgaagaaccagagacccccggtacctctctctcagtgcaattgcaaccatgtgctcgatttcctccgttatctggaccagtttggcaagaccaaggtccaccttcaagggtgcatgttctatggccagcccgaaccccctgcgccctgcgcctgccctcttaggcaggcctgggggagtctcgacgccctcatag

SEQ ID NO: 1910 - DNA, 367 bp, Glycine max
tcgacatcagatttttgaagagggctaatcttatttaggtttgaaaattgaaaatattcttaggggtagtctcctgaaaggctaaagagagggatgaaggagggaatactacgtagcgttgaaatttttaaatgagatatggccaatcccattttctgttgggttttggtgttgagcaagttaatggtcatgaggaagttaagtttctaattcatgttatattgaaaacgttactttattcttagattagattgtaatattttttctaatcgctgcttttgttttgaggttctgtgtgagattgattctattctgcaactagtactatggcagagtttctccccaaccctccatcctttgtattata

SEQ ID NO: 1911 - DNA, 380 bp, Glycine max
tatgacactttatatagaagtccacgttatgtgattgcctttagaggaactctaaccaaatcacattcagtttctcgtgatattgagctggatatccactttatcaagcaagggcttcatcaaacttcccgctctgaaatagctattcaagctgttcgaaacacagtagcaactgtaggtgattcaaatgtttggttggctggacactctctaggatcagcgatggcaatgctcactgggaaaaccatggccaagaatggtatgtttattgaatcttttcttttcaacccaccatttgtatctgctccaattgaaagaattaaggatgagagggtgaaacatgggattcgatttgcgggcagcgttataacagctggact

SEQ ID NO: 1912 - DNA, 402 bp, Glycine max
tgttgccaccgaggatgcccagggttattccgagaaggaaggcctttctttcatcgagacttctgctctcgaagcaactaatgttgagaaggctttccagactattcttgcagagatataccgcattatcagtaagaaatcactctcttccaatgagcctgcatctgccaatattaaagaaggcatgactatcactgttgggggaccccaatccaacacaagcaagccttcttgctgtacatcatcttgaaaccccgccttatacttcctacttgctcagtatcattcttttttcttaacttatctggatttcttcttatgattggttgtgcctgctcattgcaaaccttatattattcatattgttgtctttttggtttggttcccttcgctatctactaa

SEQ ID NO: 1913 - DNA, 406 bp, Glycine max
gaagcctatgctaaaagccagaattcattctggcaagatacagcttggatcattgcttcaacaacttgattatatttttgtgactggagcactttttctgaaaaggaactcaacggcaaaattgtgggctttgatatatcttgtttgccttcatttctgggtgttttatattcttttatcacattctagcccatcaaatgagggtagatctggtgcccagatctcactggagaacattaataacactggtggagtatgattgtgttgcgatgtgtcttcacttatgtcattccccgcagtttttaggaggccctcaatacattggatatgttttgtgttacgccagagtatatcatatcatgcacctgcagtggacatgcaggaatgccagtaccagactatgacc

SEQ ID NO: 1914 - DNA, 634 bp, Glycine max
gagctatcaagatccaacgttaacatgaagaatgttttagtaaggtcagctgcgcgagctctgcttggcggcggtgggcggagctactaccgccagctctcaacggcggcgatcgtggaacagagacaccagcacggtggcggcgcgtttggaagcttccacttgcggaggatgtccactcttccagaggtaaaggatcagcactcagaggagaaaaagaacgaggtcaacgacaccagtaacgccgtcgttacgagttactggggaatcacaaggcccaaggttcgtagggaggacgggacagagtggccgtggaactgcttcatggtaagaatcctcgaaagaaacaactgtgtaatacgagagaaattattacatgatctcggatagtctttacttccagttaattcacacgcgacatataattgagttctagccaactcttttttgtaaactgaaaaactcaactttatgttatgtgaagattgactaggattatgatatgtttatatatatgtcgatgtcgatgatgcctgaagtctgaacattgtttccatgatgttgctcgcagccatgggatagttaccactctgatgtgtcaatagacgtgaccaagcatcatacaccaaagtca

SEQ ID NO: 1915 - DNA, 385 bp, Glycine max
caagcattattcatcgagatgtaaagacaacaaatatcctgttagatgagaactttgttgctaaagttgccgattttggcctctccaagactggtccttctcttgatcaaacccatgtgagcactgctgttaagggtagttttggttatcttgatcctgaatacttcagaaggcaacagcttactgagaaatcagatgtgtattcatttggggtggtgttaatggaagtgttatgcacaagaccagccttgaaccctgtccttccaagggagcaggttaacatagctgagtgggcaatgacctggcagaaaaagggtatgcttgatcaaatcatggatcaaaatcttgttggcaaggtgaatcctgcttcccttaagaagtaaaa

SEQ ID NO: 1916 - DNA, 527 bp, Glycine max
  misc_feature (521)..(523): n is a, c, g, or t
cacatcttctaattcaccaacacattcaaatggacctttgtttgaattatcaggcctcatgagccacctccctattaagtaagcaattaatcccccatgcctttctgaattttattcaatttcctttaaccaaacacatacatgtaccatcgatcgaggtgtagatcaggtggaacaagattgtttcctatgaaggaggatacttgttttctctatagaaaaaaaaaaaattacgcacaaatcatcatcatctattatcaatgttcagaattgttatatacttattataagatgttgtgttaagtaggttatatttgacctgtgcaggagagggttatctatgttctatcaagggaaggcccagtctttcacttctttagcaagggtggagagcatagaagatcttcccaagaaaggcacaccttatagtaagagaatgaaatcatgcaaaagttttgggggaggcttgaatagtcagagactattgtgcagtccaaagtctacaatatcaaagaaaactnnnagag

SEQ ID NO: 1917 - DNA, 525 bp, Glycine max
  misc_feature (360)..(365): n is a, c, g, or t
  misc_feature (475)..(481): n is a, c, g, or t
  misc_feature (486)..(522): n is a, c, g, or t
actgcgtataccaaaaggaggaccagagcgggaaaataggggtgtgtttggcgagggagttgatggcagtggcaggggaggcgttgaaaacaaacataacgaccttggggccgttggttctgccatattcggagcaggtgatgttcttggtgtcgctggtgaggaggaaggtgctgaagatgtcgggggtgaagccatacattccggatttcaagctggccttggagcatttttgcatacacgccggggggagagcggtgctggacgagctgcagaagaatcttgagctgagcgagtggcacatggagccctccaggatgaccctgcacagattcggtaacacttccagcagagctctcnnnnnngcgtgtatgcaaaaatgctccaaggccagcttgaaatccggaatgtatggcttcacccccgacatcttcagcaccttcctcctcaccagcgacaccaagaacatcacctnnnnnnnatatnnnnnnnnnnnnnnnnnnnnnnnnnnnnnnnnnnnnntcc

SEQ ID NO: 1918 - DNA, 844 bp, Glycine max
atgctgttgttttgaccaattatggccctgctttgtatgctggaggacttgattctcttgttgccttggcagtgttgatcttgtttcatagcttggtaagcttctagagtttctttttttatcttgaattttgtgactttttaggttttttgagtttttcttatttgtttttataggaaattcagtgtaagaaggaaatttgtttatcaatttgtttgactttagctttttaattaaaagtagctgcaaatagttgttagttaatagttcgggatcatgatcctttatttggttatgtgatgagaaagagtgtgttgttttaatgatgatactgacgagtgagttttctgagaagcagttgagcatgaagtttgaaatgtgtatgtggaaattcattttgacttgtgcctaatgctggatgctggaatgctgtttgaagttatatagttggtgtgatggattgatgaggtgtggttttttggtgtgtgaatggagtgatattgtaatttggaattttttctcttgatttcacagttggttatgctgttgtggagttacttttctgttgtttttaccgatccggggagtgtccctccaaactggaagcctacaattgatgaggaaaggggagaggctgatccgttggttgggacagagtttagtaatctgccgtctgatcccaatccacgggttcggtactgtcggaagtgcaatcagctcaagccgcctcgatgccatcattgttcagtttgtgagtgttgtcacacacagaagtttctattttgtgtattgccacgttgagatcaagtcatcgtaagtaaatttgatgttatttttggctatc

SEQ ID NO: 1919 - DNA, 801 bp, Glycine max
tatttgctttatagatcgcactcaaaagcttgtatttacattctctctctatcttttcactaagatgggtgtcaagactcaatttgctttcaagacattttttattaaatattgtcttattcttcattgagtgtcaggttgtgctaaagattggtgtctcatgtgtgagttagagcaacacataatgattttaagagaaaatggggctcctctatctcctagtcggatactttggcatatgcggagcattaactgccatatgggtgaaggaagtcaggaagatgcccatgaatttttaaggtctcctgagattattttgcctatgttttttgaattattaattaatacagaaactttgtttcctctcttacatagacacacaaatttcctttatatttagcttgttgtttctatactgaaatttacttgtgtttgtttaaaacctatgcttagtcattgttaaattaaatatgttgtttatataggcttctaattgcatcaatgcaatctatatgcttggagggacttggtggtgagaaaaaagttgatcctagaatacaagaaacaactttcatacaacatacttttggtggccgtcttcaatccaaggtgtggattctttgttttattccttttctcgtgtttttctttgttgcctctggctcagacaacagtgaccttaattttacatttgtttgatggcttagtggaatttaatgtctacaggttaagtgtttgaattgtaatcatgaatcagaaaggtatgagaacattatggacctgaccttggagatattgggt

SEQ ID NO: 1920 - DNA, 506 bp, Glycine max
attttgctgttgattaaaatcgtgcagggcaagaatatttgttagccttattaaccaaagtagtattcatgaaccaaaagggtcatgagaagaaaattgaaaaaccagatgatgagtcagagagctatggtcggagttggaggctaacggttgaagcaaacaatgcgcgtccatggaggattgttccagacaactgctacaaccaccttcagaactacatgtctggtggacaataccagcttgaccttaacctcgtcgtccaacatatcttgtcctatgcccatgagattcctcttgctgccgacggcatggatgcctggattttggatgttgatgacacttgcatctccaacattgattattacaaaggaaggcgattcgggtaaactaaatgtcattatgttcattcattgttttctatataatcaattaaatacatggcatacatatatatgatgatgatgtgcgcgcgcaggtgcgacccatttgactcagcgatattcaag

SEQ ID NO: 1921 - DNA, 1211 bp, Glycine max
gtatattttatattttacttattgttttcttaattgcatatgaaccctaaggaatctattgctctggtaccaacttactggaatgtcattgttctatcaatttgagagcctttaacaatttagttggtttctgggggtggtaattgcatccatttatccactaaccatccaatttgtacatgcataaattaaaccaatctgtccaatcgtaggaatagaacttaatggattggatcaacaattattattggatggttaataaactataagccatattttttagaccaatgtgtcaagatcatcaatgatggtcataaagacccgttgcaggtttttatgaaaacaatcctcataaggagagaaataattagatagagaagttttgttgataagtagaagagtataaaaagtgaatggatggattgattttagggagagaaccgattctgtttatcaccaatattctgcctttgacaagttctacattagaagtaactgaaatagaatatatttcattataaattcaaaatttactgcttcaattttttaatcaatgaaggatgccctattaataaattgatttcctttgataacatatgtacaccttacaaatagcccataacttctgagttctgacagagttctccttcctaggttcatgtactcatgctcgcataccttaataattacgccatacctctagaattgtatgttcaattgaattttattttaatgtacttagtaacatcatgtatcccttttaagtttcatgctttcggttatgtaaactttaccttcttgaacccatggaaaatcttcaagggaccaaaatgatgtttaacttgttcttgtcattagtcttttctaacttagtctctatttgcaggaggagagaagaagcccgaaggctccttaacgagtccttggcaacacttgatggccattagagcattctctatcttgtattcacagcaagaatctaccgaggaaattaattttatttgaaaagtgaattttgtcctctagattttagcaaatgaaaagattaaaacaagaagttgtgcgacttccttgaaaatggtcacttgacataactgtctcatgttcttgatgaaggctgttttgcagcatgtgcaaagatattagaaatagaagaattgtgttaagagtgttgctactgttcttagaaatatttttagtagtgtataaag

SEQ ID NO: 1922 - DNA, 741 bp, Glycine max
cacttctgaccctgcagctgcagcctctcttcatttggtgagttcccttcgtggcctgcccccattgcagcagaagatagagctgcaagtgcttccaagagccacagccaagcagagaaaaggcgcagggacaggattaatgcacagcttgcaactctcagaaaactcattcccatgtctgataaggtaataggaaaaataaaataaaaatcatgatgtgtttcttttaataagtagcatagttactcctatcaaatatactatttttaaaatcttgcatactgttttagacaagaagcaaaaaagtggaattggtgagttacctattctatgatgtatagggtatcattaaggtaaattaaattagattcgatgtaataatttgatatgatatgattgataaaaattggcgttactttagcatgcgatcaatgtgattagaggtttgatcctcatgtccacgcatatagaataacatttggtaggacttggagaaactaattccttaaatgcattttaatatttcgagggattaatttctgactctcaaccatagataccttgggttaaaaacagaaaataagatttgatccagtgtaaatttgtggcatttcaatgtttcttttttcatgatagatagcacagtccctttcaattccatgaatagctttactaggttgtatgataggccatatagatttcaattccactaacttgcccatctttagtaaaaaaaaaaaa

SEQ ID NO: 1923 - DNA, 919 bp, Glycine max
  misc_feature (51)..(53): n is a, c, g, or t
  misc_feature (867)..(870): n is a, c, g, or t
  misc_feature (908)..(908): n is a, c, g, or t
gaaagacttagcagcctcttgtcacagaagatagattttgttacaacaaannnttggtctccttgaatgatcaaggaaactaacgccttatattctaacactaaatatgcaggcactgagtgagaagggctatgagcttgtttctggtggaactgagaatcatctacttttggtgaatctgaagagcaaggtaaactacaacttttcattcaagcatcctcaaatatactatgttacgaaattataacattcagcgctaattgtttgtttgttattgtcacaaagctgaattgaagttactgataactaaccatggtcatgatttacttcaagagaaattgtaaatccttgtaaaagtaacaacacattatgttggattcataaaagatagctgtaattttcatctaacagtaatattaaagtgagactaacgttcttttataaaaaaacaaaatctctgtcagggtattgatggctccagagttcagaaggtgttggaatcagttcacattgcagctaacaaaaacacagttccaggagatgtgtcagctatggttcctggtggtatcagaatgggtatagggtcttcgttgttttatattttgattttggtgtcattattcatttacttgatcttaatagttctagtggatttcaggaactcctgctcttacttctaggggatttgctgaggaggattttgttatggtggcagagttttttgatgcagctgtaaatttagctgtgaagatcaagtcagagacaaaaggttcctaaatcttcaatatcctttgagtttgtgtgtgttttatctggacactgttggtttgagttgctgagggttgctaagtgcttgaataaactaannnntagttgctgattaatttattttaatcaggatcaaaatngaaggacttct

SEQ ID NO: 1924 - DNA, 707 bp, Glycine max
  misc_feature (520)..(522): n is a, c, g, or t
  misc_feature (571)..(571): n is a, c, g, or t
  misc_feature (594)..(596): n is a, c, g, or t
  misc_feature (618)..(619): n is a, c, g, or t
  misc_feature (622)..(623): n is a, c, g, or t
  misc_feature (637)..(637): n is a, c, g, or t
  misc_feature (639)..(643): n is a, c, g, or t
  misc_feature (657)..(663): n is a, c, g, or t
  misc_feature (671)..(672): n is a, c, g, or t
  misc_feature (675)..(676): n is a, c, g, or t
  misc_feature (687)..(689): n is a, c, g, or t
  misc_feature (694)..(695): n is a, c, g, or t
ccctcacgctcccatgtaactaactgctctccttccttatttttgttttatttttaattatcgcttctaattcactttaatctgtctgatttgatttgatgttagaagaaaagggtgagatgagatgggcattgggaatgaatgcatgaattgactcaattttcatctctccctctgttactgttagttagaatactgtagaaagagggacctagacttcattcacagtaacaatattattactttgacttgtgattctcacatggctctgtctcagaaagtttaattttgatgcgttatgcttgctatggctggctgtaatcatggcatggcatggcatatgctctataatattctgattctgaattgcctatactttattataagtaccttcgttgtggacttgatttcttttttcaaaatataagggattttgaattatgaaatcagttgcattgtagttctaaatcttgatatttgcatttgcaggattctttcattcgagctgcctggacccgannntctcgaggtgaagctgcaaagaaacctaacaggaaatcgtggaagcagnggacagacatgtacatgagaccnnncttattaaatgttttcttctcnnaannatttattcatgcanannnnntacaccgaggaacnnnnnnngtgatatnntgnngctaccacaannnccaannatcttccaaact

SEQ ID NO: 1925 - DNA, 120 bp, Glycine max
tcttgatttcacgctcagcctcgcgtcacctaacaattttggtatcttaaatcaatttacttcgactttcacaattttggtatacaattacatattgacatgtctgaattgttttttttt

SEQ ID NO: 1926 - DNA, 1197 bp, Glycine max
acctttctatttaaatttcagctggatgatgtaatcgatctggtgattccaagaggcagcaacaaacttgtttctcagatcaagagttccactaaaattcctgttttaggtcatgctggtaagactattatgcttaatggcacttttactttggactgtgtgattttggtccctcaagttttttcaagttgattaagtccctttatttttgaaattaagcaaatttggtcctgctgctaatttttttttacctaagaccatcaaattctcattttctacttaaaatcttctcaaattaaatcggttaaattgttttaaatcatcttctactcaaaactcattattcaaagcatcaaatttcatataaaatagaaaattctcaaaattttcagttccaaccataatcttatatcctataaaatccttcaaattatatcaattttttttatataaatttctgacttttaaacttttaaaactatcaacctcaaatccatcataaatccctaatatttggatataaaataataacttgaaggtttgagatgattttttttatgacaaggcaattttatttttgcttaatttcaaaatctggacataattggtttgaacaaagtttgacagatcaaaatcgaaaacgttccaaactaaatggaccaaaaatgcaattaaacctttaatataatatagaagccgcgcttgatattactgtatttctttttttttggattaataatctgcgctattactaatccagatggagtttgtcatgtctatgttgataagtctgctaatgtggagatggcaaggcggattgtacttgatgcaaaaatagattatccagcagcctgcaacgccatggtaaactaaatgtactcaatgaccctacaagattggtaaagccagcaatgtctgatgtacataacttctctgttttcaaattccaacattcaggaaacacttcttgtccacaaggatttgatagagaaaggttggttaaaggatattgttgttgacctacgaactgaaggtatgatttatagccatcatttcctcttattctgtattttttcaactacataggcattatcttttaaagttttttggaatgagtaaattatgcaggcgttaaattatatggaggatcaagggcaagttctctgttaaatattccacaagcacaaacatttcatc

SEQ ID NO: 1927 - DNA, 749 bp, Glycine max
ttctggcgatgcaggcgtgcaacctgttctgcctccctgagaactaccagatgaagtactacctctatcacatcctctcctggccccagctcctctacgtcgccgaagactacaacggccgcatcgtcggctacgtcctcgccaagatggaggaagaaaccaccgactgccacggccacatcacctccctcgccgtcctccgcacccaccgcaagctcggcctcgccaccaagctcatgaccgcagcccagaacgccatggaacaggcatgccattccccctatccccctttcttttcctttagtttccactctttctttttgtcctgcatcagagatcgtgggtgttctccaactcattgggtcccgctcccgctcgcgatgcatgactgctgctagtccaaggaaattttgcatgctgtgtgaatcgaatgggaatcgaattgaacacgttaaatagatcgttcccccattgaacttagtggagccttacactattgcatcaatcctcacttaatccaccctctttcggcatgtggttgccgctgtccaaggaaattttgtcatgtcaaccctcacttaattatgcttttagtacctcaagtatggattggattggaatgaaatatctcactcactgtgaccgcaggtgtttggtgccgagtacgtgtccctccacgtgcgcaagagcaaccgcgcggccttcaatttgtacacggagacccttggctacaagattcatgatgtgga

SEQ ID NO: 1928 - DNA, 384 bp, Glycine max
ggggtagtgggttggccatgcccgttgaggttattaagttctgttggaggttcaccgcggcgaggttgcagaagctttttgaggaggctgggtgcgttgccaggctcagaacttttggggagaaggagaaggaggagccttatgtgacggataatgggaactttattgtggatttgtatttcgagaggagtattggggatttgaaggctgctagtgatgctattttgcagcttgctggggttgtggagcatggcatgtttcttgatatggctaccactgttattgttgcaggggagctcgggttgacggtcaagaacaagtagttgttgttggtggttaggagaatgaaggtaggttaattggccaaggttgacaaactacccc

SEQ ID NO: 1929 - DNA, 382 bp, Glycine max
aaattctggttgatataagcagcctcaacgctcaacgaatgggcagagttaatatcatccttcgactcaggcaatggctcctgcgaggtttcatgaacagagagcaaatcgagctgcgacccatcgcgcttatcaaagaaaagcttgtttccgacacgctggacgacaatgtcccaggaataaacagaacgaggggcacacatgagagtggacagaatcgtgtcggtggcgaaaacggtggccttgtcctcgttggcgagtctgcgaatgatggggtcgtcggtggtggtgactttgaagaagtttcgattcttgaaacgttcgaggcggcgttcgtttttgggcgtgatgcgatcgtaagtgcggtcgtagtattccagaa

SEQ ID NO: 1930 - DNA, 361 bp, Glycine max
attagcatgaattaccatcttttcgcggcactgttctggattccatctggtgattgtgtgctcttcaatggtgtagtttgccaaacataatggagactcattgctgctaccatttctattgacatacaaaaccaataagatttttgcaacacctccaagaagtcgagttgtgcaatgaacatcagaccatactctcaaccttccatttagatctttatcttctccatctgataaaacaagcacaccatactcggaatggacccgagctggatggtgacaatagacaacgaaatctgcaccatactgagctcctgacctcactacccagtttttcattctcaggtgggaataagccttgtag

SEQ ID NO: 1931 - DNA, 389 bp, Glycine max
tgttgcattaacaaaggatgagcagatagctactgatgagccatcagcatctctcaatgactcaagcattgaaacctctgacagaaacaaggacaaaactgagccaactcaaggagttgaaactccaagcacacgtgcatctgccacttctgtggatgacccagtcaccgaggttggaggagaccgtaacaaggacacaactgacaacaaaaaagctgtggataggcctgtcactgcggtggaaggagacagtaacaaggacacaactaacaacaaaaaaacagtggatgagtcagtcactgtggttggaggagacagtaacaaggatacaactgacaataaaaaagctgtggatgggtcagccactgaggttggagggaacagaaaca

SEQ ID NO: 1932 - DNA, 953 bp, Glycine max
  misc_feature (537)..(539): n is a, c, g, or t
  misc_feature (562)..(569): n is a, c, g, or t
  misc_feature (591)..(593): n is a, c, g, or t
  misc_feature (595)..(595): n is a, c, g, or t
  misc_feature (602)..(602): n is a, c, g, or t
  misc_feature (604)..(607): n is a, c, g, or t
  misc_feature (609)..(609): n is a, c, g, or t
  misc_feature (619)..(621): n is a, c, g, or t
  misc_feature (625)..(625): n is a, c, g, or t
  misc_feature (627)..(627): n is a, c, g, or t
  misc_feature (631)..(639): n is a, c, g, or t
  misc_feature (646)..(646): n is a, c, g, or t
  misc_feature (648)..(655): n is a, c, g, or t
  misc_feature (658)..(664): n is a, c, g, or t
  misc_feature (666)..(671): n is a, c, g, or t
  misc_feature (677)..(680): n is a, c, g, or t
  misc_feature (682)..(688): n is a, c, g, or t
  misc_feature (690)..(701): n is a, c, g, or t
  misc_feature (703)..(705): n is a, c, g, or t
  misc_feature (709)..(710): n is a, c, g, or t
  misc_feature (718)..(738): n is a, c, g, or t
  misc_feature (740)..(749): n is a, c, g, or t
  misc_feature (759)..(759): n is a, c, g, or t
  misc_feature (763)..(765): n is a, c, g, or t
  misc_feature (769)..(771): n is a, c, g, or t
  misc_feature (777)..(777): n is a, c, g, or t
  misc_feature (788)..(789): n is a, c, g, or t
  misc_feature (795)..(796): n is a, c, g, or t
  misc_feature (798)..(798): n is a, c, g, or t
  misc_feature (800)..(804): n is a, c, g, or t
  misc_feature (809)..(811): n is a, c, g, or t
  misc_feature (816)..(817): n is a, c, g, or t
  misc_feature (822)..(822): n is a, c, g, or t
  misc_feature (825)..(827): n is a, c, g, or t
  misc_feature (829)..(833): n is a, c, g, or t
  misc_feature (837)..(845): n is a, c, g, or t
  misc_feature (853)..(862): n is a, c, g, or t
  misc_feature (866)..(867): n is a, c, g, or t
  misc_feature (870)..(876): n is a, c, g, or t
  misc_feature (882)..(886): n is a, c, g, or t
  misc_feature (890)..(895): n is a, c, g, or t
  misc_feature (902)..(902): n is a, c, g, or t
  misc_feature (905)..(911): n is a, c, g, or t
  misc_feature (914)..(927): n is a, c, g, or t
  misc_feature (934)..(938): n is a, c, g, or t
cgtgtgtgacagctgcaaaaagatcaagttgaccttcttcattatgatctttgcctctgttcactttgtactatctcacctgcccagctttaactccatttctggtttatctctggcagcagcagttatgtccttgaggtaaaagtcataatcttttttattatctaggtttaattgaatatttggtcctgatattattgtcatttggcaaatttggtttcttttcatttttcctcctgcatattggtcttctactgttttaattatgcaatcttgatcgatctatcgcgacactcactgtcacgtaagaacatccatatgggtgtgtgacactattacattgtgatattagtatttctattttgtcaaggtaacaaatgaactcaaattgcacgattaaaatagtgggagataaaatttaagataaaaaaaaaataggaaaaccaaatttattaattttctaaaattagggaattaaaaatgcaattaagtttattatctatatccattttttattatccttgtctgatgccaacnnncccaaagtttgctgattgaattnnnnnnnnaacggaagcatgctttgaaaannntnactttantnnnnangtttaattgnnntacngntctnnnnnnnnncctgggncnnnnnnnnccnnnnnnngnnnnnnaaaatnnnnannnnnnnannnnnnnnnnnnannnttcnngaaacatnnnnnnnnnnnnnnnnnnnnntnnnnnnnnnnttttttttcncctnnnctgnnnccatanggggggatggnnatccanncnannnnnccatnnnccccnnaaaanaannncnnnnngttnnnnnnnnngaaaggannnnnnnnnnacannatnnnnnnntcctcnnnnncccnnnnnncattccnccnnnnnnntcnnnnnnnnnnnnnnttttatnnnnnctccacccccccccc

SEQ ID NO: 1933 - DNA, 295 bp, Glycine max
cacgccgcaacgacccctcataagcacctacgtccaatcccgcgcctcctcagccactaatctcaaactcctccacctccctacagtggacccacccacacccgaccagtaccaatccttcatcgccttcgtctccctccacatccaaaatcacaaacaccaggtcaagaacgagctcctcaacctcaaaaaaaacgagtcaaactcgtttgactcggttcgactcgtcgctctcttcgtcgacatgttctccaccacgctcatcgacgtcgccgccgagctcgccgtcccgtgc

SEQ ID NO: 1934 - DNA, 368 bp, Glycine max
ctgctaaaagagttcgtccaaatacattgaaaagaagaaacagctgcattcattatgaagatactgaaactgcagaagtcatgtatatcctgggattaaaattgagtttgctattttctctttgcttgcgttggctcttgattttactagaaaggggatcttaaataggataccatccctgcattataccttgtaagcgttttgtttgaatccttacatgtattatcttatccctagcgtaatattgcatacctgcattaagattttcgggcgacctttaattacgtttcttttcgtgtgctcgtaatgtgaatattcctcaagtttgctttacgcatggttctgccaaacatcggtgtgattatatg

SEQ ID NO: 1935 - DNA, 433 bp, Glycine max
ctatgtagaaaataccagccccatgtcggtgagttttggtccaaaatatcacatatcaaagaagtcttcattgaagaaccagaaaagctggaggaagaagaagacgaataggaatgatttgttgagacatataagcgttgaagctcctttggcaacccctggacgtggatcaggaatggtcaaaggtgaaaaaaggggagaccatgatgtttgattattgtgttggacgtgattgacttattgaaaattgattttgggtgaagttaccctggagctgcttctgcgtcatgggagaatcaattctcagatttcaatgttgggtttttccattgtccatcaagttaatgcatgcgtgtgtttatttccactgcctattttacgttgtgcttattattttgttgttatttttatactcggatatttactgtgatct

SEQ ID NO: 1936 - DNA, 441 bp, Glycine max
  misc_feature (101)..(101): n is a, c, g, or t
caacacttctcattcaacagctcgctggtgggtctcaagctgggaagactgtggctgctagggagattcggttgctcgcaaaaactggaaaggaaaatcgngccttcattgcagaagctggggcgattccgtatcttcggaatttactttcatcacccaatgcggttgctcaggagaattctgtgactgcgctgctcaatttgtccatttttgacaagaacaaaagtaggattatggacgaggaagggtgtcttggatcaattgttgacgtgttgagatttggacacaccacagaggcaaaggaaaatgctgctgcaacgttgttcagtctatcggccgtccatgactataagaaaataattgcaggtgagataggagcggttgaggccctagcaggactgttgcaagaggggactccaagaggaaagaaggatgctgaga

SEQ ID NO: 1937 - DNA, 448 bp, Glycine max
tgctggctgtggagttgttcttaggattgaggagtccaagaaccacattcactgtgacagatgtgatcaggcgttccagcaggtagaattagaaaagcacatgaaagtttttcatgagccacttcactgcccttgtggaataatcctcgagaaagagcaaatggtgagtttcatgtctcctaccctttcttgctagttttgtgtgtgcgtgtgtttctttctgaataaattgttttaacttttttggtaggtggagcatcaagcttcagtttgtcccctgcgtcttattacttgccggttttgtggtgatatggttcaagctgggagttctgccatggatgtccgtgacagattaagaggattgtctgaacatgagagtatttgcggttctaggactgccccctgtgattcttgtgggcgttctgtgatgttgaaggacatggacatt

SEQ ID NO: 1938 - DNA, 414 bp, Glycine max
  misc_feature (389)..(390): n is a, c, g, or t
agaatatcttcataattttggttccaaataaagttgctgtgcagaaaactcaagaaccaccaaagaaaagagacaagtcagctgcagatgaagtctccgttagtgcccaagcataaccgcaaacttccacgctagtttctaattgtagaatggatattgtgagtaacttgtattggtccgagttggaaaattttccgagcattatataattgtataattcatgtgcaataatagcatataaattcacgagaattttaattatagaggcagccttggccttttcaacacaagtttctgaagggatacatcatatatcataaaagaacaatcgcacgtggataatttatgctcattttaatttttgacgttgacagcaatatttgcatacnnacgttgacagcaatatttgcatac

SEQ ID NO: 1939 - DNA, 861 bp, Glycine max
  misc_feature (810)..(816): n is a, c, g, or t
  misc_feature (821)..(825): n is a, c, g, or t
  misc_feature (836)..(840): n is a, c, g, or t
  misc_feature (842)..(842): n is a, c, g, or t
  misc_feature (844)..(844): n is a, c, g, or t
  misc_feature (854)..(855): n is a, c, g, or t
tttcatttacatcccggcctctcagatccttttgtatgtatgtacgtatttacttatatcttattcaatctgcatgacttttgttcatctgccttgaatctaattataacgtaaccacacgcagatcccagttatcacctcacagatgaagacacccaagcattgctttcgctgcacgacactttccagaagtgtgtggtgcggtttcactctgcttctatgcttttttattttgtttatttgccttctccttcaaactatgctataacagacagtgttgttgcgttgttataaatagggaattaggtagatatcgtacttagtactttgttgctttcaatgtgtttgttttctcatgatttcaacactttatacatctcttagatcttgtattctcagtatggatgattccattgagttgctaattttgtgttttgtgcagactgcaaatggacttggcctaaaagcaaccaggggcacagattattgccaaaccacaataagtttccccagtgacaccatccccaaatgggtaaatattcattgagctgtttgttgttcattgttcattaaggaagaattaagtgttgcatatgcggttttataaaatattttaattatgataacctacgagctgggggaaaatggcttcctcctatacttcatcgcatggcttaaaagtagttaaacaattagcccattttttaacatctggagttttctgtattaacagagagatcccaaaaccggtgaacttgaagccctgtcttttgattttaatctatgtgaagctgtggctacatgggaacnnnnnnncaacnnnnnctgtgtttttnnnnntntnattagtcagnngctatc

SEQ ID NO: 1940 - DNA, 399 bp, Glycine max
gtcccttcaatccccctctggtttccatcttgcaggatcatctgacatgcaaattaggagtccaaagaaaccaagaagttcggaaattcaaaactctccaagtagtatactctcagtggggatggaaatgaagcataataataatggtgatcatgcaaataatagagaagccaacaacacaaagtttggcaatgaaaggcaccaccagaaagatggataccctttgatgactagcaatgcaaaccatggtggagggtttggagcgttcaccatggaagacatgggaagcagatttaatgtcactactgagcaactggcttcaaggttccatggaaatggtgtttctctcacacttggacttccccacaatgagaacctttctatgccaggaactcaaca

SEQ ID NO: 1941 - DNA, 1407 bp, Glycine max
  misc_feature (471)..(471): n is a, c, g, or t
  misc_feature (475)..(478): n is a, c, g, or t
  misc_feature (481)..(490): n is a, c, g, or t
  misc_feature (495)..(495): n is a, c, g, or t
  misc_feature (497)..(502): n is a, c, g, or t
  misc_feature (504)..(504): n is a, c, g, or t
  misc_feature (506)..(510): n is a, c, g, or t
  misc_feature (513)..(514): n is a, c, g, or t
  misc_feature (517)..(521): n is a, c, g, or t
  misc_feature (526)..(540): n is a, c, g, or t
  misc_feature (545)..(551): n is a, c, g, or t
  misc_feature (559)..(569): n is a, c, g, or t
  misc_feature (571)..(571): n is a, c, g, or t
  misc_feature (579)..(583): n is a, c, g, or t
  misc_feature (585)..(588): n is a, c, g, or t
  misc_feature (590)..(592): n is a, c, g, or t
  misc_feature (594)..(605): n is a, c, g, or t
  misc_feature (611)..(617): n is a, c, g, or t
  misc_feature (623)..(627): n is a, c, g, or t
  misc_feature (636)..(640): n is a, c, g, or t
  misc_feature (649)..(657): n is a, c, g, or t
  misc_feature (659)..(662): n is a, c, g, or t
  misc_feature (664)..(667): n is a, c, g, or t
  misc_feature (670)..(672): n is a, c, g, or t
  misc_feature (676)..(681): n is a, c, g, or t
  misc_feature (684)..(692): n is a, c, g, or t
  misc_feature (695)..(701): n is a, c, g, or t
  misc_feature (703)..(711): n is a, c, g, or t
  misc_feature (713)..(713): n is a, c, g, or t
  misc_feature (722)..(727): n is a, c, g, or t
  misc_feature (729)..(733): n is a, c, g, or t
  misc_feature (735)..(737): n is a, c, g, or t
  misc_feature (740)..(742): n is a, c, g, or t
  misc_feature (760)..(766): n is a, c, g, or t
  misc_feature (768)..(770): n is a, c, g, or t
  misc_feature (772)..(779): n is a, c, g, or t
  misc_feature (781)..(793): n is a, c, g, or t
  misc_feature (797)..(806): n is a, c, g, or t
  misc_feature (809)..(815): n is a, c, g, or t
  misc_feature (818)..(823): n is a, c, g, or t
  misc_feature (826)..(826): n is a, c, g, or t
  misc_feature (837)..(848): n is a, c, g, or t
  misc_feature (851)..(852): n is a, c, g, or t
  misc_feature (857)..(863): n is a, c, g, or t
  misc_feature (870)..(875): n is a, c, g, or t
  misc_feature (877)..(884): n is a, c, g, or t
  misc_feature (886)..(888): n is a, c, g, or t
  misc_feature (892)..(894): n is a, c, g, or t
  misc_feature (897)..(898): n is a, c, g, or t
  misc_feature (903)..(903): n is a, c, g, or t
  misc_feature (905)..(908): n is a, c, g, or t
  misc_feature (910)..(916): n is a, c, g, or t
  misc_feature (919)..(930): n is a, c, g, or t
  misc_feature (933)..(937): n is a, c, g, or t
  misc_feature (943)..(946): n is a, c, g, or t
  misc_feature (949)..(957): n is a, c, g, or t
  misc_feature (959)..(959): n is a, c, g, or t
  misc_feature (961)..(967): n is a, c, g, or t
  misc_feature (970)..(980): n is a, c, g, or t
  misc_feature (983)..(994): n is a, c, g, or t
  misc_feature (996)..(999): n is a, c, g, or t
  misc_feature (1001)..(1005): n is a, c, g, or t
  misc_feature (1007)..(1010): n is a, c, g, or t
  misc_feature (1012)..(1035): n is a, c, g, or t
  misc_feature (1041)..(1043): n is a, c, g, or t
  misc_feature (1045)..(1045): n is a, c, g, or t
  misc_feature (1051)..(1060): n is a, c, g, or t
  misc_feature (1063)..(1072): n is a, c, g, or t
  misc_feature (1076)..(1077): n is a, c, g, or t
  misc_feature (1080)..(1091): n is a, c, g, or t
  misc_feature (1093)..(1097): n is a, c, g, or t
  misc_feature (1104)..(1110): n is a, c, g, or t
  misc_feature (1113)..(1123): n is a, c, g, or t
  misc_feature (1133)..(1134): n is a, c, g, or t
  misc_feature (1140)..(1146): n is a, c, g, or t
  misc_feature (1148)..(1150): n is a, c, g, or t
  misc_feature (1158)..(1158): n is a, c, g, or t
  misc_feature (1160)..(1161): n is a, c, g, or t
  misc_feature (1163)..(1163): n is a, c, g, or t
  misc_feature (1170)..(1176): n is a, c, g, or t
  misc_feature (1178)..(1191): n is a, c, g, or t
  misc_feature (1195)..(1209): n is a, c, g, or t
  misc_feature (1215)..(1236): n is a, c, g, or t
  misc_feature (1239)..(1248): n is a, c, g, or t
  misc_feature (1256)..(1259): n is a, c, g, or t
  misc_feature (1263)..(1275): n is a, c, g, or t
  misc_feature (1278)..(1291): n is a, c, g, or t
  misc_feature (1296)..(1301): n is a, c, g, or t
  misc_feature (1304)..(1311): n is a, c, g, or t
  misc_feature (1317)..(1322): n is a, c, g, or t
  misc_feature (1324)..(1325): n is a, c, g, or t
  misc_feature (1330)..(1339): n is a, c, g, or t
  misc_feature (1348)..(1353): n is a, c, g, or t
  misc_feature (1358)..(1358): n is a, c, g, or t
  misc_feature (1360)..(1361): n is a, c, g, or t
  misc_feature (1363)..(1368): n is a, c, g, or t
  misc_feature (1370)..(1379): n is a, c, g, or t
  misc_feature (1385)..(1397): n is a, c, g, or t
  misc_feature (1399)..(1404): n is a, c, g, or t
tcttcccttcttcttcttcttcttcttcttcttcctcttcttcttctcatagtcagggcttgctcatgatgtgctcggattcctcgctcggccaggtcctaactcactccgtcaaacccgatccgggcgtctggcccgaattcggttttctacccgccatttcgagaacttgtagcagagacggagacttggtttcgcccaaggaaaacatggccagtgggaaagaaaatgctaagaagagaaagcctcagaactccaaggtagtagtacttgttgatgctaacgtgtgctatgcattacggtaaagaaacgatgaggttttgttttgtttaggttgttgcggagattgataataacaaggacaaggacaagagagtcaaagtaactggcgaggaaggagaatccaaagtaaccgagcaccataccagaaacaagaatgccaaatccaacgcaaataagaacaacagaganaaannnnctnnnnnnnnnnactcntnnnnnncncnnnnnccnntannnnntcccnnnnnnnnnnnnnnnattannnnnnntttttacnnnnnnnnnnntnaatctctnnnnnannnncnnntnnnnnnnnnnnntcacannnnnnncccccnnnnnctaactccnnnnnccccctccnnnnnnnnnannnnannnnccnnncctnnnnnnatnnnnnnnnnccnnnnnnncnnnnnnnnntnattcagccnnnnnntnnnnntnnnttnnnttctcttccccctccacnnnnnnncnnntnnnnnnnntnnnnnnnnnnnnnatcnnnnnnnnnnacnnnnnnnatnnnnnnttncctctctatcnnnnnnnnnnnnttnnccccnnnnnnnccccccnnnnnntnnnnnnnnannntcannnctnnttctncnnnnannnnnnnccnnnnnnnnnnnnctnnnnnccccannnntcnnnnnnnnnanannnnnnnttnnnnnnnnnnnttnnnnnnnnnnnnannnnannnnncnnnntnnnnnnnnnnnnnnnnnnnnnnnntccttnnntngttctnnnnnnnnnngcnnnnnnnnnnctcnntannnnnnnnnnnncnnnnnattcttnnnnnnntcnnnnnnnnnnncccctaccanncttttnnnnnnntnnntttttatncnntncctctcnnnnnnncnnnnnnnnnnnnnnttgnnnnnnnnnnnnnnnacccannnnnnnnnnnnnnnnnnnnnnccnnnnnnnnnnacctctannnntccnnnnnnnnnnnnnccnnnnnnnnnnnnnntcttnnnnnnatnnnnnnnnttttannnnnnannaccannnnnnnnnnccccactcnnnnnntactncnncnnnnnncnnnnnnnnnnccccannnnnnnnnnnnnannnnnnccc

SEQ ID NO: 1942 - DNA, 717 bp, Glycine max
  misc_feature (662)..(662): n is a, c, g, or t
  misc_feature (680)..(681): n is a, c, g, or t
  misc_feature (693)..(693): n is a, c, g, or t
agatgatccagaactgcatgtcccaagacttttcatggaaggtaagcatgcaatttgctgctgtgtgaaacgtttgttttgctcacgactgacccatgagtaaaacaactaaagtttgagctttaggctaccaacaaaaagctattttgccttcagttttttagagtaaaaaaggatttttctttaggcctcactttctgttgggtcggtgctgattttgcttataactcactgcaacagaaaatgttatactttatacctctaaggcatgagccatggagggaaatgcagtttatctcatcattggggtgattctgatgcagggaccagccaaacattgggaaaaggtgctgttgagcctagaggttgctggcagtgaacctggaattgatggtgatgagattgctcctcttgcaaaggaaaacgttgccactccttgagcatcatcattgataacctggttttgaatatggtcaattggtcatcgtggtcaagaacacttgccagcatctgattgtagacacctacgcataattggattaataagttctaacgagggaatggaacttcaatttcaagcaaagtataaagctaattttcataagcaaggtcttgcaatccgtgaaatttgaagcaggaatggaattttaatttcaagcaangcataaagttaacaaacnnggaggtttttcntatgcaaggccttgcaatccggga

SEQ ID NO: 1943 - DNA, 480 bp, Glycine max
  misc_feature (470)..(472): n is a, c, g, or t
gctgaaaggaactttgtgggatatcagaaacttccagtgtcagaaaaccacttgcgcaaaacttatgcggccattaacgggtcatctgttaaaaagataaatggtgcttcgtctgaaagttttaaaaagataaatggtgctttgtgtggaagtgataagttgcctcctgcagagaacaaaaaagaaattgccacctcagtttctggttccatgctcacatcttccagtgaggtgagaagcaactggggtgtatttggaaaagtttgcaggcttgacagacctcggatggtggatgaagttcatctccgcagatttgatggacttctggtaaatgatctatactaattattatgagttgaccttggttcagacaatgagctgtttgttttgccatgcttactaataaaatgattttgatatgaaggaaaatggaggtgttcatcgctgtgttgttgcaagcataacagttnnnagctcctg

SEQ ID NO: 1944 - DNA, 364 bp, Glycine max
aatccttttgatgattggtcacacaacagggacaagggggctgatgaattcttttcggaagaagaaatccgcttcagaagtcatgagatgctagagaatgaagatatgcagcagttgcttcgcctcttcagcatgggaggtaatggctccatgagtgctgaggatggctattcattcccatcattcatgccatctcccagtataccaaactatgatgaggatcgctctcgcccaggcagagctgttgtgggatggctgaagatcaaggcagcaatgaggtggggcttctttatcaggaagatagcagctgagaggcgggcacagatagaggagttagatgaataggttgttcggacaatggtta

SEQ ID NO: 1945 - DNA, 516 bp, Glycine max
agagcagagtgcttattgttgggggaactggctacataggaaaaaggttggtgaaggcaagtttagctcaaggacatgaaacatttgttcttcacaggccagagattggtgttgatattgagaaagttcagcttctattgtcattcaaggagcaaggagctaggcttgtttcaggttcatttaacgaccataagagcctagtgaatgctgtgaaacttgttgatgttgtcatttgtgccatttctggtgttcacatccgcagccaccaaattctactccaacttaaacttgttgatgcaataaaagaagctggaaacatcaaggtaattcatttacatgtaataaagtctcatcatatcatatcatacaagatttttatgatcaaataatattggttaatttattacaagaaaagaaatttcatcaaataaaactatgcagagatttttgccctcggagtttggtactgatccggcaagaatggcgcatgcattggaacctggaagagtaacattt

SEQ ID NO: 1946 - DNA, 951 bp, Glycine max
  misc_feature (735)..(764): n is a, c, g, or t
  misc_feature (766)..(766): n is a, c, g, or t
  misc_feature (768)..(780): n is a, c, g, or t
  misc_feature (782)..(789): n is a, c, g, or t
  misc_feature (792)..(795): n is a, c, g, or t
  misc_feature (797)..(804): n is a, c, g, or t
  misc_feature (808)..(808): n is a, c, g, or t
  misc_feature (813)..(817): n is a, c, g, or t
  misc_feature (820)..(823): n is a, c, g, or t
  misc_feature (825)..(848): n is a, c, g, or t
  misc_feature (850)..(871): n is a, c, g, or t
  misc_feature (881)..(894): n is a, c, g, or t
  misc_feature (897)..(899): n is a, c, g, or t
  misc_feature (903)..(906): n is a, c, g, or t
  misc_feature (910)..(919): n is a, c, g, or t
  misc_feature (924)..(924): n is a, c, g, or t
  misc_feature (927)..(929): n is a, c, g, or t
  misc_feature (932)..(940): n is a, c, g, or t
  misc_feature (943)..(946): n is a, c, g, or t
agatagcttgcagctcatctaaggtatgctgctttttcatacttcttggttttccatttttgcactctactgctttatttataatattattgacataatctttccttttctatgttcatcttctcttcataatgatatagatatgccctctttttccataaaggttttaaattatatttggggttgcagtgtggtgctgcaattgtaagaccaatggtgtggatttgagaatgttaactgcctagggtggcattcaaagcaccacacactgacaaggctattgatcttctgttttatttctttaaaaccaatggttagaacaatgctttgtttttcttattcgtgaatttcatctgcagatttcttatgttcttgacacacaagattttttcttccgaccaagaaagaaaagacgaacgccttcagggaccacaacctctcggttccgcagggacagagaggaaagattccgcaaattgttggcatgctcgtaatttgtatcttcatgaagagttgttctctaacatcttctaaaacagctgaggagactcatacataattctatatgtttgagtcttggtgtagcaacctaggaaccctttgggtttacaattttatttgttgtcagtacttgaattttcacatgaaagtggaggaggggtatatagatgggagtgtgtaatatgtttatgaggtctcatgcgttgtgcccattcctttgtaaatagaaaaaannnnnnnnnnnnnnnnnnnnnnnnnnnnnncncnnnnnnnnnnnnncnnnnnnnnccnnnncnnnnnnnncccnccccnnnnnaannnnannnnnnnnnnnnnnnnnnnnnnnncnnnnnnnnnnnnnnnnnnnnnnaaaacccacnnnnnnnnnnnnnncannnacannnncccnnnnnnnnnnacacnccnnnacnnnnnnnnnacnnnnccacc

SEQ ID NO: 1947 - DNA, 379 bp, Glycine max
gcggagagcacggtggaggctgcaatgcgcctgggggagcagttggcacggaggaagtgggtgggtgaagtgtacgcagagataaggaaaagtctttacccagacgcgtgtaaggttctagggttgactcagaaagcgatcgtctccaagatctgaatcaatgaatctctattatttcattaatccgtgtttggattggctttttcttactcttggacgcgcatcctcctgtaacaatataaagcggcttctacgtctttctagtagatacttacgcgcatccaaacgccacacaacaaacaattattagttaattatttttgtttgttgtacttttgtatcttttcctggacccgaaagatccgctttcacttatcat

SEQ ID NO: 1948 - DNA, 346 bp, Glycine max
  misc_feature (288)..(288): n is a, c, g, or t
  misc_feature (305)..(305): n is a, c, g, or t
tatttcccgcttagcataagtagtacatttcatcatcatcttgaggactacgtcaatggatgtggtactcaaaacacttgcatggaaccctgggagatattttggttcccttgggtacttcacttactcaccaaccatggttaggacataggtgaatctcatcactctctatctctcttctccctgctttctgtctgccaacttttacatcgagatggaccttgatactctattaattatatgtttaagcctatatggtttggattgtaattaggaatactaaagtangaggatttcattctctntccatgctggatgagaatggatttgctactcattctactat

SEQ ID NO: 1949 - DNA, 792 bp, Glycine max
ctcacttcttattgaaatccttcctcagtcttctcccattttccagagttcttaaaaattgatgcttccttacaagtctttctgagcattccgtttccttcctccaggtaccatcttgctttctcttttacaagtttcgattttgatgattccgctgttgagagaagccctttaatccatctgggtgttcccagaattttgttttcttgtgattccctctatcattggaaattttgtgtttcttgatctttctacaggcttatgaaaaatgctacttcattttttatcgggaatttttgtacttttttttcctttttagtttctttcagggtccttgtcattggttggtgattccgttttctttaagttgctttacacttgatcgcttttgtccctttttcttggccctttttattaacatgtagtttttgtcaatttatgatgcatatggttttcttgataaaattaatgcttttgtgacaagtggattaagaatttgattatttgggtttcttttgcttgttgtggtacatttatagtgactgaatagcactggcttgtctttgcagggaaaagttagcgtgtctttaggtcacaggattttgagagatttactttttaatctgcctctgaatcaattctgcaagaagatatataatgtttggttcaaagaaatctcctttgaaggttgctaaacctagctccgttgagtcttggacgaatccatttgattctaatgatgagggaatggataccaaaaagtatagttcctctagaaagacttcttcggag

SEQ ID NO: 1950 - DNA, 374 bp, Glycine max
caaataaaataccattcgatcttaatccaaggatcacaatcgatgaacgtatatatccgtaaacacacggaatccgtctgcgtttgaaggaaggttcgacggaagaatcttctctgactcgcccaaaccaaacgctttttttttctttccacgcgcagactaacaccctttccttcttcttcgttcggatcagattcttggaattctgaatcaaaattctcagaagaaggagatgtatagcaatttcaaagagcaagcaatagagtacgtgaaacaagcggtagatgaagacaataagggaaactatgcgaaagcgtttcagctttacatgaacgcgttggagtatttcaaaacgcatctcaagtacgagaaga

SEQ ID NO: 1951 - DNA, 381 bp, Glycine max
aaattgatttctctagtatcacaacaaagagcccactataccctgaaaattgtaatttctctacactcctacttcagggtcttctttgttggtgtcattctcattgtttccttgaaatttgatatatttataccacctagccatcagtacatatattacaagatcagctgcggtgagtgctgctaagaggaagtaaaacatatccaaatgccctttgttcaagtttcctgggatccatcctggcatctcatctgtggcagaaatcttcatcacaattgcaacaagcaagctactaacgtagtttccaagtgatattgaagtcatgcaaagtgcactaccaaaactctttaatccatcaggtgtttgtgcattgaagaactc

SEQ ID NO: 1952 - DNA, 719 bp, Glycine max
  misc_feature (347)..(348): n is a, c, g, or t
  misc_feature (350)..(350): n is a, c, g, or t
  misc_feature (352)..(354): n is a, c, g, or t
  misc_feature (356)..(357): n is a, c, g, or t
  misc_feature (359)..(362): n is a, c, g, or t
  misc_feature (367)..(368): n is a, c, g, or t
  misc_feature (371)..(373): n is a, c, g, or t
  misc_feature (378)..(381): n is a, c, g, or t
  misc_feature (383)..(389): n is a, c, g, or t
  misc_feature (391)..(392): n is a, c, g, or t
  misc_feature (394)..(398): n is a, c, g, or t
  misc_feature (400)..(400): n is a, c, g, or t
  misc_feature (402)..(410): n is a, c, g, or t
  misc_feature (419)..(424): n is a, c, g, or t
  misc_feature (429)..(435): n is a, c, g, or t
  misc_feature (439)..(446): n is a, c, g, or t
  misc_feature (457)..(468): n is a, c, g, or t
  misc_feature (470)..(474): n is a, c, g, or t
  misc_feature (478)..(478): n is a, c, g, or t
  misc_feature (480)..(481): n is a, c, g, or t
  misc_feature (484)..(486): n is a, c, g, or t
  misc_feature (495)..(495): n is a, c, g, or t
  misc_feature (497)..(498): n is a, c, g, or t
  misc_feature (500)..(512): n is a, c, g, or t
  misc_feature (522)..(530): n is a, c, g, or t
  misc_feature (534)..(540): n is a, c, g, or t
  misc_feature (542)..(546): n is a, c, g, or t
  misc_feature (548)..(551): n is a, c, g, or t
  misc_feature (553)..(556): n is a, c, g, or t
  misc_feature (559)..(566): n is a, c, g, or t
  misc_feature (572)..(572): n is a, c, g, or t
  misc_feature (576)..(591): n is a, c, g, or t
  misc_feature (594)..(604): n is a, c, g, or t
  misc_feature (607)..(608): n is a, c, g, or t
  misc_feature (611)..(617): n is a, c, g, or t
  misc_feature (619)..(640): n is a, c, g, or t
  misc_feature (643)..(648): n is a, c, g, or t
  misc_feature (653)..(653): n is a, c, g, or t
  misc_feature (656)..(656): n is a, c, g, or t
  misc_feature (658)..(663): n is a, c, g, or t
  misc_feature (665)..(677): n is a, c, g, or t
  misc_feature (681)..(683): n is a, c, g, or t
  misc_feature (694)..(710): n is a, c, g, or t
atgttgttgttgttgttgtcttattctctccttttcctggttctattccttacactgaaatcccttttccaaagcagaaaattgagaaacctaccaccaggtcctcctcctcttcccataataggtaaccttaacctcctcgaacaacctattcaccgtttcttccaacgcatgtccaaagaatatggaaacatcgtttccctttggttcggttcacgtctcgccgttgtcatttcctcaccaactgcataccaagaatgcttcaccaaacacgacgttgccttggccaaccggctaccttctctctcgggaaaatacatattctacaacaacaccaccgtagggtnntnannnannannnntattnntannntaaannnntnnnnnnngnntnnnnncncnnnnnnnnncccaggggnnnnnnccccnnnnnnngaannnnnnnntccgacaatgnnnnnnnnnnnnannnnncctntnnttnnnccaacaatngnntnnnnnnnnnnnnnttttctttannnnnnnnnactnnnnnnncnnnnngnnnncnnnnctnnnnnnnncgcaanactnnnnnnnnnnnnnnnnctnnnnnnnnnnnatnngcnnnnnnngnnnnnnnnnnnnnnnnnnnnnnctnnnnnnctatnatnannnnnntnnnnnnnnnnnnncaannnaatttccctcnnnnnnnnnnnnnnnnntccaccccc

SEQ ID NO: 1953 - DNA, 672 bp, Glycine max
gcatttcaaaattagaatttgagtttgagaggagacgagtgacaaaagatgatgttagggaactaatatatcgggaaatactggaatatcatccccagttgcttaaagattacatgaatggaactgaaggcactcacttcctttaccctaggttgaaccgtaattcctgtttctttttttactgatgtaacataaatacccatattatgtatacattatatgcaatgcttatcatttacggaaatatgtctcttgcagtgcagtagatcaattcagaaagcactttgcttatcttgaggaaaatcatggtaaaagtggcccagtgattcctccagaaaggaagcatgtctcccttccaaggtaagactaacttgcactaaccatggaatgctttctaattacgatatttaatttctggctattaatgttggttcatatgtcaagtttgttgctttatttttaagtaaatattttctgatggatatgttatatatattatatataataatttccttttaatttttgaaggtccattgttcactctagtacaattcctcctagttcacaaccatcttttacttcatacgagaacaagcaaatggcattagaggcatcaaaggtttcgagatcagtagaatcaaattccagaagtcaattaaggagctcgtgacc

SEQ ID NO: 1954 - DNA, 401 bp, Glycine max
gcaagctgcatcgaaataaaggctgcttacagaaagctggcaagaacataccatcctgatgttgtggccatgaatcagaaggaaagctcagcgaaccaatttatgatgatccattcagcttactcaactttatctgacccagagaagcgagctcaatatgacagagaaatctatagatacagaagatcagcaaatatggaagcaagaaatcagacattttcctatgctggaagtgcaaggaaatgggaaacagaccaatgttggtagcagatcgtgtaatcatgttactcatgtacattattattattaaccattttgttcttttttttcttcttttcttttaagtttttgttatgtcattcatttatgttatccttcttcacaatactatcctagactga

SEQ ID NO: 1955 - DNA, 546 bp, Glycine max
ttcttaaaattttcaatcttgagttttgcaggtggtcttgcggtcatgttttgtgggtgggttcagtatgcaaacctatttggagtggcaattgggtacaccatagcagcttccataagcatgatgtgagttttgaaaagatgcaattgttgttgttgtgtgcgagaagtgtgaggaaaatgtgctaattgggtgttttggtttcttaatcaaacagggcagtcaaaaggtctaattgttatcatagtagcggagggaaaaatccatgcaaaatgaatagcaattggtacatgatttcatatggtgttgcggaaattatcttctcccaaattccagatttccatgagttgtggtggctctctattgtagctgctgtcatgtccttcacatactcattcattggacttggccttggtattggtaaagttataggtatgattctattcatgtaaacttattattactatcaattaatgtttataccactactgggtggaaatttgacttgaattgcacatgtatcaggaaacggaagaattaaaggaa

SEQ ID NO: 1956 - DNA, 320 bp, Glycine max
agatggcattatgaatgaagaaaataaaaaggagatcatggaggttgctattcttgctgcaaagtgcttgagactcaatggggaggaaaggcctagcatgaaggaagtggctatggagttggagggaatgaggctaaccgagaagcatccttggataaattcattccaaaatccagaggaggctcagttgcttcaaaagggatcatctagcctgtgtgtatcaggtgatagcggcagccatcaatacactgggtatgacagcattaatgatcatgtacaaattgctttcgatgatggaagataattaattatggctaagc

SEQ ID NO: 1957 - DNA, 407 bp, Glycine max
gcactccaagcagaactaattcgacttgggtttattcatgaagacgtttcaggttacagtgtgaatacacatgaccctggtgtgctcaatgcagttttggtagcaggtttgtatccaagggttgggcggtttcttacaaataaaagtggaaaaagggttattgttgaaacaacaagtggagataaagttcgcctgcacaatcattccataaattttaagttgtcattcaagaaaaaattagatgacactttaattgtgtatgatgagattactcgcggtgatgggggtatgaacctaaggaactgcacagttgttggaccacttccacttttgctgctttcaacagagattgctgttgccccagcagaagaaaatgatgaagggggtgaggatgatgtaggaggtag

SEQ ID NO: 1958 - DNA, 390 bp, Glycine max
tagattcccttctaacaatggcagaatattttgcggtattgggtgaacaacagatgtctgcagatgctattgccaggtgtctatatgcccttgaatgtgcatggcatcccatgttcaatccactgcagggaaattgccagctgaagttcaaacatgatacaaacaaaccaatattcacagctcttttcactcacatgaaaaatttggacaggcgtggctgtcatagatctgccttagaggtctgcaaattgttgctttcgctagattctgatgatcccatgggggctattttctgcatcgattactttgctttaagggctgaggagtatgcatggctggagaagttttctgaagaatataaaagtgacaactccatgtggttgtttccaa

SEQ ID NO: 1959 - DNA, 401 bp, Glycine max
agttactggagcacaacttggagtgtgggattttggttcaaggaatgtattgtacatgaagctcttgtattcaaggttacctggctgcacgatccgaagatcgctgtgggatcacgtcccaaacaagccgccaaaaacagtgaatgctgaaaacacctccaacccggataactcaacccttagagaaaatgccacagccaacaagttggtgaagtatgttgacttgtctaagatgaccaaaggaccccaagaccctcctggccattggttagtcactggtggaaagcttggtgttgaaaaagggaaagttgttttgagagtgaaatattcattgcttaattactgattccacctttcgagtttgtgtatgaagatgtgcatgcagtggtggcctatgctag

SEQ ID NO: 1960 - DNA, 670 bp, Glycine max
tatctgtttattattatatttagtaaaaaggaaaatctaatataaatatatagaagttcatttgaatgaccctctaatatgtgagagcttaatttgattttagatgatgggttccgccttacctaccttggttatgattttcttgccattaagactatggtgaacaaaggagtgtttgtagctgttggacgccagattggtgttggaaaggaatctggtattttagttgatgttcttctgattgggtgccctttgttcaatcacatttcacacgtttttctgctatttatgttggtgtttgtgctctgctagatatatttgaggttgcccgtgaagacggaacagttctggctatgaagttgcataggcttggaagagtctctttccgagccgtcaaatctaagcgtgactacttgagacatcgcagtagttataattggctctatttgtctcgcctcgctgcacttaaagaatttgctttcatgaaggttttgtttcaccttcctctcctttttagtctatgtagctgtatacttgaattattatattttttgtttgatttgctggtgactcatgatttgcttgagtaggctttggaaacacatggcttccctgttccaaatgcaatagaaagcaatagacattgtgtagtcatgtcactcgtccaagg

SEQ ID NO: 1961 - DNA, 490 bp, Glycine max
  misc_feature (360)..(360): n is a, c, g, or t
  misc_feature (369)..(371): n is a, c, g, or t
  misc_feature (373)..(373): n is a, c, g, or t
  misc_feature (380)..(385): n is a, c, g, or t
  misc_feature (394)..(396): n is a, c, g, or t
  misc_feature (406)..(406): n is a, c, g, or t
  misc_feature (409)..(409): n is a, c, g, or t
  misc_feature (412)..(418): n is a, c, g, or t
  misc_feature (423)..(425): n is a, c, g, or t
  misc_feature (427)..(427): n is a, c, g, or t
  misc_feature (429)..(430): n is a, c, g, or t
  misc_feature (433)..(437): n is a, c, g, or t
  misc_feature (439)..(439): n is a, c, g, or t
  misc_feature (477)..(477): n is a, c, g, or t
atctcacatcctagctgccaattttttgatgcacagcctagctttgacttcaatcggccagttacttctcatctgcatgtttctgaaacatctgaggtcacttctgcttccaacattaaaacaaaggagcttgactttaatgaggatggcttcttggaaattaatgatctcattgatactgaacctacattgtcaaatgttgaaaattctgtggagtaccagcattttgaagatgggttaagtgaacttgatttgttccaagatgcacagatgtttcttcgtgacttggggccaattattcatgaaacagattcacatgcatatacaaatgcccttgtcagcagcaatattgaatgacancctaataannntnaaatggnnnnnnaattttttnnnatgacaggtnctncannnnnnntcatnnntntnntannnnngnactgtgatgcaatttgcaatagctgcctgatgaatggnaggatgaacttct

SEQ ID NO: 1962 - DNA, 529 bp, Glycine max
gagtggatcaatatcaaaacttcagtacgccaacgctccattcctttggaaagcacagagtgttccaacctgaaaatgggagacccagtcctgtgcttccaggtgaattaaggctgaatttccttgctgaagtgttgttactgggcattacagtatttaacttaacaatttcaatcggattttaggagaggagagatcaagcaatttactatgatgctcacattgtagagatccaaaggagaatgcatgatattagaggttgcagatgtctcatcttaattcgttatgatcatgacaacagtgaggtgcatatcaactttgcatttggttgcattaaccatttgatgcgtaatttacaagtttttaatgttgtgtttactccttgaaggaaagagttcgcttgaggagactttgccgcagatcaagatcttaagcacatgtgggatcaattctttttgacattcaaggtgagctttcaaacagtcagcaaaggacctgggtgcagcaggaagcaactagcacttgacat

SEQ ID NO: 1963 - DNA, 402 bp, Glycine max
cagcaactcctcgaggccaagcgaaggcagaggaggtccaatcagaagcttgtattcgattgtgtgaatgtctcactaatagaaattactggttatggatcagagaagaattacttgatgggtagtaggttgtgcagtgggagccacagcagggtccaagtcccagaagctgcatctcccccattggtggacctcattgtggcacagatgaaggagttaatatctagtgctatgagttctgtttgggtggtggattgtggggacagtaacagcctggtggtagagagtgttgtcagaaaagaggttgtgggcaaagggtgggttgagcttatgggattggagatggatattttggtgaaggaagtagaggggaagctgctagaagaacttgtggaggatgcg

SEQ ID NO: 1964 - DNA, 488 bp, Glycine max
  misc_feature (426)..(427): n is a, c, g, or t
  misc_feature (434)..(442): n is a, c, g, or t
caagcttccgtgacgtcagacactgcgtccgttaaaatctcggtagaaccgcaagtgttgagtttcaaggagaacgagaagaaaacgttcaccgtcacgttttcgtcatcgggttcgccacagcatacagaaaacgcttttggaagggtagaatggtccgatgggaagcacctggttggatccccaatttcggttaattggggttgaaacttgaaaaaggttgatgcaaattgcaaggttcatcactcactcgaagaggggtgtgtcttgattggctagtgattatagtatttaatatgttactattattactactattaataaatttaacttttgttgcaaacaaaaatgttgggtttatttatttatccagctggaaattgatgatagctggataaataaataaacccaacatttttgtttgcnncaaaagnnnnnnnnnttattagtagtagtaatagtaacatattaaatactataatcactag

SEQ ID NO: 1965 - DNA, 590 bp, Glycine max
aaaaaatgatttctgcgatttcgtgggtgcccaaaggggtttcgaagtcggaacttgtcgtggctgaacctcctcccgaagaggaaattcaagagataatagccaaccacgcaaccaaaaggtggtccttttgtttggttccataaaaaattatcattcaccaataaaaccctaacatccaatttttatttttttttatgtgcagtggagacagtgacaatgaagacgctaacaacgatgacgttgtggcacaagcattaaccgtagcagacgcagttggcaaggcctccactggaacctgcgacgaaataacccttgcgttgaaggaccttgacatggacctttatgatgacgaagatgaaggtacgtaattctgcattatatatgatcaatcattgcttgtatttatatgtatgcaatgcagcagcagcagcataaacttacgtttgtcatttgtttaggaattgaggtgttcagttctggaattggcgatctttattatcccagtaacgacatggatccctatatcaaagataaaaacgtaagttccagcacttgttgtcattttattagcgttgcggttaaggccc

SEQ ID NO: 1966 - DNA, 831 bp, Glycine max
  misc_feature (754)..(758): n is a, c, g, or t
  misc_feature (760)..(762): n is a, c, g, or t
  misc_feature (800)..(804): n is a, c, g, or t
gtgcattgatgccaatctttcatccaaaacgaactgcaaatactttatttttactacatcggttgaagtatgtgagattgttctattcaaattcaaatcatttttacttttccatgacattgatttgttgttatttctgtaaattagaagttaaagtattttgattttggaaaatttgcagactactttttaggaaagtagcctctgtcaacttggaaaacctcaaccatcaggagaagcttgcattctggatcaacatctacaattcgtgtatgatgaatgtatgtcagttatgtccattacaacaacatttagtataatctgtatctaaacattttttccacgcaatttattataactttcctcaataatcagaataacaaatcttaatttgtgcgcctaattatcctgtcaaaccataataatgatggtattttaagttctactttgcttcaggcattcatagagaatggcataccagagaatcctcaaatggctgttgcactaatgcggaaggtatggactactagagtcgtttgtttcttatgtattgtgtttgttctttcaattgagtataacatagcataagtgtgctctcaataattcgtgtggttttcttgttactcaggcaacaataaatgttggtgggcacgtgctaagtgcaacaaccatagagcatttcattttaagacttccttatcactggaaatttgtaagtcttgtccatttcatctcttgcttttctatgcatgannnnntnnngagttaatttagccactaaatttcaaacagacgttttnnnnnggaacaaaaaatcatcaaatgacagca

SEQ ID NO: 1967 - DNA, 417 bp, Glycine max
  misc_feature (323)..(324): n is a, c, g, or t
  misc_feature (356)..(366): n is a, c, g, or t
cgtagtactcatttgttttaaatttgaaccattgagtttgtgctaattatggtttatgacttttctatgttatctctactaataaataggttgccaacatcaacttaagccatgcaagaaaagacctgggggattattggaagaaaatgatgaatgacgaacccatgcctgaagcaattaaagatcttattcaagatcaacaggtacaagatgcaacagcagatcattttataaggtacttcgatatgaagcctaatatcattttgtatcacacccatgttgtgtccaagaagcagcagcagcaaaaggcttttgaccacaannttaaaccagtctcaaggaacggaaagtcatgnnnnnnnnnnnataaaaaatggttgaaggctaaagctgttagaattaataataaaaagaaaa

SEQ ID NO: 1968 - DNA, 239 bp, Glycine max
tttttctgccgcttgatttattcggcctgtactagcagatacgatttctgaaattgtttcgatggatcaatgtgaagtatctttgaatacgttaacacatgaatgttgtttagtatttgagttagtcggcatttaaattaaatattaaaaacacttttagcatttcatgaggtttaggcatccctcttgaacactgaaaacttaacgagggactagcaccctaaaggcctaaacaagaa

SEQ ID NO: 1969 - DNA, 399 bp, Glycine max
tagggaaaccattggtgtgtgtttcagctttgctgacccttctgttgtttctgccaatctctgttagtatttagacccttttgatatacgaagccttcaattacaatgctttacttcctcatatctttcgtctcctttctcatcctttccaagtctttcaccagcaggcctttctcatcaggggagagagggatcaaaccagggtcaattgggttttgggggagtctttcaagttggttagtttctaggctcaagaaaggaagcacaacaggcaccaccccttttagtttttttcagttttctcttggcatgtcattgaaaaagaatagtttagtgtctaaggtggagaatgaggaggaggaggggaatgtttctctcttggatttgcctgataaaaaa

SEQ ID NO: 1970 - DNA, 370 bp, Glycine max
acttggagcagctggagctgctccagagccagtgattgatacatcaggcaagaagctgagagctgatgcaaattaccatatcatccctgcagtgcccttcaccatatgtggctttgttggctgtttcactggtggaggcctttcactagacagcatagatgaatcttgccctcttgatataataatcgagaaagccaatgaaggcctaccactgagattctcaccagttaacaccaaaaaaggtgttattcgtgtctccaccgatttgaacatttttttctctgattctgatgaaaggtgtccacaccattccactgtgtggatgcttgatcaatttgatgcctctattggacagacaaatgatagagca

SEQ ID NO: 1971 - DNA, 911 bp, Glycine max
  misc_feature (57)..(57): n is a, c, g, or t
aggctcaacctttggttcgaccccaccaaggattttcactcatactctatcttctgnaatcaacgtcaagttgtgtaagcacccattccccttcttaattgatgcattaaagttaaagtatttaatgtaattatgtaacttttatagtgttattttaaaattaaaaagcgatgaagttcaattacaataaattgactagagagggaatagtgctgcacaatgggtctgaataaagctgtaaaattgcctgcttttttccctatggtggttgagctatcatagacttgggtttcacaaaaacaaaacccatggaaaaggaaatggaatcttggacaattcatgggtcttcagcataatatgtaggtacatttgtttgtgttaccatgccgatcatttaaattttgcatgcagtacacatcacaagttgcaagactttttaattgtactataaaataaaacttgaatccaaggttttaaatattggactgccgtggcaaacactgtcccaatttgcgttagaaaaccttgatgtcacggtccacgttaagatgcaaactgtttttttaaaaccttatttaaatcaaattcaacacaattgatttgattataatgttgtatatgtttttttttatgtgatcagatttttggtggatgaaacgccaataagggtgcacacgaacatggagcacaagggaattccatttcctaaggaccaacccatgggtgtgtacagttcattatggaatgctgatgattgggccacgcagggtggtcgtgtgaaaacagattggagccacgcacccttcattgccacatacaagaacttcgagataaatgcgtgtgagtgtcccgtgtcagtggctgcaatggataatgctaagaagtgcaccagcagtgaggggaataagtat

SEQ ID NO: 1972 - DNA, 554 bp, Glycine max
gactcatcataaacctccatagcttacttggaaacaagtaagaacataagcacatcctccttttcctctcattattcttttacatctccaagtatcacatcatttagttaaaacaaaattatttaatttactttattgttaatatttattcattcattccaagtatcataacatatacagtcttgttattctttcaaattttcacctagcctagctagctatagctagcatcttttcctaatgagaaattctcaaattaatgtttttttttcttctttttatgaattctcagatggtctttgatagctgcaaggttacctggaagaaccgataacgaaataaaaaactattggaacactcacatcaagagaaaactctacagccgcggaatcgaccctcaaactcatcgtccactcaacgctgcctccgccactccggcaaccaccgtcacagccaccgcagttccatcttctaacagcaagaagaagataaagaacaataacaacaacaacaacggttttcagttggtgaataatagtgcttatgccaacaca

SEQ ID NO: 1973 - DNA, 473 bp, Glycine max
aaaaaaatttaattaatattaattgctccatccggaattaatttcccacctaccttgggataagtggttgccggaagcttgagacttgaatggtaatgacttgaacacccgattctggtattaatataacttaataagttcatcccgtgaggtaatctatacccgtgctataaggaatataaaaacggacttgtatttttcttttttttataggatactggaaatgagactacagtatcctataaaagaaaaatacaagtccgtttttatattccttatagcacgggtatagattacctcacgggatgaacttattaagttatattaataccagaatcgggtgttcaagtcattaccattcaagtctcaagcttccggcaaccacttatcccaaggtaggtgggaaattaattccggatggagcaataatatttaatttaaattttttatttctaggcttcggcgtatgtaga

SEQ ID NO: 1974 - DNA, 1495 bp, Glycine max
  misc_feature (373)..(392): n is a, c, g, or t
  misc_feature (409)..(415): n is a, c, g, or t
  misc_feature (422)..(428): n is a, c, g, or t
  misc_feature (431)..(434): n is a, c, g, or t
  misc_feature (445)..(445): n is a, c, g, or t
  misc_feature (447)..(450): n is a, c, g, or t
  misc_feature (452)..(458): n is a, c, g, or t
  misc_feature (462)..(469): n is a, c, g, or t
  misc_feature (471)..(479): n is a, c, g, or t
  misc_feature (482)..(482): n is a, c, g, or t
  misc_feature (484)..(488): n is a, c, g, or t
  misc_feature (492)..(502): n is a, c, g, or t
  misc_feature (504)..(504): n is a, c, g, or t
  misc_feature (508)..(508): n is a, c, g, or t
  misc_feature (510)..(515): n is a, c, g, or t
  misc_feature (518)..(543): n is a, c, g, or t
  misc_feature (546)..(550): n is a, c, g, or t
  misc_feature (552)..(561): n is a, c, g, or t
  misc_feature (563)..(574): n is a, c, g, or t
  misc_feature (576)..(579): n is a, c, g, or t
  misc_feature (585)..(594): n is a, c, g, or t
  misc_feature (603)..(609): n is a, c, g, or t
  misc_feature (611)..(617): n is a, c, g, or t
  misc_feature (619)..(626): n is a, c, g, or t
  misc_feature (628)..(629): n is a, c, g, or t
  misc_feature (633)..(641): n is a, c, g, or t
  misc_feature (643)..(647): n is a, c, g, or t
  misc_feature (650)..(650): n is a, c, g, or t
  misc_feature (652)..(667): n is a, c, g, or t
  misc_feature (669)..(676): n is a, c, g, or t
  misc_feature (679)..(679): n is a, c, g, or t
  misc_feature (686)..(686): n is a, c, g, or t
  misc_feature (689)..(699): n is a, c, g, or t
  misc_feature (713)..(713): n is a, c, g, or t
  misc_feature (715)..(716): n is a, c, g, or t
  misc_feature (720)..(723): n is a, c, g, or t
  misc_feature (725)..(729): n is a, c, g, or t
  misc_feature (732)..(738): n is a, c, g, or t
  misc_feature (744)..(747): n is a, c, g, or t
  misc_feature (763)..(766): n is a, c, g, or t
  misc_feature (768)..(775): n is a, c, g, or t
  misc_feature (777)..(778): n is a, c, g, or t
  misc_feature (787)..(787): n is a, c, g, or t
  misc_feature (791)..(799): n is a, c, g, or t
  misc_feature (801)..(808): n is a, c, g, or t
  misc_feature (818)..(823): n is a, c, g, or t
  misc_feature (832)..(847): n is a, c, g, or t
  misc_feature (849)..(849): n is a, c, g, or t
  misc_feature (853)..(864): n is a, c, g, or t
  misc_feature (870)..(873): n is a, c, g, or t
  misc_feature (876)..(879): n is a, c, g, or t
  misc_feature (884)..(887): n is a, c, g, or t
  misc_feature (891)..(894): n is a, c, g, or t
  misc_feature (905)..(907): n is a, c, g, or t
  misc_feature (909)..(916): n is a, c, g, or t
  misc_feature (921)..(932): n is a, c, g, or t
  misc_feature (935)..(941): n is a, c, g, or t
  misc_feature (946)..(962): n is a, c, g, or t
  misc_feature (970)..(976): n is a, c, g, or t
  misc_feature (978)..(981): n is a, c, g, or t
  misc_feature (983)..(985): n is a, c, g, or t
  misc_feature (987)..(988): n is a, c, g, or t
  misc_feature (997)..(1004): n is a, c, g, or t
  misc_feature (1006)..(1012): n is a, c, g, or t
  misc_feature (1016)..(1026): n is a, c, g, or t
  misc_feature (1028)..(1028): n is a, c, g, or t
  misc_feature (1031)..(1044): n is a, c, g, or t
  misc_feature (1046)..(1047): n is a, c, g, or t
  misc_feature (1053)..(1059): n is a, c, g, or t
  misc_feature (1061)..(1066): n is a, c, g, or t
  misc_feature (1069)..(1084): n is a, c, g, or t
  misc_feature (1087)..(1099): n is a, c, g, or t
  misc_feature (1106)..(1108): n is a, c, g, or t
  misc_feature (1111)..(1118): n is a, c, g, or t
  misc_feature (1131)..(1134): n is a, c, g, or t
  misc_feature (1139)..(1142): n is a, c, g, or t
  misc_feature (1144)..(1149): n is a, c, g, or t
  misc_feature (1152)..(1164): n is a, c, g, or t
  misc_feature (1166)..(1183): n is a, c, g, or t
  misc_feature (1186)..(1197): n is a, c, g, or t
  misc_feature (1200)..(1200): n is a, c, g, or t
  misc_feature (1202)..(1211): n is a, c, g, or t
  misc_feature (1216)..(1228): n is a, c, g, or t
  misc_feature (1230)..(1238): n is a, c, g, or t
  misc_feature (1246)..(1250): n is a, c, g, or t
  misc_feature (1256)..(1262): n is a, c, g, or t
  misc_feature (1266)..(1266): n is a, c, g, or t
  misc_feature (1277)..(1283): n is a, c, g, or t
  misc_feature (1286)..(1290): n is a, c, g, or t
  misc_feature (1294)..(1311): n is a, c, g, or t
  misc_feature (1317)..(1317): n is a, c, g, or t
  misc_feature (1319)..(1320): n is a, c, g, or t
  misc_feature (1322)..(1336): n is a, c, g, or t
  misc_feature (1338)..(1343): n is a, c, g, or t
  misc_feature (1346)..(1354): n is a, c, g, or t
  misc_feature (1356)..(1360): n is a, c, g, or t
  misc_feature (1362)..(1366): n is a, c, g, or t
  misc_feature (1372)..(1373): n is a, c, g, or t
  misc_feature (1375)..(1377): n is a, c, g, or t
  misc_feature (1380)..(1382): n is a, c, g, or t
  misc_feature (1385)..(1390): n is a, c, g, or t
  misc_feature (1392)..(1403): n is a, c, g, or t
  misc_feature (1405)..(1405): n is a, c, g, or t
  misc_feature (1407)..(1430): n is a, c, g, or t
  misc_feature (1435)..(1466): n is a, c, g, or t
  misc_feature (1468)..(1468): n is a, c, g, or t
  misc_feature (1471)..(1479): n is a, c, g, or t
  misc_feature (1483)..(1484): n is a, c, g, or t
  misc_feature (1488)..(1492): n is a, c, g, or t
actgtatatcaagggtgagcttattggtggatcagatattgtgttggagatgcaaaaaagcggagaacttaggaagaatttacacgagaaagggattcttcctgcagagaccattcaagatcgactgaagaatttgattgcctcgtcccctgtgatgctgttcatgaagggtaccccagatgcaccaagatgtggttttagttccagagttgctgatgcccttcgacaagagggcttgaattttgggtcctttgatatattgactgatgaggaagtgagacagggattgaaggtatactcaaattggccaacctatcctcaactctactacaaaagtgagctgattggtggtcatgatattgtgatggagcannnnnnnnnnnnnnnnnnnnccacgacaagccaacgnnnnnnngtagatnnnnnnngtnnnncgggtcctctncnnnntnnnnnnnaagnnnnnnnntnnnnnnnnnctntnnnnntaannnnnnnnnnntnggtngnnnnnnttnnnnnnnnnnnnnnnnnnnnnnnnnnaannnnnannnnnnnnnntnnnnnnnnnnnntnnnnattttnnnnnnnnnnatccttacnnnnnnngnnnnnnncnnnnnnnntnntctnnnnnnnnnannnnnatncnnnnnnnnnnnnnnnncnnnnnnnnccnctccctnccnnnnnnnnnnntttcttctgatgtnanntgcnnnnannnnntannnnnnntcatannnnctctgctcattctcannnntnnnnnnnntnntttttaccnttcnnnnnnnnncnnnnnnnnattattcctnnnnnnacttatttnnnnnnnnnnnnnnnntntctnnnnnnnnnnnncgctcnnnnctnnnnctatnnnntaannnnataatctatannncnnnnnnnnatatnnnnnnnnnnnntcnnnnnnntttannnnnnnnnnnnnnnnntattaacnnnnnnntnnnncnnncnntaattcttnnnnnnnntnnnnnnntccnnnnnnnnnnntnccnnnnnnnnnnnnnntnncctggnnnnnnntnnnnnnccnnnnnnnnnnnnnnnnctnnnnnnnnnnnnncttactnnntcnnnnnnnncctctatttttcnnnnatttnnnncnnnnnntcnnnnnnnnnnnnntnnnnnnnnnnnnnnnnnncgnnnnnnnnnnnnctntnnnnnnnnnnactcnnnnnnnnnnnnntnnnnnnnnnatccacannnnntcctcnnnnnnntcanatattctcggnnnnnnnctnnnnntcannnnnnnnnnnnnnnnnnattcananncnnnnnnnnnnnnnnnannnnnnctnnnnnnnnnannnnncnnnnntaacanntnnncgnnnccnnnnnngnnnnnnnnnnnnanannnnnnnnnnnnnnnnnnnnnnnncaccnnnnnnnnnnnnnnnnnnnnnnnnnnnnnnnnantannnnnnnnncatnnaccnnnnncct

SEQ ID NO: 1975 - DNA, 515 bp, Glycine max
aactggaagaactgatacagaaaaaagtaagttcaatccatacttatcaatttcttctggatttatttatttgtttagccacattcttccatcaatttgctgtttctcttccaagtccctgaatatttactttatgttctgcgtgttttgccagcttttggatcccatgttggaaacacaatcgcatagtgagctgctttctgctgttagattgttggtatcagaggatcattgtgatgggagatttgtctttggtcgccaggtcctaccacaatcaaagaaggaaacaaactccaaaactggtggtggagctgagggtaaaaattataaaaatcatcttcaagcattccttaacagggctggacatgattcaccaacttacaaaacaaaggagctgaaaaacaaccaattccgtactactgtcgtatttaatgggttgaattttgttggtcagccatgcagcagcaaaaaattagcagaaaaatctgctgctgctgaggctctattatggataa

SEQ ID NO: 1976 - DNA, 851 bp, Glycine max
  misc_feature (52)..(55): n is a, c, g, or t
  misc_feature (788)..(792): n is a, c, g, or t
  misc_feature (828)..(830): n is a, c, g, or t
aaggtctcaagcaatgtttgccacatggacactgacaatagtggcactatcnnnnatgaagaattaaagactggcttggctcgaatcggatcaaaactgtctgaggctgaagtgaagcaactcatggatgcggtaagtagttagaagtcacggatccctacaagagcataactagttgaacatatgtgcattcattgcatcttaaactcagcaggattgttgttctcacgtatattttttctcaggctgatgttgacggaaatgggtcgattgactatcttgaattcatttcggctacaatgcataggcacagacttgaacgtgatgaacatctttacaaagcattccagtattttgataaggataacagtgggtgagttttacaagactggtattttagtgttttttctaatcatttgtgtttggacaacgagataatgttttctgtttaaagtcacacactcatctttatagttttgaactgttttattctctgcttcgtagttgagttcttcaattttaatgacaaatttgcaatcagaagttgtcctttgaatttgtttttggcctgatatcctgatgttcgatagcacatttggtactggcatggagcttttatctgtaaaatactaacatttttatgttaaactgcattagtttactttaaggatacatcaataacctgatgacctgacttgaggagcacccatgattgattgatttgaatattgaattacaagagataaaaattgaatggagaataacagtgtctttaaattgatggacannnnnattacaagagatgaattggagattgctatgactcannnatggaatgggtgagaagcaac

SEQ ID NO: 1977 - DNA, 399 bp, Glycine max
tctacgctttctcctcgccgatggcgaatttccggtaccggatcatcgtcgacggcgggagcaccggcacgcgcgtgcacgtgtttaaatacaggtcggggagatcgctggagttcgggagggatggtttgaagtcgatgcgcgtgaacccggggctgtcggcgttcgcggaggatccgcagggcgcgggggggtcagtggcggagttggcggaattcgcgaagcggtggatcccgagggagagctggggggagacggagataaggctgatggccacggcggggctgaggatgctggacgcggcggcgcaggagaggattctggcgtcgtgcaggaaggtgctgcgtgactccgggttcaagtttagggacgaatgggcttctgttatcacaggttctg

SEQ ID NO: 1978 - DNA, 400 bp, Glycine max
gcgggcttcgtttctcacacacctcctccaacaatgacactcccaccaccttcaatgccactgcccatagcaagaaaaaaagcaacttttctgcatcaaccttcagagggttggggtgcaccgccggagcgtcgcagcaggtgtcggtgccggcggtgattcgctcctccgccgattggcaaggaaagaaaacaagaaaaaagaagcacaagagaagcagcagcagcagcaagaacaagactttccatggtggggttctagaagggtccaatccagagtgcgtggattttcaagatgtttggtgtggccctggaattgggttctcaacagatgctgctgctgctgcctctgttgattgtgttgtggccaggaagaatgtctcttctgcaagagggaaaaa

SEQ ID NO: 1979 - DNA, 370 bp, Glycine max
caccaatgccaatacccatgtgcaacgaaattcaagcccaagcccaagcccaagcccaagcccaacctgggtttaagctcgtcggtttcaaaaacttcgtccgaaccaatcctaagtcggaccgctttcaagtcaaccgcttccaccacatcgagttctggtgcaccgatgccaccaacgcctctcgccgattctcttggggacttggaatgcctattgtggcaaaatctgatctctccaccggaaaccaaatccacgcctcctacctcctccgctccggcgacctctccttcctcttctccgctccttactctccctctctctccgccggctcctccgctgcctcctccgcctccattcccagtttcga

SEQ ID NO: 1980 - DNA, 360 bp, Glycine max
ttaccggaaccagcaggtcacgtaccgaacctcaatcccaccctcataccaaggtcacaaggaagaggatgtgtggtccccattcgtcttcggcactaacgtccccgtcgcacccttcaacttcgttggtctcagtcaagaccagaccaacggcaacgtcctcgtcctcgttaagattgacggtaaggtacgttggaaagttggtaccttcgtctctggtcactacaacctctatgtaaggtgccctgctttcataacttttggcccccaaagcaccgggattgcccttggcaagaacgccgttaagtatcaattggttcaacgctgcaccgtcggggtttgatgtaaccgccgtccaac

SEQ ID NO: 1981 - DNA, 378 bp, Glycine max
gctatctctctcatccttgccttggctcaggcagattcagattctcatttcgaaggctttgaagccgaagacgacgatgacgacttggaagactcttccatccatccagcctctctccgatcaccccccctctccgaccctactcccactccccagcctccaccttcggatctccccaaattccctcccttcgatttttgggacgacgatgaattcgaaggcgtccccgtggaacactcctcccccgagcctccctccgatcccaaatcccccgaaaacgcctccaccaccgccaccaccactcaaacccctccaacccccaaccctcctcgctccttctccgtggagatcatctgcggaagctttcttatcaagtta

SEQ ID NO: 1982 - DNA, 349 bp, Glycine max
acttctggatgcggatcttgtcggctcttgtgcccgtctgagccgccaccagcttcttcaggtcgccgatggtgtcatcgtcgttgcacttcacgcgcaccttcttccccaatcgatcgttcaacaccacctcgatcatcttcgtgacgcgaacaaccctaattcccaattccaaacctaaagtctttcgcctttacttttcagttttcagagcgcattccaataagaaagatcacttttaggcagctactgctgtattgtcttttctatgagctaggtttgagtgttgtaataatttgcttgctgcattatgtatgccggctagtgttccatattgaggcatccttag

SEQ ID NO: 1983 - DNA, 324 bp, Glycine max
ccacacttgagcaaatttccatgcttgcttcccctgatggggacactatgcagcgaatcgcaacatattttatggagtcgcttgctgatcggattcttaaaacatggcctgggatccacagagccctcaactcaaccaaaatgactttgatatccgacgaaattctggttcagaagcttttctttgagcttttccctttcttgaaggtagcatttgttctcacaaatcaggccatcattgaagcaatggaaggggagaaagtgattcacataattgatctcaatgctgctgaagctgctcagtggattgctctccttcgagtat

SEQ ID NO: 1984 - DNA, 487 bp, Glycine max
agatggagattaacctgttattatgatttgtgtcttgtttaactagtttgttcctttgtataactaattgtataattaatgtgttgtttgctgtttattctgtaggaggaggaggatgatgatgacgacgagtgaagatggtgatacaagatgaagcgtaggaggatgtgggaaaagaaaattgttttgcatagtagttgttgggtttagaatttcataggatggttcccaacccacatccctttatgataattagtttctgaatttttattttgtcctcccttactagggttagattagcgcacaatcgtaattagggttcagtatcatgatcatgtacttaaaagtcaatgctatgatacgtttcaattctattctcgaagaaattccacagcctctttcaactttattattttgtttgtttgatgtcgttacatgtttttacgtggcatcgtttcttggttctaaaaaaaaaaaaaaaaaaaaa

SEQ ID NO: 1985 - DNA, 700 bp, Glycine max
ggcatgattatattcgccagtaagtcaacaatttttaatgtagtattgccatcaaatttgtgaatcattttaattgtaacattttttattttgtttttgtgcaggtataataatgtgaatattaatgttgctgtgcagactgataacgggctctttgttccagtcatcagggtgagcaagggcatctttttaatatttcaaatacaattacggcctttattccaatcacaggtcctaactttgaccttgtattcataatatatgcaggatgcagacaagaaaggcctctctacaataggggaagaggtcaaacaattggcaaagaaagccaaagaaaacagcttgaaaccccaagattatgaggtaattggagtttcatgtccattctttattcatctgtgaataacgacctcttgggctggtttatgaatttttggcttgaattgcattacagggaggtacatttacagtgtctaacctgggagggccatttggtgtcagacaattctgtgcaatcatcaatcctcctcaggctggcattcttgccgttggatcttgtgagaacagtttggtcattttttcctttatttctttcattaattgcagttacttttctcttatctttgtgcattgctgactacatgagcagctgagaggagggtcgttccgggttcaggtgctgaagagttcaagtttgctt

SEQ ID NO: 1986 - DNA, 445 bp, Glycine max
acaaagacaatttcaaaagatggctttataggtatttatttttgttttgttgttagtttactgataagagttttactgaatagttcaactgatactttcacttataggtacatatggttatgtggctcctgagatttccgaaaacaatacaataacagaaaaatgtgatgtttattcctttggggtagtgctactggaactggtatgcaaagacaagctaaaagatgttgagaagcgggagaagcaccctgttgaggagaatattgatccgaatatcaaaggaaagattgcaccagagtgttgggaagtatttatggatatcacagaaagatgcttgaagtttgatccgaatgagcggccagcaatgggtgaagtggaggtgcaacttgagcttgctctgtcactgcaggaagaagcagatataataaatactggcgatgattat

SEQ ID NO: 1987 - DNA, 372 bp, Glycine max
tgtgcttgcagttcgccatacaccggatttcttcttccgaggagaattcgctcaggcacacggcgcagcccgacggcggaggatccccgtcggcggctgccaggtcgcggaacgccgccacggggagaaactcgcggatgaggagggcggagagagtcggctcgcgtggcggaggcggcggagggaggtcagaggcggcggaatcggtgtcgaggaggtcggagatgcggaggaggcggaagagggcgaagacgagggagcgcagccacgcgaggagggaaagcgcgtggaggaacattttcggaaccagcagctccgggtaccctacgggaaaacccatcgtcgggcgcgtgagactatacgcgctttgtt

SEQ ID NO: 1988 - DNA, 1166 bp, Glycine max
  misc_feature (1113)..(1116): n is a, c, g, or t
  misc_feature (1119)..(1121): n is a, c, g, or t
attcttaagaaggaggaagtgaaaaattgagtgatgaagcaattgaagaaactcttgaaaaggcaatacatcaatccatgtgtaccatatacctctataaacatgatgcatgtggttttgagattgaggtttcttctgtttcatttgcaggttgtcaagttgcttgcctatattagtgacaaagatttgtttgctgaattttataggtaaaacagctttggatagaaaaatgatcattttggaaatgtttcttaagttgtttgctattacttctgagttgtttttgagaaccaaacttgatgttgtcccaaagctttttatttctttttctttcatgtaacagaaaagaggatggttattttttgtgaaaaactctagataaaaatatagttaaaatggaaagtaatagtggggtatttggaaaatgaagagagtggattgcaactatttggaaattttacttctataactacctttactaccatataccatattagcttacctttcaaacattttgtagtttttgggacaagaagtgaagatagaaaatgtcttcttgattctataaattaatagtatggatgccaggcaatatcctctttggttttggccttttgggttttgattgcttttcatgccttacggttctctttgcattatttttgtgataaacaaaagtttgttgcatctttgtgacatgattgatgatacggtggtagtctatcattgaattctgctttctgtggctaatttgagtgtcatcattaccttttttcctactgtaagatgcttgcaaaagaatagtcaaacatgttcttgcgtgattgcttgtaggaagaagcttgctcgaaggctcctttttgacaagagtgccaatgatgatcatgagagaagtattttgacaaaactgaagcaacaatgtggtggtcaatttacctcaaagatggaaggaatggttagtcttttcaagtctttgtaaatggagctggtatactatattctactacataagtagaatgacaaaagaaaacattgggttctgtggcttccaccaggttacagatttgacattggcaaaggagaaccaaacaagctttgaggagtatttaaccnnnnaannntaatgcagaccctggaatagacttgacggttacagtttgactact

SEQ ID NO: 1989 - DNA, 408 bp, Glycine max
tttaattcagttgcaggttaatgactttgtgttggtctattctatgaatgtcaagggaataataagtcttgaattcaattgcaggttaatgactttgtgtgcctctcagatagggcttacactcatgaacatatactaaccatggagaaaaccatattgaacaagctggaatggactttgactgtgccaacacctttagttttccttgttcgttttatcaaggcatcagtcccagatcaggagttggacaacatggctcatttcctgtctgagttgggaatgatgaactacgcaaccttaatgtactgcccgtcaatggttgctgcctcagcagtgcttgcagcaagatgcactctgaacaaggctcctttttggaatgagacacttaagctgcacactggttactca

SEQ ID NO: 1990 - DNA, 370 bp, Glycine max
tggtggtgatcgaggatctggaccggttcctcgcggacaaaacggcgagaataagcgcgtcgggaatactgaacttcatggacgggcttttaacctcgtgttgcgccgaagagagggttatggtgttcacgatgaacacgaaggagcatgttgacccgaacctgcttcgtccgggtcgggtcgacgtgcatattcattttccgctttgtgatttttcggcgtttaaaacgcttgcgagtagttaccttggcgtgaaggagcataagttgtttcctcaggtgcaggagatttttcaaaacggggcgagtttgagtcccgctgaaatcggtgagttgatgatcgcgaaccggaactcgccgagtcgtgctat

SEQ ID NO: 1991 - DNA, 384 bp, Glycine max
caaagccagagaatgcatacaccaggaggcgtaggaatttgatggcattgaaccatatttgggacaagaataatagaaactaccctctaagaagcagtggtggtggcatttgcaagagatcaatcagcttgagtagaagttctctggctcttgcagttgccatgaacaactccgacagcagtagtagtatcacaagcgacgattccggttccagctcgaattcgatacctcctccctctccactaccgccactccatccgcgaaacagagtgtcttccttgcggaatttctctccctggagatcattttccttgactgatctacagcagcattgtgccattgctgcaacaataaaaatttcaagtccctccattggaaatgaaa

SEQ ID NO: 1992 - DNA, 419 bp, Glycine max
ttggcctgtgaattttctcccttttggtcattggtggagtgtgctcgctgctcagtttgggctgcttgacagtttacttgcatgaaattataaatgctcatctatgtagcaaggtttttcttaataaaaaaatcaattgcttaaaccgtcttgcaggttggaatatgttatttttcctatggggtatattcagagggaggaggatcaatcacttggattccacaaaaaagatatgtattcccagtttgaatgtgatgccaaatgagaaagattttccaactgctgtaatgactttgtctgaaactcagtgttcacctaagcacatggataaagagtccattgaccaaggtcacaatatggttagtaggaattttgatggcaaagaaactatttttgaccagacacatttgggtttacaa

SEQ ID NO: 1993 - DNA, 382 bp, Glycine max
agacagcatgaggactaaagctcatcaacccggcctcaacttgaagctcctcattgtagcggtcttggttgccattaccctcctatttgtgctaattagatcatcaaacacgaaaggagtgaagcagcaagaggcattatcagtaaagagtgatgggagttgcaacaagatgaagataccgggatcggtgtcggaagcactgatccactactcaacatcaagcataaccccacagcaaacggtgaaagagatatcagtgacagcaagagttctggagaagaagtcgccgtgcaatttcctggtgttcgggttggggcacgacagcctgatgtggaatgcgctgaatcacgggggaaggacgatattcctggaagaagacgag

SEQ ID NO: 1994 - DNA, 366 bp, Glycine max
ttttaccattatatagactattgccacttgccctctcttcaagtttgtttattttcaattaaaaatgttaactggagcagcaggggttaaaaagggtaggatatatgggtaggcgttaatgcgttatgcaattgcatgccatttctatggattcaggtgcagctcccatcaatgccagtagttcatttaaaggtttgaaatgcaaagtgacaactctggtgcctccttgataatgagttggacggacgctggtaatttctcaccagagatcctccaagccattcatcagcaactcgttctctgcttgcagaacctctatctaccacttcaaagtgaagcacgcctttgtcacattagcattctacc

SEQ ID NO: 1995 - DNA, 305 bp, Glycine max
tgtgttggtttcgtttcgtgttcctgtggttttcgtttttgacctacaattctagttgtgtttatagtcgatcgaatgaaatgatagtaagaaattatcgcatcaaatttctatggattttgctatctgtttgctggacgtggaaatcgaattggattaatggtgatggttcttagtttaccggattcggtaaattgtatactcaaaacgataaaaataactaatttattttttaaaatttgcataaacaaccctttggtactaaaattaatttagttgatctgcagtctgcaccaaaaaaaaaa

SEQ ID NO: 1996 - DNA, 386 bp, Glycine max
atgaaatgaagaggatctttcctcattttctgccgcaccacacgacacgacacgacacttgtgttcaaaccatgacttgtatgcaaccaagacacccccaaattaaagtcactgtttcacaattcagttcataccaactcatcactataaaaattgcaagagcccctctgtctctgtagccattctttttcaccacaagataagaaaaaagaaaaaatgtttgcagggaaaggggctgtttggttctccagagcggtggcgttggcagcaatcgcggtggtagcttgcgttgggcttacacaggcccaacccgaggccaggttcaactgcaacagcgcgaacatccccacgtgtcgcgcgctcataagctactctcacccgaacac

SEQ ID NO: 1997 - DNA, 429 bp, Glycine max
cagactaaccagaactgggctgctcttgtgaaggatgctaaagaaagaaacttgatcatgaaggctaagatgccataccattcaatgttcaaaacagataaaaataagtcttatgttgaaaattctgataatcatgcaagacgattgaagcacaagaaggttaaggatactggtcagagtgtaacaaaaattttggttcacggcaaggatattgttgagaggaaaacgaaatgtgttgcctctgaagttagggacaggaagggtaatgtggatgagaatacttcttcagctttgggaaaatatactccatgtaaagaaaggaaatctgaagatgagcatatttccattacgaaggatatgggatatgaagttgaaaaatatgaaagcagaagctcctgcggtgacatgtttacaatgtcaggtcaacag

SEQ ID NO: 1998 - DNA, 441 bp, Glycine max
gcaagcccaaatcggttcgtgcgggttcaacccgaaccgacaatgtgaaagatccatttccatctcatgctcgacccaccccacaggaatgcgaagccgtgcgtgacactctcttagccctacacggcattcccccggaactcgccaagtaccgcaaactcccaccgtccgatgacccggtccaactgcagccacccgaaccggttctcgacggtcttgtccgaaccgtcctctcgcagaacaccaccgaggccaattcccaaaaggctttcgcttccctcaaatcctcctttcccagttgggaacaagtaagtcacaaacatagacatttgtaatcgtacggttttgtctcgtattggtgttgggtttgaacacggtgtcgttttgtgtgttggaaggttctctgggccgagtccaaggacgggagaatccatcgggcga

SEQ ID NO: 1999 - DNA, 688 bp, Glycine max
tctttatattcctttctaatcaggactttttaactagcctgttttggttccttaatacatttataggtagggcctcttcgctgctggcctggtggattgtgcctttctagatcaattggtgacacggacgtgggagaatttattgtgccaataccacatgttaagcaagtgaaggtaagctagtttcattttgaagtcttagtttatatattgatggtcatttttatgtggagatgtttagtactaaatttcagcactgatgaccttctcttattggttccccagctttcaaatgctggtggaagacttattatagcttctgatggtatttgggatgctttatcttctgatatggctgccaagtcatgccgaggtgtacctgcagagcttgctgcaaagctggtggttaaggtgatgttaattgggccaatctcactatcttttcaggaatggatgttccattatcttctctaatgctttgtgtttttctcttccattttttaacaggaagctttaaggtcaagagggctgaaggatgatacaacttgcctcgttgtagatattattccttcagatcatcccgtgttgccaacaattccaagaaagaaacgtaacgtgctaacttcccttctctttggaaagaaatctcaaaactctacaaacaaaggcaccaataagctttcttctg

SEQ ID NO: 2000 - DNA, 1005 bp, Glycine max
  misc_feature (982)..(984): n is a, c, g, or t
  misc_feature (988)..(991): n is a, c, g, or t
  misc_feature (995)..(1000): n is a, c, g, or t
tgtcaccaaaattccatatccatggactcattgcaggttttgctccaacattcctttttttctgtttttcttttcttttctaattacaacatttatttatgctattgattaacttgagttttaggcgttaaaatgatcttagttggttgaacaaaatacatgagttattgtaaacatttgacagtgtctttgattcttcccgataaaaacaaacttcagcttaaggttaacattacatattgaaaaatatcattaaaccaatcttaactcgtgctatatttattattatcacataggtgataggtagataatcagaaataaaatatgtgttgatgttgtctatctgatcttgtgcttatccttagtgataatatcacattttggaatgactcaccacagtccatgcttcctgtcatcaagaagcttattgccggtggtattcgcatttgggtttacaggtacacatacactactacatacattactgcaacatatttgttagtcccttttgaaaagtagagaaaactaattgattttaactagctaattcaactcgcggaactcgaaagttcaaatttaagcagtgatggttagttatatgctcagtatcgtaaaagaagtactattctttgtttctgttttataattatgaatttaattcttcatatattaatttactttattcctttctttgtaaagtggagataccgatggaagaattcccgtgacttcaacaagatacactcttagaaagttggggcttgggatcgtcgaagattggactccctggtataccagcaagcaggtaaaaatcacatttgagatttcttcattaatccaaacataatataggctgaatttgtgtcttattaaaatatatatgtattccaaatttatgaagaaacatttttttgacaggtgggaggatggaccattgcaaacgatggacttacttttgttaccataagaggtgctggtcatnnnagtnnnntacnnnnnnaccca

SEQ ID NO: 2001 - DNA, 437 bp, Glycine max
caacttcaccggagagctatggtctgtttacttctctcagcatagtggaggaggatggatacatgcatttgatctggagtttaataaggggaataagccaattgtttattcatcaaaagatggccatgctagcttccctcatcccgggacgtaccttcagggatcatccaaactaggaattggagtacgcaatgatgcagctcaaagcaaatttattgtggattcgagtgtcaaatatcagattgttgcggccgagtatcttggtgaaggagtcattacagaaccatgttggttgcagtatatgagagagtggggtcctaccgttgtatatgattcacggtctgagatagagaagataataaatctgcttccactatttgttagattttctgtggagaacttatttgaactatttccaactgagctttatggtgaga

SEQ ID NO: 2002 - DNA, 358 bp, Glycine max
ctagtaatcacaacaacatcaactatgggtggggattggggtgtcttatatatgatgtaagaatactaattttataatttatttgtatttgtttctttttatttgctgcactttttagtgtttcttttctgtgcctgctgaagtacacataatgggtgtaatgtggaagagaaattgtgattcttgtgttcattctggtccgtcaaaagagtgcaatcaccttgcttacttgcttttctcactctggttggttcatttggagtttcatttccttctagactgaagtttataatggttgcttataatttggacaaaattagtgcatgtatgttcaatactgatagctttcaatcggtgc

SEQ ID NO: 2003 - DNA, 371 bp, Glycine max
ccaccgaggtccctaattctcgaacccaacacaacttgaatatgttgcgtgttcaagagatgaagtcaagcactgtaactggcaattgatattttatggtttttggcggttcacagctcaatatcctttccttatggccagaatattgtgaaaagaaaggaagggaattgtattttattttttaaatttttggctaaaggagggattttcattgcttcttacatattgtatttagtactgaaaactgctttcttttgagcatgaaaatggcttataatctctaatcaaagttactactactactactactactcgtgcctggctggctacctggagtactgagtttactttggttctttatccctgtttcg

SEQ ID NO: 2004 - DNA, 386 bp, Glycine max
tccgcgtagcagtgatgcaacctattcatatagaccctgaatccatcaagccaccgaagagaaggaacgtgaagatttcaaaagatccgcagagtgtggcggcgaggcacagaagagaaaggataagcgagagaataaggatacttcagagattagttcctggtgggaccaaaatggacacggcttctatgttggatgaagccattcactacgtgaagttcttgaagaagcaagtgcagacgctggaacaagcaggggcaagtagacccttgaatgttgttggcttccctactactgcgtccaacgccaataataataatagttattctggttttgtgaagagttgtcagccttatccaatgctgggttctgcagcttctaaacaa

SEQ ID NO: 2005 - DNA, 1019 bp, Glycine max
  misc_feature (920)..(922): n is a, c, g, or t
  misc_feature (925)..(926): n is a, c, g, or t
  misc_feature (933)..(934): n is a, c, g, or t
  misc_feature (937)..(939): n is a, c, g, or t
  misc_feature (943)..(945): n is a, c, g, or t
  misc_feature (965)..(969): n is a, c, g, or t
  misc_feature (993)..(995): n is a, c, g, or t
  misc_feature (1004)..(1005): n is a, c, g, or t
acagtcatattgttgctctgattattaactttgtttctgcatgcatcacaggtttgttgattcataaacattttgtttccactgcagtgttgttgaatctgtttcaatgaacaaccgatttcattttcttccttattttcaggatctgctcccctcacagctgttcagttgctttgggtcaacctgattatggacactctgggtgcattggctttggccactgaacctcccaatgatggacttatgctaagacccccagttggaaggacaacaaattttatcaccaaacccatgtggaggaatatttttggtcaaagtttatatcaactaattgtccttgcggtcctcacttttgatgggaagaggctactgagaattaatcgtccagatgcaactatagtgctcaacactttgatattcaactcctttgtattttgccaggtaaagtatcacatgcatcctctctaacaccgtgatgattgtaattggcaaatagatggttagactttttaaagaaaccacatgatgttttaatccaaatagttgataaaaagtggaagaaaagttgaacatgattaaaagatataataaagcttggacagaagaatgtgtcatataataatcttcatttgttatgaattctgtaatttgaattacatattattgttactgttatacttgacctttatgtgaaaataagatatatgaaaatgtgaatagcggaaactccctctttttgggtgtattgatgatttactgaaaagttctaaaataaataatacatgaactgacaactgaaaaataagatatatcacaaactcaaaagtcatagtaacggtgattgcgacagtgcatgcttaattgactataaaactcagttttaacatgttaatacctttgctattcccccatatgattcnnncanntttggcnnttnnntacnnntggtaaaccattcaagatgnnnnnaaaatgatcgagttccattgcgtnnngcttatttnngtgctgttcacctc

SEQ ID NO: 2006 - DNA, 436 bp, Glycine max
tgggtattcttccagctatgcttgtaggagttgtggtgaatgttgtatttcttatagccatgtattggaaggtgttatcttgtcctaaggatgaagaggatccaatctcagaaattgtagtagaagaggaggttgtttctcatcagttttctccagccagaatgtctcattttacatcctttaattctcaagaatgtaatggcagtgtagaccaatcaactccaagtgaaagcgaagttcagatgattcataggagcacaaaggattccacaaaaaactcaaatgcatccaaggaggggacaaatgacacaaaggaggaaattaataatccttcaaaaaatgttgcaatagtagtagataaacctattgaagcacatgttatactctcttcagaagaaaaggactacatgaacaacaaatggaagagggtactgtg

SEQ ID NO: 2007 - DNA, 873 bp, Glycine max
  misc_feature (46)..(48): n is a, c, g, or t
  misc_feature (854)..(855): n is a, c, g, or t
ccatgagacaagaactcagtgggtcatgcacgaattgcgccttgtnnnttcctacccatgtcaggtaattaaagtgagaaatgttgatatataacacatttcttttttccatgctattgatacaaattagtttctatcaaaagtgatgactaattttcattggaaacaataagcgtgcacataaggtgaacatgttgatcctaacatgatttagttcatatttaaaaatcaataaggattcgaaccttagatcatttaattaagagatacaagtcattactaattgtatcaacttttgtgtggtatataacacattttttgtggtgttttcttcttttaaatatattttttattattgattcaaatttattaaaaattataaaattttgtatactttgaaagtctcactttttatttaatatatttatgttgaaaattctaataaattttaattcagaataaagagggtgttaaaaaaagtatttagaataaaagagtaaccattatttcatttagtattgtacatattttgttccaataagagagttgtgccaaagctgcattatttttgtttggctttccagtgtttgacctcttgagaatttttcaattctaatgcagatgccagtggcagattttgctgtgtatcgcatatttcagaaaaacaagatgaagacaagaagatcacatgggaagaagccctctagtagcagcaaacttcagagacttgttgatgttaaagctagtttctttgacttcactgtggattttaatcatgacgatatagggcctcccacaccttgttccccatgtctaagtgaaggctgtagtgaaatctcctctagcaagttagnntaggatttaggagtagaa

SEQ ID NO: 2008 - DNA, 1522 bp, Glycine max
  misc_feature (54)..(58): n is a, c, g, or t
  misc_feature (1470)..(1476): n is a, c, g, or t
gcttcttctagctggtcatcgatatttggatgtaaggtaagtaagagattaccnnnnntaacgtatacataacataacgcatagagtgtttttggaatcatgttgcagaatcagcctaaaaccttatctcttcttcttcctctattttgtgtgcaggaccccggaagagttcgatgctggacacgctcctggcgcaattaacataccttatatgttcagagttggatcaggttctatttcaattctcaaaattgtatattaaattataaatactatcatcttagtggcaatgttagcagctgctttgttgattcctaatgcctcccaaaacaaaaatagctacctgatatagcttgttctttggacttggactcttctattaatttattgacattttggtttgggaaaatattttcttgtttctatgttcaaaaatttatatagaaattactcaaaataaattttattattttctattttcagcatttcctatataactacttggccaaggcattttattttcactatcttatgcatccaatgaatccgacccaattgatagtttcaacttcaagatgatgtcaattgtgactcaatttttcctatccctgaaatgcaattacttttgttgaaagttcaaattaaaatatcaatagtggttacttgcaagagaaggttatatatttagtgttaaaactaatactctaatatggtaaagttatatacagggatgagtcttgtggtcctatgtattttttattttgtctaatttgttaatatattctccattcatgtattcagggatgacaaagaacagcaactttattagagaggtgtcttcacagtttaggaaagatgatgaaattattgtcgtgagtgcatatcttcataaaactattattcagtcattaaattttttgttatttttagcacccctgcttaatttcgatgttgacttctggtttcccaggggtgtgagcttggtaaaagatctatgatggccgcaagtgacttgctagctgctgtaagcattttttttcttcaatgccttaattttggaatccgaaaacaagcatcctagtttgtttgaaagtctaaataaagttttattttttccacatcaagacatctttcagggctagctgtatacattgactatttcagcctttataatcctctttcaattctttagaaataatggaataaggttgctctaaattaacttgtttctaaagttagttttgttatttaatttgaagtgcaacaagatcttaaaccattgaaatttatggatgagtacaacctttatcattcatgtttagaggaatttcttcttggtttcttgtcattcatgtttcctaagaatagtttgatgccttaccatcttgcaatatttcttcattctgcaggggttcactggactcacagacatggctggtggttatgctgcatggacacaaaatggacttnnnnnnnagctatgaagtgtttctgttggaactgtagctgtaaatagaataag

SEQ ID NO: 2009 - DNA, 491 bp, Glycine max
  misc_feature (452)..(452): n is a, c, g, or t
  misc_feature (480)..(487): n is a, c, g, or t
ctgaggttgacctaatgtgcgctatgcagcttccttttcagggtaattcatatctgttatattacctgttgaaagaaaattatcttttctttaattatcaaaacaatacccatccaaactcttgctttaagctttagttacaaatgtttttactttcaagtatctcatttagcttcattgtcaaacatttctcaatgtcttcagctctttgtagttggtgttattcaaggttcaccaaaggaatttgctttgctgctttgttttttgtaaatacttattttcagttaaagaaaattaacagtaactagaaacttgggaaaatgaatatactcctcaggtatggattttatggtgatgtcatcacagagagtgagaagtatcgctggatgggtcccaaacgttatgattacgctggaacaatggtatttttaaagcacaggtaatctctaagnggatgtgatattatctctgcttttaatnnnnnnnnctga

SEQ ID NO: 2010 - DNA, 495 bp, Glycine max
ggggtgtcagaagagaagcttcagaatatgattgaagtttggaataaggtaatacaagtatataacttatcttctcttcaaccaaaatgcaagaaaaactgtcgactatatctctctctgctcaatctctggaaatgcttagattgatatggaagaagaatgcatggatgttgatgaatatcttgatgatgaagacaaagatggagatgctgatgaaaatagcagcttcagtggagaagatgatgtgaaatctgaggtattaccagaaagagagaaagatcgtgctgggagtatttctggtgcagaaaatgaaggcatcaaggaggttgactgtgagggcatggaagaaaaagaagactattccgatggttggctatatgatgatgatttggttgatgaagatgaattttgttcaccttcaacggtggccaaccaacaaaatgagtcctataaaaaggacaacagtgtcgtgaaagatggctcgataggacaatc

SEQ ID NO: 2011 - DNA, 407 bp, Glycine max
gggaagcaagaagtgatgattggatactcagattcaggaaaagatgctgggaggttctctgcagcatggcagctatataaggctcaggaggaacttataaatgttgccaagaaatttggaattaagctaaccatgttccatggtcgcggtggaactgttggaagaggaggtggacctactcatcttgctattctgtctcaacctccagacacaatccatggatcacttcgtgtgacagtccaaggtgaagtcattgagcaatcatttggagaacaacacttgtgctttagaacactacaacgtttcactgccgccactctagaacatggcatgcaccccccaatttctccaaaaccagaatggcgtgctttgatggatcagatggctgtcattgctactgaggaata

SEQ ID NO: 2012 - DNA, 472 bp, Glycine max
cagcttgtgtgatgagaaaaaggagaacatgaatttgaaggctacagagttgaggcttggtcttcccggattccaatcgcctgaaagggaaccggatcttttctctttaagctcaccaaagcttgatgagaagccactcttccctttgcttcctactaaagacgggatttgctcgtcggggcagaaagctgttgtttctggcaacaaaagaggttttgctgataccatggatgagttttctcaggtgagaagagaagcttcaagttttccatactgtgagaaatggattattttttttggcaatatctgagattgattattacaatcttttgtgcaggggaagtttgctggtaatacagggatgaacgcggtgctatcacctagaccttctggagctcagccttctgctatgaaagaaacaccaagcaaattgtcagaacgtccttgctcaactaataatggaaccggtcaa

SEQ ID NO: 2013 - DNA, 373 bp, Glycine max
ttttgccagttacacaagttaaagcaaggttttatagttacactacagttgagcatgatgagatctgttatttaaatccttgagttatggttaagggtgaaattgaattaaacccaagaatgaaacagctcataaagaaacctacttctacttttttatacaaggctctcaaagtagaatgtgtgatagtcaccactcaccttagttcattagataatgaggaaaattcttattgcatcttaactttatctttattctcaggattactaaccatatcgatagtggcttgttttcatcatttactgtaatagtcagcttttttcacaaggataaggtattatgggatgttcagtggagtatttaagtggcttgg

SEQ ID NO: 2014 - DNA, 396 bp, Glycine max
  misc_feature (32)..(32): n is a, c, g, or t
gactggggtaaggaaaggtggcccaatagccnatttgtaaatggagaacacgctttaaagtttccactatgtggaaccttccctgtgaactttttcagggtggtgtggagaacaacatatgtcatcatcactgctttgatagctatgatgtttccattcttcaatgacttcctaggcctgattggttcactgtccttttggccattaaccgtttacttccccatagaaatgtacattaagcagtcaaagatgcaaaagttttccttcacttggacatggctcaagatattgagctgggcttgcttgatcgtttctattatctcagctgctggctccatccaaggcctcgctcaagatctcaagaaatatcagcccttcaaagcccagcaataatta

SEQ ID NO: 2015 - DNA, 887 bp, Glycine max
  misc_feature (63)..(67): n is a, c, g, or t
  misc_feature (539)..(539): n is a, c, g, or t
  misc_feature (636)..(639): n is a, c, g, or t
  misc_feature (683)..(687): n is a, c, g, or t
  misc_feature (697)..(703): n is a, c, g, or t
  misc_feature (707)..(708): n is a, c, g, or t
  misc_feature (720)..(722): n is a, c, g, or t
  misc_feature (727)..(729): n is a, c, g, or t
  misc_feature (731)..(736): n is a, c, g, or t
  misc_feature (739)..(740): n is a, c, g, or t
  misc_feature (744)..(750): n is a, c, g, or t
  misc_feature (752)..(753): n is a, c, g, or t
  misc_feature (756)..(759): n is a, c, g, or t
  misc_feature (761)..(765): n is a, c, g, or t
  misc_feature (770)..(773): n is a, c, g, or t
  misc_feature (776)..(777): n is a, c, g, or t
  misc_feature (781)..(782): n is a, c, g, or t
  misc_feature (788)..(792): n is a, c, g, or t
  misc_feature (794)..(797): n is a, c, g, or t
  misc_feature (800)..(806): n is a, c, g, or t
  misc_feature (808)..(808): n is a, c, g, or t
  misc_feature (810)..(813): n is a, c, g, or t
  misc_feature (816)..(819): n is a, c, g, or t
  misc_feature (825)..(825): n is a, c, g, or t
  misc_feature (836)..(841): n is a, c, g, or t
  misc_feature (843)..(848): n is a, c, g, or t
  misc_feature (853)..(857): n is a, c, g, or t
  misc_feature (859)..(860): n is a, c, g, or t
ccctaatcttcgacctactcctttgcacttgaggaggatttggagcagcttaaagtccttgannnnngctacaagatgaaggtaccctaagttatttattcaagctcttattattatttcatctttatccaattgacttgcatgttttttacttgattattctaaactgaccttataatctcctaattataatcaaatagccttcaaccagggtttggttgccaacttgccatttgatgtgagtagtccaaaaaccattgtatattcaggttctctaataaaattgtctctgtctgactattgaactgaacacttggtgacagctctagttggtaagatgctgttaggaaaccctctattaagagagtctatgttaagaatgagaaataggggagcaccaggtgatctaacccctgagacattgtagtagtatagcagaaaatctgttttagtataaacaaatattgcttttaaaaaaaaagtataaacaaatattaatagaaagcgggttacacaactgcaaaataaaaaaaaaaatngtatcaagattgtagctactactaaaaactgaatcattattatacactcgtacttgtagttgatggctgggctttactcatctggtctgatgtgggnnnnattatttatttcatttctggacactttataaaattgtttatttnnnnnttctgctatnnnnnnnaaannttcatcatgagnnncatgnnntnnnnnntcnntaannnnnnngnnaannnnannnnntaatnnnnganngganntttttnnnnnannnncannnnnnncngnnnnacnnnnatttgnaaaattaattnnnnnnannnnnnccccnnnnncnnttaaaaaaagttttttttttttttttt

SEQ ID NO: 2016 - DNA, 408 bp, Glycine max
ggcctgattgagattgctagtgggtgccatcagttagagaagcttgacctatgcaagtgtcctaatatttctgacaagactttaatagcagttgcgaagaactgtccgaatctggctgagttatccatagagtcatgtcccaacattggtaatgaaggtctacaagctattgggaagtgtcccaatctgaggtcaatctcaatcaagaattgctccggggttggtgatcagggagttgctggcctcttgtcttcagcttcttttgctctaacaaaggtgaagcttgagtcactgactgtttctgatctctctctagcagtgattgggcattatggtgttgcagttaccgatcttgtcctaagttgcctcccaaatgtcagcgagaaagggttctgggttatgggtaat

SEQ ID NO: 2017 - DNA, 639 bp, Glycine max
  misc_feature (601)..(601): n is a, c, g, or t
  misc_feature (634)..(636): n is a, c, g, or t
gtttaacgaggtaatttcctttgttttttctaaaactttacttacattgtttcaaagaatacctaagtacttaaccatggattgacatagtatcacattcttaaacatctcggtgcacctattggaaatgttaatagaggtccgcacacttccattatgaaatgcaatgcgatcattgaagatttaaactcaattatattgaactgcagtctattcagttctagaactttactaatcactacaagtgtttttgttcttttttactacacttatgacgtgattatattgagtcatgactcatgactctacacttaccccagagacaagaatatctgattgttatgtatgatgtttgacgatgcagggatctgagtgggactttggtgtgttttctggccttgaaggcgttgagaaaccaaacccgaaaatttacgagattgcacttgagagggccggaaatattgcacctgaagaagctttgcacatcggggacagcatgcgcaaagactatgagccagctaagagcatagggatgcatgcactattgttggataggtttaagaccccagatgctgtggaatggaggaaatctggtgcagtngttcttcctgatttattggcagcaaaagaatgnnnctc

SEQ ID NO: 2018 - DNA, 940 bp, Glycine max
  misc_feature (886)..(887): n is a, c, g, or t
  misc_feature (889)..(893): n is a, c, g, or t
gatcttcattgcttcctcttttggatccgcttcattcgcgttcaaaccaacgactaatcataactcttctaccggatccctcattttttccctttcctttctgcgtttaattcatatcggagaaggagagagagaaactgcgacatgaacaaagcgactcttccgttgacgttaattggcgatggagacggtgaccgaaaggtgactaaggtggcggagcccggtgacctcgtcattgcgcttcacgtcctcaacaccatcactggtttctctctctttctctcgcttctctctctctctctctctctaacgtttttcttaatctgaattggtgactgcaacagaaattcactcaattagggttttatacatcggttcattaattatctcaatttttaaaattattgtgattattattcgaaatttgaagtgaaccatatgtattcatggcatcaagtttctttaacactaatgaagaagttcaggaatctgcacaggtatcaatttacgcatttatcatcacctttgttcgatttttcattcaattagcttgtgcgtttatgtaatttgtaatttatttggttctgaagtagaagttacttaatttgtgcctttttctactctattgtattttgaatacaaagaatttagaagcttggaagttctacgtttattttcatgtattaggcttgcgaagagtaaaaaaaagtgagtttgttctgagatacaatatagctctgtttgcaggtcatgccattggggcaaatcctgcaattcctagaatgtttccaaatatgtttccactggttataagtcaggtatatttttgtttctttttgccaactctggttatgcaatgcgatgttttttcatttatttcacacannannnnntctttcttaagttgcagctatctatgtactcctgatatggttatata

SEQ ID NO: 2019 - DNA, 576 bp, Glycine max
attcaatcaatttaggcagaaaatgaggtgttttggttttatagtgataggtctagtggctgtgcttggagggttacccttctcctcaaatgcaaaattagaaccctgtttttacaagaagacttgtccccaggtgcattttattgtatttaaagtcgtagagaaagtttcaagaacggatccacgtatgcctgccagtctcgttaggcttttcttccatgactgttttgttcaagtatgtaaatttacttgcttattcatcctccctttctatctaatttagttaatcctttcctgctttaaatgacaaatcccacaattaaaatcaaaataaatcccttgctccaattttattttttttatctctaagtgggtttattagtctcacaaataattaagctcgtagtattttgaattcttttatcactttaggtactctttttccatttaaaacatttaataagtcatatttgagtttgattttcatgtattgttggtataaaattgtttatactattaaccaaacaaaaataatttaggtatgacttttaacttagttattatgtaaaaaaaaaa

SEQ ID NO: 2020 - DNA, 396 bp, Glycine max
gttggctcatccttcggtggcatgcttcttgacacattgtggttggaactcttcaatggaagcactcactttgggagtgccaatgttgacatttccagcatggggtgaccaagtcacgaatgcaaagtttttggtggatgtgtttggagtggggattaaactgggttatgggcaggctgaaaagaaagtggtgagcagagaagaggtaaaaaagtgcttattggaagctacagaagggccaaaagcagacgagttgaaacaaaacgcgctcaagtggaagaaggatgcagagaccgcggtggctgtaggtggctcatctgccagaaatctcgatgcatttgtgaaagaaattaaaaaacgtggagctgttggggtcagcgggagataagtctataa

SEQ ID NO: 2021 - DNA, 403 bp, Glycine max
gcttcatcctgtagctcagtcttcccatccagctcatataactacaggtatgatcagcataacagacattactttaagaggcaatgcgatggattggacgatgggcaaaaatggagggtttagcactataatatccactgggttttgtcaaccggatgttaattcggatgctttgatacgtgtttctggcaagactgcatttgtgttgtcgcatggctggattttcctgactggtttctctgttcttattctttcactgagttgcaagatcggaagcatcatgtatactggtaaatgactacaaataaggttgacggctactagagaataaggagcagtcagttaagtataatttagtgtttggtggtactcattgaatgagtaggatcccgtgactttgtaa

SEQ ID NO: 2022 - DNA, 399 bp, Glycine max
atcactcaagagattcaaccaagaaatatagaagctagggttttgttacatttgtgttagcacgcaaaactttgcaaatatggagagcagcttaggagacatgttggttaaggttgtggtgttcattctagttcaagccttggtttaccttatcctctccaattcatcaaacgtgttcaacaagaacatgaagaaatctaacagcttcaggccggcacgttcggtgagcattcgccggatgctcgctttgatctctgattttcctccagaagaagaaccctctccttcaccgaagggtgctaaaacaacatcacttcatcaaagtgatcaataattgtaaggatttaattaaattgtggctgcaattacaaattggagacaatttcagcttatcgggtg

SEQ ID NO: 2023 - DNA, 632 bp, Glycine max
  misc_feature (51)..(52): n is a, c, g, or t
gctacaagcacaaccacaaacttgtatcgggcattgatcaaacaaattacnntatattaacagctacgggcttccccctacccattgaaaatcctcttgtaccatccggcattcggggtccagggggttgcttggcaacgacttgatcagtgaaaattgtattatttgaagagggtgttcccacacgattattttgatgacaatgtactcggccacgtcccttaccccggccccggctacgaccttttctttgcccactctctttgtcatgaccatgctcttctccctgctaatttaaaggaattatggcctaaagcatagaatatgcaaatgccagtgctactttgtcctcaaactacgagttaaaaattttcgcatgacaatcgaagaggacacggacatatgcagttaaaaaccattgttctcagcatatcaaaggcatattaccaaaatgacccaaatcaaatttttctttttaagggctcaaacatgtttggaagggttcttaaactcgtgcgggaatgatttccaagcacacacgcactcacaaagacatatgctagaaactgtataatttggttatggagttaacaagggataacaaagagcctaagtgccgtgcaaaaaaaaaa

SEQ ID NO: 2024 - DNA, 380 bp, Glycine max
actctggagaaacttttctccacagggctgtgtccggttttaaatctcatgcattcagaagattggacaagcaggttgaacttttgagaaacatgctgagtgggaagaactttcatgtggcagacattatcaatgtcaagaacaatgatggaagaactgctcttcacatggccatcataggcaacattcacactgatcttgtgcagctcctgatgactgccccatctataaatgtgaatatatgtgatgttgatggcatgaccccactagattaccttaggcaacaccccaaatctgcatcatcagatatactaatcaaaaagttgatctcagctgggggaatgtttggctgccaaggccatagttcaagaaaagcaata

SEQ ID NO: 2025 - DNA, 578 bp, Glycine max
tattaatcccaacttaattaatatagcctgctattataagcaattttttcctttgtaacattttcattttattcatcacaggttcttgatgagattggagtggatattgcatcccaggttggttttagacacaacatgtatccattgtctttgcaccaattctttcatttaattatttttctgaatgttgttgagcctgatgctggtcttttatgttgctagttatcttctgctcccaaagggcgtattgcttcaaggaatactgaaaatgttgctccaaggtacatttcaaacttattcatggaaaatgcattctatacattccttgaccattggtttttgtcatgtatacagtttcttttattggttatgtggtataatactttttattagatttaaattgattgatctgccagttaaagcttttaaatgcatttagatttttttatttttttatattatttattgattttgtgttgattctgttattttaagagagaaatttctttttgttgatgcagaccagcagaatcccaagatgtcgaagaacttgaaaagagattggcttctcttcgaag

SEQ ID NO: 2026 - DNA, 335 bp, Glycine max
ttggcaccaattgcaagtctttagtggaacttggtttaagcaaatgcgttggagtgaccaacaagggaattatgcagctagtatctggctgtggcaatttgaagatacttgatttgacttgttgtcagttcatctctgatacagccatctctactatagcagactcttgtccagaccttgtctgtctgaagctagaatcttgtgatatggtgactgagaattgtctttatcaacttgggttaaattgctcacttctcaaagagcttgatcttactgattgctctggcatcgatgacataggtaaactatggaatctctatctttttaaataatat

SEQ ID NO: 2027 - DNA, 384 bp, Glycine max
cacttatgtttttactttgcttattattagcatatttggcttcacgtttcggatgtgattttccacgtttagttgtgattttgaaaagctaatagctttagcttccacatcccaaaggtgattcctctgttccggactggtttccaaacatactatatgatggatatattttgcgggttacaattttgaacgatgtgcatgggaaggtgaagatgttagtgacttttcctgctattagatatacatatgtagagctaatgcttgagacattagccaaacgttggagaaagaaatatgatatttatttatttattttgaaatgcttaggatgtaatactgagtaagtaatttgctagaactccgaactaccgagtaatatagcta

SEQ ID NO: 2028 - DNA, 319 bp, Glycine max
atgttttcttattctgaggatcatttgtgtgagtcgtgtgaaaaatatttcaggttttatgttggctaagaggcctaatgtttgggccctagaaatctctggttaaactgtgtaaagatctgttacttggtttaaagtttgtgtgttttgttcacttccaaggaatttatgtgtgcaagaaagatgtaattgaaaaatttagcaatagactaatggttttatatattctatgttgcaataaatcttaggatatgtatatcactggaacagattcactatgccagtgtgtgagaaagcaatgatagttctaaatcctccc

SEQ ID NO: 2029 - DNA, 397 bp, Glycine max
gaagtttgctttgctatctctcaccaactaagcaaaaggcatgctggaagatgaatttttcttaaatagtataacttttgcttaattcttttttgtagctctattgctttgcagcatgttgagtggggaaatagatgccttgctgattgcagtaaatagttgccactcaattttatgttgctatgcgaactacagtttgttcccctttctatctgtctctcccgtaagtggtttactcattcaactagtgtttggtatcattttgtttcatgtgatttagtttgttcaagttgcttgaggaagttgtaattgcacagactgtcttattccttattcattcaaatatcaagaaaaattaaagggatacttctagatttcttgacggtatccactgtga

SEQ ID NO: 2030 - DNA, 729 bp, Glycine max
  misc_feature (60)..(63): n is a, c, g, or t
tatacatataaagaacaatattcaataattatactagtaaattaacaaggtgttttgtannnncttttctacttacgcatctcgaaatgtcgcattagcaagcttagcatcagtcgcaaggatcagagaaaaggctttattgggtggcaaatttacgaaaagactggctccctggtacgtatgatagaaatagaacgataacactaagatttcctttgtttgaagagaaagaaaataataatagtaaaatttatatatttatatttttatatttttatttcgttttatatctaagcttacgtttcaatgccagggaaaaaaaaagtaaaaatgaaaaaatagaaagacaacgaccatttttataataaaataatttaacatttttttccacttatttcaagatatgaaaacttaattgcaatattttttacgtagcatgtccataacaaataattttagcaagtttcaaagtcacccaatagttagaagataccgtaatttgcctattgttgatggttaaattactgctaaagtctctgtctaatgtgctagcagcaattgtgaagacccaaggagccacattgagaacagttccaggtgtgggtccatcattccctgcagaggcaactaaaattctgtttctagcaattgcatgaaatgccccaatggaaacctcatttgtgaatattccttctggagtcacaacgtagcttccaccagcagaaagac

SEQ ID NO: 2031 - DNA, 507 bp, Glycine max
ctttccattccacctgatcttctcttcaccataaaaaggagctattttgattcccctctgtcctcaaggcttttgcctaaccagccacagcactgtaagttttttccttttctctctctctctctctctctttttctgtgtcactgtgtgagaagtgagagtgcaaatctttgacaaaagggttttgtttgttttgttttatcgtgacttgtgtgcagttggatggaactaccttcagatgggtttgggaagaaaaatagaccctgagccaggtaggtgtagaagaactgatggcaagaaatggagatgctccaaagaagcatacccagattcaaagtactgtgagaggcacatgcacagagggaagaatcgttcaagaaagcctgtggaagttttaaaatcaacaacaacaccatcatcatcaacaacaaactcaaatgcttcttctacacaacaagcaatctcatcaatcaccaaaattaatagcactctctcacctcttgcatc

SEQ ID NO: 2032 - DNA, 333 bp, Glycine max
atcggtgttagagaacacggaatgggagctatctgcaacggcattgctcttcacagccctggactgattccatattgtgcaaccttctttgtattcactgactacatgagaggtgccataaggctttctgcgctgtctgaggctggggttatttatgtcatgacccatgattcaataggacttggagaagatgggccaacccaccagccaattgagcacctagcaagcttccgggcaatgccaaacattttgatgcttcgtcccgccgacggtaacgaaacagccggagcatacaaagtggccgtgctcaacaggaagagaccctccattctt

SEQ ID NO: 2033 - DNA, 391 bp, Glycine max
  misc_feature (224)..(224): n is a, c, g, or t
gaccagattggacccatcttgggaggtccaccccttcctcagttagtgaagaatgagtaggagccttccctgtaagcagctccaaaagcatgataccaaagctatagacatcggctttttgggatattttgcgtgcatcagtgacctctggcgcacggtaaccagacacacggtttggtgtagaggttgggagagcaaggtaagcaaggccaaagtcagagacncgagcttcaaaagttttggtgagaaggatattcgatgacttgatgtttccatgggaggatgttgggccatgcgaatgaatgtatgcaatcccacgagcagcaccaagggcaatggcagaccttgtttcccaattcagtggagtcctccctactccaccatttgcatg

SEQ ID NO: 2034 - DNA, 366 bp, Glycine max
  misc_feature (310)..(310): n is a, c, g, or t
gatgcaacaaagaggattttcctgaagaagattttaagaaggcttttaggatgggaagagaaacttttgacatgatctgtgaggagttgaattcagcaattgtgaaggaagacaccactttgaggaatgctattcctgtgaggcaaagggtggctgtgtgtttgtggagattagccactggggaccctcttaggattgtgtctaagaggtttggtttggggatatcaacttgtcacaagcttgttcttgaggtttgcaccgctattaagtctgtgcttatgccaaagtacttgaattggcctgatgaggntgcattgaggagggtgaagagtgagtttgagggtgtttctgggatccctaatgttg

SEQ ID NO: 2035 - DNA, 376 bp, Glycine max
tcttatttcttgattttccagttcagtggaagtctacatatctcatgcttgaaactgcactagaatacaggagtgccttttctctcttccaagaacacgatccctcctattcagcaagtctaactgacgaagagtgggaatgggctagttctgttactggctacttaaaacttttagttgaaattacgaatgtattttcaggcaacaaatttcctacagcgaatatatacttccctgagatttgtgatgtccatatgcaattaattgactggtgcagaagttcagatgattttcttagtcccatggctttgaagatgaaggctaaatttgacaggtactggagcaagtgcagtttagctttagctgtagccgcagt

SEQ ID NO: 2036 - DNA, 490 bp, Glycine max
cattttcaaattggcaagtttttcttttcaaattctaaatttgttgttcttggtacaaatttgtgtcttaatttgattatctgtagaattgtagtagtaagtgagcttcacttctttgcaggtttgctgttatacatggtaaccttatcggtgctcaagctttgtaccgtcaatgcagttgtttcccttctctttaacatggcgccacccaagaaaacctcttagctccttatcggttttggggtccaaatccaaatttctttcctcattcatctatttacaacccattgatctatatccatgactatcttctatgaatgagatattttgagggaagctcaagagagattttacctacaaaacattttaaagacatttgttaattatataggtttttgttgttttgtgtttcttttgagttctagtctagggaggatctattgaaccgtcaccacaaaaacaaaacgtagtgttgaggagataatatttc

SEQ ID NO: 2037 - DNA, 406 bp, Glycine max
ttcgtcttcttcttccaacgtgaagcaatctctgtgttcgaaatggctcgtacgaagcaaaccgcaaggaagtccaccggaggaaaagctccgaggaagcaactcgccacgaaagcagcacgcaagtccgctccggcgaccggcggcgtgaagaagccacaccgtttcaggccgggtacggtggcgctgagggagatccgaaaataccagaagagcaccgagcttctcataaggaagcttcctttccagagactcgtaagggaaatcgctcaggacttcaagaccgatctccgcttccagagcagcgctgtctccgctctgcaggaagccgcggaggcctaccttgttgggctgttcgaggacaccaacctctgcgccattcacgccaagagagttaccattatga

SEQ ID NO: 2038 - DNA, 222 bp, Glycine max
ggggcgagagggcttagggtttgttcgtgtgatgtacaaagctgtagtactttcttagtgttattgttttgtaatcgattatgaaacttctattttcactgtgactggattggaaaatcatttgtagtatggaaagtgtcagtggtgaatcttgagaattacatcgtctttggtctttaatctggtaatataatatcccttctagcaagattaattgggaag

SEQ ID NO: 2039 - DNA, 821 bp, Glycine max
tatctgcgatcttttctttttctaactcaattattaagggattttcactttcatcttccctttgtgggtgggtgggtgccgccccatcaatcaatcccttatgccgctccaatattacattctagcactactctactcaatttcaaacaatatcactttctcatttctatattcatttttctttatccttattcactctatcatctaatctctgcctttggctccgtctatttctctctttgaactttagacttctccccttttcttattccatttattttaatttgttactatttctgtgtatgctttttctttttttgtgttgtacgctgttgcagaagaagtctctgcgaactcaattacgttaaccttattcaagtataatagaatgttccaataatctgaaatatccaattgtgtctttgaatcttaacacagaacttatcagatgagcagagaaaatacgccagcaatggcaaaggaagaagtctgtgatgatggttcctccagtgttgagaatgtggatttagaatctcatgctcgaattagtctcgacaaggataatggcttgggaacctgtcgtgtgtgccaatgtaccgaatctgataaaaaggcagatgccgcactagaatttttgggcatcattccaggttcagaaatgtgtaaaaccaagggggaagtgggatctgatggtggtggcgatggaattcccgaaaatacgtctcttgacagaaataatgagaaaaatgctggtatggtggaatttgtaagccctaatggggaggttttcatttgtaaaagcgatttggaacttggtttgg

SEQ ID NO: 2040 - DNA, 703 bp, Glycine max
  misc_feature (44)..(47): n is a, c, g, or t
  misc_feature (49)..(50): n is a, c, g, or t
  misc_feature (630)..(630): n is a, c, g, or t
  misc_feature (684)..(684): n is a, c, g, or t
agacatgtcgagaatcaattaacacaatccaaatataattaatnnnntnnttaattataagataaataacacagagaaaggaggagatgagtgaggctgcagctacgacgacttcgtcttccatgatgcgcaattaccctctcatttccgccatcgttgctttcgccatcgcacaattcatcaagtttttcaccgcctggttcgttcgtttctctttctattgaatgcgatagtttagaaaaattattgaagtttttggtttttttggtaatgatttaagtttttggtttggttaatggtatgtgaatcaattgtgaatttttgtggaagaattgaattatatgacagtgaattgtaattatttggctaatgacatttgatatgtacagtgtttaattgacggttaattattattattattacgtaggtttaaggaaaaaagatgggatcccaagcaacttgttggatctggtggaatgccttcatcccattcggctactgtcactgctcttgccgcggcaatcgggttccatgaaggctttggaggacctctttttgctactgctttggttctagcttgtattgtatgtcttttttttttttttttaagaaaaagggcacagggggttngatttttttgtgggaaaaagggggaaataaaaaaaaaaataaaattttttttgnaaaaaaaaaaaaggggggg

SEQ ID NO: 2041 - DNA, 409 bp, Glycine max
gttatctctcgtcatggattactgcgcgcgcgaggattccgcggagcctgtgattatcattccccgcacgcgccctcggtttcaggcgcatgccgaatccgcctctgcttcgtcctctgattccgatgagaatgcctgcaacggcgctgctgaggaggttgcgatacgcataattggggccggcgagcaggagagcggttcgtcgccatcgtcgtcgtcgaggggccggggaggggagccgggttgtgaggaggcggtggttgggaggagtgggatgctttcgtcggaggctcgccggcgaatggcggaggaaagggtgcctttggtgtctttggatgatgggattggtggcgttagggaatcttcctcttcttcttcttcttcttcttcctcttcttcatcgtcatct

SEQ ID NO: 2042 - DNA, 415 bp, Glycine max
  misc_feature (372)..(372): n is a, c, g, or t
gatgcatttgttggttcggatttggatcttcgtactcgttctactggggctaaccctggaacagcaattaaaacatcatctgcgagaaatgcttctcatgtcaagaactatgaaactgcaatcaagggcattgagggtttgcaattagaaaatgatgagaaggcacattattgattcctcaccttttcatgttgtaaatataagctttggttgacgggcactacaatagttgcatgttgccaaggtgagtcgcgaagggacgtgaatttgaactcagaagtctgggcttgtgttgtttaacccttgtgctcatgctgatcaagcatggaagctgaaaaaatttgagctaaatcagggattgttcttgctatnagaagctgaaataatttgagctaaatcagggattgttcttgct

SEQ ID NO: 2043 - DNA, 455 bp, Glycine max
cacattcaacaaatagattctgatatattttcttagaagtttcttggcttcagcctttttgaaaacagttgcttcgaagctttgtcttttcaaatctatttgtaagttttatatagttctgtgtatgctttttgtcattcttataggttgcatttttattaatttctgggaagtctgtcatgcatgcagattctggtttgtaagaatgaagatttggctccatccacctaatgaagagaatatgcttatcaaccattggacgatactgtggcctgaccattggttacctgtcaaatgaatatgcttgttttatgtttctttgttttgcagaccacatttcgttgtgtgtgtttttggcatccaatttttgagtatcactgtaacactttctttctactgtgtcaattatatttctagctaccgactgtggcgtacagaggctgtgggtgtagtaa

SEQ ID NO: 2044 - DNA, 386 bp, Glycine max
tgtaggcttctgcatggggtttctgcccgtgcatttcagaaggcctgagagaatgcacacagttgctattgttttttcttgcccatgttacctttaattattttgatggtctgctgatgctaactccatcagcagacctcagtgatggcttctgcaagttgaaagcagtggctgataggaatttgtttctgaagctttatgcaacatatatcaatccctcttttccaagattttcaaacacaacctattcccctccttgtttctcactcactttaggttggtggttctggagttagatgcttgtacagttgaaagctagaccaaaaattgtacttaggaccatcagaacctctgaaaaatgttgagttgtcttaaggggcttaccc

SEQ ID NO: 2045 - DNA, 565 bp, Glycine max
atctgatgtgatgcaacaacttgttccaaaaatacagcaggtatgtctgtcacttttggtgcctatttgattgtttgttatactcttcatcttcaacatgcccttatttctatatctagtaggctaatttttgttactgtaggttgaatatgttataatggaaaagcagcaggaaactgcttacaaggaagccattgaagagtatcgtgctgtttcacaagctcggatggaaaaatgttccaatcttaattcaaagagtgttcttgaagttcttcctcgacgacagataaacaactattttgttcagttccgcaaggttcttgattcatgttttgacttaaaaatccagctattttttattttttattttgggatttatacaactctcttttatttggtttcaaatttcttttgttattcagatagcaaaccatcccttgttaataaggcgaatctacaatgatgaggatgtcattcgctttgctagaaagctacatccgataggtgcttttggttttgaatgtactttggacagagttatagaggagcttaaaaattacaatga

SEQ ID NO: 2046 - DNA, 957 bp, Glycine max
  misc_feature (903)..(906): n is a, c, g, or t
atctttttttatttttgaaaagttgaaatgggctattatgttgttagtacatatcgaatagaatgcatgggtgaagtattggtaaatgatggtgttaaaatctaataatttcactatgccatgacaactcccttatttatgcagggctaagaaaggacttcagttatacggtgaaaatagtgtttctaataatatattaataaatataagcagaatgcagtcatgcatgagatctatagacaaaatttgaatattattctataatgctatcaagatgtcctcacttttatgacactgaacatgcaggaactccaatcaatacgtggtcagcttgcttctgagcagtcaaggtgtttcaaacttgaggtaatcattaatgcttctgacaaccttcctctcttaatcatgagaacgtgtttctaaacatttattatctttacattgataaatgaaactttgaaagtacacgatgtctgaaaggtatgcctgatctctccagtggatccaactcagaataatgaagaaatcacaaaacttatgtcgcctaaatgaaaaatggaatgggttgtgggtaaggagtacttttgatgtagagagtatttggtgatgcatacctgcctgggagaattgttgttatttacagtctagacatcccctggtctagtttgtctatctgaggctggtttagaagtttggtgtttgttcttttattattgatgaaataatttgatttgtttcttttttcactgtttgggatgacaggtggaggttgctgaattaagtcagaagctccagacaattgggacactacagaaggaacttgagctcctgcagcggcaaaaagctgcatccgagctggctgccctgaatgcaaagcaaaagcagggttcaggtggtgtatgnnnntggcttgctggtgctcctccccctacccagaaagaagatgatgggtgatcg

SEQ ID NO: 2047 - DNA, 311 bp, Glycine max
ccttgtatctgactgttcctatttaatatctgattgaattggtgcattgcactcagaatacaaataccttaccttacttggaatgttatttttcaatgtagggtggagaaccttgttccatttgggcagaaggatttactcagcaaagatcaaatgcaaaagccatagagtctcttggtagaatgctaacagaaggcattcacacagacatcaccatcaatgcttctgatggaagtataggagctcatagagctgttcttgctgccagatcacctgtcttccgcagcatgttctcacataatcttcaggaa

SEQ ID NO: 2048 - DNA, 418 bp, Glycine max
accctgccggtgattactacgttcagaaaatgcccgagaagttcccgccagcgaattttccggcaagcgcaccgggttattggcctgaaaaacatgtttccggcgaggcttatccgccggcggttacggcaacgtccggcggaggggaaccgtcggtttatatgattccggcgccggggacgttctatcatgcaccagttatgcggcctccggccactcagggatactacgcagtgcaacaaatgggttctgataattaccgtgaagcaccggtttatggcggtgttccgccgcctaaagcggcgattccggctagcttggcgccggcgcagcagccggttaaggctcccgcgtatacggaaggattcggaatggttcggccaggtgggatgctggataatacggttggtccgtactc

SEQ ID NO: 2049 - DNA, 347 bp, Glycine max
gcaaattctagaaaaaggaagactaattaatacccatggtggttttctattctggagaaatccgtgcagagaatgataaccaaatggtatacttttctactatcaagcatgtcttatagtaccaatacccttaaaacaaagtaaaagatgaagttttttttttttccaaaaaaaaaagggggggaaagccaaaaaattttttttaaaaaaaaaaaagttttttttcccccgggccccaaacccttggaaatttgggtccctgggaaagaaatttcggcccccaaaaaaaaaactttttccccccaaaaaaaaatttagaaaaattttccccccttggggggcttttt

SEQ ID NO: 2050 - DNA, 601 bp, Glycine max
ttggagctcaccggtaagtttggtactttgtcgttatattttcaagctttgatgaagtccgaggatattttaaattttttggcaaaaccttgaagttgcagaacgatgttcttaaagattgcttgaacatttcttcataaagttttaggttaacggtgatcaagcatgattctagaatgaactacacatccccatttatcggttggcccttggcttgccatgatgtttctaggatatgactgaatcattgtttctcataggttgagatgactactggagctacaattcatacaacacaagggttgaagatgactgtaactcacagaataaaacctcctattgtgccctcattacagatgtcaactttggaagtggatccatccataagcctttctgatcaagatgaagtaagtcagaaaggcgaagtttaccaggctcaggctcagtcctaattgctgctgtataacaaatcataaaccatacaatgagtgcaaaggggggaaaaagtagtattctttatattcttttagctgcttgagtgaaatttgtagtatggtgaggcttgatatccccaacatcccccaaacccagctcctgcaag

SEQ ID NO: 2051 - DNA, 539 bp, Glycine max
agagggctatctgaaaatcgcattgataagaaagtttaatgatggaagcgggaactgctctcagtctccgactccacactcgcattcccattcccatcaacactgccaattcaaataccttattattccaacctcgcttcactctttcttctcattctccttcttccttttccgcttacagttacagaggccccacaccaaaacgccccttcctcgccgactgggtctcccaaaacgacgacctcgttcgcaccctcccaatctacgtcggctctgcctccctcttcgccgtcctcctaaaccgctccctctccggcatcgcccccgtcgtcgacgccggcaggcacgtccccagtctctctctctctctctctctcgctctttgcttagctcaattgattcagaaaatgcacgaaatagaattcctaaattgtggcttattattaggccttgtttggttgtggtgactggtgagtgattggcattgttgtgctgtttttgcagttcgcagtccagagctgacctcttgactttgggat

SEQ ID NO: 2052 - DNA, 639 bp, Glycine max
gacttggctcaagtgagtatttgatgaattgctaatacatggttctcaggtcagattattaatatcagcaaatgctaacgttggtctgcattaatggagagctagggaggaaaatagctttttcttttctcatgttctcccaatttattactttagatgctacatttctcaaggagtttctgaaacctgcttgcaggcatccaaaacacaaaatgtcaaagcaaaccctggtaatggtgcaacccttgagttgagaaggacatcatcttttgacagaacttgggaagagactgtggcagaatctgtagctaatgaacttgtgttacaaagcttttcttcctcaaaaaatggccaatttggttctactgagcaacaagatgaagctgctaagaataaatcaaaagattcaaaaggtgtgaaaggtggtcgttcatctcatgaagaaaaaaaggtggctaagtcacatgaagagaagagatctaggccacggaagatgatggagtttcacaacatcaaaattagtcaggttggtatttttgggccttttggtaaaattgttatctatcatcacttctgatgcaataattcaaattcagctaaatgtcatggattatttcttacaggttgagttactggtta

SEQ ID NO: 2053 - DNA, 362 bp, Glycine max
ctcgattcctggacccttttagtctgaagctctactgatttatgaattatagtttgattggatggtgtaaacatctcgtaaataccactattttggataaaaaatagttgaagaatatctcttatttgatggaatagagagaaatctaatgtatttatatgagataagtaaagatgttaaaatagacatgattgaaaatatgtgagaaatagtataatgttggcttcgaaattttcaatttttctctaccaagccattcaatttcttccaaacacaattcctgccactcccaagtcttctggagaactcggttttatgaattttcctactttctttgtcttaagtttctggctgatctgggc

SEQ ID NO: 2054 - DNA, 430 bp, Glycine max
ggatgtcaacaagtccactgaggaatactattacaccgctgagtggaacgaggaagagaagcaaaaagggttgcaccagaatagtctcaagtttgctgagaatagccgttcagagagaggtaagcgtgtggcctcagcaccaacaccaccaaacacaactccaactcatgcctagcttctccactttgcactctcattcatgcgccttcagcgtatttttaaccattggatgaagatcagacaattgaagttgatcgaacgagataaaatatgagtggtctgatcttcatcagacggttttaaattgctgaatgtgggtgaatgtgttgaagagtgaatggagtgattggggaatccggatcccaagttttaaggccttagggtataactactgcagtagaaaataccaccaataatgaggaacaaccta

SEQ ID NO: 2055 - DNA, 362 bp, Glycine max
ataaattagagaagtactaccaacacactctctaacacacttctcttgacacatattctaccataagttacaaataataaaaaattacaaaatcatgaaaataagatctaggacccatatatttttgtgatatctaaaaaatttcaagcaataaaaaaaatgtattgaaaagagtgtataagataatgtgttgttagcatttttatataaactatgttaagagcaaggtctgatgcatacgttgctagtttttatattagtattgagaataaatagctgaaagtcccttggttcaatctatatcatttgggagggggaatttgttgggaataaatttgtatgtccacgatccaatcatcata

SEQ ID NO: 2056 - DNA, 661 bp, Glycine max
  misc_feature (60)..(61): n is a, c, g, or t
  misc_feature (64)..(64): n is a, c, g, or t
  misc_feature (533)..(533): n is a, c, g, or t
  misc_feature (545)..(547): n is a, c, g, or t
  misc_feature (549)..(550): n is a, c, g, or t
  misc_feature (555)..(556): n is a, c, g, or t
  misc_feature (558)..(559): n is a, c, g, or t
  misc_feature (561)..(573): n is a, c, g, or t
  misc_feature (590)..(597): n is a, c, g, or t
  misc_feature (600)..(604): n is a, c, g, or t
  misc_feature (606)..(613): n is a, c, g, or t
  misc_feature (615)..(621): n is a, c, g, or t
  misc_feature (623)..(628): n is a, c, g, or t
  misc_feature (631)..(633): n is a, c, g, or t
  misc_feature (650)..(656): n is a, c, g, or t
ctgtgcccacccccttgcttttctgcatttttttttatccttctttgtcctctgtattcnnctnaaggcttcttaatcactttctcaattccattgctccctctctaccctgagttttggaccttgccatagattctctcagattttcgctcttcctggtatcttcagaatgctttctgtgaggtaaagtatctgactttgatgcaatcctttatctgggtctgtctcttcaattcctttccctcaacaacatttctagctccttgcttaatgtttgatgcacaatttgattattgtgactgaaatttgtaaacttgggtcgattttgtggcatgggtgtttttttttttttttttttcaaggttaaaaaaaagggggcttttaatggggggcccttccttttttgcccgggagggctccccgctttttttggggggtttttttttaaaaatttttttttttggggttttagggtttttgggggggggaaaaaggaaaaggttttcccccttttggggtttttaaaaaggggntttttttttttnnnannccccnngnngnnnnnnnnnnnnngggggttttgaaaaaannnnnnnnttnnnnngnnnnnnnnannnnnnntnnnnnnccnnntggggaaaaaccccccnnnnnnngtttt

SEQ ID NO: 2057 - DNA, 319 bp, Glycine max
atactgggagttttctgtttaggaactgtcagtggtctttggatttgcttgatgcttgggctcccatgggccccaaggggccggttcgcgaggaggccgggaagatcttgacggccaatctcaaggggaggccggcgtttgaggccgacgatcagtccgccttgatatacttgctgctgtccaagaaggagaagtggatggacaagacgtttcttgagaattcgttctacttgcacggttattgggccgggttggttgatcggtatgaggagatgattgagaagtatcaccccagggttgggggatgagaggtggccgt

SEQ ID NO: 2058 - DNA, 721 bp, Glycine max
atttgttgttctgcttcctgagaccgtgttccatggcatgctctccttctacaactcttgtgtcaaattctcttctccttaacaaaacgactagtcagtgtcggcttcatgttcatcccaccctttcacttaatcaaaaccttccaatatattctaataacctactcaaactctcaacaattcaataccatgcaacaaccacaccctttgttgctgcttctgcaggcaagtcttgtctcactctttagtcttttctctttgtaaagtaaagtaaacaagtttctgaaatagcataattttttttatattattgacttttgtaattactttaaaatatatgataatttctttgaaagtgtaaattgtaaaaaaaaaattacatgtgtcacactcaaactctttaaggttgtttatttcaatgggtgactgagaacaggagttgagtctccggtgttgggtgaggataccacgagttcactggattcggtgaaagtgtttgatttgaatggaaacgggattccaatttctgacttgtggaaagataggaaagccgttgtggcatttgcacgccactttgggtgattttatcatatttactacacaaattaagttaccctttacctagtttgagtttgtttagtattcacttgtgctccttttttctctgtacatttacaggtgcgtgttgtgccgcaaaagggctgattatctttcatccaag

SEQ ID NO: 2059 - DNA, 570 bp, Glycine max
  misc_feature (359)..(360): n is a, c, g, or t
gttctgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaaaaatgaagagcaccatcttctttgctctctttctcttttgtgccttcaccacctcatacctaccttcagccatcgctgatttcgtgctcgataatgaaggtaaccctcttgaaaatggtggcacatattatatcttgtcagacataacagcatttggtggaataagagcnncgaggaagatggtgctcttcatttttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacag

SEQ ID NO: 2060 - DNA, 355 bp, Glycine max
gtttgtgccgaggtatctctagttctgacttacatgcacctgtgtgtggaggattggaaatggtggtggaaatcgttctttgcctctggttctgtcgccatatacatctttttgtactctgttaactatcttgtgtttgatctcaagagtttgagtggtcccgtgtctgcaactctttacttaggatactcactcttcatggttctagcaatcatgctttctacaggtacaattgggttcctctcttcattctggttcgtgcattacttgttctcttctgtcaagttggattgaagtctcaacgctctcacaaattaccattactgagaaaagatttcatcaagaggaccctttg

SEQ ID NO: 2061 - DNA, 514 bp, Glycine max
ggggttccatgcgccaactatacctgcgctgctgtgcatgatgtctagtttaccgtacttggaaacggtcgtgttcacggcgtgttcgatgttttcttcttttgtgacatcacaatgaatgtaagtagctgaagatgaatccaagtctttgcaaattgagtggcctaactcgtcttggatatcagcaatcaccactttggctccatgcttggagaaaagtcttgctgtgcactcacctataccacttgctccaccagttatcagtgccaccttcccttctagcctgtttttcaattttgtatttcaccaataacaatatgtatgagcttatgctaactaattatttggaaacaaaattaaaattaatcggccaagaatttttcttctcacgtttggataagtttttccacagattattataagaaaataaaataagaaaaataaaatgaaataacttttttttcataaattaaaaattagtttatacataacctaaagtttacaattttttttt

SEQ ID NO: 2062 - DNA, 560 bp, Glycine max
cacagatgtctcgcagcttgtaccttgtttttgagtatatggagcatgatcttacaggacttgcatcaaatcctgatattaagttctctgaaccgcaggtaatgatgatttcttttcatttactcaaggtctgatatacatggagttgaaatttttgtgcatgtgtctggcataagtataggaaagtgactatgcgtgccttctactctgttttttataagaaaattcctaaaacatcaatatttttgtatgccattgccagctgaaatgctacatgcggcaacttcttagtggattggatcattgtcatagtcatggtgtcctccatcgtgacataaagggctcaaatcttctcattgacaataatggagttttaaagatcgctgattttggtttggcaagtttttatgaccctcaccacaatgttccattgacaagccgagtagtaactctatggtatagaccaccagaacttttacttggagccaatcattatggggttgcagtggatttatggagcactggttgcatactgggggacctatatactggaaggccta

SEQ ID NO: 2063 - DNA, 619 bp, Glycine max
taggagtcagtattttttagtcttccaaattaaaatttgcatttgagtccctcaaattccttaaatgcattttttaatttctcctgacaaatttttggcagtttgaatgcataaattgtggcagttgttgactgcaagagggactaaaacaactttttgcaaatttgagggattaaaaaatgcaaattttaatttgaaggactaaaaaagacagacctctcaaatttgaaggattaaaagtatatttaagtcatttttttaatgcttcagatgatgaggaaatttctgtgaaactatagatccccttttatagtcctattcatttcctacatcattgatacaaatcaatatgactaaagtataaattgattgtgggaaaaaaattggtagatcacatgcattatcttcatcttaggaaatggttttcatgcaactgatatttgcttttgcagagacaactacgaagatagtcattgtcacctattggtaacatctcttctagaatcataagcatttggcccgcttcaaaggggcatctttcatgagaaatacttcacaactttctttgctgctgacttcagtgtaaatgaatggcttgagacatggtcgaatcttcaga

SEQ ID NO: 2064 - DNA, 401 bp, Glycine max
agtgatgattcatcctctgatgaatgggaagaagatactgaagcaaaagctgagatattggcttatgctaagaagatgatgaggaaaaagcaacgggagcagatgctggatgatgcatacaacaagtacatgtttgatgatgaaggactgcccaagtggtttctagatgaggagaggagacatcgccaaccaataaagcctattaccaaagaggaaattgctgcaatgaaagcacagtttaaagaaattgatgctcgacctgcgaagaaggtggcagaggccaaagcacggaagaagcgtgttgcaatgaggaagcttgagaaggtacggaagaaggccaatgccatatcagatcagacagagatatctgatagttcgaagaggaagcaaattgaacaaca

SEQ ID NO: 2065 - DNA, 509 bp, Glycine max
  misc_feature (450)..(453): n is a, c, g, or t
  misc_feature (493)..(494): n is a, c, g, or t
  misc_feature (496)..(497): n is a, c, g, or t
  misc_feature (499)..(506): n is a, c, g, or t
tcattggctggtggactcaccattttgatcttttgcttggagtgggtggttttgacacttgcatttttcttgaagtattatgcttgtgttgaggggaatagtggggctgttgtgcctgtgaggagtgggaaggtgcagcaggatgaggacttgaaggattggccttggccttttcaagtttgattcttgtgatgacaagaagaaacacaagaataacaatgacatgttccttttgaagttgttgcagctgttttgatgataatctttcaaatatgttgattcgttggagaattggatgcttttttctcctgatagagatatatgtgtgtgtgtttgtgttggctatcatcaaaaaaaacagctgcaacaacttcaaaaggaacatgtcattgttattcttgtgtttcttcttgtcatcacaagaatcaaacttgaaaaggccaaggccannnnttcaagtcctcatcctgctgcaccttcccactcctcaacnngnncnnnnnnnncca

SEQ ID NO: 2066 - DNA, 696 bp, Glycine max
ttgaggggatcagtacgaggaatatgtcaaaactgagctttattacaaaaagcatttgttccggacacctcattgttcccttctgctgtctaactatgcacagtttctcttccttgtccttcatgatattgatgggtgagttctcaaaaaccaattttgttatcacatctgattagtattagataatgctgcattctttagctagccttttgattagtgagaaagagcaaaagaataagaggaaagagtcatgttgcttgtttattctctatgcaaagaagggtgtttaattttttgttttctttgtcaagctcaaatgagtcattttttgaagatttgtgttggtgtagagtgtatagaagtgatatcaatattgacaaacaacgagggtactacttgacttgacttttgttataggtaaacttttcacgggcgaagcaatgacagataatggaaatgtatctcaagtttcttctttagctccttctagagggtattctattgctgatttatttttccctttttaatacatttgatttgttttcagggcagaagagtactacaagaaatcagtgctagcagaatcatcggaagctgaggcattcagtcgctacgctgacttcttgttgatggtaagaaaggatgtttgggctgcagaactgagatatctgcaaacattggaagcagatcctggga

SEQ ID NO: 2067 - DNA, 499 bp, Glycine max
aaaatgatgatgcagaaagtagttcaaaagagacagatggcaatgaatcaagaggagctttgagagaaaatggtaatgaagaagaatcaggttctggagggaatgaaaatgacagtgatggggaaaaaagtagtcctagagaagtggaaaaatcacctatagagtcagcaagtcctgatggtgccaaaattgctgaagtttctgatgacgagctgctggtaaattgctcatcctttgcggaattgtggcacctacttttatttacttgataaaaatctagtacatttaattttctaagttaatcactaatcactaagaatggctgatgcagagcaaatggaggcgtccctcgggaaagaaaagctcagggcaaaaacggtgagcagtttgacagttgtagcacaaatccctgaagatttcagtagcagtagtgctgtggcagcatttagtgtgtttcagttgaagtataggtatcagagtggatgatgactgccattta

SEQ ID NO: 2068 - DNA, 958 bp, Glycine max
  misc_feature (407)..(407): n is a, c, g, or t
  misc_feature (454)..(456): n is a, c, g, or t
  misc_feature (462)..(472): n is a, c, g, or t
  misc_feature (478)..(479): n is a, c, g, or t
  misc_feature (484)..(488): n is a, c, g, or t
  misc_feature (499)..(505): n is a, c, g, or t
  misc_feature (511)..(514): n is a, c, g, or t
  misc_feature (523)..(523): n is a, c, g, or t
  misc_feature (525)..(531): n is a, c, g, or t
  misc_feature (540)..(553): n is a, c, g, or t
  misc_feature (561)..(567): n is a, c, g, or t
  misc_feature (572)..(576): n is a, c, g, or t
  misc_feature (578)..(578): n is a, c, g, or t
  misc_feature (594)..(597): n is a, c, g, or t
  misc_feature (599)..(606): n is a, c, g, or t
  misc_feature (609)..(616): n is a, c, g, or t
  misc_feature (618)..(622): n is a, c, g, or t
  misc_feature (625)..(628): n is a, c, g, or t
  misc_feature (631)..(638): n is a, c, g, or t
  misc_feature (640)..(650): n is a, c, g, or t
  misc_feature (652)..(656): n is a, c, g, or t
  misc_feature (662)..(666): n is a, c, g, or t
  misc_feature (668)..(668): n is a, c, g, or t
  misc_feature (670)..(684): n is a, c, g, or t
  misc_feature (687)..(692): n is a, c, g, or t
  misc_feature (696)..(698): n is a, c, g, or t
  misc_feature (700)..(706): n is a, c, g, or t
  misc_feature (708)..(713): n is a, c, g, or t
  misc_feature (715)..(721): n is a, c, g, or t
  misc_feature (724)..(740): n is a, c, g, or t
  misc_feature (742)..(744): n is a, c, g, or t
  misc_feature (746)..(752): n is a, c, g, or t
  misc_feature (759)..(760): n is a, c, g, or t
  misc_feature (762)..(767): n is a, c, g, or t
  misc_feature (769)..(770): n is a, c, g, or t
  misc_feature (773)..(775): n is a, c, g, or t
  misc_feature (777)..(781): n is a, c, g, or t
  misc_feature (783)..(785): n is a, c, g, or t
  misc_feature (791)..(801): n is a, c, g, or t
  misc_feature (825)..(826): n is a, c, g, or t
  misc_feature (828)..(839): n is a, c, g, or t
  misc_feature (846)..(857): n is a, c, g, or t
  misc_feature (869)..(870): n is a, c, g, or t
  misc_feature (875)..(875): n is a, c, g, or t
  misc_feature (877)..(880): n is a, c, g, or t
  misc_feature (882)..(885): n is a, c, g, or t
  misc_feature (896)..(903): n is a, c, g, or t
  misc_feature (909)..(911): n is a, c, g, or t
  misc_feature (913)..(913): n is a, c, g, or t
  misc_feature (915)..(915): n is a, c, g, or t
  misc_feature (921)..(925): n is a, c, g, or t
  misc_feature (927)..(927): n is a, c, g, or t
  misc_feature (932)..(939): n is a, c, g, or t
  misc_feature (941)..(941): n is a, c, g, or t
  misc_feature (949)..(951): n is a, c, g, or t
  misc_feature (953)..(953): n is a, c, g, or t
atgtttctatgatatggcactggggtttggaaacaatatataatcccagcgccactgcatctgactgatcacactctggctgagtgtgatggccaggtcatgcttgtgggtttgctcacgaagaatgcagccacttgtgtatgcatatgggagttgcagaaaatgactctcttgtggaaggaggttgacagaatgccaaacatatggtgcttggacttttatgggaagcacgttagaatgacttgcctggggaacaaaggcttgctcatgttgtccttgagatcaaaacaaatgaaccgattggttacttacaacatagcaaagaaagaatggctgaaggttcctgggtgtgtcgtgccacgtgggagaaaacgacagtggatagcatgtggtactgcataaaaccngggaaccttcagccattctttctttgctatgttgtaagtaaccaatnnntccttnnnnnnnnnnnggacanntgagnnnnntttgttcccannnnnnnttctannnngcttccatnannnnnnnccctatgtnnnnnnnnnnnnnntccttccnnnnnnngtctnnnnngntactccctatgcatannnngnnnnnnnntcnnnnnnnncnnnnnccnnnntgnnnnnnnntnnnnnnnnnnnannnnntggatnnnnnantnnnnnnnnnnnnnnnatnnnnnntttnnntnnnnnnncnnnnnntnnnnnnngannnnnnnnnnnnnnnnntnnnannnnnnnaataaanngnnnnnncnnatnnntnnnnntnnnttcatnnnnnnnnnnntccttctttttccttttccttttnntnnnnnnnnnnnnctttttnnnnnnnnnnnncccccttctttnnttttncnnnncnnnncccccccttcnnnnnnnnctttcnnncntncccccnnnnntntttannnnnnnntnttttcctnnntnatttt

SEQ ID NO: 2069 - DNA, 862 bp, Glycine max
tcttttctgagagccttttgattaaagtacccttttttgttttttgttttgaattttctcttctgtgtattgttgctctctgatgtggtatatgtgtgtgtgcttcctgttagataaaatggttgctgcagctgtctgtaattcctgaaattgttgaggttcccagtttcagtgacggtgctaaatctttcttacaaggtctgattgatgactttagtgttgaggatgcctcggaggttaaaaacattgagagggtcacgaatcatgatgtgaaagcggtggagtacttcttgaaacagaagtgtcaatccaatgctgaagtggctaaggtcgggattcacttttgtgtttctttgtactctgaggctgtgcactgctttactgttttgattaagggttctgatggattgtgttattctaaaccttttcgcaggtgcttgagtttttccactttgcttgcacatctgaggatataaataatcttgcccatgccttgatgctgaaggaaacaatgaattctgtcatgtttcctgtcatggataaaataatgattgctttgtgtgacgtggctaaagataatgcggatgttcctatgctttctcgcactcatggacaggtatgttcatttgtgcatttgttgcatatttttaagaatcaatatatattgtgggatgtaatattgggctattgcaaatactttaactttgatgtgacaaacaattggattggtagataattcctttttaaacagttttgcaattcattagtgttattgttcttccactttattggtttttagttcttcatctttaaacagtcgtgattgacctttgcaatttttctgcactacttaacagccagc

SEQ ID NO: 2070 - DNA, 568 bp, Glycine max
gaggctacaactttggaagccagtaaaaatccaatgaggtaattttataccttaatctttaaaaacaatttctgtttagtcgggcactgtagaattcatatgaacttcttcattttctcagacgccaagttccaaccccttcaagaccatctagatcattgggaaacagtataacaagagttgtaagacgtggtaagttctctatttaacaactttatttgtgttttcatgatatagcttgttcttcttgtagtaatatcaaagacttgcaatacattggtattcttgaacaggagcagagagcgccggtgttgacgcaaatgggaattcttttgatttcacaacaaagttgctgcacttagcatggcacccaactgagaattcaattgcttgtgctgctgcaaatagcttatacatgtactatgcttgaggaagaaagatgattgaagaacatgtatttgcttttggttgacctgtttttggggttgctgtggagaaggcttctttccccttcttaccaaccaatgagttggatgctacatttaactcacactacaagtgcccttca

SEQ ID NO: 2071 - DNA, 380 bp, Glycine max
agacaggcattcaggttgctgtgactgtcccaaatgaagagatcctagcaattggtcaatcgaattccacggctgccaattgggtttcccgcaatgtggtagcgcattatccagccaccaatatcactgccatttgtgttggttctgaggttttaactaccctcccaaatgcagcaaaagtacttgtcagtgcgattaaatacatccattcggcccttgtggcatccaatcttgatcgccaagttaaagtttcaacacccctttcctcttccatcatccttgattcatttccaccttcacaggctttctttaatcgctcactcaatccagttttagtcccactacttgatttcttgcaatccactggctcttatctgatg

SEQ ID NO: 2072 - DNA, 821 bp, Glycine max
ggaatcgatctcggcaccacctactcctgcgtcggagtgtggcagcacgaccgtgtcgaaatcatcgccaatgaccagggtaacagaaccacgccgtcttacgtcgctttcactgattccgagcgtttgatcggtgacgccgccaagaaccaggtcgccatgaaccccgtcaacaccgtcttcggtaaaatccctaaccgactttttgctttatcgagatctgcattgttcctagatttttgaaactccacttttctattttagtaatttgtagtattttccaatcctaatgtattatctggcctattatttttttgatataataataataataataataatcgttgaatggtttattatgtacactcttattgttcgttgaaatctgatgttgaattgaatagcaataggcgtaggcactgttaatacttgtcgaaatgtgattttgaactgaataaatcatattgtgtgcaattttattatttagagagttatttgatcctacaattttgagggaatatggtatgctaaaagttaagatttatcttttattctttttaatttggattgtgcggattgtttggtgattggttatttgttgcctgatgtcagatgctaagcgtttgattggaaggagattttctgatgcctccgttcagagtgacatgaagctatggccatttaaggtcatccctggtcctgctgacaaacctatgattgtggtcaactacaagggtgaggacaagcagttctccgctgaggaaatttcttccatggttctcatgaagatgcgtgagattgccgaggcttatctcggtccc

SEQ ID NO: 2073 - DNA, 487 bp, Glycine max
ctatttccgcctcggaacaggaaacgacaacatgctcgttgaaacgacagcgcgaggacgatgatgatgcttcttccgatcgtgatcccaggtttgtgttattttattttttgtttcgaacgaggaatagttatttattattttatttatttattttggtttgtggcgtgaaatcagggtgttgagaagggttgggcgtctcaacggaggttgcgtgtgacggagaatcgtcgttgaaaggaaggagggagtggtctggcacacgacgtcgtttcctgattggggaaagtaagattttcacagccgtacgatcgaccaagatattttttaagctctttcatcattaacttctaatctaaccgcttagaagttacaatggtttttgacatataggtttagtgttgtgtattaactattaatgtggaattttctgttttcctttatcggttttttaagataaacattgcgatgtcatcttgatgtaaac

SEQ ID NO: 2074 - DNA, 666 bp, Glycine max
  misc_feature (632)..(632): n is a, c, g, or t
  misc_feature (634)..(635): n is a, c, g, or t
ggcaattgatggaagcggtaagaattttgtctgattaccccttagcatttttggtacttttgtattacctaatcccctgcagttaactttcttcatttggtaacttttttttaaaaaaaagttggaacactaatgttaactcttctctgctcttatgctgtcgcttgatgacacccctgatatatggatgaattcattccctgcaatttcacctcttatcttgatgattttatatatccaaacctagatttgtgcttgtgaattgtgattaaggtgaccgttagtccttgaatatgctgtgcatttacagaatacccttattgtcctgtgaaattttaatgatcatattattcgtataacaatgctgggaaaatagttggattatatcttttgagctgtttaataataagtttaacatttctcttgattttacattattatttggttctcaggctgatgtggacggaaatgggaccattgattacattgaatttataacagctaccatgcacatgaatagaatggaaagagaggaccacctatataaagcttttgaatattttgacaaggatagaagcgggtaatctcttttttgaagtaaaaaaacatctcattatttactaacttgacgngnnatgctaaggggagggaaaaagacacaaaatt

SEQ ID NO: 2075 - DNA, 1168 bp, Glycine max
  misc_feature (1106)..(1111): n is a, c, g, or t
agtgtatgcctcttatcctgtttacttaatcctgttttatcctttctttaggttctttacttaatcctgttttatcctttctataggttctttacttaatcctgttttatcttgccgagaatcaaacagagaaactggtagacgtaagtgctccctacagcctactgctgttagattatctaagaagttttcatttgctgtgatcatcatagtttctcaatttgtttttctatttccaggttatatcaagtaatttacaaaagatatcattcctttctcttctaatgggtactagtttatttggatgggcagtcaagcaaattataaatgttatccaggttcgtatgtgatatatatattctggatttttttgaggtgctatatatatttagattttgaccaccctactccataacgaaaagatgaggaagaaaaaacaattaaaaagaagcaacacattagagaagaaaagaaaatctattcaaaatcatgtgcattctagtttgctttttcggtttaattatcacaaaccaatctttttcccaaacaaaaaaagaagaaaagaaattcacttgcgatcaagtttttatattttaagtcagcacaaaacttcataaactgtattttatttagtacagttttaaaaatgtattatactgcagatggtgattagttatgtctaaggattgtattagacagttaaaatgtggattaagattcagcacaatcagtaactagcaggttccgtggtgcctcaatgcactcttacttgattttgaatatattgactctttatcaataacttaatattatgacttgggaattgaaaagagttgtctatacattcttgctatataaagagagtcttggaataagaactgattattcatgtgtttatctgatgttttttattagtaattagttgttcattaaatacacttgtgattttagatgaagacagcagcagatgcgtgtgtgctttatgacatcgaaaaagaacacaagaactgatgtttcttccacgaccaggatccccttgtctttgtttttcaataccatgtgcgctcaaagattaatatgaattatcccagatggcaattgggctnnnnnnttcagttttctataatttgtaatgaaagaaaaataacatactgaactgaagaatcta

SEQ ID NO: 2076 - DNA, 380 bp, Glycine max
ttggtcgggaaactactgtgaaagacaaacagtggctgaaaaggaggattgccatgagtttaaccaactcatgtgatgtttcagctacaactttcattattaaagataacaaaatagttagaaaatttgaagaagacagttctggaaatatgaatgctggatctttaatctcttcggaaaatatgactgaagaagaagatgtcaactttaaggattcatctgctgtagatgcttgtggaattgatgataaccaagttgtttctgaaacaagatcagaaaatggattggaatatgagaattatcagacaggacaaagagctgcaaaaagaattcggagacctacgaagagatatattgaagagctctctgaaaatgaatct

SEQ ID NO: 2077 - DNA, 637 bp, Glycine max
ggggctcttatcaccagtgtctatgccagtgcctaaacagctaaaatacacgccaggggttgccaatggtttggtgagagaatcagcagcatttgtagatcagggtagaagggtaagttaatcttcatttgaatctgtacaagtcttttattggatacggatgtgaatttgctggtaatgcagatggtacccatcggacagttgtcaatgaaaaaactagcaattgtaggacaagcttctggaaagttatggaggtggaaaagaagtcatcatcagtggttactacagttcaagtggaagtggcagaaaccatggagactttcagaatggatacgacacagtgatgagacaatcatgagaacaaaaccacgctcacaggctttgtcacgtatcaggtgatcttttttaggatcagcccagttcatgtggctcggtatctttcgacccacaagaattatcctaaaaaagatcacctgatacgtgacaaagcctgtgagcgtggttttgttctcatgattgtctcatcactgtgtcgtatccattctgaaagtctccatggtttctgccacttccacttgaactgtagtaaccactgatgatgacttcttttccacctccataactttccagaagcttg

SEQ ID NO: 2078 - DNA, 434 bp, Glycine max
  misc_feature (54)..(57): n is a, c, g, or t
  misc_feature (96)..(96): n is a, c, g, or t
tggtaaaacatgctatcaacagttttaaactttgaaactgaaattttctttctnnnnaaaatgctccgtgtgtctctcgcctctgaaatagactcnctgagagatgttaaggtggatattgatggtgaaaagcctcccaaagagaaagctttgaaacccaagatgccactccacaagtggaaaagctttccaaatacaaacaagtcatcaaataggggttctcggagcagaaaatgggcaaaaaatatgtactcggatattttagagatagatggaagtccccttccaaagctccctgaaaaaaaaaaaaccgttggaattattaccatggaagatgtcattgaagagcttttgcaggtattaaactactaatgatcattctgaacaatcttgttccctcatgaaacattgtagataaaaaaaaaaatttattt

SEQ ID NO: 2079 - DNA, 1098 bp, Glycine max
agatcaaggactctctgctagggacatggttgctttatctggtatttctcttttttcttctttatcttatttttccccatctttgatctctcccttccattatatgaacaattactccttttgtctgtgtttagttgagacttgagacacgttttaatatcggttttgcatataacagtgatttttcctttccaaaattcatactagaatgtgacatttaaacaaccacatgcattggatcaagtcctttttctaagtttgaagtcatgtccttaaatagtaacacatttaagcaacaagaaaggcacatttaaccaaccaagaatcatccatgatttttcaatgtacggggaaataagtgaatctaatattaggattgacctaatggtgaaaattaaaatttcacaaaatcttaagttcaaaccttgttgtctgtcattgaaaaaaaaatatatttcatatataactataaaatatgaataacaagcaatttcataaatcaacagaaattacagctacattatagttatgggatttagtaacctcaaattctctaaatagagagaatgaagttaataatcaaaaaataataaagaaatactctatttcgagagtcctccatatatttaatttatcattcataaaagtaagtaaataatatgaatttaattagaatgtcttatctaaagagatttctaattagttgacactgtaaaaaaatatttacactaacagcgcatgaaaattaaacttaataattattagtgagactagtacatgagactaacaacagtaaatcagttattaaaaattatataggaatactgaaaatttctatttatgatattatgtgtgtggtttcacttgcaggagctcacacatttggcaaagcaaggtgtactagtttcagagatcgcatatacaatcaaaccaacattgatagaacatttgcattggccaggcagaggaggtgtcctaggactaatggcacaggtgacaacaatctagcaaatctagacttcagaactccaaatcattttgacaacaactacttcaaaaaccttctcatcaaaaggggactcctgaattctgatcaag

SEQ ID NO: 2080 - DNA, 471 bp, Glycine max
ttggtgaagccaagcccagtggcaaggaacttcttcttggtaaggagttttatttcattgatttggccccttttctgtaggtcccttttgttttgaatctgatgcagagtttgattttatcattgcaggagttttgattccaaaactcagctccaaaactatacagcaggctgttggagttgtggggtgccttattatgcctcacaatgtgttcttgcactctgctcttgttcagtcaaggcaggttgaccgcagcaagaaaggccgagttcaagaagctcttaattattactcgatagagtccacccttgcccttgtagtttcctttattataaatatttttgtaacaacagtgtttgctaagggattttatggctctgaacttgcaaacagcataggtcttgtaaatgcaggacagtatctagaggagacatatgggggtggactatttccaattttatacatatgggg

SEQ ID NO: 2081 - DNA, 274 bp, Glycine max
aagctaagagattgatctttcagtgacagaaagatttagggagagggtggttgacgaaggatataatcctagttatggggctaggcctctaagaagagccataatgcaacttttggaggatagcatggctgagaagatgcttgctagagagattaaggagggtgactcagttatagttgattctgattctgagggtaatgtgattgtgctcaacggtagtagtggtgccccagattcactagaagatgtcttagttagttgagttgtacttttt

SEQ ID NO: 2082 - DNA, 399 bp, Glycine max
actcttgaccctcctcaacaaggctaagaagcacgtccatcaagtcctggttacttttgggttcagcttcactattccttttacttttgtgttcttccagccaaacttgaacaaacccatctaactctttcgccgtctttttcattttcttctctgcaccatccaaatccaaccatctcaaataaggaagagcatcagacacattgaacgcccccgtcaggtcaaaaaattctctcagcgcctttcggatccgttcgttctcttcattctcaccaacaaaacgttttcctaccaccgttctgaacataacgtttaacgttatgtccccgaaccacctcttcatttcagttgttgccttttcggaaccctttaggttcttgtaagtctctttcactgccg

SEQ ID NO: 2083 - DNA, 396 bp, Glycine max
ggggtggtttggagaaaacagattggtccaaagcacccttcatagcagaatacaaagggttccacgttgatgggtgtgaagcttcagtgaatgcaaagttctgtgctacacaaggcaagaggtggtgggatcaagcacagtatcatgatcttgatgcttctcaatggagatggctcaggtgggtgcgcaggaaatacaccatctacaactactgcactgacagaagccgctaccctcagcttccacctgaatgtagaagaaaccgtgacatttaaattcacatgtagtactatgtttatggttgctaccataagtttcttattgtattattgattcatcatttaccatatactttattcctaccattatttattatcattgtattgtttgagctgt

SEQ ID NO: 2084 - DNA, 479 bp, Glycine max
gagcggagccggaacctgcaggacgttgacagggcagcgctgtcgcgtcccttggatgagacgcagcagagctggctccttggccccggcgagcagaagaagaagaagtacgtcgatctcggctgcatcatcgtcagccgcaagatcttcaagtggaccctcggcacaatcctcttcgccgccttcctcgccggcctcatcgccctcatcgtcaacaccgtcccccgccaccgccacaaacacccccctcccgacaactacaccctcgccctccacaaggccctcatgttcttcaatgcccaacgatgtatgtaaacaacttttggagtaactcaatccctcctccaaccaaaatacagtatgtataaactaacttttgtgttgtgttgttgcagcggggaagttgcccaagcataacaatgtttcatggaggggaaactcgggaatgcaagatgggaagtcttcagatcattctgcta

SEQ ID NO: 2085 - DNA, 703 bp, Glycine max
tatcttcttctgcccttttccacttcaattaggtatatcgccgattcgattcccaatttgcttaaactcaattaagctttcctgcgtcaatcattcaattaaaggtgattattagtatcattcttttttataatccatgtaatcctcctacttcatccttagttatcttaggcatcaaaaccctaatttcacatccttcacgcgcttggtcttggtattttctctgcgcgattgatttttctgcatgcaattcgatgcacagttcgtgtttttccaaaaaatccttgttgtccctgttcaattttatgtttgccctttaagttgtgtttccatttactgattgtctgattttccctgtgctcctttaataaagtttgtaacgttggaactttctattgcagtttcggattgttatatttaagtagatgtagtgtggtttgattgctaaatggcatcctctgatggtagagttacgtattcttcattatctaagctagaaaaggagaatacccattttggctacgatgatataaatcatcatgttgaatctgtgtggtctgagcttatgcctggtaccccgtgtggccaattagtcccaacgttgtctaacaaagagacattgtatcagtttccctctgaggatgatgacttgtttgatggaggttatgaatcaggtgatgatgctcgtggtattgtacccctc

SEQ ID NO: 2086 - DNA, 584 bp, Glycine max
gatgtttggtcttgtggagtcaccttatatgtgatgttagttggggcttatccttttgaagacccagcagatccaagaaacttcaaaaaaaccattggtgtgagtgataacagataactgcaaacttattgaatccttaaataatatcaagtctagaaataagagttagttgtttagtttcactttctctgatatggtgtttcaattggaccttttgttggcttattacagaagatacttagtgtccagtactcagtcccggattatgtacgagtttccatggaatgtagacatcttctatcacaaatattcgtggcaagtcctgaaaaggtaattgatttaatgtctataaattccttctggatgggagatttgatctctttaatttcggtgcactgtttatataaatactcttcatatttattctcaagtaacttaaaagttttgcttctctgataccaatttgggcacaattctagcaatgcttattctttccactatctttagcatctagttgacaatctactattaaactatatgtagcttccattcccattgtattgaaccatttacggcattttgca

SEQ ID NO: 2087 - DNA, 310 bp, Glycine max
tgcatatgctactttcttctctcttctcggggaattgaagcgttgtggtccgattgtttgctagatcaagcaaattaacctatatactggtctatatcatcatcaccttgcacctctctctctctctctctctctatatatatatatatatatatatgtgggtttaatctcttactttctttatcttttcacttttttcagttttggtttgatttaattacttgattaaaacttacatatatggatttgaatatatagtacgtggttttcgagcttggtgtttctagatattataataatatgatggtga

SEQ ID NO: 2088 - DNA, 412 bp, Glycine max
agaaggctgagacacatgacagcaatgcaacgaacggtgaagacaagaacaaggacacctcgactaattctgctcaggacgaaaacaccagcaacaattatgtccaagaaggaaatgttgcgtcatccaacaatgacaataaagatgctagccaagatgttcaactcacttcctctgatacttcctcagaacaaaagaaagatgaatccttgaatctagaaagtaacactgactctgctcagaatgacaatgtaaactctgatcaaagcaacaaaaacagtgatggaagtgctaatgacaataaagatgctagccagtcctatacttcatccgagcaaaacaaagaaggatcctcaaactcagataacaatgctagcaaatcagatacttcatctgatcaaaacaacaaaga

SEQ ID NO: 2089 - DNA, 385 bp, Glycine max
  misc_feature (127)..(127): n is a, c, g, or t
  misc_feature (277)..(277): n is a, c, g, or t
  misc_feature (301)..(301): n is a, c, g, or t
ctttgatgatagttttacagcaaaaaatagtggattaggcactacaactaatcatgcagtttgtcagtctcatagttcggccatgcaaatgcctaaacagcagagcctgtttgctactggccctccnatcacactttctgttgtaagcagaattaggaacggagctaatggctggagaggcaccgtaagcggtgctgctgcagctgcaactggtaggaaaaatgccctttctggggccattgcttcatctttccgtaactataaaggcaatgaaggnaacttttccaaggcaaagtatcanctgttggtcttttcaccctctggttccatggtacaatatgctttgaggacaataactggtcaagattcagctgttgtttaggag

SEQ ID NO: 2090 - DNA, 727 bp, Glycine max
  misc_feature (552)..(552): n is a, c, g, or t
  misc_feature (675)..(678): n is a, c, g, or t
tatgaaaaggtgcttgttgcggcaacacgaacactgcagatgagttttgttttaggagttggactctcttttgcagttggagttggattgtattttggagctggaatcttttccaaaagtgttcttgttgtgcacttaatcagaataggcctcccggtataaacatatatacattccttccacaacaacaaatttgataatgtgttttgtgtcatttttatctgatttcatatttaatttacccaccagtttgttgctgccacacaaccaatcaattcattagccttcgtatttgatggtgtgaactatggagcatctgattttgcatattctgcatactccttggtaagttctcataccataattttttattaaaaaatttataatgtgtcatctctatccaaatttatttaacaaatttctatgctcttaatttgttcaggtcacggtgtcactagcaagtgttgcttcattgttccttctctctaagagcaaaggtttcgttgggatctggattgcactaaccatctacatgagtcttcgcatgtttgngaaaaaaaagtattcgtcatctctatcaaatttatttagcaaatttctatgctcataatttgttcaggccaccgtgtcattggcaagtgttgcttcattgtttcttctctctaagagcaaagnnnncgttgggatatggattgcactaaccatctacatgagtcttcccatgttt

SEQ ID NO: 2091 - DNA, 927 bp, Glycine max
ttgccctatgctttacacttgggtgtggatttattattggatcattctttgctctcaagggtccaaagagtcagcttgctcacatgttgtcaaaggaggtaacttgctagaatttcatttcctattgcttgcatggtaatataaagcttgtccagtgactatacgttgcttcaaattgaatttgtttgggctttttgggggaaaatagtctcttatttgattgcacatgtttgctgcttcttcctaactgtctctctttgtaattatttttcagaggctccctttcacattggcttttttaggcagtatgattggtaccatatatgtatcaatggtgcttcacagctacattctctctgtggtattctctgtagtgcaggtatcagtttctcgttcctcaaaatgcctctttgtagcttagccattctccaactcccatgtgttattgttttcacttgctgttgatttaaggcatgctcaattttttttgactcttgagcatggttttgaatttattttagcaattaggaacaactccttcaatgtagcaaaaccaatataaatttaagaactgctatttccacactctgtggtgcactttatgtgatgtgatgtgtgtgtattgtatgtttaacatggttccaagcttccagcagctggggcatgtggagatgtgtcttacatactttcttctgttatgtttctttataactatccgtcttgcattgaaattgaaattttgactttgcttgcaggttctctcacttggctactattctatatcgtactttcctggtggatctgctggaatgaaatttctgacttctgcttttacctcttcaataatgaaatgttttgggcggtgacctattttttgttgatagttgagttgagttcagacctgtgtccatatagtagttgacttgt

SEQ ID NO: 2092 - DNA, 351 bp, Glycine max
gttttgccttttttgtgaaaaagtgtctacagagaacaaaacagaacggaacagagagagagaggagcttctctacttgactttctggagagacatggagggtgcaaactggaggataacagatgaagaagcagggccatcctcttcttctgggattgcttcaactaaacaacaaaacccacctgaaacttttcatcataggaaggaggcagaagaagaagaagaaaccgaggaagaggaagaagaagacgtttgtcagcataaaaatatcacctttgttcctggtcctctcctttctctcaaggatcagatcgaaaaaaaaaagatgacggtggttaggagaatgaaggt

SEQ ID NO: 2093 - DNA, 361 bp, Glycine max
tttgacaccaacgttgagaagctgaagacggtgcttgatgtgtacgaggccaagctgagcagcaccaagtaccttgctggggacttttatagccttgctgatcttagccatgtttctgaaactcactacttgatgcagaccccttgtgcttccatgatcaatgagcttcctcatgtaaaggcttggtgggaggatatctcttctaggcctgctttcaataaggttgtgggaggaatgagttttggtcagaatcattgaggaatgagtgtgttttgtgaggttcaattactacctaatttgttgcagtatctagtcaagcaaatgtggtgttgggtgttcttgaaacttgtttcaagaagaa

SEQ ID NO: 2094 - DNA, 1046 bp, Glycine max
  misc_feature (945)..(950): n is a, c, g, or t
  misc_feature (978)..(991): n is a, c, g, or t
  misc_feature (994)..(994): n is a, c, g, or t
  misc_feature (1040)..(1043): n is a, c, g, or t
tatgtgcttcttcaagtatatcctctccatgcattcttagttcagcagcttcgtacaagctcaacattccttgtatatcattggctgctttttcactaaagtttctagtttggtctttgaatttgtaaaatacatctgttaaattaataaacatatatgtgttaattccaatatatatgtgtggatgttatcacacaaatgacttcaatgcatatttaaaatcaaacaatttctataaataggtttgaatcaccttataaacccaatcaacccaatccagaaggtgaaaaactcttttgaatttagtttgaaagagacaaaagccttatgtcaaattagatcttaggatgttagggaaatttcaaatctaagagatttgagccgacctattccaaagtatatgtattttgggaaatttatttaagataattagtctatgattcttattttttaccccaaacaaaataaagcaaaggcaaactttgtcaatgttattctcaacctgccaatgatctatcttggttgcgctaacatgctccatatcattactatttaaaatatttatatatgctatagttgtttatgtatttttctttcccttgcatatacatttgaaattgttctttgttaaggtaaaaatctcattactatactccactggtttgtgcttcctgaaaccactacattatcaatagttcaagttctggctacaatcattcttgaattgtttgagcttatttttcctctaaagttgactcaagtatattcctaggcagctaaatatcattcttggtgtaatgcaatgtccctagtaccgaagtagtgaatgagaaatttaatataatcatggtgagttacgatgtgttattgttatgttgaaatgtagattgggtggactgttacttgatgaaatgtgataaccttgttgcctaagcaaccgaaagnnnnnnccacatgacaaagatcatcatcgtgagnnnnnnnnnnnnnncanttgttgaaatgttgtaaatttggtgcaatgctccatcaattcatgnnnnaaa

SEQ ID NO: 2095 - DNA, 576 bp, Glycine max
atctagcaagcaacaaaaccttctatactgattccaatggacgtgatttcattgaacgtgtaagtcaaatgggttgaaaatttgagttctagttatggttttccatatgaatgcctaacctaatgagttgctacaataatgcttacttttacaggttcgagactatagaaaagactggcacttggaagtaaatcaacctgtagctggaaattattaccctgtatgttttgtttaaccatatgtgttacaagatgctacattaatacacacgaagacacagtccttgaatttgttgactaatagaatctagtttcagatcaaccttgggatttacctgaaagataaaagcaaagagttttctatattggtagatagagctgtggggggctccagcatcatagatgggcaattggagctaatggttcataggtttgttatgttgttcaagctcaattgcttatgctcattatgtatcgtttcatattataccaatcaaactcgactttttccatttcctccactcttttatataggaggttacttcaggatgattcccgaggtgttgcagaggcactg

SEQ ID NO: 2096 - DNA, 894 bp, Glycine max
  misc_feature (825)..(827): n is a, c, g, or t
  misc_feature (836)..(845): n is a, c, g, or t
taattaggtactgaccatttccgtctatatatatggccaataacccaacacgttctataaacatatagtgactaacctcccactgaagagtaattggtggattccagcaatggccgtggttcatggcagttgggtcaaggttagtttgttatcatctttatcattatgtttctaaagatttgtagaattattctcactttctttttctcttttattaactctattgctcaaagtcatttttggttaattaatatgaaatcatatatgaagaatccctatttgttgtaccctttttattcttcccctgcaactgttcttttctttggtgttttcaattgcaatattttttctcaaaagcacatgcgtttaaagttatttagataatattgattttcttaatacccacccatcgtgcataaaattccggatgaaattgttctcaagagatggagaagttgttgaaaatgaaaaattggtggtttaggactcctttgtgctttttcctccgttgaaaggtcattgaggctcacaatagagcaaagttttgatgtcaaaatcaagttttcagtgaaaagcacttaaatcacacatgggctttccaactaaaattctctctaataagtctcactcatttgttttttctttgttccttggtttttgtcatccactcatttcttgttcaagtaatgtgccaaatcccccaataaaatgaaataaaaaatatttgtaccaagcttcttatgaaccaattttaagatgtaattccctttgatatcttgtgtatcagcttgatcaaagaggagaagggcaaggagcgagaagctnnnatgctatannnnnnnnnnacagaaggtgtatgcatttggtggcgaattcgtgccacgtgtccccgtg

SEQ ID NO: 2097 - DNA, 590 bp, Glycine max
gaaggaagaagagagaaagagggaaggtaataacaaatccctcgctagagcctagaactagaattagattctgcctgtgatcatatattatattacgaaattcaattgcagctgctgctgaatcgtaatcgatcttatatctacactctaccatggacattgatgatgatttcacattttgtcaggtaaacatagcattagcaagcatgaaatgccattttgtttttatcttcatatttattttgttaatgatgatgcatgtaattggataccatgagtgtatataggtcagtgcacctgttgatgttgaaacaaacaagcttgcttcagatatagctgatatttccattaaagaagaatcttcaaatgcatctaatactgctcaggataatgctttacccaatcagaaggaggctaccgttggttctttgtctttcactgtaactagcacagcttctagtcggccaaatgaatccaccacaaaattagtaccaactcaggctaacatttcgtctctaaagtcaccggcacagaagaattccgttaagaagccaacggttcgggccaaagttccttttgagaaaggctac

SEQ ID NO: 2098 - DNA, 367 bp, Glycine max
cctagccgcctccaccatcagttcccagcacggtggaaaatttgccatcgatgctacatccggcgttactccggtgaacactccccgcgggagctgggacctcgggtccggttccgggtccggttccaattcggatttcgggttggaaccgaatttcttttataataaggggtttgtgatgtcggcgatggtgagcggagaggggaagtgtagcaagcccgaagtggaggttggggtgcagcacgtgacttgcacggaggatgctgcggctttcgttgctcttgccgcggccttggatttgagtatcgacgcttgcaagttgttctctcagaaactccgaaaggagttgaggcagtagattccatta

SEQ ID NO: 2099 - DNA, 491 bp, Glycine max
gccgcttatggtacaactattattacgatttatagttgattataattgctactcttcatgtggttcataaaaagtttcaaaagagaatagtatatgttacaataactgaaggtgatctaggtaatatttgtgaaatgatattaatcaaatattcttgtttataatgaaaaacaggggaaatccgtttttgcccaaaagaaatgacgttggatgggtcatgtccacttgggacttcaggggaaagttgctttctggaattcctgaatagattgggagcaagtgccatgcctatgaattgctcttgcaaagatgatccttcccataataaacgccaatgcacttgtaatgttgtgtgtaacacatgagacaattttgcctctagagtgcacttcagtccaaattattcataaaataaaaaaacgtgtactgatcttgtaatttctctacatatgttgagaattttaaaagcccatcacctaatgttccagtta

SEQ ID NO: 2100 - DNA, 392 bp, Glycine max
cagcagatttgtaccctcccaagtattagtttatagaagagtgatagggtctcttaggacattatgtaacatttgtaactttgttgtaacagaatttcagccaaatggtatgacagcatagacttaaaagttaaatcagcagctaagacatgagagatatatcacccaattgttctgatattccacgggattcaccaatctgtgtattgtaaccttattttttgtgagatagaagatgaagaatcaatttcctggttgatgatggctttgcatcaaggagagtttgatcaaaaaccatgtctttaccaagtaaatgccaagaagcaaagtggcatgcttaggaaactccaatcatacaaggaaggactgttgaaaggctgctaacactgaga

SEQ ID NO: 2101 - DNA, 355 bp, Glycine max
gaggaaggagacggcggtgatccgcgaagccgcctcacgcgccgtccaggagctgccggcgtcgctcgacgtcggcgcgtcggtggcgcaggagtcgctcgaatccgtcggccaagccatcgacgacatcggcatcaccgtttggaactcgacagcgcagattatctctcacggtagggactctctcttagcctctgatttcgattccgattctttcgattcgaacaattacgataatagcaatgctagcaagaaactgttgagcggtagtggtagcagtgatcgtggtttggatttgaaacggtatagtaggtttgatacgctggtgggtgcgcttcagtgtgatgtgaatacc

SEQ ID NO: 2102 - DNA, 624 bp, Glycine max
  misc_feature (316)..(316): n is a, c, g, or t
  misc_feature (331)..(332): n is a, c, g, or t
  misc_feature (334)..(335): n is a, c, g, or t
  misc_feature (341)..(341): n is a, c, g, or t
  misc_feature (353)..(353): n is a, c, g, or t
  misc_feature (355)..(355): n is a, c, g, or t
  misc_feature (359)..(360): n is a, c, g, or t
  misc_feature (362)..(362): n is a, c, g, or t
  misc_feature (565)..(568): n is a, c, g, or t
ttctggtggaactgtatcagaagcttcaaacttcaaccattggaatggttcatctgtgcccagtgacatgccaacttcctacacatttcctgctgttgatcttcattatcgcagttgggaacaccactcccctcctttctctacagcaagtagtcgtctagttgctgctgatcagccatcagtatcccctggtagtcaaaggccagccaggggtggttcggatgtaccaagatcaggatcttttatgcatcccttccttgttggtcacaggtaccactctagagttgacataccttagtaaaatacatgagtgtangtaatttattatcanntnnaatttnatgagtggggtnanccannanatattatatgtttttcacactaaatgcactatgacttttggttataaaagatgaaaagtgatggatctcagaatcgtcactggctagtgaaatatgctcaggtcatatgattgatattccatgcacattttggggttacaactttcaatggattaatttctgcagttgtacaactttcaatgcattaatttctgcagttctgnnnncagagcggggagctcggttgcttcctcaatgatccctccttatcctggtagcaatg

SEQ ID NO: 2103 - DNA, 402 bp, Glycine max
agacacctcctcctccagttgaagacagagattccttttcaagcattggtgctgttataaattcagagagtcaactggacactgctgtagagattgattccatggtatccttgtcaacatcctcttctaggaggaggaacgatgcttcaagagtgtctgatgtggatagtggagattctcgtgctccaaggcggagacgtttgaactgataaaagtctgttagatgctcaagttttactattctatcatgtatcacatatgataataatcttccaacacctatgtaagtgcttcatgctttcttgttaccttatatttatgaagttttcaccatttacaagttttggtagatttaagatggtttcagattaccaccggttgcggtttaagaatctcctttga

SEQ ID NO: 2104 - DNA, 914 bp, Glycine max
  misc_feature (862)..(864): n is a, c, g, or t
  misc_feature (866)..(867): n is a, c, g, or t
atttaccttgcagtgagtttttcttattcttcttgcacccttctttcaatcccacacacacttatctcaaacttttgcatctcttaacattaacgttctttgcctaacctctgtttttcaaattctccacctattttcttttaccaagtctcccaattttcacattatttcaattctcaaaaatcttgatatcaaagcttccatttgcaatattattttttgtgttagataaaaataatctcatttgagttaggtaaaaattatggtagacatcaaaattcttccttgtattgttacgattctatttggtggctcgaataggattatccttgattagaaatacagaaaaagttaccgataaatgttagttttttttttcaaaatgttaattttattaggaaaaaaagattgtacttacaattttttttttcttttttgttaatcattcaactcgtgattataccaaaaatttgagcttcaagatacttttttttcctcctctatttgaactattatcctcttctaattttgataaataaataaaaaaatactctgtctttcggtttgtaactgtgtttttttgctagtaacgtaactggattgagataaacaagaaagtgaagttagtattgttacttcgcgcaggttctgaatcattcatcggcgtgaactacggacaagtcgctgacaacctgccgccgccgtcggcgacggcgaagctgctccagtcgacggccatcggaaaggtgcgtttgtacggaaccgacccggcgataataaaagctctggcgaacacggggatcggaatcgtgatcggagcggcgaacggggacattccggggctagcctcggaccctaacannnannaaacgtgggtgaacaccaacgtcgtaccgtactaccctgccagcaac

SEQ ID NO: 2105 - DNA, 460 bp, Glycine max
  misc_feature (23)..(23): n is a, c, g, or t
  misc_feature (400)..(401): n is a, c, g, or t
  misc_feature (407)..(409): n is a, c, g, or t
  misc_feature (432)..(432): n is a, c, g, or t
  misc_feature (435)..(435): n is a, c, g, or t
  misc_feature (439)..(442): n is a, c, g, or t
gcagctgcctgcacagttgccancacatcaaatacaacaacttcaccaaatgaatgatgcaaatgatataaagatgaggcaaggaatcggtgttaagccaggggtctttcagcagcatcttacttccagtcaacgctcagcttatccccatcaacagatgaaagggagtccttttcctgtttcttctcctcaactccttcaggccacatctcctcagattccacaacactcatctcctcaggttgaccaacaaaaccaccttccatctctcacaaaagttgctacccctctgcaatctgctaactcaccttttgtggtacccactccttcacctcccttggctccatctcccatgccaggggattctgaaaagctgatttctggtgtttcatcaatcagnnatggannngttgttgtatttgatgtgttggngantggnnnngcagctgctgctttgatg

SEQ ID NO: 2106 - DNA, 399 bp, Glycine max
acttctgcaaaaagttcaaggcatcagggcctcctccaaatccgacagtgcacttgatatcagccatgagacagattcttagaaggactttggattctcctagagtaaggtccacaccaaatagtccaacccagactctcacaaaaattcatggttctgtgcttacaagatctgagagctgcttccctactctctctgaagggttgtgatgaagggaatacttgtgtatttagttggataaaaatggaagcaggaagcataaataaggacagaaaaatataagctgcaaaagtttagatgttcaattgtagttttgtccagtacagaactttcaatctgtttgttagaaaatttgaacataatttggtcaagaattttgcttcactcagaccagttaca

SEQ ID NO: 2107 - DNA, 434 bp, Glycine max
tgctcagcgttagagttggtgattctgatactactttgagggggctagtcttcaagcctggacgatacgttcctatttcacctgataatgatgttgctccaagtgttccaatgatccaaagaaatgaagtttccttcccctcaagagctgctcaggttcagactcctctcccaaaggaaaggaatgaacagcctgtgaatgttcatagagttgaaactctcgcaatgaatggctcaccatctgtccctcaggtacctagaggagctgtcagttctagtaacttagttgcctctaccggaaagagtgtgccttctgtgacgggccagatcactcatcaactacccagaggtaatgtggtgcctgttctgctccagcctaataatttttcaaatggagtgccagtttctaatcaaatacagcctcgattacaccag

SEQ ID NO: 2108 - DNA, 601 bp, Glycine max
gtttgaactcttacagaagttttgaagcaggggtgcaacctgcaacaaccaaaggggaggcaagtaattggccttttctggttaatatgtgaaagttctcctgtttatgactttatgttaaatacattggttttcatttatattttccctttttctttattttgtgtcttctaaatttaatttttaccctcgcttacaggttcaaacagttaaacagggttatctgttaaaacgatcatcaagctcacgtggagattggaaacggaggttctttgtacttgataaccaagggaatttatattattacagagtgaagggtgtcaaacccatggtagttatttttgtctttatttgttttgacctatcaagcaatttgctaatgtttacttccaaatctgtccccagggctctcagtcatataattatactcgctcgtctgaacaaaacagtggcatgtttggtagattccgtacaagacacaatagggccacatctctaaatgaggatattttaggttcttgtatggttgatctgtgcacatccactataaagatggatgcagatgatacagatctacgtctttgcttccgactttgcttcc

SEQ ID NO: 2109 - DNA, 414 bp, Glycine max
gcttgacgaaaattacaatgccaagatctcggatttcgggttggctcggcttctgacaaagctggacaggcatgtgatgagcaacaggtttcagagtgcattaggatatgtggcaccagaattagcatgccagagcttaagggtcaatgagaaatgtgatgtctacggttttggagtgatgatccttgagctggtgacaggtaggaggccagtggagtatggagaagacaatgtgctgatactgaatgaccatgtgagggtgttgcttgagcatggtaatgtgttggagtgtgtggatcaaagcatgagtgagtatcctgaagatgaggtgttgcctgttctgaagctagcaatggtatgcacctctcaaattccttctagcaggcctactatggctgaagtggtgcaaataca

SEQ ID NO: 2110 - DNA, 883 bp, Glycine max
attgtgttggattgcccacttactatttttgtcatcatgatttcagtagttactatatgcctttgactggtatccagttaagaactactgtaatggttgtagcccttaaaataagacagtgcttagtgtgctagcttggtgttccaagtaacaaatagaatctcttttaatacaaacaacttgcatgctactatttagtatctgccttttcttgctgacatttgtgatgaaaatcatgaaatgggttgattatatcaaatttgaagagaaaaccatttttcatcaaacgaacttgtttacacaagaagtgaaaatttgttcattgtggctgattttactgcaccaaatttgaagagaaatcagcctttgttgctgatataaacttagcaaaccctaaacatgaaaattgtgttcttgtgaatatggcaacttggcgaacattgcttttctgtagtcattgttttgggtacaaagcatttcatgtcactttactaaatctaacatcattcccatactctcttcagggaactgctgacgaggttgttgattgctctcatggcaagcagttgtgggagctatgtcaacagaaatatgaacctttgtggctcaaaggaggaaatcactgtaatttagaactctatcccgaataccttcgacatctcagaaaattcatatcctcggtagaaaagccgccatcacaaagagtgagtttcaggagaagcatagacagagttgaacaatctagaggaagtactgattgctttgaaacaccgaggaagagtactgatcagagggacaaaccaaggaaaagtactgataggacagataaactaaaatttcatgaattcaaatttaacaatacggaaaagtagagaagataaga

SEQ ID NO: 2111 - DNA, 738 bp, Glycine max
atgcagaaagagtcagttgttgtgtttgatgaagctcataatattgataatgtctgtattgaagcacttagtgtgagtgtgaggagacagactattgaaggtgctagaagaaaccttagtaggatgcgtcaggaaattgacaagtatgtgctgtttctagctttctccttttgtatggtgccaattttttcactattacaacttaaatagggaagaacaggagaataaattaatagaatttaagaattctgtggaatttggcatcttctgtacaatgcaaataaccttttatacgttggttaggttgattcataaaaggaagaattatgaaggatcaaactttacctaggggcatggggaattcctgccctttttcctgtgcaatagtgccaatattgctttattttccatttgtacccatagctgaaatttgattcagattctcttaactatcggaatttgaactggtaggaaggttcaaggccactgatgcaggtagactccgtgctgaatacaacaggcttgttgaaggtttggcactaagaggagacctgcctggtatgtaggatgagagttttgttcttaatgtcttaattcttaaatgttacctctggtcatcactaactaaaacttcttttctttacgtagctactgatgcctggcttgcaaatccagccttgcctgatgatatactaaaggaggctgtacctggaaatattcgccgggctgagcatttta

SEQ ID NO: 2112 - DNA, 471 bp, Glycine max
tttggagctgcaaattccagaaagtgaggaatacaggtttgttgatgtttgaattctgattcagtaagtatgttttcttaaactaaattcgtctgtataaccaaaatttctctctaattacaaacaggtgggatggtaaatatgagaattcagcttatgctcttccaaattgagaaattcctatgtctgttaaatgttgcttcttttagaattcccccaaaaatatgtcatggatttctgtactttctggtatgcattaatccaggctactttttgagttcttgaacaaatttcaacagatgaaagaagttcatgaagagtagtcctctaagtttggagtattaatttttggtgtacaatgacaataccaagatttgaacttagaattttatgcaaattactcaaactccttactactaagctgttgtgggttgaatggtttcatgatacgagagagcattgataagctgg

SEQ ID NO: 2113 - DNA, 483 bp, Glycine max
ttcgctttttgcccttgttgcaaagcaaccaacatttcatcagctgcgatcagttgagcagctggggtacattactgtgctcatgcagaggtatgttgatctgtagcatcatttatgtagtcagcttgaaagacttagatttgtttttaactgcaattttaaacatgtgtaggaattattgtggtatacatggactacagtttattatccaatccacagtaaaggtattactattttcctatttggaatttggaactaatctaaaataaattttaatttatgacgcatgcttaagcccagcactttacttgcttatccagtctcctggaaacattgagcaaagggtcgaggcatttctccaaatgtttgagaccaaactcctcgagatgacagttgatgaattcaaggttcgatagttcaattcatattttatttagttttctggaattgttggtagatatgcctgacttactccttgtgttg

SEQ ID NO: 2114 - DNA, 542 bp, Glycine max
cttttgaaactgtccggaaggtttgtttttgtttttgtactcacattcatatatactgcatgagtggacacatgcacgctccctaatttatatattatcatttttttttccgatataatttaggactctaacggacagccttcttgcaggataattttgttcttcattatgaagtggtggaaaagagaccttctgtgcctcaacattgaggagggaaaaagaaaccttaaatgtaaagtttttatttatggatttaatttttaggacgcaagtcattttgagtcattagtgttccttcaatttggcgtatttcttacattctcgtaaatcttgatgcactgagggctgttatccctttccccccagccataatgtagttaaataatggacgttaggataatctggctgtctggaagtggcggatatggatgtcttcccaatgcacagtgacacagttatacacctgactcctgggtgtctagtatttttttagcaatttactgcatgcacaatcatatttaacttctctgatagggagctat

SEQ ID NO: 2115 - DNA, 220 bp, Glycine max
  misc_feature (60)..(60): n is a, c, g, or t
cgcttttgcttagtctaatgcagagttctcaagaggatgttcaagagagggcagccacanctcttgcaacttttgttgtaattgatgacgaaaatgctagcatagattgtggaagggctgaagcagttatgcgagatggaggcatacgcctcctacttggccttgcaaaatcttggagagaagggcttcaatctgaggcagccaaggtactcttttttcc

SEQ ID NO: 2116 - DNA, 381 bp, Glycine max
gtatgggttgggcagcagtaaatatacttatgatgatcagtattagtactacaatttggcaataccctgataaatttgagaaggattggactgtttatggatcaagttactgagaagaagaaatgagatatgacctctatggtttgtatactactgagatatttgttctcattacttgaagtgcttggaaacttttgtgatgtatgcatgcaccttaggtaatgtttggggctccttattacaagggcaccacaagagaagagtgaacccccgattttgtagttttttttcgttttcttcactatatacattaattcctgtgcagtatgtatgaatgatagcagcatacttcaaaatgggtaacaagctgctgcttaatta

SEQ ID NO: 2117 - DNA, 424 bp, Glycine max
aggaatcaggtttgaaattttggaggcaatcacaaagcttctgaacaacaacattaccccatgtttgccacttaggggaacaatcacagcatctggtgatcttgttcctttgtcctacattgctggtttgctaactggtagaccaaactccaaggctgttggaccctctggtgagattctgaatgccaaagaagcctttgaattggccaacatcggtgctgagttctttgagttgcaacctaaggaaggccttgcccttgtgaatggcactgctgttggttctggcttggcctcaattgttctatttgaagccaacatcattgctgtcttgtctgaagttatttcagcaatttttgctgaagttatgcaaggaaagcctgaattcactgaccatttgactcataaactaaagcaccaccctggt

SEQ ID NO: 2118 - DNA, 819 bp, Glycine max
  misc_feature (29)..(30): n is a, c, g, or t
  misc_feature (783)..(784): n is a, c, g, or t
  misc_feature (786)..(788): n is a, c, g, or t
ttatacctggtttgcaaggagatatcccnnggcaattccattaagggagttccctttgttgctggaaagtaagatttttgtcagtaactaaatactaataaatttttattgaggatactatgaatatataaattgattgtccttcataaagcacttgtgttggatgattcggattattgatgttcttctatcaagggccttacagcctattttattattacaaaatgcatttcgttcagaactttattttttatgctttcggtgacagcattatattcaatttatacattttcataaatactctcaatgcatataaaggtagtatatctaagttttattagttgttatcaatcattttgtctatgaatttagatattgtatgttaaaactcatgcttttctgttcccatcagtctggggacacaatcttagcattcctcagactattttattatataaattgtagagacctgaactaaaaaaaaatcttttctttttaattactttaacccaggaacaaggttgcagcttgtgccaagcactacttaggagatggtggcacaaacaagggaatcaatgagaacaacactctgatcagttacaatggactgcttagcattcacatgccggcatactatgactctatcatcaagggtgtttcaacagtgatgatctcgtactctagctggaatgggatgaaaatgcatgcaaacaaaaaacttatcactggttacctcaagaacaaattgcatttcaaggtaaaaaattgtctaatcaactctannannnaaatattaacaagtcaaaacgaaatagaaaa

SEQ ID NO: 2119 - DNA, 440 bp, Glycine max
  misc_feature (413)..(433): n is a, c, g, or t
ctctcgtctattgaggtttctcatctcattcttcactccttgatgatcgcactctacatttcccttcctccccttctcaattccccaatcaatagcaaccctcgatcccttattcctcttccaatcgcacctaaagataaagaataaatactcgttcaaacccccaaatccctgaatcccaattcacttgatcacacactctctgtttcgatcatggacgtggacggtggcaacaagcgcgtgtacaaccgcctcggtggggacgccaagcaccagaaagtgtgcttccactggcaagcgggcaagtgcaaccgctacccgtgccccttcctgcacagcgaattgcccgcgaattctcaccacgccaatggcgcctcctcgaagcgggcatacgacaattcgggcttctcaannnnnnnnnnnnnnnnnnnnnggggggg

SEQ ID NO: 2120 - DNA, 400 bp, Glycine max
gttggcacccgatgtttttagcactgttttgtatcggttttgccaccatgtgtgtccttgtccttgtttctttgcagcagtacatgtatcgagtctttccagtggtgtttacccaatttttaacgtatttgagcttatgctctgtacgcgatttttgggtctaagttttagtcaaggggcatgttgaagttccagtttatgtggtgatgttgtcctggttactttggcagttcttcagagttttatgaagcctttgtcatcgggagctttggtcatggcagcaagttattatacaggtctgtcgtcacaatcttttccctttgggggatgggttgttttttttactaccaaagcccttgttttttaggcttcattttttttggaacttgtcattgtaacc

SEQ ID NO: 2121 - DNA, 1290 bp, Glycine max
  misc_feature (1244)..(1251): n is a, c, g, or t
gctgctggtatgtcttgctaaggtacacaaattaacattaccttaatttttcatttttcatatattcaatttcttcaaatcaagttctttttgttaacgtttagtttgtacccacttgaatatgagagtgatgattttcttttgttgttttgtcatatacaggtttcatctgatgttaacatgcaaaaggaagaagatgaagaacttcgctttcctaatcaccctgtatgttattttttttccttggcaagatattagtgaaaatgtttctttacttttgtgattttcttatgtgcttgatgtaaccgtatatattataatatccttactggaaatatcaaattctcttcagcttatcgtgagagacgggaacagaaggctaatgcaagacataggtaagcaaaacaaagtattttggatgctttattaggttaactttgatcctgtgcttccggttttaacttttagattcttactaactagtctccttagtgacattttttaaaaaaaaatttaaaaattatcataaaaataacatgaaagcctaaaaaaacacaagcaatgtaattttatatgtttcgataattttttttctttagattttttaactaatgtcctatatgttcccataaattttttcttttaattttttaactaattctctaagaacattagtcgatttttgcctaacttttaagcatgagtacccattatcatttttcattctcaccaatgtatatatcatatatacataaaaagcctctagaatcagactactggatgctcatatagtatacacaattttatcttcaagtatgaaaaattaaaaattaacataagatttaattatttatttgatttctatacacaattttgggttttagtctatatatttagaaattgcctgatttaggtctctaaacatatattcttccatctattttagtcattacacatacatattttaatcttaagacaagtagtaaattatttatgtacttcagtcaaagttattaaatcttaaaataaagaaatgatttttgatatatttgtttggtggtggtgttataaatgactatgattatgcagattgcggaggattgtgcaagacaaggtgcagtgcccattcgaggccaaacgtgtgcaacagggcttgtggcacgtgttgtgtgaggtgcaagtgtgttcccccaggaacttcaggcaacagggagctctgtgggacctgctatactgatatgatnnnnnnnngcaacaagaccaagtgtccgtagagcccggcccatgaag

SEQ ID NO: 2122 - DNA, 404 bp, Glycine max
gaggagcgaggattttccgacgttggagcggccaacgagagcgaactcagcaagtccatcggagggacaatcctcagtcttcacgctgcttttcacaaactcggcctgcaataccagagcatcattggcgtagttactcaacagaatgttggaaccgttcaagactctggaactttcgagggacacggtggtctccggcggaacgaagagcttctcgagggatagctctgttggggaagggttaacacttacgggttctgaggcggtgagagtggatttgggtggccgtaagagggtggttttggagtaggctcggagagtgagggagggagataaggtaacgaggtagagagggaaccttgggaggtgaagaaggaccatttcactgcactttagggactcag

SEQ ID NO: 2123 - DNA, 833 bp, Glycine max
tgacgctggtatttaatctcatagagtttttaccctgatgtttaaaaagtgtttgcctcatcctttatctgcactgttaaacttaatgttttcgactcaatatgttatagtctctttcttcttagttagaagttgtcaatgattttattgacagtagattaggtttgtttgtatgttgagtgtcccctattatgtatgctcacttgcattgagctctattataatttgtaatggaatcatagtttattcatcaaaaggaaaaaaacaaatgcaagcaagtctagcacttgtattattgtttggaggggagaaaaattttcccgattcattttgtttcctaattttttttgtgatgtattttgaaaagattatgcattgaaatattttaattcttctaactgtgataattattattatgattttagtgctgatggaatgatgtttggagcacttggtctttgcccaatatgttctggctttctgcgttactctggaggaatgtaccggtgccatggctacatttccgagtggagtaaatgttcttactctacctgtgaaccaaaccgtattgaagggaagtggaaaatcccagaagaaacaaataatcagtaccttaaaaaagtgtgtgaggaaaaagttgtcataaaacaaaaccaataaattatgatttatgactaaagttttttcttacggtttacagtggttcaaatctcaaaaagggaagaaaccagttaggatattgcctcttccatcaccaaggaaatctgctgaaagtaaaatgattgctagtcagcatcatcattcatcaaataggaaaattgcgagattgaaag

SEQ ID NO: 2124 - DNA, 334 bp, Glycine max
gacttgagatctctgacattggagtcctgtaaggtgacagcaaatgacatcaagaaactgaaatcaatgtacctcccaaatttggtaagctttcggcctgggtagttattgcggtattctgatatgtgtatatgtatatattattatacttatatatgtcagtggtactgaagtcgtatcttagagaagaatggaaagacaacctcaaattgtacataggctataataatgactttatggaaggtgtaattctgcttgtgctgcgaagttttgttgttttattgtaaatgtatatgtatatgatatgacgaaaaagaatgatgcagggacgtgt

SEQ ID NO: 2125 - DNA, 871 bp, Glycine max
ttttcctacacaatgggggcaacacttgcaaggctaccctctatctcttattcataaccacaaccttttttatcgcaaactctgcaaggattctagatgaagtggaatcccaaccccaagccataggcaatctaccagcacctggagctaccaatccttcactcacaacagctccagtcaccaccacaccacagatagatcctgccaccactttgccaagtggccaaacatctgcacccaccaccatatcacaggtaggccatgaaacacccatactttaatttgtttcacgtatatgtatatgtatcctaatctgatacacattagatactatatactcttgcatactttttccatacatatatgtgaattatccatgcctttaaaaatgctaagaaaatctaatacaactaatcaattacatatgagacgtggaagcatgtgtggtatagaaatatatatagagacattttccattaatgaccaaaaaatggacattgtcctatttatgaatgatctcaaagaaaggaatgagattgatatactacttttcataggaaggaagtaatttaagatgatgatgatgataatgatttataatttttattttattttcactaatgtcctagaagtatgttattaatttggatttgtaaaattgaaattatatatttattatattttatgaatagacatgtatgttacacgtggtatcctgtattggatttaatacatgtatcgtatttgtgcatcatagcaggtaggtcctgccaccactttgccaagtggccaaacacctgcaaccgccgccaccatgaaccctgctactacagaagactctggagaggaagatgataaccaagtagagcca

SEQ ID NO: 2126 - DNA, 1043 bp, Glycine max
  misc_feature (64)..(66): n is a, c, g, or t
  misc_feature (982)..(983): n is a, c, g, or t
tatgcactaaaccatgttactatatccactcatcggctgaaaactcatttgaaggagataaaannnctaaatcagtttattaaggatagtggattcagattgaattctgaaggaggagtgctgaaaggtttgtacccttgtttcttattatgcaactataaggttttcaaggtttttttcttaccaaaataaaagcattcaatgttcaatgtaagacaatctcaggttggtttctttctgattaagacaattgctatctcaagtgaaaaaaaatgaggattgaagagaaaaatcccctcatattcattataatggcaaatatgacaattttccttcaattcctgcttgtgttcaccttctgaaagttttccttgctcatcagatctatcttctttccctcactcctatgttggaaataaaagtcccgtaaagctgtttaatctgtttgcatgctcctaattatgagatgtatactgaaattataacctagattaactatgaacgtgctgatataatcatcttgaaattgaagatgaccatagcaagttgtaattcattgtgatcaaggatcatgtgaatgatttgaatatttcctctacttccagtgagccctgatggtcttctccagcaaagctcaactgtagcagattcaatttctttcaaattttctgatggtataactgaatcagttccatgctcatacattgaatttgctgagcgactggtgctgccgcagtataaaaatttacctgacacagaggtaagcatcattcttttcaacatcagctttcaactttttattataattcttatctttggctgttgatgattaggactaattttatgaccagtgtttttggttactggtgaaacagtgaactactttaagaatttgaatgacctgctaatataatatgtattgtaagacatttttctgcaggatttgctaatccttgtttcgtttttaactaatggagcaggnnaaagagttccatagaagagatggttttgaggtagcaagtgctgacaagatattgaaagca

SEQ ID NO: 2127 - DNA, 1134 bp, Glycine max
aatgaacaggttaccttctaaagaaagtctgttatagtttctgcatggtttaacttcctgaattttggctctgttgactttagcaatgtgatggccaatgaaaaattcttaacaatgcagtgacactttatctaaaggaaacacatatcttctgctaaaaaatagagttaagtcttcaagaatacttttaaatccttcttattatgttttcacaataataaatttatgtactttttttgtttagtactttattagtattatgaggattaatagtgcgtatgagaacatgaaggtggatgtctggatatgtaacttgagataagtgtagcaaatactgtatgcctgagaaagttggagtgtcacttattgagtaaaaaatgagagaacctgaggtggtttggttacatgaaaaggcagattgacaagatttgatggtgtctgtccattgaactatatgtagcttactctacttgtgtgataaagcctgatttttattattttaatcttctttgcttacttggatatattccttgaaaaatagagtccaacatgggagaagagtttagatgaaggcaactaagatatgtattgtattttgcattttctttctttttcctgggtttataaatatagttttcactttattttatttcttgggtgtagtctttatttccatagaacatgtgtagttctgtggtaacttgatagaaacgcagaaaaaataagattgaaactagagaaaaactgagaaagaaccagaagaacagaactttattgacaaacagaacaggaaatgtagaacagaattctcctcaagggtttccccttcaccaaggatctctccacctgcagaatctatcaaattcaagaatacttccctctaatctgatttcccctatttataaccagtctcttctaactaactaactagtcattattgactctcattataaaccctaacttaccttttattcacactttgtttatatctttgtaacaggagtgggcaatatgtatgggaggaccatcgccctagatccggtgtatggaagggatctagtggtggagaagttatctgcttcagtggatgcgacgatcatcaaacttcagctgatacatctgtaagtttcagca

SEQ ID NO: 2128 - DNA, 314 bp, Glycine max
aggctgctgatggcaagtttcactttaaatctcactggcttttatgctattgaaaggtgagatggaactattagcaggtgtacataagttccccctcttgaaggcttagaaaccaaaaaagaaaatatatcttgtgtaaaaacttggccttatgtgaacgaacctatgattaagacatgtgatagttgtgattttgaataaagaagcgcacaacatattaaagctaatagctgatgaaatgattgtggtatgtatgtggaaaacatagagattagatcaacataataccacagcactgtcatgttacttgataa

SEQ ID NO: 2129 - DNA, 382 bp, Glycine max
ctcgtgagatcggaggcgtggagggcgagtgggtgaaacgggccctgacagcactgattcggcccagttcgcatcaacagaggaggagagcggggttcgagcccaggcccagtcgtctctctgtcatgtccaaagcccaggatctatgattttcttttagaaaaaaggttttttctatttacaccttgcaggttgttcttgattttgctggtttatataccataccacccatggcgccctgatctgccgccagagttggattccggcgaagcggttgggaggtagcggcgagtcctatccggcgagttttggtttcgtcgtctggagcagattggtgaatttggctgcatagatctatgacactggacctacacattgattt

SEQ ID NO: 2130 - DNA, 529 bp, Glycine max
gtcctgattttgaagcagatccattactagagagtggaggaacaatgtaaagttatctttatcacataaacataaaagttaaaattgttatgaacatcatttttcctattataggttattccaataactgtcttttctatttgctacagatggtcctttaatttcttgttttacaatagaaagcttaagcggattgtatcttttcgattcagttgttttaggtgagttggaaatttcataatctctttttcttaatctacttcttggttgcatctatattcatccctagcacgatgctatttgtggcagtaacttgattgctgacggactgcttattgatgatatacacaatgagtacgatgaagagatatttgctgacatggatatatgagtcgcttctacctcgattagttagcatatgaagacttctgatcctcccatgtgtagttctgtaatataagatggtttcagatgcgtagttctgtatatcaaagaccgtttcagtgtggcctgagtcgtagatatagca

SEQ ID NO: 2131 - DNA, 348 bp, Glycine max
  misc_feature (294)..(294): n is a, c, g, or t
  misc_feature (296)..(298): n is a, c, g, or t
gagacaccagctaagggtgttatacgagctatgttccctcatcattcacactctcaagtttcctccgttaccctacccttttcccacctcgtacccatgttcttcttctcgcgcttcttcgtctttgtcgcattctaggagacatcactggtggacaacgttggcgacctcccaggattccccggcagcattcgcgtcgctgtttctgggcatgtccctgtccctcatgcttctcggggcggtcacgttcctcgttgggttgctgctgctgccttgggttactcttctggtgangnnnttctatgttgctgcacttgtctccaatttgtctgtgttgggccgttcatc

SEQ ID NO: 2132 - DNA, 737 bp, Glycine max
gaggttctctccaaataccccaattcaggtagttattctagcctttcatgatcttgaaactaaattggtattccagttttataaacaaagatccaaggttctaaactcaaacctatttgcatatagcatcacctctgcaagtgattcaatttgttgaaaagtttaaaactagtaaagctacagctcgtttaggatccagcaacagattttgtggaagatgtttatcattcgtttgaaggatataaagctaactaaatggataggtattgttttttcatcggaaaatgttaaatgttagtttttgttagcaggggagattgaacccgcgacctttcctcccttaccttctttcttaaccatccaaccaaccttatatctcctggtattgttggttttattgaattgcattcttgacagtttcctttgatcttgacatcttcaggtattgtcttaagacctgctttcatatatgggaagaggagagtgaatggttatgagcttcctttggatttggtaggggagccagcagaaaaaattctacgagcaatagagaacttcaccaaacctttaagttctcttcctgcatctgatttactcttagctccacctgttagtgttgacgatgttgcgctggctgttatcaatggtgtcacagatgatgacttctttggtgtttttacaattgaccagatcaaggacgctgccaataaagtacgggtatgaatatgatcccggat

SEQ ID NO: 2133 - DNA, 853 bp, Glycine max
gttggagcttgacatggaaggggtgtggagagaaatggagaagcttgtcaaggaaaaccttgtcagagacattggaatatgcaatttcactcttacaaagctagataagctgatgagcattgctcaaattatgccttctgtctgccaggtgaaattatataccgagaaatattttttgtttaaataaaaatccctcaaacttggatcacttctagttttggtcctttaaatttaaatttgtttttttagtctctgaatttcgaatacttctctttttagtccttcgtgattgatttgtggtggtttgtatacaatttgtgatgatttttttactatatgaggggtctaaagagggcatttttaaaattgaaggactgaaaaaacaaatttaaatttaagggacttaagccaaaaatgacctaaatttgaggggaaaagacatatttaagccaaaaatgacctaaatttatgtttccttggaaggaacaatcccaaaggttgagtattggataatggacaatggtactccaataccacttgttttttctgaacttgtgtgtttgccattttgttatagatggaaatgcatcctggatggagaaatgacaagatgcttcaggcttgcaagaagaatgccatccatgttactgtaatcaacacattgctagtttaattagatttattttggttttgaattttttatgacaaagggccatgattgaaatgcaaaaattggtgaataggcttactctccactgggctcatcagacggtggaagggatctgatcaatgatcaaaaggttgataggatagccaataagatgaacaagaatccagggcaggtgttggtgaa

SEQ ID NO: 2134 - DNA, 366 bp, Glycine max
tgtccaagtgcacacaacaacacaccgctacgaagccggcgtcgtcccgccggctcgttttgaggcgccgcgttacgaagccggcatcaaggcgccctcttccatttaccattccgagagaggtccgacgacctctcaggttctcgcagttgtcgccggccttccggtcggcggcatcctcctgctcctggcaggactgaccctggctggaactctcaccgggctggtggtggcaacaccgctcttcatcatcttcagcccggtgctgattccggccacggtcgcaattggcctggccgtggccgggttcctgacgtcgggagtctttgggctcacggcgctgtcgtccttctcctggatcctgaa

SEQ ID NO: 2135 - DNA, 337 bp, Glycine max
  misc_feature (326)..(326): n is a, c, g, or t
atgaggaaagtttgttttgccctttgagtgaagaaccatatttttcctgctatgcacagggcaccgtttttttaaccggctaatattattattcttttttccgatcaatattttgttcatagcatatcatcatgtgtgccaccttataaagtctaacctgtatagcattgcatctttaaggcttttggaagggttcacccctagctagtgtgacccagctgtaataatttcattttcaggcataactctagtctatgttccttgtttcagtggttttactttcgaaaaacatccaataggatagcgagttggtatgttctgaacanaatattgttgg

SEQ ID NO: 2136 - DNA, 526 bp, Glycine max
atcgatgaactactgtcaaggccttgtaacagtcttcttccttgtcaacaatcaagcgcagcccataaatgtcatggatatcatctatggtaagtttcttcctgcatagagacatgaataattgagaaattggaagtgtacaaacattacagttcagcacgtcaggtaaaaaacccaaatggaacataagaaagataaattaaaaaatttagcaactagaagaaaaagaaggaaaggtatagcatactttaacattttgcaataaatgctatacaagctcttatgtcgcccagaaatgacattataagaaatgccttcatctttaagagcttgctctaatctctctattgcagaagtaatcattgcatcatcgtacgattccacaagcttggatgaaagctcctcatgctggcttgggttgagatgcttaaaacacaaattttctaattgttccttccaagtagaaattcccaagcgattggccaaaggtgcaaaaatctccaaagtctcctttgcaaacctcagt

SEQ ID NO: 2137 - DNA, 547 bp, Glycine max
  misc_feature (468)..(468): n is a, c, g, or t
  misc_feature (470)..(475): n is a, c, g, or t
  misc_feature (479)..(489): n is a, c, g, or t
  misc_feature (496)..(501): n is a, c, g, or t
  misc_feature (504)..(516): n is a, c, g, or t
  misc_feature (522)..(538): n is a, c, g, or t
catatatacacacaagaggcaccaaaaagtttaaaattcatcttacacatttatatatgctccaaaatgttacttaatttaacatgttagtcataggttacttaaattaacatgttagtcataggaaaatgtgcacatgtgcatgtttgttaactaacttttcatgcaaattactaggtgtggccaccaattggcaagaagaagttcgagactctttcctacttgccagacctcgatgatgcccaattggcaaaggaagtcgaataccttctaaggaaaggatggattccttgcttggaattcgagttggaggtcaatttcttgcaaccccttttggtttaattatagtttcttagtcttagtttgtttcaacttattttgaagaaataatcgcttctcttgctggcgtgctaaaagtacttttggaaacaaaaaaaaaaaaaaaaaaaaaaaaggggttttttccanannnnnnattnnnnnnnnnnnttttttnnnnnnaannnnnnnnnnnnnaaaaannnnnnnnnnnnnnnnnaaaaaaaaa

SEQ ID NO: 2138 - DNA, 1183 bp, Glycine max
  misc_feature (60)..(63): n is a, c, g, or t
  misc_feature (1168)..(1176): n is a, c, g, or t
atgtgagtggccgttgatgcttttgatagtttgattggtttctttgtctatttgttctgnnnnttatgaatgaactgaagttagatgtctaatgaatctgtttgatgctttctgcttttgcaggatggtcccattgaacctcaacgatattacgaacttagggaaaaggacaccattaaatttggtaacagtaggtatgtgagatgtagatattaattgattttcatgttcaaagtacgttttcttttgtttgagtagaaaattattagccaaagttgtattagtaactgtcccactttccaatgacaaaaaagattatattttatggctttgttaatatgaaatatttgtcattcattatttgaaccaagttatttggtaattaggtttagattcaagaaaaaaatttctgtaatggaaaacaattccgtaaaatgattaaatgaaaatttggatctttttgggtggaaaggaaggacaaaattttaagtagctcaatttgaatgtatggaatcatatcgtctgtattgaccttcacttgagaggaggtatgtggaaattgttggttagcaagtaccaagttcaggcattcctgttctgacacagaagtctgaagccaatttacatgaacctgaaaaacaattagtttacttctcatgaagatgaaaatttcataatattgggacatctttgtcgggatgatttaaagcatgtgactgaaaattttcgtggctgcactagtttgtctgaggcatgttaatgcaatgattttccttgctttcttattcttttttgttggaacaaaaaagaatacatctataacgcttatgccctattctcctcttgatttttcagtatgcccaatgaagtaatggattttgtaccttactactttgttctatataaacgcatactaataacattttttgttttctattgcagtcgagaatatgtattactacatgagaattctattgggcaatagacattagtctccaatttcgctctatctgctcatcaatactgattaaagcagcatttgacctgcagttttttgtaattcatgtccaacttatgtgtattccctcctttcagaagtttctagatcagtttgtcaacaagtttcttgttattattatatatacaagacacgttggataatttatcnnnnnnnnngtatatc

SEQ ID NO: 2139 - DNA, 493 bp, Glycine max
  misc_feature (408)..(416): n is a, c, g, or t
  misc_feature (437)..(438): n is a, c, g, or t
  misc_feature (441)..(443): n is a, c, g, or t
  misc_feature (455)..(455): n is a, c, g, or t
  misc_feature (457)..(457): n is a, c, g, or t
  misc_feature (459)..(459): n is a, c, g, or t
  misc_feature (464)..(470): n is a, c, g, or t
  misc_feature (474)..(476): n is a, c, g, or t
  misc_feature (482)..(483): n is a, c, g, or t
gctatttgactgcttcggccatgttccgtggtaagatgagcacaaaggaggtggatgaacagatgatcaatgtgcaaaacaagaactcctcatactttgtcgagtggatacctaacaatgtgaagtccagcgtgtgtgatatcccacctaagggtcttaaaatggcatccacttttattggtaactcgacctcaatccaggagatgttcaggagagtcagtgagcagttcacggccatgttcaggcgcaaggctttcttgcactggtacaccggggaaggaatggacgaaatggaattcaccgaggctgagagtaacatgaacgatcttgttgctgagtatcagcaataccaggatgctactgctgatgaggaggagtatgaggaagaggaggaagaagaggagatannnnnnnnnaccctaaaaaacaaaaccctnnctnnnatctataaaaanangnattgnnnnnnntatnnnccttgnntttagttgta

SEQ ID NO: 2140 - DNA, 831 bp, Glycine max
  misc_feature (688)..(690): n is a, c, g, or t
  misc_feature (692)..(692): n is a, c, g, or t
  misc_feature (720)..(722): n is a, c, g, or t
  misc_feature (768)..(769): n is a, c, g, or t
acgcatacttgttattttgcaggtaaaagtaaagttaacttacatactatcatgagatatttattgttcttatttcaagaatcaagcaggttaacatatatggacgatgcatcccaaaataaaaattatgaaaaatggacttcgtcagacagcataacatatcatattgcttttatggtaacaaaccaattgagggttctaaccaacaagaaagaaagtagagtgaagtgtgggaataacaataatagaaacccaatagagcagatatgggaattacaactaagtcgcctccatcttgtgtcctctttatatcaattatggaagcaccgttcaatgccccagaaatttgtgaagtctcatcaaaattgaattctacaacaggatcagcagggaaattcaattcaacataaaacccatcctgagcttcacccttttgcaagtctgaggcactagtgatattgatcgctgggatctttttggcagttaatattccagatatagccacaaatttgacaacatcggtgtcctccaaaccagatgaaaatattgtgtgcgcagcagctaaggtcgcaagtccacaaaggttaatatacataatggtacatgatccacataataagtcaagataattaagagtttatgactaaattaagtttattcgcttcatgctcacatgttcgaatttttnnnanttgacatttctaacaaattaatattttnnnattataaaagaaaaaaaaagaaaggatatagtcattccggccaagnnagtttatttgatttacctcactaacaggagtgaaccatctgagatcaaaacgaggataagag

SEQ ID NO: 2141 - DNA, 613 bp, Glycine max
cattttttggcatccatgtgcactccacacccatcaatctagttttctcagaaatcactgttgctactggcgaggtaacaatcctttcatgactgtctttattctgctaatcaacaattaattcaatcatgccaaacccactttcactctcactccccctaatgagacttttgaattggagaatgaaataatcacctttggtgtacccttggagacaacaagttttatgttcatcaacataaatagtgtgacattgggaaaattaaaatatatcaagtaacatgtgagtaacatagcatttgcttattgtgcatgtaacttgttgcagctgaagaaacactatcagccaagaaaaagtcaccgcattgtatcagtgaacctagagggtactaaggttcccttatatggggctggatccaccataactgtatcccaaactggtgttgaagttccactcacattgaactttgaaatccgttcgcgtggaaatgtagtgggtaaactggtcaagacaaggcatcgtaaggaaatcacttgccccttggtcctcaactcttctcgatcaaagcctatcaaattcaaaaagaattcatgcacctatgattgatcagtg

SEQ ID NO: 2142 - DNA, 717 bp, Glycine max
  misc_feature (535)..(536): n is a, c, g, or t
  misc_feature (609)..(609): n is a, c, g, or t
  misc_feature (614)..(617): n is a, c, g, or t
  misc_feature (648)..(650): n is a, c, g, or t
  misc_feature (663)..(665): n is a, c, g, or t
  misc_feature (667)..(667): n is a, c, g, or t
  misc_feature (674)..(680): n is a, c, g, or t
  misc_feature (685)..(690): n is a, c, g, or t
  misc_feature (708)..(714): n is a, c, g, or t
tttttcttttttcttatattctccatatagaaaagtatgctatttgttacattgttttcttttggtatcaacaaatgattatatggcatatgtatattttaataatagatgatatcagaacgacaacgaattgaagcccctcctacacctagtgtggatagcagcatgacaccacccccatcatatgaagaagtaaatggtgtatgtgcttctcaagcacataatggctcaacagatagtatgggttacttcttaggagaggttagactatttcttgcactaaagttagagatattgtaccgaaaaataagtgtctgtttagtgcttacatttactttctattgtacattttactcatgcaggtgttatttccctaccatgctgagtctgaagttgaattgaatctatccgtcggagattatattgtcgttcgaaaggtttgtctcttgcccaagtctatcgttacatcttttttttttaaggaatctcttttttccttgggaaaaaggctttatatttggattgtttttcgggnntttcccacccataaaaacaaaaattttaaaattgacccttgaaaaaaaagtaaagtataagggaaccaaaagnaaaannnnagacccccttcctttcagtttaaccttcaannnaaattgttaatcnnnantgaggtnnnnnnnttgcnnnnnncaggacatgtttgtcccnnnnnnnaaa

SEQ ID NO: 2143 - DNA, 504 bp, Glycine max
tctctatttgtttcatatattattattctcttttagaatacacaattgtttcactgtgatattatagttgctaaggtgaaggttaatttttgaaatttgatccttatatacaggttgggctaccaagttggggaactaccatgcaaaaagggacaaccttcgacgtacgaaggcagcaacgggaacctaactacatgggacaaacctcgtacaagtggtggtaccttggagtccatagttaaccaacatgtcagcgaaaactgctataaattggttgctatggacgcattagtgccctgttcgaaacagggcacacgcaaggcagtggagtcgggaaggcttggtgcgtgccgagaaagtagttccacgcgcgtggcgtcgcgtgccagggtggcggcgcaggaggaagtggggaaacgcgctgggatggtggcgcgtttgcctacaacgctagaattgagtggctgcaaggattggagcgtgagtggtagtgaaacttgtcgt

SEQ ID NO: 2144 - DNA, 389 bp, Glycine max
tttctgcttttcatactcatcacaacaacaataactctggtctcatgtgatccctgaaaaagactatatcaaggaattcaaaaagagaaaaacgaaaatactcatcctcataagcatgacttcagcgtcaccgggtcatcggagaaaattctccggcaaggacccgccgagttccgggcgcaaactccagccagagaaacactccggtcgccgatttgcgcccgctcctctgacgctgaagcttccgttgcaaaacagtgagtactctcttcttcggccatcgaagctgttgctgaatgtgaccatcgagaactgtttgggggccgtacaggtgctgttgtcgcctgaggacaccgtcgccgatttgataaaggctgcattggcgttct

SEQ ID NO: 2145 - DNA, 330 bp, Glycine max
gtagaaaggccatcattttcagaaatttccaagaagctgaggagtatggctgcttcaatgaatttgaaatagtcaattgatcttgaataagttaattgaccttctcacgttgtatgtagcctagaattggtaaaagggaaataaggtgaagcatggttcttccagttcaaggcaccaacaagcttagctttaaaaagggaaaaaataatttaaaggagtgttcaagcttatccaagcttgtatcgtaatatcatgccttggtttagtctaaaaatgttttttgtaatgttgcctttaatggtattttccttggtgcagttacttgcacta

SEQ ID NO: 2146 - DNA, 706 bp, Glycine max
  misc_feature (60)..(66): n is a, c, g, or t
  misc_feature (649)..(651): n is a, c, g, or t
  misc_feature (662)..(662): n is a, c, g, or t
  misc_feature (696)..(696): n is a, c, g, or t
  misc_feature (698)..(701): n is a, c, g, or t
tataggcatccctaaacagcacacggaaacggcaacaagccaagtcagtaaacacagtcnnnnnnngcaaaccataaaagggacgccaataaaatcgacctcaatcgtcgaataagctgagctattattgaattaaaccacacgacatatgactttcaatatctatgataaccacaacggtaaaaatagaacaagccaaattaccatctgaatttgaaacccgagaagcgacgcatattcgaattggtaagagaatctgagaataaaagggaattgagtatggataattataattaccgagggagaagggtccgattccgagaccgggacggagatcgagaacgatggcgcccatggcagtgccctcgcaacggcgtctaggtctctgcaacatagtggttggtgagagagagagagagagagagggtattttggagtttgcgggttaagttactttcgttcggtgaggaaagcaagccaaacgacaacacgcagcgcaggtgaggtgttgaatgcttatatagggttgtatccaatccaattcgattcgcgattttgattaagacggaaaaacaaaccaccttcgttatgctttttcaacaccgcaaacgcaaaagatgcccctctcgcacgccacggaaacccaacnnnattctatttcnttttctcttttcataaactgttacgccctgattnannnngaggg

SEQ ID NO: 2147 - DNA, 409 bp, Glycine max
ccttttggcaacatctcaaaggggtcagcaccttccatatcgtaatccttatcagggtcactacttcacctctcatccataccaagaagaggatgatgccacttcacaaatgctcaatcttggatcccatcaccaccctgtgactgggatgtttggggagatggtttatgccagggtgtttggcaacccagaaaacttgtatgcatacccaaattcttatcagctgatgggaagtgctacccctagactgagaaggcaagagatgcaggcacataaatctttgaacagaatttctatttttctcttttgctgcttccttctttgtcttattgtcttctaagtgagcacttgacattattttctctcattatctattgtatactttgtaaagaaggcaagagatgcaaga

SEQ ID NO: 2148 - DNA, 372 bp, Glycine max
gaagctaccactgttcagaagtgctacattgagcttgccaagcaagtcaaggaaaagctttccaaggtagatccttactttgacaagttggcagatgccatggtcacttggattgaagcttgggatgagcttaaccctgcgggagcatcagtggccaatggcaaagcgtgaatcggtttttggttaactgcataacagccacagaacttggaaatggaactatttatatactgtattttttttccttagtatttatcttcaacttagctgttattctcggcttaaaatttgcagcattgttagctgtaattctgtttaataacttcatcatttgagcttagaaacaataagtacacccgtagggcgttaaaa

SEQ ID NO: 2149 - DNA, 374 bp, Glycine max
tggttgcaaaggaagataagataggtaccagctatcacatagtttatttaatccgttatatgccacctgatatataggcatattagctagttaggtaggtatagtagtttaagttaattcaaccatggaagacagggatcactgttgttccaacaattcaacgatgatcacaacaacaaagaaaagaacgggtagaagaagtccaacatcggataagctcaagaatcaacaccgcgagaagcagtcgatgaaaccttaccgtggaataaggatgcggaagtgggggaagtgggtggcggagatcagagaacccaacaaaaggtcgaggatatggttgggttcttacacgacacactctatattcccttagtgtg

SEQ ID NO: 2150 - DNA, 218 bp, Glycine max
tttgatgttgaaaaatttgatgtcctccgaaccagatggtacctggattttactgtttttaagattctgtcattggtacttgttagtgagtctgaatttttttacataaagaaaaccagttgcatatattggccgcaaactctgaattattgggtcttccagatatcatttcaacctaacgttaactgttgagctacactatcacgctattacaatgg

SEQ ID NO: 2151 - DNA, 399 bp, Glycine max
tcttcgattgtgtttacacgtgtgtgttaaaggtggcgaatcctaaagagaagggaaatgaggttgatgacaataaggaattgatattattccatgaagggataatgaacaaccctacattgtcaaggctatttccgggtttgaatagggagagggagatgtctgctatggtctcagctttgacccacgtggtctccggagaggtgccaataaccggtgattcttcttcttcttcttctttggttcttcatcatcaacctcatgatgatactgttattgttacaccaaccatgccttcttcttcttcttcatctacttatgttgttggcacctcttctctcaagagaagtagggaaaatgatacatatacatcatccttattctcacatccaccttcaa

SEQ ID NO: 2152 - DNA, 709 bp, Glycine max
ctcttggaacgaccctttcacttcttcaggtgtgtgttaagattctcaatctctcgtttgtttccagatctggtccaatttctttacgcacttcccttttctcttttactttaaccaggcacctactagctcgcttatttctcaaaaaaacaaacgcaccttagcggattaaccttttaattacccccttttttctctttccgttcttgcttttcatttccacaacttttgcagtttaacaatcattttcacttcttttcacgcctttcaagctcattcaaagcttcctaattttccccatccccctctttttacttcatactttagtatccaacatttttttaatcaaattaaagaagaaaaaaaaacattaattcctagtgttggttgctatatgctaaatggtgtgttttgcatgcgggtgaagctggatcatcattccttcgaggaatcgatgtgaaccgtttaccttctgtggtcgattgcgaagaggaagcaggtgtgtcatctccaaacagcacggtttctagtgtcagtggaaaacgtagcgagagggaagaagccaatggtgaagaaaacgacacagacagagcttgttccagaggcatcatcagcgacgaagaagatgccgaaacctctagaaagaaacttagactctccaaagaccaatcaattatcctcgaagagagcttcaaagaacacaacactc

SEQ ID NO: 2153 - DNA, 760 bp, Glycine max
gccttgggttcttgatgttgccaagaaatttgggctacttggtgctactttcttcactcagacatgcacaacaaacaacatatacttccatgtttataagaagttgatagagttgcctcttacacaggcagaatatttgttgccagggttgccaaaacttgcagctggggacttgccatctttcttgaacaaatatgggtcctatccaggctactttgatgtagttgtgaatcaatttgtcaacattgataaagcagattgggttcttgcaaacagtttttatgaactggagcaaggggtaagtgacttgactagctgaaaattctcttcattaatttgatttgtacttatttgttggaatgaattagacagcagtagttatctgggtaaaaagtttttccttcaaattttggtcaaaatttgtcctagttcctattacttcaggatgattctggtcttcttttttatttataattgatggattttgtctctcatcctagtatcctaagttccataaaaagagaaaaaattcatcaattataaaaagaattcaaagaccaaaaatatcatttttaaagtataacgactaagaacaattttgattgaaattagagagatctagaatacatttttatcctagttattttgttggataatattgatgattgaaatttgaaatgaaatttattgtaggttgtggattggctggtgaagatttggccattaaagccaataggaccatgcctgccatctatctact

SEQ ID NO: 2154 - DNA, 825 bp, Glycine max
tatgcaaagagcagctgggttgtatggttcattgatagtagatttgccaaagggacaaaacgaaccgtttcattacgatggtgaattcaaccttctttttagtgatttgtggcacacaagctcacatgaacaggaagttggcctctctacaaaaccactaaaatggattggtgaacctcaggtaattaactcgattaaattaacataaattctatttttcttctctttttttctttgcaaatcttatacataattgagttatcaataaaaagaataaaaaataaccttcactatatattccttaattatgtattgaaataagatgcaagcatatatatgtatatagttattactactttagcttgttctgtatactactttagtttgttcaataacaactcttaaattttgacaaattcaaacaagattctattattaatttttactgagtacataactaattattttcataactaacgtaagttttgtctctataattcatttaatctttatttctttgtatcttctaaaattccgtgaaataacttaaacttgaacatgtggcccatctgcgcaaagtggtaatgaatttttataatatagggcttctttaatcttcactccccaactgtttttcttttctgttgaatgataaaagaattaaatggtcgtaatttccactttttttagactctgctcatcaatggaagaggacagttcaattgttcccttgcttctaaattcatcaacaccaccctacccgagtgccaattcaaaggcggtgaagaatgtgcccctcagattcttcatgtggaaccaaacaag

SEQ ID NO: 2155 - DNA, 409 bp, Glycine max
caggccaccgccgacaaggcgccattgctcgatgtcacccagttcggttactttaaggttttgggtaaaggggttttgcctcagaaccagcctctggtcgtgaaggccaagcttgtttccaagatcgccgagaagaagatcaaggaggcaggtggagccgtcgttctcaccgcctgattttttttagggtatttttatttaaaaggattttgagatctgttgttatttttggttttggttcttgttttaatctgtctgaactggattagtttaaatgttttttttttatattctcaatgttctggattatatcgttttttgttgcgtgttatggtatgcgatgggagttttacatgcacaaatcggtatttacaatacggatttggaacgaggcgactaaggttaatgt

SEQ ID NO: 2156 - DNA, 543 bp, Glycine max
catatagccagaaactcgtcagaaatatcctcttatgaggacttcatggaatatatagatctaaaactcagtgaaattgaagctgaactagtgactgttttgaatgtctcaaccttggtactggataatgaagagagagcaaagaattctaggttgcaacaaacaattgaactccttgacagcatccatggcattagacagaggtataacacttcgatctattaaagcataatttttatagtctcctttgaagatttaactataaaaatcaatttagactaggtgctctgtagtgattttgaattattgatatgaatatattcatattaagagaaaataataagtaacgcaacactttttcaaatttccaaactcacagaattagaaatactaaggaggcaaaagtgaggatctgatcaattttgttttgctcgactcatcttctgcttccaggtgagaactaacttcatttgtaaaaaaaggtctgccacaattttcttgtatcccttaatcacttaatgtggaaacaggaaagacacattt

SEQ ID NO: 2157 - DNA, 374 bp, Glycine max
atgctgattttgttcatataaagatgttgcgtaataatacctttgttactgtaacagattctcaaggaaatataaaactcagtggttctgctggtccattgaaagacctgaaatcagggcaaaagctttctaggtatgcagccgaggcaactgcggaagttgttggccgaaaggctaggggtttgggattgaaatctgttgtcatgaaagtgaatggatttactcattttaggagaaaaaggaatgcaataatgagctggaaggagggctttactgctggttctcgaggggatagaaatccaattgtatacattgaagatactacaagaaaaccccataatggttgcagactcccaaagaaacgacgaatttag

SEQ ID NO: 2158 - DNA, 437 bp, Glycine max
aagtgaaggatcagaaagtgtaattgtgtaaataattggggattttagtttaatttgaattctatgaccattgttatggtttgtgttattgattcccgcttggaaaggaaaaattgcaattttggtcatacttttcggctagaacaagatgaaggacggttgacacattatgaaactgagaaaggacgcaatggtgattgcaccacaaccacaacaatgcatgctgaaaagtaattgctttgtaagacattattgcctaaacatgaatcacgttgtacttcaaagcattaatacatagcaactattttccaaagtttagtttagaactttagatattggtatttttatttggctagtgtcccatgcatccttgtagacaacctgattaacatgtaatgaagatatgtccaccatttgctataaagttgtcttgcctc

SEQ ID NO: 2159 - DNA, 637 bp, Glycine max
tcttcctctgctttcttctcttcttctttcttctctgcctcttgcttcactatcactgcatgcttccctgtcctcttgtacacgtgctccaccagcttcgctgtctcgaacacccccttcacgcttacctccgacttcttcagatccgcttccgctgattcaacccctgccatcattttcattttcaacaattttaatattaatattccactacacatttaaatgcaattgaagtcacaaaatgtgtgactttattattttactattgagttgaataactagaaaactgattatggtaggtaacaactgtaactttattccgaaactgaatcacagaataaaatccacaaattcttcccgggatgggaccttgaatgccacgagacaaagaaactttattacacacacaaacctttcattttctcgatgcgtctcttgatttcctgggcgcaagcttcgcaatgcatgtgaactttcagaacaactgtgataacccgaggctgcatatatagtaaaataaatatgaataaaaatgaagatttaaaacgaaaggaaattaaattaaatgaacctcttctttcttctcctctggtttgggcttctcttgttcctcttggggttttttctcctcttccgt

SEQ ID NO: 2160 - DNA, 272 bp, Glycine max
gaagttcgccttggtctgtctaagggaccagtgtacccaagtattatataattaaatttgactgttattctagtgccagaaaacagtattttgtgatcgaagtttcttgctattcgttaaaatgaaagtgtccaaggagttggcatattttgtgatcaaagcttcttgttttcctaatgctctggatgctagaaatgttattgatccatataaacagagcatgtctttcaaattaaagcagaatttatgcatgaggcatttgagttgagcaa

SEQ ID NO: 2161 - DNA, 392 bp, Glycine max
tttggctcccaattaaagcaaatcagttgctgcttgacgccaaacttgcagttttgtttttggtataagacttatgcctcattgttgttgccgagtcatatgccttaagttacataacagttgtttcagttcctaatggcaaaacgtatcaacactttggaaaaaagataaagggatttaacattcctgtcctataatgcaatgccattatagaattacttgcctgcctgaattgaaaaggtggagattgttaagattataacatttgttattcttttttttcttttctatattgacatactgtacaatcacataatttcattgtgtcgttgctcaatttgtatttgttatcaggcagagaggtttttggcacacctgtcagcaaacatatt

SEQ ID NO: 2162 - DNA, 744 bp, Glycine max
aaatgctaattcatcaagggaaagttcttagggatgctactaccttggaggagaataaagtagccgaaaatactttcattgtaattatgctatcaaaggtaaaattttcttctcttttttaaaaactactacacattggctttttaagttatcaaaatatattccattattttgtttcatatattatgttgtttaaattttatgaactactgttttgcaattatattcatttattctgcacttaattagaattacgtgcttaaaatatgttagagtaagagcacatctggtgaaggatctactacttcaactgcattatcaaccaaggtgagaacagtttgccatgttatgaatatttttaatgttactatcattttggcttttcccttttttgggatatggtaagacaaaagcttaatccatcttaagggttatgtaaagttatctaacaattatgtattcattgcaggctccacagacaagtacagttcccgcttcaacccctccagtggcagtagcgcctcaagctcctgctcctgctgcaactggggcactgtgagtgacatattcatcacaggattttcttgatttgttttgttaaatttcagttccgtccattttgaaatgtattgtatggtatctaaagctttctttcaatttgacaggcctgcatctgttactgcacctgtatcttcaccttctccagctccagccccagctcctgctcctatatcttcaggaact

SEQ ID NO: 2163 - DNA, 636 bp, Glycine max
ctttatgcttatggcctcttcaagcaatgcctactggccaccttcacctggttacaggccaagttccaaattcaggcctgtgaacttctatagagggtttagaaatctttggggccctcagcaccaaagcatagaccaaaatgcattaacaatatggcttgatagctcctcaggtatgagtcttgatgtttaaattcactttcaatgcattattatctactacgtattttatttcattgttattgaagtgtgacacatcttttgttaacaggaagtggcttcaagtcaaatcgaccatttcgatccgggtactttggtgcttccattaagctccatcctggctatactgcaggagttataacagctttctatgtaagttataatcaattgatttgtacaaaattacaagttgattgatggaagtttacacattgatttttagtttaagtccacttaatgatttggttaataacagctttctatgtaagatgtggtcaaatgatttttacataagttgattgattgaagtttggtttaagtttactaatgatttgagtaatggcagctttctaacaatgaggcacatccgggcttccatgatgaagtggacattgagtttcttgggacaacatttgg

SEQ ID NO: 2164 - DNA, 922 bp, Glycine max
  misc_feature (68)..(68): n is a, c, g, or t
cggcgtggtttcttgtgctgatattcttacccttgcatccgaaatatcttctgttctggtataacttnatgctatctcttattcattttgcttctgtgctgagaataaaatcacattatatatatgtttcaatgtttgacaaatatttaatttcgagagtagagtttagatagaatcattatcataaagtatactaaccaaaaggttgcaatcaattagaaatgatatgtctaaggtggtttctgagttactccttctaatcatatttaaatgccatcatgatctttttctaacattgattattacatagctcaaagtctatattattattagtcatgttcaattaagaacaccttttactttattggtcttaaaatgatactatatcttacaagtatgtattaatatagggtggtggtcctgattggaaagttccattgggaagaagagatagtttaacagcaaaccgaaaccttgcaaatcaaaaccttccagctccattcttcaacctatctcgacttaaatctgcctttgctgttcaaggtcttgacaccactgatctagttgcactctcaggtaagaatttttttcccaattaaattcatcctatatgttgcaacaattaaaataataagaataataaataaggaatttcttgaaattcagggtaaggtaatatattagattcaaagggatatattattaatgaaaccataaattaacattactctaggaaaaagaaagtccatgatggattgattagtatatgattcacacaagattcaatttcaggtgctcatacattcggcagagctcactgcaatttcattcttgaccgattgtacaatttcagtggaactggcaaacctgatccaactcttgacacaacttacttacaacaattgcgccaaatagccccaat

SEQ ID NO: 2165 - DNA, 775 bp, Glycine max
acatttgtgttggtgaggaacacccctggctctaacaacagggtcaatctggtcaaagctgctaatcctgaaaccaaggaagagctcattgagagcttcaaaaattcaggagtaaatctaattcaggttggtgcttttaattgaatagcaatttcttatttagaactagtttcaaacttaatcctagtaggagtaattgatttgatgtatctgtttaatgggatcttcagggagatatgaatgatcatgagagtctggttaatgcaatcaagcaagttgatgtcgtaatctgtgcatttggtagactactaattgaagaccagttgaagatcattgcagcaataaaagaagctggaaacgtcaaggttagtcctttttactgaataatcttaaatttttgtgttttcaaattgccatgcactttaaattaagtaacgtagtactagtagattaattttatttgctcatgtaacaaaaatattttcttttaagatgacttttaatttaattattataaaaatcaataattgcactatcagtacgtaggttagtttttttccaaaacttatccaattgtttaatgctgtctaaaattgttaataaatttttctacactaataattagaaaatgttgattcttaattccttgtgtcaacagagattttttccatctgaatttggattggatgtggatcgtcacgattcagttgacccagttagagaagttttcgaggaaaaagcaagaattcgaagaataattgaagccgaaggaatt

SEQ ID NO: 2166 - DNA, 364 bp, Glycine max
gctgagatgggttatgtgcggttctatttggctcccaagatagaagaggatgaagaagatacgaaacctcaagtttaatctacctattagatggttgggttaggatattaggattttaatgtctttgaacttgtagctttcgtcatacatcttctgttgaagatattttaaccgtgtgagcaatgaattcacattttgtggatttcttagatgtgtattggttacctaccaccttattttccctcgatttgattgttaagaacaattcgaaacaattggtgtgtatttttcatgttgatgcgtttttatttgtgaactggaacagcttcataaaaaaatactgcatcaaagacaagaaaccttg

SEQ ID NO: 2167 - DNA, 375 bp, Glycine max
tttcttcttatcatctccgccgtccttctcttcctccaccgccgatcccgctgccggcgcttccgcctaccgcctggtacactcgggctccccttcgtcggcgaaaccttacagctcatatcagcttacaagagtgacaacccggaacccttcatggaccagcgcgtgaaacggtacggtccaatcttcaccacccatgtgttcggcgaacccaccgtgttctcgaccgacccagaaacgaaccggttcattttgctcaacgaagggaagctcttcgaatgcagctaccccggttcgatatcgaacctccttgggaaacactctctgctcctcatgaaaggttctcttcacaagagaatgcactccctcactaaa

SEQ ID NO: 2168 - DNA, 293 bp, Glycine max
  misc_feature (241)..(244): n is a, c, g, or t
  misc_feature (278)..(278): n is a, c, g, or t
acatcactgtaattgtggtggatttgaaagctcaaaggaaatttaagagcaagacttgactgtttcttcaactgcatctgggtgttggaagatgatggaaaactgaatatgatccaatatagtttttttgcccataaatttttcatatgggcatcagaatagcaccctgtacaatacatccacctctccctagaactctctcaactgattaagagtctccttgtacactgccacattgtgnnnntgtaaatctttgcctgcttttgtaggggtaggtncaggaggccagttcc

SEQ ID NO: 2169 - DNA, 767 bp, Glycine max
cattttccttcttcttcatccttatcacattcttttcttcatcatctggtaatatcattctttcagtttctacatacacaaaacttatatctagtttcatatatatttttttttgtatttttctctaatcaaaattagaatttctccttcataatctatctttagacccttcttaagtcagtttgtttaaattatttgtctaaaaaaatacttattttaataaaataaatattttttgtttttctaaactgcttttatttttttaaaaaaataattttttatactctaagaagcaaatcttatttaattattgaaaaaatgttttttttttaatttaaataaagtgattgatgacatgtattgtgaagatgaactgtaggtttaattagaaaataatacttatgaaactgcatgtaaattttgttgcttcatttcatttgcatggctataataactttaaactttgtatgttgcagaagcgggatccgttggaataaactatggaagggttgcgaacgacctacctacaccagcgaaagtggtggagcttctgaaggcacaaggtctgaaccgtgtgaagctctacgacaccgacgccaccgtcttaaccgcgtttgcaaactcgggaatcaaggtcgtagttgccatgccaaacgagcttcttgccaacgccgccgcggaccagtccttcaccgatgcgtgggtccaagccaacatctccacctactaccccgccacgcaaatcgaagccatagccgtcggaaacg

SEQ ID NO: 2170 - DNA, 683 bp, Glycine max
tagagtttaaaatacaccaatagtgtagcttgctaacgtactccaactaaaaaaaagtgtgtatacgatagcaagtgcttgtggggattgctaatgtacacacgtggagctagttgttatttgactcggttgtctgaatcggttgttgcagcagggtcgggagccacaggtattgccagatcctttgttatttccattatcttgtttgttttgattttctgttttgggtgtgttttgtttggttatggaacatatgtgtctggttttggttttggttttggagcatattatattggacatgttgattctcgaatgttggggttggtcatatttgtctgcggagcaggtgctacatgtttttgacttggatcaggcattctggtgtctggtttcctgcgtaaaacaaattagtgggaattttggttcaattggttattgattcatttgcgtgtgagtcttagggtttcattttggttgagtttcctggtgaatggtctttaactttgcagctatgcagagccaagttgtgtgcaatggttgtaggagccttctgctttacccaagaggggcaaccaatgtttgttgtgcattgtgcaacacaattacctctgttcctccccctggtaagctcattggctgtttctgttgttgcaaattttaagattaggtaaacttacacattt

SEQ ID NO: 2171 - DNA, 814 bp, Glycine max
gggaaagaggttttcatgttatcatctagtctagttatctttttcctatatattgcaattctgctgattactttttatgctgagtttaatataactttcataaagtatgccccattaatgttatagatgaaagtgttcaaaagctttcatttagaactttcttaaggatatttcccccagtttgctattagtttttattgtttgcttcaaattgtttatttgaattatcttttttttcatttagctgctgaggatgaggatctggctcctggtgcaaagaaaattcatcctggaatatcttctagcataatttctgagctaactgattgcaatgctgctctttcccagcagagaaagaagcgacaggtactcttggtgatatatataatataaatatatattgacattttcaagtgtttctttagttgtcttcattttgagctcagttttgctttgagcttttgacaagttggaatttatggaacttttagtattcctttttactggttttgacttgcctactaaaattgtaatacatatgtatcttgtgtgtatcagtgtatgctataaacttttgtggcatattttaattatttctttgctgtttctaattgtaaatttgaatgttttcacttgtttgtgcatattctttgtcggtttgttcagattcctccaactttggctcctgtcgaagctctagaggcatatacccagatatctagtcatccctttcacaaaacaaacaaacaaggcattatatctcttgatatcctttattctaaggtatggcttttaaactttatatatggtggaa

SEQ ID NO: 2172 - DNA, 594 bp, Glycine max
acgctttcggaggatctctccgtttctctagtggggtctaacctgcatgtgttttcactcgctgagctcaagatcataacgcagggtttctcttcgagtaactttctcggagaaggaggtttcggacccgtgcataagggcttcattgatgacaagcttaggcctggtctcgaggctcaaccggttgccgtcaagcttttggacttggacggttctcagggccataaagagtggttggtgagtccttgtaccccttttgctttttcacctaacgcataaaatgccatcaagtgctcataagaaaacaatagtgatttttattttgtcataaaaatgttgtttttaacaacatagactagtattaataatgtggtaacatgctttaattacatttattgcttatgattttcttgattaattatgaggaataatcctttttgcaataagtgcttctgagttctgaccttcccttttgtttttttgacgacagactgaagttgtgtttctgggtcaactaaggcatccacatctcgtgaagctgattggatattgctgtgaagaagaacacaggcttctggtatatgagtatttacc

SEQ ID NO: 2173 - DNA, 733 bp, Glycine max
gctggcacacccatcttgccatcactccctttgatgtcttgaaagtcaacatgcaggtgcttttcaattcttttagttattttaactcacttgttccacaaatcatgttttattaggggatggaaattagggaagtgattagtctcttatgtttttatgttgggtgagttcagctcccttgaatcgatctttgtgtcttgagaaattagtttctgactctaggctagataccttgggcacccaaatgaaatgagggaagtgaaaaaaaaaagttgaagttggaatcactttactcttgttgtaacactttttttatgttatagcaaaaatattgagtgctttttcaccctaatgtgtagaaataatagttgttgatttgatcatgtttgttgacggggaaagtgatgttgttacatgtaggtgcacccaattaagtattacagtatttcctcttgctttactagcttactgagggaacaagggccatctgttctttggaaaggttggaccggcaagttctttggatatggtgctcaaggaggatgcagatttggtctttatgagtattttaaagaggtttattccaatgtattggtagaccagaacaggagttttgttttctttcttagtagtgcgtctgctgaagtgtttgccaatgtagctctatgtccatttgaagctgttaaagggagggttcaagcacaaccctgttttgctaagggattgtatgatg

SEQ ID NO: 2174 - DNA, 719 bp, Glycine max
tcactgatatatttgtcattttcagttagcattaacattttaccactaattgtaacatactcctgacctacagattcaggatggcgaaatatatgcaactatcaaccagaaggatggaatggtgagattcttggaggatcctgaacagtataaaacctgtgaaatgattgaacatattgattcatcaatccaaaggtatgcttttggtatattttatattaagctcatttagcccaataactttcctgaagtgtcttgtaagacaattatgtttaacctgaaaatcttgaaatgaaaatttttcagttttaatacttttaatgcttaatttgatagtgatctgtgtctatattatatgtccttcctcttgtactgaaagcaattttttttttttctcaattaatgtccagaataatggcactctcaaggaaacttactgcgacagacgaacaaatttcatgcgatcagttgtatttgtctaaggtgtgcttaactgtttcatccttttatctataaacttctatataaaatattattaactaacaagagtgaatgtatactcaggctggaagagagagacaaagatatgactttgatgactttgacgttccacaaaagttcaacatttaaggggctaggaatgatggaagtagatctggttatagtgcatcacccgtttcctttatcttttgttattcctggttctgagagtgggggag

SEQ ID NO: 2175 - DNA, 382 bp, Glycine max
atgtgctaggatgaagtttggacttaaaccggctgcagttagagtagaaggatttgattgcctcagcagggattgccagaattccggcatccctgctgttgcttaaactccattcatagaagtgtatatagaagaagccaagtgccattacttataaaacgtgacttaactagagagagttttgaatgtttcggagggaagtaagaaattcagttagttgtgtatatagcaaatgcttttttgtatggtgaggtgaatcatctcattgtgagtatccgtggcaagtttagggagctgcagaaaaagcaaaccttctgttcttgaagtttgatgtgtagagagcatgtctttttgtaatataaggaggttgtatcggagtgac

SEQ ID NO: 2176 - DNA, 490 bp, Glycine max
tgggttcctcttcatctttgtgtttcggcacacccaagttgttcaattcagcaagggtggcggtgaatggtcggcgaagaaacaaaggtttgagttgcaacgccatgttcggtctgggggtgcccgaactggtcgttattgccggcgtggccgccctggtttttgggcccaagaaattgcctgaagtcggccgtagcatcggcaagactgtaaagagcttccaacaggtaacccaaattataacaactgtgaggggaaaactaaaatgaaatgggaggatggttatttgttggattttggcattcacttttgcacattattgcttttaaggatggttattattattatttttggcaaaccaatggtgtaggctgcaaaggagtttgagtcggagcttaagaaggaacctgattccacccaaggggactcatccgagaaacctattgttacagtcactgagcagcagcaggaggacaatgaggtgtctact

SEQ ID NO: 2177 - DNA, 738 bp, Glycine max
ttgctccaataatgactgaggcatgtatttgtgatgctgttactacttggatggaaacaattacgatgtgaaattattctcccataatgttatcttttttctttctttcaatcccatcatcatgcaattttttttttcttctcagtactgggagaaggccaaatttccatttcatgttattccaaagcttggtgcattgcgcattgctggtggcacaatcaaggttctctctatggatattttcctctgttgtttagatatttgtatggtctatggagttcttagctagctccgattctcaggattatggttgtcctggtctttctatcactggaagtgctatagctgtggcagaagttgcaagagttgatgcaagttgttcaacttttattttggtccattcatccttggcaatgctcactattggtaataaccttgtttcatttcttttaaataattccctaaattttgttccatttgtattagatgacatgatgttaatagttcctgatattttataactttgactgtcaagtttagcattatgtggatcagaagctcagaagcaaaagtatttgccttctttggcacaattgcaaactgtagcatgttgggttagttgattttctaggcattgtgttattttatgtttttgctgaagaaccacttctgaaatggattattttcttaacatcaggctttgaccgaacctgactatggaagtgatgctagtgcttt

SEQ ID NO: 2178 - DNA, 359 bp, Glycine max
cacagggccacatcctcccactcctcgacctcatccaccacttagccctacgaggcctaaccgtcacaatcataatcacaccaaaaaacgttcctatcttaaaccctctcttatcctcgcatccaaacacggtccaaactttagttctcccattccctccccaccctaacatccccgctggcgcagagaacgtccgtgaggtcggcaacagaggaaactaccccttcatcaacgccctctccaaactccaaccagaaattatccactggttcgcaacccacagtaaccctcctgtagcactcgtctccgatttcttcctcggttggactcagcaactcgcttcccaactcagtattcaa

SEQ ID NO: 2179 - DNA, 375 bp, Glycine max
tgggcctcctcgatcacttgtgggatgacaccgtcgccggtcctcgcccggagaacggccttggcaagctccgaaagcaccacaccttcgctttccgatctgcctccggcaagggtacgcatgcgcatgcccttgctgaacttaatttcccaaattcattttagttattctaaaaataatgataataataataacaagaaccgcagcaagaattagttcttatgatctcacgcgatcataaaacgaagcaagatttgtgaggtttttaatttaactgaagtgataagtatgattattatatattaattctaaggtgaaggcgttttcgttgtgtggttttggtggattcagaatcagacagcggaaacgtaaaaa

SEQ ID NO: 2180 - DNA, 762 bp, Glycine max
ctgagctgaaaaaaattgaggtaatacttaattaaccggttcagtatttattagcatggtgacatttcttatatgcatgctacgtaataacatgatgtatatggcactggaccgaagaaagtgcatcctttcttaatatcaatcaataattcaatataataaatttggcctatgtttccctgcatgacaaggaaaaggatgcatgatattataatatacttgatatatggatcccttctttttgtctttaaagataacttaaaagcatgtgctatgaaatagatcagaacagattctactgtcacaaataaagtaaatgaagtctatcaagtgaatatagaagtaaatattgtacttttgctgaataatatagcttttaacttgatgtgtgagcaggagcaactggagaaaaagaaagcagaacatggtgaaagaatgaagaacaaggtggccttagttcacaaggaagcaggggagaagagggcaatgatcgaagccaatcgttgtgaagaggttctcaagacagaggaagtggcggcaaaataccgagcaacaggaaccactccaaagaagaccatagggtgcttttgatttttttgcattttgtgtctgatttccaaaataatttgtaattgcccattttgtccgtggtttctaatgttttgttctcaatgttttctatgtctaagaaatagtccaaataaaacaaaattttgtaaatgtcttttgttttgatcatctagcttgggcgaaatgttctat

SEQ ID NO: 2181 - DNA, 912 bp, Glycine max
tggcagaaggtgacaaagaagattctgaaacctttgcttaatttcattttctattgtaaatgaataaatagaattgattttttcccctttcaaatgaaggtctggtggtgagcatatgtcttggtggtgccttgattggatgtctactaagtggttggattgctgatggggtggggcgtcgtagggctttccaattgtgtgctctgccaatgataattggtgcttctatgaggttatacttccagtaccaatataatattgttgagtcattttgtttttctcatggaatagatggaaactatccttgcactttattcaaccacttcgtaggtttctattgtttttctcaaggtttatttgttggctaccgtggaaacatataatagtttattacttcatttttgtgtcctctaacgtgatagcatattaacatatttttacttctttcttgccaatctcaaatgtacctgactgccatcttatggtttccatatggcctcttcacccattatgatattttcttgtttcctcgtttgttctagaaaagagcataagcctttcttctttcctatgtttcctgcatataatgtctataataatagaatgacatagcagagcatttcaccatttttatgaaaactgatgtgtatttcactttggttaaatgacagttgtttacttttatgctttccaatataaattcttatgaataatttctcattgtaaaattgtgcattttcagtgcggcaacaaacaacttgtttggcatgcttgtaggaaggttgtttgttgggactggcttgggcctgggccctcctgttgcctctctgtatgtgacagaggtatgtaaatcactaaattggtgcatctgtctcattgactagactgaaaatttacttgattattctcttg

SEQ ID NO: 2182 - DNA, 491 bp, Glycine max
aagggggtcgccttcttctctttctcttattctcagccttgtcgcattctctttcctctcaggtaatttcaaaacccacaatttttatttttaaaaacgcaaatttaaaaataaaattccttttttttaaacacttgtgcggtttctgaacttgcagacgtacaatcagcatcgttcaagattgtgaacaagtgccgccacacgatatggccaggattactctccggcgccacatcaccgccgcttcccaccactggattcaccctcgagagcggcaaatcaaggattgtaaaaatcccgaagtcttggtcgggtcggatatgggcacggaccctctgcggccaagactctgacggaaaattctcttgcgccaccgccgactgcggctccggcaaagtacagtgcgttggcggggccaaacctccggcgacattggcggaattcactctcaacggtgccgacgggttggacttctacgacgtgagtttggt

SEQ ID NO: 2183 - DNA, 377 bp, Glycine max
gagctccttttgttaagtagttttacaatttagtaaaataaattgtcccttcttgtggaccattttattctattagatttgaatgtagtgaaacctgagacttggtggaactcctcctgagtccttgttgatgatgtagtttcagtttttttctgcttgggtttattaagttctattcctaatgtcacatggcttgtattaaatactgaaacttatgggcaagtgatattgtcatagtattattttagctcattaattgactctaggatattgattcctcccctattattagaggctgccattaattgtgtagcgaatggttacaatgccaatggcacaattgaaacatagacactgtcggtgtgacattaacatca

SEQ ID NO: 2184 - DNA, 363 bp, Glycine max
cgccgccgcgaagcatcacctcgccgaggcggcggagtacgtggggcagaagacgaaggaagtggggcagaagaccaaggaggttgggcaggatattcagagcaaggcacaggatacaagggaggcagctgcaagggatgcaagggaggcagctgcaagggatgcaagggaagctgctgcaagggatgcaaaggtggaggcaagggatgtaaagagaacaacagtgacagcaacaaccgcaaccgcatgatgagtaattctgatattagagggagcattaatgtgttgttgtgatgtggtttatatggggaaattaaataaatgatgtatgtacctcttgcctatgtaggtttgtgtgttttg

SEQ ID NO: 2185 - DNA, 391 bp, Glycine max
  misc_feature (116)..(116): n is a, c, g, or t
aattcccaaaccaatccccatcgttgaccgaccctctccgcaaagaccacgtgtccttccccgcacgcctcgccgatcggaccctcagcctcgcgccgctccgtgcggtggctcgngaggtttccgacggagcgttggcggcggcggtgaagaaggggttggagaaggatccgcgcgcgctgtggcggagatacgtgggttggctgtaccagcacaaggaacttgggatttacttggatgtgagtcgggtcgggttcagtgatgagttcgttaaggagatggaaccccgtttccaagcggcgtttcgggcgatggaggagttggagaagggcgcgatcgcgaatcccgatgagagtcgcatggtgggacactattggctgagggaccctaa

SEQ ID NO: 2186 - DNA, 377 bp, Glycine max
  misc_feature (366)..(366): n is a, c, g, or t
  misc_feature (368)..(370): n is a, c, g, or t
  misc_feature (374)..(374): n is a, c, g, or t
attctttgactgggaattgccacaaggaatgaaaaaggaagacattgatactgaagtgttgccaggagttacacagcataagaagaatcctctgtgtgttgtggccaagtgctatatgtaaaatccaaaagtcgtaactactgctgaaaaaaataaaataaaataattaatgattgtactcttccaacgaagattattaaataaagatgtaagcactccaaaataaaaatatttctgttgtgtttaatcttatgatctcctcttaggtttaatttaattatacatgcatccctttttttttacattactttaagttcttcaccgctaacagtattaattaacgttccaaaaatgtccctccccttnannncaancac

SEQ ID NO: 2187 - DNA, 564 bp, Glycine max
tcactacactttttttattattattctctgccggcgtggctttctttcttcttttataaaagtcatatcataatcataataatattaatcgagttttccgcagagaaaaaaaggggtcgaacgagtgaatcagaacataagtgaagactgcgaatataggaacccaatcctaattctattgaatttttatttttagcggtggaaattcatcatcgatcgcatctattccataaatagcaaatagaaaacaatgggtaaaaagcaatcttttcggagcaaagcagcctacttcgtttctgatctcaccactggtcttctcaaccctatttctgacaacaacaacaacaacaacaacaaacccccttctctccctccttccgtaagttctctctctctctatatattcgctcttattaatttattattccattcaattaatactctgtagtcatttttattattattgaattaatcctatgtagtaattttagacacgttttttgtgaaatcaacatgattgttattcagggagaagaagaaaaagaagatgtgggtgagtcaaag

SEQ ID NO: 2188 - DNA, 717 bp, Glycine max
acttaatattctttttccttgagacctgaaggggctaaggaaaattagaaggacacacaagtataaaggcggtgaaataaaagagaaagacaagaagacgacatgggaagaccaccttgttgtgacaaagaaggggtcaagaaagggccttggactcctgaagaagacatcatattggtgtcttatattcaggaacatggtcctggaaattggagggcagttcctgccaaaacaggttaattaattagccctacactcaatttgatgattattttgcataatattggttcttgttctttgttgtgtttattagatcattatttaaagaagtttctgattgaaatattggccatttgggtttcattgttttatctttggatctgaattgatttttccattttggggttattttcagggttgtcaagatgcagcaagagttgcagacttagatggactaattacctgaggccaggaatcaaacggggcaacttcacagaacaagaggagaagatgataatccatcttcaagatcttttaggaaacaggtacaaatcaatcttccaagcacctacttagtttgagatttaaagatttatttatttttaactgttttgagtattttgatttgggaagttctatcttttggatccacatgcttaacttaactggatcacattggctatgttaaagatgggctgcaatagcttcataccttcc

SEQ ID NO: 2189 - DNA, 531 bp, Glycine max
  misc_feature (466)..(466): n is a, c, g, or t
  misc_feature (477)..(477): n is a, c, g, or t
  misc_feature (504)..(505): n is a, c, g, or t
cgcaacgacgatgatgcaaaccaacatcaccaccacaatcctcatcgcgttctcttcggtcaattcctcgaatgttctaccttgagccatgtccaaccccgttcagattcgcgtcgccgccgacgcaggcgacggcttcgactctccggcgaagcagaaagccgccaaccgcagcgcctacagcattcgcccctttctctacctccgccgcgccaaacagttcctcggcgccgccaagttcaagctcttcttagttctatttgctctctccgtcatcgttttcgtctcctccagactcagttcgtggatgggatggaaccctcaccaatcctcttcggtttcttccacttattcttccacttactcatcgcggtctcttcggtcaattcctcgaatgttctaccttgagccatgtccaaccccgttcagattcgcgtcgccgccgacgcaggcgacggcttcgacnctccggggaancagaaagccgcccaccgcagcgcccanngcattcgcccctttctctacctcccc

SEQ ID NO: 2190 - DNA, 522 bp, Glycine max
agctctagggactccattttctatgttctcttagatgctgcgaagcaaaaatcatttctaaaggcatttgacaaaacagattataaatcatcaaataatttgttgattgcctacaaacctcggagagggaagtatagtgtatttatgggcgaaatgacaatagaggaggcagagaagttcattagctccgttctcagtggagatgtacccttcagagaaacaagtaggaagcctgtactagagtattagatcataaaattgggttttgcactgttttggatgcatgctcatgtacatagacaaagagatcataaaattgggttttgcactgttttggatgcatgctcatgtacatagaaaaagagatcataaaattgggttttgcactgttttggatgcatgctcatgtacatagaaaaagagatcataaaattgggttttgcactgttttggatgcatgctcatgtacatagaaaaagagatcataaaattgggttttgcactgttttggatgcatgctca

SEQ ID NO: 2191 - DNA, 444 bp, Glycine max
tctgcacgttgttcccaccaccaccataccttcttcactcactctcgggagcgtcgaaaagaaaaatgttcacattagctacctcttcccaagtactgttaagacttcagccaccgcactcgatggagccaatggcccactcactcaccctaactccgtttcccgccaccgcttcctccttccgccaccgtcacctctacgccgttaaagccctaactcttcgctccgtcactcgccgtttaaaacccgcactcgttagagcctgtgatcggtcacaacaggttctctctttctcaatcctcatcgccaacattatcagctaacagaaaaaaagaaaaggaaaaaagtgttaattgaaacttgcattagttccctgaatttggaaataataattaatcagaaatcatatattttttcttaatgtggtgaaaaattaaggttttt

SEQ ID NO: 2192 - DNA, 619 bp, Glycine max
aatgtcatggacatgactacagtatatggagcttttgctgcagccttgatcaatgatcccttgtgggtcatgaatgtggtctcatcttatggtcccaacacactccctgtggtttatgatcgtggccttattggaaccttccatgattggtaattttgaaaatttaaaattatgaagcataaggttattatttatgaatgtatttgtgttaatatcatatggtgtggtatttattttgaattttattatttggtaggtgtgaagctttttcaacatatcctcgaacctatgacctccttcatcttgatggactcttcactgctgaaagccacaggtgagtatgtgaactcatttactctcattagtaacataaacatggagacactcactctaaacttagatttttgaatatgtttctgacaatggttgttttgttactttacagatgtgaaatgaagtatgtgttgctggaaatggatcgaattttaaggcctggtgggcatgctatcattcgagagtccacttattttgtggatgccattgctactattgccaagggtatgagatgggtgtgtcgcaaagaaaacaccgagtatggagttgacaaagagaagattct

SEQ ID NO: 2193 - DNA, 601 bp, Glycine max
gcaacctctccccgctcagccaccgccaccgccacgtccatccggtcagttaatactttttcttttcaaaaccctttattcactattttctattacttttcttttatcttcgtcactcacacatctactacttggtttgctttcatccgtttgaaacttttaatattcaaggatacccacttgacttttatgtagaaatttctaaactttttttaattattcatgcgtaatcagctactgcacaattaagcagattaaattaagtgcctttgtcttctgaactattgaactttaaaatatgcaatccattttttttttggcctctaagtgaatctgattataggaatatgtatttcattttctatcacggcacagtgaggcacaagtgttgtgttattgagttaggctttactttttctcaagctaatagcttcgtcatccaggttaatttgtttctaaaatagatggtttttgaataaggaataacacctgcagaaagggctttgaatgcaatgttgcaatttttgtagcttgaagtcagtgaaagggttaaagaaagtgattgactgattgtgttgtgtgttgctggattgtatttgag

SEQ ID NO: 2194 - DNA, 370 bp, Glycine max
tctactgatatgttggagagtacagggatatcaccagagaagaaagtgaggaagatgagggcgtctccatttaacaagaaaagcagttctgtattgggaagggttgctgctgctgacaaagatgaaagtgtaagtaaagacttgtctggtggttctgatgcttctagttcttctccaagcatcactgaggaggtggttgagattgcaccaccagcagcaagagctaggccccagagggccaatcgtaggcaaacgacatatgtactgagtgaatctgaaagtgacaatgattctgataatgaagattattccgattttgaggaagatgaagactaggaagggaagatgtgtgtgctttgtagaaacctga

SEQ ID NO: 2195 - DNA, 707 bp, Glycine max
  misc_feature (266)..(266): n is a, c, g, or t
  misc_feature (275)..(278): n is a, c, g, or t
ttggatggaaacaattacgatgtgaaattattctcccataatgttatcttttttctttctttcaatcccatcatcatgcaattttttttttcttctcagtactgggagaaggccaaatttccatttcatgttattccaaagcttggtgcattgcgcattgctggtggcacaatcaaggttctctctatggatattttcctctgttgtttagatatttgtatggtctatggagttcttagctagctccgattctcaggattatgtantgatgcttnnnntgggtttagagactgtatcttttcatcatgctcctgtatttggacttatatgtggagcactaggatttgatagaactagttctcagagagcttacatgttcatcacaatgagagatgtgatttctgctgctacaaggctaaatttgataggaccccttggtgcagcattgctgcagcatcgggttgctcctattgctgaagttatattagaaaaatggatgaatcgagttgttgaggaagcttgccaaactatgcctttgctagatactgtgcagggctgccatggttacttgttttcaagattgttttcatcctagaaggcaaaatgtggatattgcacttaatattttgatgcatgtaaaaagtttgtttgtaatagtgatgtgcttaagtttttgagttttctaacttcaatgatgccctctcttc

SEQ ID NO: 2196 - DNA, 361 bp, Glycine max
tatccagtagcaatgtgagtggaagaagcagcccaatcagcaatcaaggatttcatataaaaaatgatacagtggggacatcaaggttatctccttccaagagctcgtaccctcctagtcaagcaagcaaggatgacatagatgcatcatgccaacacagtatgagtaactttagcagtccacgagtctccaaccttactccttcaccaatgcagaggccaggtttgaacagagaccatttcaaccccatgtatcaacaaccatcgggaaaccagtctccttcgtcagctaaaggaagtgaagggaacataaatccagttcacgacaatgtgccacgtgtaccaatgagaagcaacacctt

SEQ ID NO: 2197 - DNA, 374 bp, Glycine max
  misc_feature (370)..(371): n is a, c, g, or t
tttttaaaaaattcctttaaaaaatgaagaatactatcttcttcgctctctttcttgtttgtgccttcacctcatacctaccttcagccaccgctgatactatcttcgacataaatggtgattttgtccgaaacggtggcacatactacatcttgccagttataagaggagacggaggtggaatagaattcgccgcaacaggaaacgaaacatgccctctcactgtagtgcaatctccccttgaggtctctaagggtctaccactaatcatttcatcaccattcgaaatccttagcatccaagaaggccttattttgaacattgggttcacttttgtgcccccctgtgccctaattccttctgagtggannaaa

SEQ ID NO: 2198 - DNA, 1375 bp, Glycine max
  misc_feature (1166)..(1168): n is a, c, g, or t
  misc_feature (1171)..(1172): n is a, c, g, or t
  misc_feature (1178)..(1179): n is a, c, g, or t
  misc_feature (1181)..(1183): n is a, c, g, or t
  misc_feature (1185)..(1189): n is a, c, g, or t
  misc_feature (1204)..(1204): n is a, c, g, or t
  misc_feature (1209)..(1212): n is a, c, g, or t
  misc_feature (1216)..(1217): n is a, c, g, or t
  misc_feature (1219)..(1221): n is a, c, g, or t
  misc_feature (1223)..(1224): n is a, c, g, or t
  misc_feature (1241)..(1243): n is a, c, g, or t
  misc_feature (1257)..(1260): n is a, c, g, or t
  misc_feature (1263)..(1279): n is a, c, g, or t
  misc_feature (1282)..(1292): n is a, c, g, or t
  misc_feature (1294)..(1295): n is a, c, g, or t
  misc_feature (1307)..(1308): n is a, c, g, or t
  misc_feature (1310)..(1313): n is a, c, g, or t
  misc_feature (1319)..(1320): n is a, c, g, or t
  misc_feature (1324)..(1325): n is a, c, g, or t
  misc_feature (1330)..(1343): n is a, c, g, or t
  misc_feature (1346)..(1347): n is a, c, g, or t
  misc_feature (1349)..(1350): n is a, c, g, or t
  misc_feature (1361)..(1367): n is a, c, g, or t
  misc_feature (1369)..(1372): n is a, c, g, or t
gatgaatctctttaattataattaatttgacctatcaaacttttcctgtcgaattatatccaattttaagtcaatgaagaggtttttgtatgaatgttttctcttttcacaaacctaatttgagcgctttccagtttcagtagtgactgaagtaatcatttaatcgtgttattacaagtttccattcattaatatactcggattaggtgtaaattttttcttggatcaattactttgtttaatgcttcaaaatttgcatgctttcaggttttatcactctcttccgccaataacgaaggcatatggcaccgtttgcctgttggctaccgcaacttaccatcttggattagatcatccagcttacattgcactattgtacgataaagtgttctacggttttcaggtgagaattccatcatatcagaatatgaggaatatgctgttattgcttttgcaaagtattgcattcattctctgaggcttcccttttgatatccctatctgcttgtctttgatgtggagatttttttatttataagacagattgaggatctttttgtgtttcttattggccaaattataagaaacgttatggaggtttacttggttttactatgaactgtttgtaacataaccagatttgcagccaaagactaccctccaattgccaaccagattattctagattttcatgattgtttgtatatcaaatcatgtgctgcatatacatgtacttttgaggtcaactttgttattttcatgtgtatcgaatgattgtttgggctctatagagatgctctctacttctttatagactgctgtagaaaatttctatctaatcagtagcatccaccaattccttttggctacattttctgatacatgtggagaaagtgatgaggcactgtggatactgtgcactacactgctccattaagtaggcaagggtttaatcctatggtaaccgacaggttgcagattgtttggggagacttttttgactaataagtagtaaattagagttttattgctgaagtgtatgatttcccttaagcttaacttgccgttgacaaccttgtgtaataattttagtgttttcttgagttgaactatttagtaaatctcttgtaactttgcatcatctgtaggcttggaggttgttcaannngtnntctatnncnnngnnnnngttctctactcacanttcgnnnngcanntnnntnnaatgaagtcagtaatannncgataatgtatgcnnnnccnnnnnnnnnnnnnnnnngcnnnnnnnnnnntnngagcctacatannannnnccctgnnctgnncttcnnnnnnnnnnnnnngtnnanngaatgaaagtnnnnnnnannnncgc

SEQ ID NO: 2199 - DNA, 1468 bp, Glycine max
  misc_feature (15)..(15): n is a, c, g, or t
atatcttcaggttcnagaagctgcaaaattaagcaataacttcagcacatgagagaaaccatttttaaggataactatcccttaacacaattaaaagaggaccaatcattacttgattcatctaatgcaagagaaaattacccatatcaaacacaatgaagaaatggcaaaaactaacatgaggattggcaatagtataagatgagagtgtcaataaagggcaccataaagagattgagaaccacattaaatattcctacatatgattttatgtttatagaaacaatcaagatttcaaattataacagctgatgtattctatcatttattacgataagttatattacatatattacatattacatcaattacaaaaatgggatctttctgagtatccacccttgatattcaatccataatatttagtatttaccaataccatatttatataatgctctctcaaattatgatacaggattaacagagttagataatgctagtaatgcctattagagaactcatcctattaatatgctaacctccaccttttaagttttaaaaaataaaaaaggataacgattgcatcagaagtatgtttatcacagattaattgtctgctagaggtttgatccaaacaagaatcatttagtatttggtgtgtggtaagataaatgaaacctaaagaaaaattatcatatatgggattaaaataattgttttatagtttaacaaaaataagcacaatcaaccattcatcaactccatatccatcatattttaccagactaagtacaaaatatacattattaaaagatacatgctgatgaaacatgctgttttaattaagcacctgcaatcgaagataagcaaagattggagtttccatcaagcgaatcaatttatccagttggaccaaaaatttgacattaatatcctcctcctccattgattgaatcacagcactggcatgttggtaagtctgtcggggaagaaaattttattttaaaaaaggtcatatggttcatatccacgaaaagacattgtttacaatgtctgcccgtggtatgtggcatgtgggcacttgctagacaaagaaaaacttgaaaaggaaaccaataatcagaatcgtgttatagattcctacctgagccaaaaagcaaagacttataattgccataggagaatgacaccaagaggcatacagagaaacatacaagtccttcccagcaggatttaccagtgattgcttcaaaagatctcgaatctcagataattctgatgatgtaagtaagatcaaattcagagcctgaaatattttaaaaagggaaaaaattaaatgcagatgaatactgcttcattacataggacagcctaattaaaagaaaatccattgcggccattttaagcaaaagaaaaagtcacaaacctgaaccataattgacgcaaaatcaaagtcagatctcttcta

SEQ ID NO: 2200 - DNA, 853 bp, Glycine max
  misc_feature (838)..(838): n is a, c, g, or t
caaggacgcttggcagatggttcactggtggctgtgaaaagattgaaagaggaacgcactcctggtggggagcttcagtttcagactgaagtggagatgattagcatggctgtgcatagaaatctcctccgactacgcgggttctgtatgacaccaacagaaaggctacttgtttatccctacatggctaatggaagtgttgcttcttgcttaagaggtagatcttctgttttattctttttagcaattgttaatgcccttttgaatccttatttcttctattcctttctttgcccccttccccctacccaccctacagggaacagggttctcatttaccatttctcccatagttctactttagcctatgcttatgaaagtagtatagttgttggatgctcgagctgtggcacattctattcataattatataaaaagggattctcaagtttattattttggggggctatttcttggggaaagtttattccagaaattcccaagctcaaagaaaaaagagacgaccaagtaaagatataagaaactaagctgttttatgaaaattgtataagcctgattcctaaactagaggaaaccccaaggagttcatagtgacacattctatgcttaagaaaattttacttgtattattggcccacccatactggttatattctcaatcattaaatgtttattattgtcttataattttgtaattgctttattttagagcgtcctccatatcaagaacccctggattggccaacccggaaaagagtagctttgggatctgcaaggggtctttcatatttgcatgatcattgtgacccaaagatantcatcgtgatggaag

SEQ ID NO: 2201 - DNA, 1288 bp, Glycine max
  misc_feature (365)..(366): n is a, c, g, or t
  misc_feature (368)..(373): n is a, c, g, or t
  misc_feature (375)..(378): n is a, c, g, or t
  misc_feature (381)..(382): n is a, c, g, or t
  misc_feature (389)..(389): n is a, c, g, or t
  misc_feature (391)..(392): n is a, c, g, or t
  misc_feature (394)..(395): n is a, c, g, or t
  misc_feature (401)..(401): n is a, c, g, or t
  misc_feature (404)..(404): n is a, c, g, or t
  misc_feature (406)..(413): n is a, c, g, or t
  misc_feature (417)..(417): n is a, c, g, or t
  misc_feature (419)..(419): n is a, c, g, or t
  misc_feature (421)..(421): n is a, c, g, or t
  misc_feature (423)..(423): n is a, c, g, or t
  misc_feature (428)..(428): n is a, c, g, or t
  misc_feature (430)..(433): n is a, c, g, or t
  misc_feature (436)..(438): n is a, c, g, or t
  misc_feature (441)..(445): n is a, c, g, or t
  misc_feature (447)..(451): n is a, c, g, or t
  misc_feature (453)..(463): n is a, c, g, or t
  misc_feature (469)..(478): n is a, c, g, or t
  misc_feature (490)..(500): n is a, c, g, or t
  misc_feature (502)..(503): n is a, c, g, or t
  misc_feature (505)..(505): n is a, c, g, or t
  misc_feature (508)..(514): n is a, c, g, or t
  misc_feature (517)..(520): n is a, c, g, or t
  misc_feature (523)..(527): n is a, c, g, or t
  misc_feature (532)..(533): n is a, c, g, or t
  misc_feature (535)..(548): n is a, c, g, or t
  misc_feature (550)..(559): n is a, c, g, or t
  misc_feature (562)..(566): n is a, c, g, or t
  misc_feature (572)..(578): n is a, c, g, or t
  misc_feature (580)..(580): n is a, c, g, or t
  misc_feature (585)..(586): n is a, c, g, or t
  misc_feature (592)..(592): n is a, c, g, or t
  misc_feature (599)..(601): n is a, c, g, or t
  misc_feature (613)..(614): n is a, c, g, or t
  misc_feature (616)..(616): n is a, c, g, or t
  misc_feature (623)..(627): n is a, c, g, or t
  misc_feature (629)..(632): n is a, c, g, or t
  misc_feature (634)..(635): n is a, c, g, or t
  misc_feature (637)..(637): n is a, c, g, or t
  misc_feature (641)..(647): n is a, c, g, or t
  misc_feature (651)..(652): n is a, c, g, or t
  misc_feature (656)..(657): n is a, c, g, or t
  misc_feature (659)..(661): n is a, c, g, or t
  misc_feature (670)..(671): n is a, c, g, or t
  misc_feature (678)..(678): n is a, c, g, or t
  misc_feature (681)..(681): n is a, c, g, or t
  misc_feature (683)..(685): n is a, c, g, or t
  misc_feature (690)..(692): n is a, c, g, or t
  misc_feature (694)..(705): n is a, c, g, or t
  misc_feature (709)..(713): n is a, c, g, or t
  misc_feature (721)..(722): n is a, c, g, or t
  misc_feature (724)..(724): n is a, c, g, or t
  misc_feature (727)..(729): n is a, c, g, or t
  misc_feature (734)..(746): n is a, c, g, or t
  misc_feature (748)..(748): n is a, c, g, or t
  misc_feature (758)..(762): n is a, c, g, or t
  misc_feature (776)..(777): n is a, c, g, or t
  misc_feature (783)..(786): n is a, c, g, or t
  misc_feature (788)..(790): n is a, c, g, or t
  misc_feature (793)..(794): n is a, c, g, or t
  misc_feature (796)..(796): n is a, c, g, or t
  misc_feature (799)..(802): n is a, c, g, or t
  misc_feature (806)..(817): n is a, c, g, or t
  misc_feature (822)..(824): n is a, c, g, or t
  misc_feature (827)..(828): n is a, c, g, or t
  misc_feature (834)..(834): n is a, c, g, or t
  misc_feature (845)..(846): n is a, c, g, or t
  misc_feature (867)..(868): n is a, c, g, or t
  misc_feature (870)..(870): n is a, c, g, or t
  misc_feature (875)..(876): n is a, c, g, or t
  misc_feature (880)..(883): n is a, c, g, or t
  misc_feature (885)..(888): n is a, c, g, or t
  misc_feature (893)..(895): n is a, c, g, or t
  misc_feature (904)..(905): n is a, c, g, or t
  misc_feature (907)..(907): n is a, c, g, or t
  misc_feature (909)..(909): n is a, c, g, or t
  misc_feature (911)..(913): n is a, c, g, or t
  misc_feature (916)..(921): n is a, c, g, or t
  misc_feature (927)..(929): n is a, c, g, or t
  misc_feature (932)..(932): n is a, c, g, or t
  misc_feature (939)..(941): n is a, c, g, or t
  misc_feature (944)..(952): n is a, c, g, or t
  misc_feature (955)..(958): n is a, c, g, or t
  misc_feature (960)..(962): n is a, c, g, or t
  misc_feature (964)..(967): n is a, c, g, or t
  misc_feature (970)..(970): n is a, c, g, or t
  misc_feature (984)..(990): n is a, c, g, or t
  misc_feature (1006)..(1022): n is a, c, g, or t
  misc_feature (1028)..(1036): n is a, c, g, or t
  misc_feature (1038)..(1045): n is a, c, g, or t
  misc_feature (1051)..(1060): n is a, c, g, or t
  misc_feature (1062)..(1070): n is a, c, g, or t
  misc_feature (1072)..(1073): n is a, c, g, or t
  misc_feature (1076)..(1084): n is a, c, g, or t
  misc_feature (1086)..(1088): n is a, c, g, or t
  misc_feature (1091)..(1115): n is a, c, g, or t
  misc_feature (1118)..(1124): n is a, c, g, or t
  misc_feature (1131)..(1134): n is a, c, g, or t
  misc_feature (1139)..(1145): n is a, c, g, or t
  misc_feature (1147)..(1151): n is a, c, g, or t
  misc_feature (1157)..(1158): n is a, c, g, or t
  misc_feature (1161)..(1163): n is a, c, g, or t
  misc_feature (1167)..(1182): n is a, c, g, or t
  misc_feature (1189)..(1191): n is a, c, g, or t
  misc_feature (1193)..(1207): n is a, c, g, or t
  misc_feature (1209)..(1212): n is a, c, g, or t
  misc_feature (1215)..(1221): n is a, c, g, or t
  misc_feature (1226)..(1226): n is a, c, g, or t
  misc_feature (1228)..(1232): n is a, c, g, or t
  misc_feature (1235)..(1243): n is a, c, g, or t
  misc_feature (1245)..(1264): n is a, c, g, or t
  misc_feature (1267)..(1267): n is a, c, g, or t
  misc_feature (1269)..(1271): n is a, c, g, or t
  misc_feature (1275)..(1275): n is a, c, g, or t
  misc_feature (1277)..(1277): n is a, c, g, or t
  misc_feature (1279)..(1285): n is a, c, g, or t
atgaaattgcaaatttatcacatgcaacagagcaagtttccttgggaaacaagagctctacgccaattcgtcatgctagtgagccaggaagtaatgttgatggaaaaacagtgtccagtctcgaggtgcccagtgcagaaagtgagtttaaggccatggctgctgatgcttctgtttttacctttggagatgatgaagactacgaaagtgattgaactacaacaagaagggttactttgttatcttaatacttcaaatttgtacataaaattgcttgcaagttcctacacaacaatattttggtcatccatttgtttgtttgttgtaattataaatttggctatttcattggcttaatgcacaannannnnnntnnnnctnntccccgngnntnntccctnccntnnnnnnnncgcntncntncgctncnnnncgnnnacnnnnncnnnnntnnnnnnnnnnncctccnnnnnnnnnnttccctttttcnnnnnnnnnnncnncnctnnnnnnnccnnnnttnnnnntcttnntnnnnnnnnnnnnnncnnnnnnnnnntcnnnnnttttcnnnnnnntnttttnncccttnctatccnnnttttcctttttnntnctctttnnnnntnnnntnntncttnnnnnnnttcnncccnncnnnccccctttnncttttcngcncnnntcctnnntnnnnnnnnnnnncctnnnnntccccccnntntcnnnttttnnnnnnnnnnnnncntccattcccnnnnncccccccctccctnntttttnnnntnnnctnnanccnnnnccannnnnnnnnnnnccccnnntcnntctttnttttctacccnnccacccttttttttttccccnncnccccnncttnnnncnnnnctccnnnccttccctnncncncnnnccnnnnnncccctnnnctnccctttnnnttnnnnnnnnnccnnnntnnncnnnntcnaccccttccgcccnnnnnnnttttttttttctttcnnnnnnnnnnnnnnnnnttttcnnnnnnnnncnnnnnnnntttttnnnnnnnnnnannnnnnnnntnntannnnnnnnntnnnatnnnnnnnnnnnnnnnnnnnnnnnnnacnnnnnnnacccccnnnntctcnnnnnnntnnnnncccttnnccnnntttnnnnnnnnnnnnnnnntttttannncnnnnnnnnnnnnnnncnnnnccnnnnnnnccctntnnnnnccnnnnnnnnncnnnnnnnnnnnnnnnnnnnnctntnnnatcncntnnnnnnntcc

SEQ ID NO: 2202 - DNA, 398 bp, Glycine max
  misc_feature (87)..(87): n is a, c, g, or t
  misc_feature (213)..(213): n is a, c, g, or t
atgggcgacatcatgaaaacgtcgtcgttcgcgcttaccgaggccaagtacgtcgccggcgacaacatcaagcacgtcgtcctcganaacgtgaaagaggcctccctccgcgtccggtcgcgccaggagaacgtcgccggagtgaagctcccgaagttcgactacaccgccgacgccgacgccacgaaaaacgacctcaccggactcgcacgnggtgggcagcaggtgcagcagtgccgcgccgcctacataaaggccatcgaggtgctcgtggagctcgcgtcccttcaaacatcgtttctgactctggatgaggccatcaagaccacgaatcgtagggttaacgctctggaaaacgtggtgaagccgcgactcgagaacacgattagttacatcaa

SEQ ID NO: 2203 - DNA, 404 bp, Glycine max
  misc_feature (394)..(396): n is a, c, g, or t
  misc_feature (399)..(401): n is a, c, g, or t
cactcacttaaactcattgagtcttgataagtttccgaatccaacccacttaaacttttttatagcaaaaataaaaactgacatgactaaccttataaaacaatacagtttcttattctttccactgtatatgccattattgtaatccagaccttgcaatccaactagttgacccttctgcaattgcatctgatctctccctgcctcccagtgagaggcttcatgttccccatcttgatcattgaagctttaaaatctctagcaaaagccaaagggattctactatatagttgcaccaatttgtcactttctgtgccttttcccttgaacagctcttgatcagaatggagaagaccctttttgtgcagcaaatccgtgtatgatgtggtgtatnnnctnnncaa

SEQ ID NO: 2204 - DNA, 684 bp, Glycine max
  misc_feature (54)..(55): n is a, c, g, or t
  misc_feature (355)..(355): n is a, c, g, or t
  misc_feature (358)..(360): n is a, c, g, or t
  misc_feature (363)..(364): n is a, c, g, or t
  misc_feature (383)..(385): n is a, c, g, or t
  misc_feature (387)..(387): n is a, c, g, or t
  misc_feature (389)..(391): n is a, c, g, or t
  misc_feature (400)..(407): n is a, c, g, or t
  misc_feature (409)..(415): n is a, c, g, or t
  misc_feature (420)..(423): n is a, c, g, or t
  misc_feature (429)..(430): n is a, c, g, or t
  misc_feature (433)..(435): n is a, c, g, or t
  misc_feature (440)..(450): n is a, c, g, or t
  misc_feature (452)..(452): n is a, c, g, or t
  misc_feature (454)..(456): n is a, c, g, or t
  misc_feature (459)..(463): n is a, c, g, or t
  misc_feature (472)..(475): n is a, c, g, or t
  misc_feature (477)..(478): n is a, c, g, or t
  misc_feature (481)..(484): n is a, c, g, or t
  misc_feature (486)..(494): n is a, c, g, or t
  misc_feature (499)..(503): n is a, c, g, or t
  misc_feature (505)..(507): n is a, c, g, or t
  misc_feature (511)..(512): n is a, c, g, or t
  misc_feature (516)..(517): n is a, c, g, or t
  misc_feature (521)..(526): n is a, c, g, or t
  misc_feature (533)..(535): n is a, c, g, or t
  misc_feature (537)..(537): n is a, c, g, or t
  misc_feature (541)..(559): n is a, c, g, or t
  misc_feature (574)..(575): n is a, c, g, or t
  misc_feature (587)..(594): n is a, c, g, or t
  misc_feature (598)..(600): n is a, c, g, or t
  misc_feature (602)..(604): n is a, c, g, or t
  misc_feature (606)..(607): n is a, c, g, or t
  misc_feature (609)..(611): n is a, c, g, or t
  misc_feature (624)..(626): n is a, c, g, or t
  misc_feature (635)..(636): n is a, c, g, or t
  misc_feature (638)..(639): n is a, c, g, or t
  misc_feature (650)..(653): n is a, c, g, or t
  misc_feature (655)..(660): n is a, c, g, or t
  misc_feature (662)..(662): n is a, c, g, or t
  misc_feature (668)..(671): n is a, c, g, or t
tgacataattcagaagcaacaaatttttaacttcaaggtaactaaatccatctnntgtaggatatagaccttctttcacctggcataaaagacagatcaagacgcaatataaatcaaattactcattgtcactagggtaagcttttatcatcattcgtcaatgatattaaattataacagaaaattcaatatgaaggccaacgtaaccaatattatgaatttgtaagataaagtcaatatcagaaggcatttaggaatgctttttcttttataaaaaaatagttgaagtgaaaaagtgcaactcaccatggcagttaaagattgaattttatgccttacggtatcaagtccttcnttnnnttnnttcaacaacgccgccagcnnngncnnntctctgcannnnnnnnannnnnnnaagannnngaatgnnctnnnctaannnnnnnnnnngnannnaannnnncaaacttannnntnnttnnnntnnnnnnnnnggttnnnnnannnttcnntganntacnnnnnntttttannnantaannnnnnnnnnnnnnnnnnncatattcaaaaactnnaaggaaaaattnnnnnnnnccannntnnnanntnnnaaaaaaaatgggnnnaaaaagggnngnngaaaaaaaaannnncnnnnnncncaaaannnngggaaaaaaaaaa

SEQ ID NO: 2205 - DNA, 382 bp, Glycine max
agagagtttcgggtctcaccaacggggagttattgagagagacggaggctttgttaacggttcttgaagggattgggaacatacccgacgctgcatccatggaagggaataaattagtttctgaaatagcgactttggtggaagaagatggggttgcaacgttgagtgaggtttttgttagagttaacgagttcagagagagattggccatggggtgtctcggttttggagaagtggtggaattggtttacgtgttgaatagattggacaggtgtaaagagatattggtgatggtggtgatcacggagaagcagagattgtgggatttagtgagagaattgaaggtgaaggtagagaagatggaggtgtacagggaagaaga

SEQ ID NO: 2206 - DNA, 274 bp, Glycine max
ttttccaagtctgacaaagtatggttcactaccaccggagttaagaaatcaaggcccaaagatgcatatgaaatgcctcgtgatgctattaaggtagaagaattttgaggcactttataatatatggtattccagttcaattcgctcatgatatgcaatacatggttacactattagacaattgtttttttgtttttcttttttctgggtaagtttagaggagttatggtgttacagttgacaaacacatttgacttggacctggataagttat

SEQ ID NO: 2207 - DNA, 577 bp, Glycine max
tggatattggggcttggaggagtgggacacatgggggtgaagatagcaaaggcactgggtcaccatgtgactgtgataagctcttctgacaagaagaaacaggaggcacttgagcaccttggagctgatcaatatcttgttagctctgatgtcactgccatgcaggaagctgctgattcacttgactacatcattgacactgtgcctgttggtcaccctcttgagccttatctctctttgctcaaacttgatggcaagttgatcttgatgggtgtcatcaacacccctcttcaatttgttagccccatggtcatgctaggtaattgtgttgcactctctaatttttttatttttttggaatttcaattattttgtaaattttttattaaacgggcacactgatcaaactcttcaaataattattacacaagttaacaattttattaaatataataattaattgcactagaagtgaattattataattaaattttaatgatgggtatttgtgttgtgaagggaggaggtcaatcacgggaagctttattgggagcatgaaggagacagaggagatgtt

SEQ ID NO: 2208 - DNA, 838 bp, Glycine max
ccgccgccaaagtttccgtctttaccgtcaaatgctcttcttcgggtaccctctctctctctctctctctctttcggttttctttcgcaatacctttaaaaaaagttttctttcttcatggacccatttttttactgcatgaaaaattgtttttttctttgcccctttgatgtgaatgtcgtatttttcgcttttattgttggagggtattttgttaaaattgttaactgacgcagttctgttgcatgtgacataggtggtggagagaggccttggaagaattcagatgctagacttgtgcttgaagatggttcaatttggaaagcaaaatcgtttggtgcttcggggactcaagttggcgaagttgttttcaatacatcattgacagggtgaggatactatgaatcttgggatgcgtgttctttttttggttttgcttgcatgctaaatgagtggttggttttctttgttgtgttgtgtgtgtgattctcaggtatcaagaaattttgacagatcctagttatgctggccagtttgtgctcatgacaaatccacatattgggaacactggcataaattttggttagtttttattttctaattcaaatgagtcttgaatcgatgtggttggaagccatttgaaaactgtgttttggttcactttttttccagatgatgaggaatcaatacagtgtttccttgctggtcttgtaattagaagtttgagtatcaggttctgttctcctgctttgaaattttttttccattgattgaggtttgattagtctacttactctttttgcaatgcgtgattattcagcacctctaactggagatg

SEQ ID NO: 2209 - DNA, 737 bp, Glycine max
atcagttgtgttaaaatttctttggaaattgcacttaatttatatgatgatgatattcatcataatcatcaatctgaacattaagcaaatttctccatttgcttcaaaagttctaacaggttgttccatttgaacttggccctcaatctcatgcctttgataggaaccctaactactaacccttcagacatactgattacaaagaagagatcttcatttgtgaatgaaaatgtttgttttacaggagttgaataagctaaatgcttataccgagactagagtcgatcctcaggagatcgttgatcttttcaagaaacgcttcctggtactaatatactatgaatccctcaactattattgattttgaagaatttgtgattggtttcttgctaatctctttgctacttcctttgcatttctactctgcagcctcaacagtgaacgttgtattgctgcaggcttcctctaaaatgtagactctgcccatatagcgtcctttcattcacgggatgggatgcatctgcagtcaaatgtcggttgtgtttatctgccagagttgcaggatagtttgaagtcataatcacgttcatttttcagcttgtttgtttgatgtcataataatgtttatgtaccagtttgtgatcactgatcaatatgatataatgaccaatatggtattattatcctatttgaactatgttatatcacgtactaagctatgatatctcaagtgtccg

SEQ ID NO: 2210 - DNA, 310 bp, Glycine max
gcccggtttcttaaaccgggcgtgcccgatttcaaagggagcaacttcgagttcattccattcgggtcgggtcgcaggtcctgccccgggatggtgttggggctctacgcgctcgagttggcggtggcgcacctccttcactgcttcacgtgggaattgccagatgggatgaagccaagtgagatggacatgggtgacgtgttcggactcaccgctccaagatccacgcgactcattgctgtgccaaccaagcgcgtggtgtgccctctcttttaaaaaaacaacaatttgaatcttttttcttcctttt

SEQ ID NO: 2211 - DNA, 596 bp, Glycine max
gcgcatctggtgatgatcaggatggtggtgatgatcagccacagaggaagaagagataccacagacacactcctcaccaaattcaagagcttgaggcgtatggctttatgaaactctgcagctttttaatttttattttgccaatttgcttgtgtggttgagttatgtggtaagttttgtgttaattgtgttttgctgtttatttagtttctttaaggagtgccctcatcctgatgagaagcaaaggttggatctcagtaagaggcttggcttggagaataagcaagtcaagttctggtttcagaatcgacgaacccaaatgaaggtgaatttgaagacactaatataatatatgttattgcacttgaatgcagtttgctgatgcaatttagatgctgtactaatcgaagtgattttctcttgattcagacccaactggaacgccatgagaacataatgcttaggcaggagaatgataagctcagagctgagaacagtttgatcaaggaagccatgtcaaatccagtgtgtaacaactgcggtggccctgcaattcctggccaaatttcatttgaggagcaccagattaaaattga

SEQ ID NO: 2212 - DNA, 458 bp, Glycine max
ggggattttggtgggtcttatttcaatacaaagctcttcctctctcaatcccatctccctctcttcttcttcttcttcttcttcataacacaaacacaaaacataaacctttcttccaaccaaccttttttccaattcattctttgtttcttcaaaaatcttcaatccattttcaccttttcacaaatggggatggctgcagagtcacagtttcatgtcttggctgttgatgacagtctcatagataggaaactcattgagaggctcctcagaacctcttcttatgaaggtacaatcttttagaccaaacaccaaaatctgagagaaaaatttgttttttttcatttcttatttactatctttatcttgtctgataagaaggacccttttgttctcaatggcagttactacagttgattctggtagcaaggctttagagtttctggggttgtgtgaga

SEQ ID NO: 2213 - DNA, 820 bp, Glycine max
  misc_feature (36)..(39): n is a, c, g, or t
  misc_feature (368)..(368): n is a, c, g, or t
  misc_feature (395)..(395): n is a, c, g, or t
  misc_feature (761)..(769): n is a, c, g, or t
  misc_feature (814)..(816): n is a, c, g, or t
gacccaccacgttgtcccacgtgtgcacatataagnnnntggaatgtatcataagatgattattattgttattgttatgtacctcaagtttgcacatgagttcttgggcagtgtgggcagaaacaataatgtgacgggcagctggtgttacgaaaccttcgtccacagctttgtccatgaatgccagcagcgagttgtagtacccatccacgttcaacaaccccacctgcaacccattgcgtcccatcactctttttttttttttttttttttccccgggggccttaaaaaaaaaaaaaaaaattttaaaaaatttttccctttaaattcccttttaaccaattttttttaaattttaaccaaatttntttttttaaaaaaaatctccaaaaacnttttttttttttttaaaccaaaaaaccccctttttttttttttttttttttttttttaaaaaaaaaaatttttccttaaaagggtttttttaaaaaaaaaaaaaaaaaaaaaatccttttttaaaaaatttttttttttttccggggggggggcccttttttttttttttaaaaaccccttcccaaaaaaaggggttttgggggccaattttgggcaaaacccttaattaaaaaaaaaaggggtttttgggttttttggattttcccgggttttcagggaggcctggtggggccccggggaaaatttccgggggtttttcaagggggccaaatccccctttttggaaataaaattggcaacgggcnnnnnnnnngcccggccaatcccaattagggggcccttaaaaaaaaaaaactannntagg

SEQ ID NO: 2214 - DNA, 704 bp, Glycine max
atttggccattctcatgctctccgctttcgctattttcttcactcttcaggtaccataccctttactcttcccctcttccccatcattcgctccctgtaaaaccctaatagatgcaatctcgcacgatccaatttcactttttattgcttaatttgatttctttttagcaagatggcggtatttcgttcaaagacgcatggatgcacctaactgatgaatatccaatcaaatatgaagccgaacgccttccgccgccgctcgtcgctgatctcaacggagacggcaaaaaggaagtacttgtggctacacacgacgctaaaattcaggtacattcaatccagaacttgtttacccttctttactgctctcaattttggttcacttgtaattttttatttctggttttggcatccttcacaattcaagtgtcaatgtgtgcataacactaacattttttaatctttacttgcttgctgatttagcttgataataataactttgttctgagtggtacttgtattggtaactggattatgtacttgtggtgggggtctcacaggttttggagccccatagtaggcgtgtcgatgaaggattcagtgaggcgcgtgtgttggctgaggtgtctttgttgcctgacaaagtacgtgtgatgactgggagacgccctgttgctatggcaaccggctatattgaccgctat

SEQ ID NO: 2215 - DNA, 396 bp, Glycine max
ggagacgaggcggacgacgagaagcgagagctggtgttcaaggaggacgggcaggagtacgcgcaggtgctccggatgctgggtaacgggcggtgcgaggcgatgtgcatcgacgggacgaagaggctctgccacatccgcgggaagatgcacaagaaggtgtggatcgccgccggagacatcatcctggttggactcagggactaccaggacgacaaggctgacgtcatcctcaagtacatgcccgacgaggccaggctcctcaaggcctacggcgagctccccgacaccactcgcctcaacgagggcatcggcgccggcttggacgaggaggacgacgccaccgccaacgactacatcgagttcgaggatgaggatattgataaaatctaatca

SEQ ID NO: 2216 - DNA, 325 bp, Glycine max
cgcgcaggtggcgtacgatagtggaagtgggagacaggtttattatactgcgcccggtggtggtgtaacgcacgctcctccgtaccatggggtttttccgcccgtaaccgctgatatgagactgggaggggtttcgtttggtcaggatgttaaagtcataagcaagcttacccaaggttcagtctgatcattatcgaacaaaaaaataaaaataatagttcagtgtgattatgattatggttatcgctaaatatgtttttttttttgctatcttgttcgtaatcctatttatgtaataggaatactattagcttttagttttcgc

SEQ ID NO: 2217 - DNA, 402 bp, Glycine max
atacaacttgggatttatcacgtggacaaggtgcttcttcctctagatttctttataaccaataaggctccagcttcagctccatcaactcttgcaaagtctcccaaagctgctaaggataactcttctgaggacgatcaagaagaaacaaatcagcatcagaataaatctggggcagtgagtgtggttagcattggtggagcaacgttgatgtcgcttgtgatagctttggttgcaaccatgttgagttgatccatttggcagctgcactttcaattttatttgtcaaacacgccattaatttctttctttttaccttttttgtttaaattttggtatgtgtttctgttttcttgtgtattggtgttatatatgaaaaggacgtgaatacttcaatgatca

SEQ ID NO: 2218 - DNA, 1036 bp, Glycine max
  misc_feature (637)..(637): n is a, c, g, or t
  misc_feature (645)..(647): n is a, c, g, or t
  misc_feature (654)..(658): n is a, c, g, or t
  misc_feature (674)..(675): n is a, c, g, or t
  misc_feature (677)..(685): n is a, c, g, or t
  misc_feature (717)..(717): n is a, c, g, or t
  misc_feature (735)..(742): n is a, c, g, or t
  misc_feature (748)..(749): n is a, c, g, or t
  misc_feature (794)..(806): n is a, c, g, or t
  misc_feature (821)..(829): n is a, c, g, or t
  misc_feature (835)..(838): n is a, c, g, or t
  misc_feature (841)..(842): n is a, c, g, or t
  misc_feature (858)..(865): n is a, c, g, or t
  misc_feature (872)..(873): n is a, c, g, or t
  misc_feature (875)..(877): n is a, c, g, or t
  misc_feature (879)..(879): n is a, c, g, or t
  misc_feature (882)..(895): n is a, c, g, or t
  misc_feature (897)..(898): n is a, c, g, or t
  misc_feature (908)..(909): n is a, c, g, or t
  misc_feature (912)..(912): n is a, c, g, or t
  misc_feature (914)..(921): n is a, c, g, or t
  misc_feature (924)..(935): n is a, c, g, or t
  misc_feature (942)..(948): n is a, c, g, or t
  misc_feature (959)..(968): n is a, c, g, or t
  misc_feature (971)..(972): n is a, c, g, or t
  misc_feature (974)..(974): n is a, c, g, or t
  misc_feature (984)..(991): n is a, c, g, or t
  misc_feature (1007)..(1016): n is a, c, g, or t
  misc_feature (1021)..(1026): n is a, c, g, or t
tctgtcaatccacagaacaatgctattgcaccctgcatggcctcttttccgtcgaggaaggagtttccaaggctagtaagggtgagagctcaggcttctggtgataacaaagacaactctgtggaagtacaacatgttaacaagggtgaccatggaaccgcggttgagaagaagccacgcagaacttccatggacatttcaccatttggtaagtttcccattcttatagtatccaccattaaaaaggcattattgatcaatgcgttagtcttgcatgactcttttaatttgaaattttcgaattacaaaccgtcaattactatcattaattcaactataaatctccatgtataatagttattactagtattaacttgataaataattaccttaaaaattatgttaaagtgatttctgattaattaactctgtagtaggtctattaaactaaaaaatatgtcccttaaaatatgctgttattaacttgttgctacattctaaattttgcatataataaattgagttggttccctctcaaaaaaaaaaattgagttggttcaattatattattaaaggttttcaaggggattctgtcattggatattctttacatatatggaaggggtggctattgtcntctattcnnncattgcnnnnnactttttttttttccnngnnnnnnnnnaaattttcaaatttttttttttttcccccccngtaaaaaaaaaaaaatcnnnnnnnntttttnnttttaaaacaaaattttttaaaaaaaaaaaaaaaaattttttttnnnnnnnnnnnnnttttgggaaaacccnnnnnnnnntttggnnnnttnnaaaaaaaaaaaaaccnnnnnnnnttggctnnannnanaannnnnnnnnnnnnntnngtccaattcnnggnannnnnnnnccnnnnnnnnnnnnaaaaaannnnnnncgggggaaaannnnnnnnnnaanncncaaaaaaggnnnnnnnncaaaacccaaaaaaannnnnnnnnnttttnnnnnnattccaaaaa

SEQ ID NO: 2219 - DNA, 784 bp, Glycine max
  misc_feature (718)..(718): n is a, c, g, or t
  misc_feature (730)..(733): n is a, c, g, or t
gtaattccacttccaccgattcgaccaggaccgccattaaaaataattccatttccaggaactaacatagttccatttccaaaaccttacattcctcattcatacaatacaattacgaaccttcttggcgcacgacgtgatcaagttcaagatttgccactcctcattcagactacacaattacgaaccgtcttgggaatctgtagtcatgtcactgcacgaacttgtctcactgctccaaatgttgctacatcagatttagaggcttgtctcactccttccatgaatcaatgcgtctatcctcctggagctgaatctggtacgtcttcttttccctttttctttttaaatcatttataaattaatacactttttttcattttactaacaaactcacttcatatataagccttgtaaaaactaaattctatcttgacttctcactacttttttatatacttctcattgttttaatttatacaaatgtccttcatgtcaataacatttttttcatacaaatacaggaataattaacgcattctttcatgtggaattttcgagtaacaaaatcatgaaaaatatttattttttctccattgatattaaataactggggttttatcgatcaaattttataatgtccatattttaaaagagagataaattcattttacacaaatacatatacttaagtgcatttaaattaatgtgtaatctncgtgtataatannnnttttagtagtataataatgtgtcttttatcagttgtttagattttaatgat

SEQ ID NO: 2220 - DNA, 452 bp, Glycine max
gtctggcactttagctcactcactggatccctttcccctagaagaacttttttgataatatagatgttcatatgggttgacaatgcatgtataggtgtctcacttcaactatcagaagaaccatcacaagctgaagaagtatacaagcaagcattgtctttggcaacaactcaacaagcgcatgctatattatccaacttgggaattctctatcggcatcagaaacaatatcagcgtgcgaaggctatgtttacaaagtcacttgaactacagcctgggtatgctcttgcattcaacaatctgggtcttgtgtttgttgctgagggtcttttggaagaggccaagtattgttttgacaaagccctccaatcagattcattgttggatgcagctaagtctaatttgattaaggtggttgccatgtcaaagttatgcaaaggcctctcctcatg

SEQ ID NO: 2221 - DNA, 861 bp, Glycine max
  misc_feature (835)..(835): n is a, c, g, or t
  misc_feature (837)..(857): n is a, c, g, or t
aattattgtgaacgttttgggtcatatttatatgacctccatctgcaatctgaccagctccataagaattttgctctgcatttgcttgggaaacataatcaggtctttgcttattcaaaagctcattagaatcaaccttattttggctttcctgataaaacccaacacgattttgctggtaacctgaagaatcatcattttgataaccaccagaaaactgtaaatctgtcctttcagcagcagtgctaacagcactcaatgtactaaggcctttgggcgagcaacatcctttgcacaacttcaaaagagaactaactgtaattgatgaggctctctttgaagacatcatttgggacttaacataatctgaggaaagacaaattggaaatcaaataaaatcagtgaaaatgtaagacattggaggggagggtatcaactgaaacaacaattttgggcaaaacattattctgaactgatgaaagttagaaaggggtttaaatttaacaaataaaacaaaagcaatgttcacactgaatgcaaattgatgtttgtgattattaaaccaggggatcagagttgttccaaaaatttctctacaagtctatctctataaatttatacccctaagatgtagcaaaataaattttctatttcacagaatgatgccacagaaagcttctaggattatactagcataacaaattcattaccaaaaagtctaagttgactaaagaacaaagtactaaaaacatagcagataccaagttctatcatattatactcatatcagcaatagaatggtacagatacagagcactcacaaatcacaataacngnnnnnnnnnnnnnnnnnnnnngggg

SEQ ID NO: 2222 - DNA, 633 bp, Glycine max
cctgcggttaagttttccaacgacaccgagaggcttcagcatattaatagcattcgcaaggcccctgtgggtgctcagatgaagcgtgttattgatcttcttctagaggtatattgctccttgtttcattcggttcatagttttattctcaggattatatggcactggtgatgttttatttatttatccataacttacgcagctcaacctactgagttagactcccttcacatatgactctagtgatatataggcatgagatggagaaattaaaacttgaaattgcacacccacacacgcactagtttagggggactgcctcattccgaggtttagggcatggcatacgcatcaaggagctgtagctgtagtatcatttactgtagttgagcaacctaagaaaatccaccatcagtagttgatttgtttaaaccatattcatttggtgcacgtgtttactgacagacacgacaagcttttacaccggagcagataaatgaggcatgctatgtcgacatgaaggctaacaaagatgtctttgagaatctgaggaaaaacccaaaagtgaactatgatgggcaacgattatcttacaaggttacttttattcatatgcatatatctgaacatttt

SEQ ID NO: 2223 - DNA, 1081 bp, Glycine max
  misc_feature (1014)..(1015): n is a, c, g, or t
  misc_feature (1074)..(1074): n is a, c, g, or t
  misc_feature (1076)..(1077): n is a, c, g, or t
ttcactcttccctctcattttctcttctgcttcggttttgtgttttttgttgcagaatattattcactgatttcccacatctttagggttaggtgatctgtaatacgctatactcatgttctttgtttgtgcactcaacgtgtttgtggaaaatcctctcagactatcgtgtggcatagttgttatttttctttttcctcgttaacaccctcaactcttactgtaattatgtgccgagctgaaaaattgaaaccagattttttcagatcatgcaatcattagttacccgttgtttaagttatttgtttatcagcaaatggtagtttgttagttttgttggaaatgtcattgggaggattcgagcttcaactcccccccctcccttcctaaccactaggccaaccttgtatctccattttgtttaagcatgcctgcaaagcttgattgtttttgtcttgtttcaggccatggacatgtcaaatccttctgtatttgtaaatgctcagttgattcccaactttatagggaagaaagtaagagcagtggttcaggtgagccaatgtgatggtggggttaccacagcaaaatccactgatgactgtcaattaaccataaaagggttgccacaagtccctcttatgaattatattgaggtcattggcattgctgaaagtaacagttctattgatgccgaaatatggactgactttggcagcacctttggtacgaaccattacaaccttttttcttacttaattgtcaataaatagattcacttttctctctaattgagaaacgaatcacttgaagtaaatgtttcttcttacatgttttttgttctcaattaaaccccgaatttgatttattgggcgattgctctcttcctctaccatggacacaatagaaattagaatcaggaactgtttgttacttcttatttctattgttctgttcctacgtatttatgttggttttgatcttgccctctctgtagacaccttctcttacaatcanntgtgccaactagccaatggtgaatttaagggtctgtttctctagggacatcaaggaagncnntcag

SEQ ID NO: 2224 - DNA, 412 bp, Glycine max
actgatgatccaaccctcaaatcccttccataatccaatcctctcacagcaaatccaccttctcctctctcttttcttctttctccacctccaatgaaaccagagaccaaaatagaaacaacaacaacaaaagcaacagaaaattctctgcagcaaccttcagaggcttcggctgcactgccggtgcatcgcagaaggtgtcggtgccggtgcctgcggtgattcgctcctcggcggatagggaagggaagagtagcagaaaaaagaagcacagaaggaacagtaacagtggcaacagcacaagtgatgatgatgatgatgatgtttggtgtggccctggaattgggttctcaactgatgctgctgctgcatctgtggaatgtgttgtggctaggaagaatgtgtaaaaaaa

SEQ ID NO: 2225 - DNA, 393 bp, Glycine max
tgccaaagtttcagattttggattgtctaggttggctcagacagatatgagtcatatctctacttgtgctcaggggacccttggttaccttgatcctgagtattataggaactaccaattgactgataagagtgatgtttacagttttggggtggtgctacttgagcttttgacagctcagaaggcaatagattttaacagggctgctgatgatgtgaacttggcgatttacgtgcatcagatggtggctgaggaaaagttgatggatgtcattgatccagtgttgaagaatggagctaccactatagagctagagacgatgaaggcagtggcgtttttggcattgggttgcttggaggaaaagagacagaatcgaccttcaatgaaagaggt

SEQ ID NO: 2226 - DNA, 770 bp, Glycine max
tctttccatagccagtaaaatacctgtgtctgagtctacaaggcaggaacttttggatattgatagcattgcatataggctgcgtagggaaattgaattactagagagcattgatcttatccggtgtaaaagctgtgaggtaatcattgtctaaccaaagccccacagttttgcacttcttattgcttgtgaataaatatagaggcaatttgggattgtacaattctgtttcaactttcatcaaatgcagaaaatactgtttcttcctctttttttaccttaaaatttgcagactataattgcaaaaagaagtgatatgttgatcatgtcaagtgagggtcctcttagtgcatatgtgaattcaggtggttatgtgcatgagataatgactctatacaaggcaaatggtttagctctcactggatcagcagtagcagatcacagttggtttcccgggtaagtgtcagtccatttccaaattctgtgatgctatgaacaattgaacatatcaagttatttatttttctttagagttttcatgtaatggtgatgacccatgtacatttacatttcttttctcacttagtttgctgccatctaaatgtggtatggctggattctattttccattgtgatgttgggcttgtcctctcatttttcagagacattctccacctgttatctaggttttgggagaagaaaggaggtgaaagtgctgttagtttatgttttagttcctgagtcaagtattgtttaacgtctatgctata

SEQ ID NO: 2227 - DNA, 853 bp, Glycine max
  misc_feature (797)..(798): n is a, c, g, or t
  misc_feature (842)..(842): n is a, c, g, or t
  misc_feature (845)..(847): n is a, c, g, or t
ggggtggttacagcatcattggttttggggacatcatcttaccagggcttctagtagcattttcactaaggttgaatagaaactcatacataaggaatcctattcatcatcttgtactccttataaaaacatttttggattgatgtagacaatcctttatgccaagtgaatggttcatgaacttgatttttctaatgataactatacaggtatgattggttggcaaagaagaaccttcgagatgggtacttcttgtgggcaatgaccgcttatggtttaggtatgctatgtttgatctgagggcagttttcattagataaatagaatgttagcagagtaattttctttgtaagtgtttggtcctgcttagactgaaaatgtggaggagctgactatatgtttggtctttacatcatattctttgaattttgatctgcaggtctccttatcacatacgtggctttgaacttaatggatggacatggtcaaccagctttgctttatatagtcccatttacacttggttagtaaaataattagacaaaactcaatttaagttgagtaataaaacactgattattgtgcaaaaagaaatatttggacctattccattgtctgttgaacatgctgaaccaatgcaaagctttatccatgttttttggtatagatataacttaaattagtatagagctttatccattaaaactggtacgaatttttgaaatgcttttctgtatttgcaggaacctttctgtcattgggaaagaagagaggtgaactcaaggttttatggacannaggggaaccaaaaataccttgccctcacatccaagaggatcatnaannnaaacca

SEQ ID NO: 2228 - DNA, 781 bp, Glycine max
ctaactagcaaattatattatgctttatctgcatctctattctaagtcctcgtgctgtggagtttcaaattttagcccttggtacttggatgtttcttactttaaaatgtcatggataacataaattacatattagatgcattaagaattagcatactgtaagtttctctcatgtaatccctcatccttggtactcatgcaaatttgctagctgtgccatagctttcaaatgcaactagtaccgtcgaatggaagtttttaaacttaaattgatcttcctatcatgacattggtataagcaatgtctgcacaaaaagaaccactgtttttgaaatttttgtgcttcagtgctctgtatcctgtcaaagtagttactggcaatctttttcctaatggagagtttacttgtgcttagtgaaattctttatctttttagatcaagggaaattggatcaaaccaggagctgcagtcatagatgttggcacaaatgctgttgatgacccaacaaagaagtcgggttacaggcttgttggagatgtagattttgaggaagcatctaaagttgctggttggattactcctgttcctggtggtgtaggtccaatgacagtgacaatgttgctgaagaatactgtggagggagccaagcgctacattgagcaaaataattgatcttcctttaatttgaataaatgaaaggtatgtactattagtttgaaattctttgagaatcgggtttatccacagttttgtttctgctaaggtagatgaatgcatcca

SEQ ID NO: 2229 - DNA, 413 bp, Glycine max
atgtgtacagcaagcagttgacagcattgtcaaagcttgtagggcaaccccgcgcgtctgtatttgaattttcaacttaggaactgagagttgtgcgactgagtgctcctgtcctggctgcccaggttggctgaggaagacttgccttctctagtggcagttgctggttaaatgttagttatggacaaaaattgctaaggaactattaaagcatcctgaaaattattcgatgtgatgtgtacatttattggaagataacataaattaaactattaaaacaaactatgcttggggatggagtgtggaattgtctttagcagctcagttgcttgccctttttccctttttatctatttcatgtggaaaagtgcaattagtgacgtcaacctcactgtcctggtcactagctaaaa

SEQ ID NO: 2230 - DNA, 704 bp, Glycine max
agcttcactgaaaggcttagagccagggtatttacattttccaataacaaaaatatatatttctctcttatctttctccttcagttttgaatctgattcttcgtgttctttgactattatatcgagcatgaattggtaaacatagggtatgcattctcctcaacagcggattaattgtcacggggcattttgattttactatacttgcatttagacattgagatgtatgcttttgtttcaaacaggtaccctgggggtcctctgctaaatcctcttggcctagctaaagatattaataacgctcatgactggaagcttaaagagattaagaatggtatctttttttctcagttctttgatatttatcaataaatgtataattctccaaaagctcgtttccttagttgtaaatccttctattttcagggcgactcgcaatggtggcaatgcttggcatctttgtacaagcttcagtgactcatgttggaccaattgataatcttgtggagcatctttccaatccatggcataaaacaattattcagacccttgccaattctagctcttagttctagaaagtactgtatgaatatgtggcttgggcttgagcttatccataaaatgaaattactttttatttttccacctcgatcatactgtggtcaaggatcaagtttagatgtaagggtcttgaagcacaattc

SEQ ID NO: 2231 - DNA, 882 bp, Glycine max
  misc_feature (873)..(873): n is a, c, g, or t
  misc_feature (878)..(878): n is a, c, g, or t
gctggttaggaggtttatgaggctctaagagcaagtcctcaatggaatgaaacgctttttgtcattacatatgatgaacatggtggattttttgatcatgtgaagaccccttttgtcaacattcctaatccagatgggaacaccggacctgctccctatttcttcaagtttgataggttaggggttcgggtgccaactattatggtctctccttggatcaagaaagggactggtaagctcaaaatctgcattgtttatccttttttagcttctctactctttggttaaaacaattatgcctatttttttatggtagagatgtcagacaattgtgtctaatacttcttctatcatgaggctacggcatgtttttattctactggatactacattaacttttctgggacaatcattgtcctttctgcctatgggtattccggtgccatcactttgataagatagccttgactttgagatgcatttagttggttgatttttcttttctagagcctacaactacaagaccttgtttgtccttttccttgtgttttgagtagagtaaggattaaggattgttgtcttcttgtcaaatttagtatgtaaactacacattgattttgagcaatgtggttataatggctttggtttacctaatcttattgagtgcatttgttagattctgaagcttcagccttcttttgattggtttgacatgcctactaattttattttactacttggtctggtttctcagtgataagtggcgccaaaggaccggctgaaaactcagaatttgagcactcttctattcctgcaaccataaagatgattttcaacctttcctctaactttctgactcacagagatgcatgngctgngaca

SEQ ID NO: 2232 - DNA, 1183 bp, Glycine max
  misc_feature (657)..(658): n is a, c, g, or t
  misc_feature (677)..(679): n is a, c, g, or t
  misc_feature (1115)..(1125): n is a, c, g, or t
  misc_feature (1152)..(1157): n is a, c, g, or t
  misc_feature (1163)..(1163): n is a, c, g, or t
  misc_feature (1175)..(1178): n is a, c, g, or t
tcatttttatctcagtttttttctcctatctttttacaggtaataaattattaataattgtatctctatacagaatgtagttgaacactgaactgggttaaatttgatcccctttatcatctctattctacaggcattttctatcaccttttttggtgaatggggtgacaagagccaggtgaggatactgcataactgcataagctcttttattggagactgcttcatcacttcattaagcacaacttttttctgtttcagttggctaccataggtttggctgcagatgagaacccatttggtgtggttcttggagggattctgtaagttttgacttttaattattctctttattctggactcagcctatttccgtagggcattgcctatttttcctttggttgcccgtgatggcatacggcatatgttatttcaataatttgttgctgtaattctgcatacatgtgttatatgtatatgccttgcacatgcattgtgtttgtctggatgcataaatatgtatttaggatgtcacaatcctaaggtcctgcaattttgtaagagaggaatgtaattcttaattacttttcacaggggacaagcattgtgcactgctgctgctgttgttggaggaaagagtttagcttctcagatatnngaaaaaattgtaacaattnnnactcctttttattatcactacctgttgtccatctccccaccccctcgtcttttttgttaactcatttaaaattttaaattcaatattctgtatcttaaaaagttctcatgcatcaagtttaaataattcaaaattagtttcagactaccaaaaaaaatatgggagtaatgaaatcagagtatataagaattaatggaaaaggtaatggaataatgaagaggatgctatatgtgaacaaaaatacaacactatagccacgagtccttagaacactttttgatgtagtgtgcaattctgatttaccaccatattactggtatatagcactaagatgagcgtgtatgccatataaatgttgttctcaatactttgcaggttgcactctcaggtggaattcttttcattgtttttggaattcagtcattcctctctccannnnnnnnnnnaaggctgtgcttttggttagtgattannnnnntgcgtnttttacaagacnnnnagcaa

SEQ ID NO: 2233 - DNA, 372 bp, Glycine max
ttgactcggagctatcatcctcttcatctcagcaggaacaacagcaaccagaagtcctcttcctccccctcaatcgcaagaagaagaaggtctcttggaaagagggcactgtagacaacgagttcatgcagaagaagagttccaagaagtgctgtatcttccataaacagaagccctttgacgaagatgatagtgatgaggatgaacatcactctgatgaacaccctcacgatagtgggttttgctgtaagaatcatgatgaagctggcccaagcagttagggaactgattaagctgagaggttattaatgaaccaaaagaggcatatattttgtagagtaaatgattcaagaaacccttgaacttgagttt

SEQ ID NO: 2234 - DNA, 273 bp, Glycine max
atacaaagaatcaacgaacgtgatcgaatgtgagccgtaagatctgatgaccatggaacaatcaacgctgcacttccaagtacttcacctaacgcttgtccagccatccgattctgaccaattcgccggcgtctgaacggttacaagccgccggagtctattctccggcgaacacgacgacccgaattcccacatacgccactcatcagaatccggggaagacggaagcgacgccgttacggtggaagcccagtgagttaaatcaaagtgtgt

SEQ ID NO: 2235 - DNA, 330 bp, Glycine max
tctcaggctcatgtttcatgactgccaagttcaagtaaatgtgtttcttctctctttttgtcccttatatactttgctcttcacaggcttgcttcaccaactagcattattgcagaacattttcaagacaaacccaaccgtgttcttgtttcattaattcaagatttatatataaagccttgttgttgttgtgtttattttcatgcagggatgtgatgcctcaattctgttggactccaactacctagctcacagtcacagctctgaaatgatatcttcaaggaactttggcatcagaaagcgcgaaacgatcggccaaatgaagtaaaa

SEQ ID NO: 2236 - DNA, 346 bp, Glycine max
  misc_feature (52)..(54): n is a, c, g, or t
  misc_feature (56)..(57): n is a, c, g, or t
  misc_feature (59)..(60): n is a, c, g, or t
  misc_feature (100)..(102): n is a, c, g, or t
  misc_feature (156)..(156): n is a, c, g, or t
  misc_feature (337)..(339): n is a, c, g, or t
gttcactaggaggcctgttcctttggtggggtctaattcagaccatgattcnnntnnannaacaaagtcttacctccctttaaccaaacgaacagaattnnnagtagcaatttaaggtgacattgagtgtgttataagacaatccccacttttttnccacaaaaagaaaagacatattatttccttttgtttgattttcctgtgtgtggcagcagttgagaatgtaattattattttttacatgtattattatagtccatacacgattgttgtcattgttgacgttttcagtgagtgtggatttgtaaatcatgacttggtttgactgtttgcttannngagtgca

SEQ ID NO: 2237 - DNA, 774 bp, Glycine max
  misc_feature (123)..(125): n is a, c, g, or t
  misc_feature (143)..(145): n is a, c, g, or t
  misc_feature (354)..(393): n is a, c, g, or t
gaacttataattcgaaggcaacttcgattcccaaatgaaatccgccaccgaagcatcgcgaaacgccctgttcaatcgtgcaagcttgcaaatatccggtgggtccaaatacatcaacaccannnccacacaactctcgggtnnntccccaagccttggcctcgaaggggtagcatcaccatcacaaacacaagaggaaaaactagcacccatgttgacacttaacacacaccaaaccaaagtaaacccctttgcaccccccaaagttgaattcctttctctaaattccacacccccagaatatgaactgaactcaaaacttgatatggaacctgaacttttcaattccacacnnnnnnnnnnnnnnnnnnnnnnnnnnnnnnnnnnnnnnnntgagttcagttcatattctgggggtgtggaatttagggaaaggaattcaactttggggggtgcaaaggtttactttggtttggtgtgtgttaagtgtcaacatgggtgctagtttttcctcttgtgtttgtgatggtgatgctaccccttcgaggccaaggcttggggacatacccgagagttgtgtggcattggtgttgatgtatttggacccaccggatatttgcaagcttgcacgattgaacagggcgtttcgcgatgcttcgatggcggatttcatttgggaatcgaagttgccttcgaattataagttcattgtggagaaagctttgaaggatgcctctgtggaagaattggggaagagggatatttatgccagac

SEQ ID NO: 2238 - DNA, 407 bp, Glycine max
tcgtgccagcgtgtccttttaagtaccctgtttttcaggctggggtaagggtgtgtttggggaaggacttggctttgatggagatgaagtccgttgtgcttgcgttggttcggaggtttgatattcgggtcgttcaatcgggccaggagccccggttcgagcccggtttaaccgctactttgagaggcgggttgccggttcgggttcgggtttgtgaaaggaaatgaatagcaagtatgtggttgataaagtcataaagccataaaggagttcacaactagaatgaaatcatgaaatcaatgaggggatggaagaaccgttttcgtgtaaataataatgttgcagttgaattgaaagttttctttttccccctcttttaagctggtttcttgctgaatttgcgttag

SEQ ID NO: 2239 - DNA, 685 bp, Glycine max
gattggaggttcttgtgattagtgctcagaagggtcatggaatgcagttcccaaaggtattgtttgctccgccacatcttgtattgttttgaaacccaatttttgtttattttcaaccccttttggtgttgttgctgacatgtatgtgttgtttggcctcagggtggttgggaaactgatgaatccatggaacaagctgctttaagggagaccatagaagaagctggagttgttggcagtgttgaagtaagtgtgtgcaaacactttcttagtttttttcttcaccccaaataattgttgtgccttcgattcttaccttgtgtgttgtctttgttttcttgcagagtaaactgggaaaatggtattacaagagcaaacgccaacccataatgcatgagggatacatgttccctttgcttgttaagaaggaattggataactggccagaaatgaacacaagaaaacgaagatgggtaagtgtgtaaccaaacattattcacttagtcaaattcactttcccaattgcaaatatcttaattgggtatgtttatgtggttagtgtcctaatgtttcattgatgtgcatcatgcagatgactgtggatgaggcaaaagtaatatgcccttatgcttggatgaaggaggctttggatgaattggtcagaagacaaactcaactgcactcc

SEQ ID NO: 2240 - DNA, 321 bp, Glycine max
gggcttctccgctcgaacttatgcaagggctatgtgatggtgatgatgattgaatttgaagctgctactgcattactctctttggtaatgaatttgaagaagcagaaagaaaggaaatgatggtctttacaccgtcaattttaatatttgtaagtgtaaactctgtagtagcacagtgatgtagtgtagattaggcatttggcagcgtggtaaatattcttagattgaattgtgttatcaacagtattaaacgttttaggctgaatgaatgatattgatgaatttataaggtggggaggctaagatggaatcatgtagtta

SEQ ID NO: 2241 - DNA, 688 bp, Glycine max
tgaaatactgaaacagatttgatgccttgatccactttgctggcttgaaagcggttgctgaaagcgttgcgaagccccgtcgctattttgattttaatttggttggcaccatcaacctctacgagtttatggcaaagtataattgcaaaaaggttcgcacctgaccaacatttttatcacgccctaattttttaactattctatcacaaattattataatggtaaaccttatattgacttcaatggttatttaaaattacatgtccataattttgtatattaattgcatttcgctttcatttcatttttgggagagtgctttattacttttacgttgtgttccaaacaagtaaacagaatcagattcttgcctttccttctttttttcttgtgatcttatagaatattgcttaacagcatgattgttctcctgcatagatggttttctcatcatctgcaaccgtttatggccaacctgaaaagataccgtgtgaggaggatttcaagttacaagctatgaatccctatggacggaccaaggtaaccttcacactttgttctgagttgcttttttccctttttgttgttcgcagcttgtggtttctaaggtcggataaacttatccataattacttataggtaaaatgaattagacttttttcatgtaagttaatttatagaaactatc

SEQ ID NO: 2242 - DNA, 1075 bp, Glycine max
  misc_feature (1067)..(1070): n is a, c, g, or t
  misc_feature (1072)..(1072): n is a, c, g, or t
gatcttgctggtgagatgaatttggaagttccgatgaggtattttagtcactcatggtttaaatttcagttttatacaatatgttctacatttgagatgtcaagatgcattttctgtaatttaatgtgcacaatataagaaaataagatacttcaaaaggtttctttgtcacactttaatgtttatgcaagagtgttcttggtttaagtaaaacgttgcatttgtcttttatgcaaagaatctcttgattttccttgctggtgtgaggtttcttttgaggtaaatattttccatcattgatcattgtagatggatgatgacagcgatagtgatgaggagagtgatgaagagacccctgctaagaaggtaatgatattgctgttgtattgtgtattgttttgtttggtcacatatgttaatgtcttctatatgattggtgagtagtgagcaaacttcaccagctcttatatgtgactttattttgtgaaggtggatcagggcaagaagagaccaaatgagtctgcagcaaaaactcctgtttctgccaagaaagctaaaactgctactcctgaaaagactagtgagtgtatcttccatacattctttttattcatgtcagttttcccaagttcttcatcgttcatagactagtgtgtcattgatgaatgtattcgaattcagtttgtattatgcacacaaattatacattttactctttacttgtcattctgtgtttgagtgacacttgtaaataaatgcttatataattgtttttgtttaatgcatttttcatgtttatctttccattatgcagtggtaatattttgatcaaaatttgtttgtagatggtaagaaaaatgtacatgtagcaactccccatccttcgaagaaaggtggaaagacacccaacagtacaaaaggccagtctcccagttctgctggacaactatcttgcgcaagttgtaaaaagtatgattctatttttgcaaatagtagcaaaagtgatttaagtaaaccttaaagaatagtgttattaagttacatcatgacttatgacgggatattcnnnngnttg

SEQ ID NO: 2243 - DNA, 684 bp, Glycine max
ctctcccctcactcagaccctggtggcatgaccattcttctctctgatgattttgtgtctggccttcaagtaagaagaggagatgaatgggtcatagttaagcctgtcccaaatgcattcgtcatcaacattggtgaccaaattcaggtccagccctctctagatttgttcaaacttcaaacctttttactagtcaagctgctatataatgactaattacattaatcactcctttcacactattttagtcataccatttgtcttacatgtttgcttgaacattattttgaggaaataaattatatattatactatactactattttttttctaaagtaattatctcaaacaagcacttttcaggctcaaatttcaacaattggtggttgttactaattaatcagtgttcaatgcatgtttatctttttaggtgctgagcaatgcaatatacaagagtgtagagcacagggtgattgtgaactcaaacaaagatcgtgtgtccttggcattgttctataatccgagaagtgatttactcattcaacctgccaaggagcttgtgacagaggagaggccagccttgtactcaccaatgacctatgatgaatacagactttacattaggctaaatggaccttgtggaaaggcccaagttgaatcactggctttccaaccatgacttaa

SEQ ID NO: 2244 - DNA, 882 bp, Glycine max
ctcgtggccttgcttcaggtacgcccccgcagaattctgcataactcaatttgtgccctaattggtcaacttctcttaaaaatcacggaattagggtattccatgactcttatggtatatggagggaaaatttttgattaattattttgaacttttgtgtagaaagcagaaagtgcttctaaggagaaaggtaaggcatctgctgttgcgatcaacgcggagattcgtcgtactaaggctcggttgctggaggaggttcccaagttgcagagattggctgtgaaaaaggttttagttcattgttatgattaattgaatttgtgaggtgttttatttgtgaattctcatcaatcatgtagctggagcttttcggatgtaacatagagtaattgttgggagctaatataatttatttaatcgaattgaagagttctgttataaattttgaacaatgagaaagagtagagaaataaatccaacttcaccattgtaacttcatagaatgtgcagtttcaaaattaatgaatgattcaatgtatccacaggtaaaagggctttcgtcacaagagtttgctgcccgtaatgatttggttcttgcattgccagatagaatccaagcaatcccagatggggctcctcctgtgccaaaacaaactggaggctgggcagcttctgcctcccgtcctgaaattaagtttgattcaggtaatcaagttatccatgtctcaggctgatgcaactatcgcatttcatctgtgaaagtgagaggccttttaattgtctgactctgttcatgtatgtgaatcactgaatcatctcaaatatagatgggcgatttgatgatgaatacttccaacaaagtgaacaatcaagtcaatttag

SEQ ID NO: 2245 - DNA, 272 bp, Glycine max
tgtagcatcagagtcataaactcataatcaggccaccaaaatagcaatatcccatactcattaaaaagaaaaatagtaaatgtacatataccacagaatgaacttgcctggtaataaatctcagcccagaacagtaccaacagcgcataagttgtaaagaaagcaagactaggcatgtcaagtaagatatgttggacaatctgcacacacgaagctgagcattagctatgagattaaaaaacttaatttataaaggaattgaaaaaaaaaaa

SEQ ID NO: 2246 - DNA, 401 bp, Glycine max
gagtgtatgtagtctgtttcaggttgttaatagttggttccttccacctagttctgttaatttgtccccctcacccaaagaaagaaaaatcctccttccaatttcttatatttcttgctgcctgaagaaagccgtttgagaagaagcttcaagttgatataattggtttcctcatcttcaaagttttaacagattgtattaagtattaatactattaattagaagaaccattgtatactcatgtagtatactagaacactagtacgatgtgatccgggaggggatgttttaaagcttgtttgtatatccctgcctccccttaattatgagaaattttactttggatgattatcttgctttcaaggaattgttgttcatgttcccttattcaatgttatggt

SEQ ID NO: 2247 - DNA, 668 bp, Glycine max
  misc_feature (50)..(54): n is a, c, g, or t
ctccctcacactcgggtgcaaacgcttacgcccccttgcccccaagcttnnnnnaccgacaccatttctccacctcatcatcctgttacaaccttcgacctcaagagcttcatcaaacctgaaagtgcctccagaaaacttggaattggatcctccgatgataatactaataagagagacccatcttcaccccagggccaggtccattaacaatctcttctatattctaattcttaatgagaatttgatattccctttaatttaatttgttccgtagcatatcatccatacattcgtgcaacatataccgagagagtgtaggtaagttgattgagcagcagtatgtgtgaattattataaattcccgttaactcacgcatccaactcaactaattaagttaaacacccatagtaatacactagtgacacttaattcacgtgcacatatatatgatacaaaaatatggtttaattaataattttgttgttttatatgcatgatacaggctgaaacgcatattccaggagggacacggtggaatccgactcaagaacaaatagggatattggagatgctgtacagaggagggatgcgaactccgaatgctcaacaaatagagcagatcacagcacagcttagcaagtacggcaagatcgaagggaagaac

SEQ ID NO: 2248 - DNA, 1253 bp, Glycine max
  misc_feature (76)..(78): n is a, c, g, or t
  misc_feature (1241)..(1243): n is a, c, g, or t
gtagtacggagtgctatattttatatatttgttcacgatccactcatttcgtttatattaggtttgtttgtcctannngggttgtagctctatgtttgagctttggagaaatactgcagacatccccctttcctctcttttttttaacccttagcagttagatgatggagataacaatgatttgatattagccctttattgcattatagaaaaacgcatttgccatgccccctctcaccaattatggtatcatgataaggaagagaatttgtgctgattgatttttttttatgcatgtgtcctttatgtgaatttgtgactggttgcatcctatattacctgaatgattttgttcattaagagctttccgatatcctccgcaagcttgattaatgatttctacaatgcattatgtatattgttaatgtgcaggttcaaatgcagaggcaaatgcatccgcagatgcagcagatgattcattgagcttctgaagatgttgctctcctacaacctaaaataagatagtagaagatacaactgaataggctccaggttcattcaatcaatcaattcattcgactcaaactggtttcaagggataattcattcaaacatatggtcagctttttggctaagtagctattcataatcaaacatggccttcatcatcctcaaattcagcagtttaggcaggaagagggatatatgatgacaaattgtggtgctgtgaactttttgttgcatagatttgttgtggttgtgcaaggattttgttggcaataatgttaccctgatatattttgcatttaaatcaagatatcttaaacatgcagtgaatgcattttagcattttttgttctttgctcacagtaattttgcgccattagtggatgtggttaaagatggctccaagaataatgtacatcagagtcagcaacaagttcatggaatgcagccacagctacagcaacaacagagttcccttcggttacctcaacaagtacttacatctacttctttgaccattatttaatgctttaagttacttgtgtgatgcatggatatgaacaggggcacaggctgtgagacatagaatgtccttattttggatcctttgagaacccttcacttttgtagatgtattttgtgcttcctcaaaactgaattaccctatgcctcaagttgaattatgatttttttttgtctggccagtgataattatttgtagcatccatcaaaannntattttgtac

SEQ ID NO: 2249 - DNA, 503 bp, Glycine max
catggataaacggtcgaagcattggacgccattggcctggatatatagcacgcggtaactgtggggattgttattatgctggaacttacactgataaaaaatgccggacaaattgtggagaaccctcccagagatggtaagagttgacagtgacacaacactatctattttactacattgaaaggagtgacttgaatatgatgattcatgacaacctattgatggcattggacaggtaccatattcctcggtcgtggctgaacccaagtgggaactatctggttgtgtttgaagaatggggaggtgatcctactggaattactttggtgaaaagaacaacagcaagtgtgtgtgctgatatataccaagggcaaccaactcttaagaacagacagatgctagactctggcaaagttgttagacccaaggctcacttgtggtgtccacctgggaaaaacatctctcagattaaatttgctagttatggattgccacatggaaca

SEQ ID NO: 2250 - DNA, 502 bp, Glycine max
cgacacttacaatgatggaatctggcccaaatgtcatcaacaatgtctgtgggactgttaagtgtgttgttgtcatcatttctggcagaccgattgtcattgaaccatacatttcttctatagatgcattggtggctgcatggttaccaggcactgaaggccaaggcatgacggacgtcctttttggtgactatggtttcactggtaagcttgcgaggacatggttcaaatccgtagatcaactcccaatgaatgttggggatcctcactatgatcctctttttccttttggtttcggactaacaaccgaatccgtcaaggacctggtagcaaggtaatttttcctttaaactattaaagctttttatatgttaattaatcaatgctgctagtcattaactacttttcatttgactagagttgctcctcttattactgatggaaccatccattctgcaggtcaacctcagctgctgttggtgcaagggcttgtatatttacc

SEQ ID NO: 2251 - DNA, 521 bp, Glycine max
cttacatgtcactgttgaagacatatggtgtttttgtcctagttggtttcccaagtcaagtcaaattcagccctgcaagccttaatataggtacgttggttttgaagcatagaaagttaatttgttggaattttcagttttcattcgtgaaattcaattcattgaagcagtggaactgtaaatattcatcttctgtttgacaggatcaaagactgtagccggaagtgttacaggtggtacaaaagatatacaggagatgattgacttctgtgctgcaaacgagattcacccaaatatagaggtaattccaatcgagtatgccaatgaagctcttgagaggctcatcaatagggacgtcaagtaccggtttgtgatagatattgagaactccctgaaagaaaaataagttgtacttgttgcctcctaaattgggcatgattggacttcaccttgttcgataaacaagatgttcatagttcataattacttacatagaggtgatttcaatggagtatgcgatg

SEQ ID NO: 2252 - DNA, 679 bp, Glycine max
caacttgtcatttggaggtcagacatctctttcctcgtatgtctgtgtgtatatatctgtgtttataagtatcttccatatgataatcagaggaaaattttcatgtgctaaattggtcaaactaatattctaataaatcttcaagcttatgcttttgtttaaataccatttagatccaaatggagagttaatatttttcatcccaaaaaaataagagggacttctaattgtggttgtagacttgagttgtagaatatttgatcaaatttttatttcttgaaagaataatcacttatgcttcccttctctttgatcagaaggagttcgtgctgctattctgttgtgggcactattggtaagcatcacaatgagtcaatgaggcattctgatgttggtgatcaatttattctgatgctctccctgcaaaaatggctagaatgtttttttcattgtataattctgccatgcctagtttgggagctttctgacagccttcatactgtgtcaagcttttgcaatatggtccaatcttaatttatatgtagtttctatggccaaacagccttttatagttctagaattttctaataagattgaggatgtacatattctggaatacataattgatgtttttgctccagaaagaaattgttcgattcattaaagaggagtctgaaag

SEQ ID NO: 2253 - DNA, 469 bp, Glycine max
  misc_feature (426)..(426): n is a, c, g, or t
  misc_feature (458)..(458): n is a, c, g, or t
  misc_feature (460)..(460): n is a, c, g, or t
atcagccttgcttcttgaacccaaaagaaatcacaggagaaagagaggaaagaacggaaaaccaaaccacagatgggcagaaccattcagaaatagcagactaaacagggcatatacagagcacaaatataacaccaagttaaaatgcctttaaaatgtggtgatcaagttaaatgatcaaatttaattaacgtaagatcaactgattgatcattgacgttggacaaaaccaaatctagtacatcttttgcagtatttaagccacaatgagtaacatctatatttacaaacttttgaattacatcttaaatatcaaaagtgagatctgcttaatatcaccagcatctcttaattatttctactgaatacagcgttaataacctctttcagatccttgcaacctacaaaaaaatagcaagaggaacnccatggaacaggtccttctccctgagactgananaacacaacc

SEQ ID NO: 2254 - DNA, 850 bp, Glycine max
tagggaagaacaaccatttttcaatgaccaagatctgttgaaggctttggttgatttaactacatcaaccgaccttgatctccaggaaaaggtgattgttgatacagcacctgatactatcgttaaagcattgtcaaatgatctgttttgtttgtgactaaccttatctgtgcaatgccaatgtcataaaaacacattttgaactatgcctctttcatatgcaagactccaagccatgttccattatggtatgtctacatctgaaattgatccaatgaggttgttcaatgttatctgctttccaatctatgatctctcaatttgcccacaatgttgtgtttctggtgatgttaagcatccttctggaaatcagtagaaaaaattgttttagatttatttttgaaacaaggtagtatatatgttcagtagagtaagagtgagggattgtttaaaactggtcatttatagttgttctttatttcaattttgtatgtttatgcagattatacttgtgtatatattctaatcttatttagataaatttctccataaatacttatagaagaaaataaaaataaaattcattcataagttaaaatcaagtcatgcatcttaactttcgagaagttagactacagaaacaaggtagtattatatgttcagtagagcaagagtgggggattgtttaaaactggtcatttacagttgttctttatttcaattttctatatgtttatgcagattatacttgtgtatatatattctaatcttatttagactacagaacttctaaaaaagtcatgcatcttaacttttcgagaagttagactagagaatttctaaaaaagtc

SEQ ID NO: 2255 - DNA, 489 bp, Glycine max
tataaactaatcaaaagtggaatttaatgatgtagaaataatggaaagcaaaatgagtggatgaaatgaaaccttggtccctgcctttgtgagaagaggagagtgatgatgatatcaggaggaggaggtggtggtggagggaaatcatcgtggagttcatcaacatcgtcctgggtacccacaacctcagtgtcggcatcgggaaagaggattcagagggaaatggttgaactcaacaacgaccctcctcctgattgctctgctggccccaagggcgataacctctatcactggattgccaccattattggaaccccaggtataccttatttattactattactatgataatcatgtttccaacatttaataataataacaacggtagatttcttctttgcttgcagaaacaccctaccaaggtggcatctttttccttgacatcaaatttccaattgattatcccttcaagcctcccgaggtagtatt

SEQ ID NO: 2256 - DNA, 336 bp, Glycine max
gcaagcccaaacaccccttttcaccattgcaatcttcgttcggtttcagagaaccccttttgaatttgtttgaattttctgggaaactgggcattttgtgatcatcatctgggttctctcgatctccatcttttttttctggctttcggttttttctcctcagatcctcttctgtttttgttttctcagtttttttattcgaattttttaagttgtctcgcaattctgcctcgtgggtgtgtgtttttccaaggaaaagattcagcttttaatagcaagaaagtgggaaaaggattgattcctatctgggtttttttatgcgattgttggtttaaa

SEQ ID NO: 2257 - DNA, 373 bp, Glycine max
gagactgcaaaagaactaggacctaatgctactttcatagcatgtgatgttactcaagagtcagacatttccaatgctgttgatttggccgtttctaaatacaaacaacttgatatcatgtacaacaatgcaggaatagcctgcagaagtcctctaagcattgttgacttggacctggaactgtttgacaaagtcatggacataaatgttcgtggcgttgtggcaggcatcaagcatgcagcatgtgtaatgatcccacgtggaagtgggtccattctctgcacagcaagtgtcacaggtgtgatgggaggggtggcacaacacacttactctatatccaagtttgcagttgtgggcattgataaatctctgg

SEQ ID NO: 2258 - DNA, 776 bp, Glycine max
  misc_feature (700)..(700): n is a, c, g, or t
  misc_feature (702)..(705): n is a, c, g, or t
  misc_feature (714)..(716): n is a, c, g, or t
  misc_feature (723)..(726): n is a, c, g, or t
  misc_feature (737)..(746): n is a, c, g, or t
  misc_feature (754)..(773): n is a, c, g, or t
cgggttcagcctctgaaccccatcgacctcgatggttcgttttttcttgttataaaaaattcgacgattcctaaccctaaattttactagactaatttccctctttattattattattattgttattgttattgttattgttattattattactccatgggggttttaggcagtgtttgaatttgatggtctgattgtaatcgttcgcagatgattttgatgattacgaggatgtgatttgcgttgatagtaaaaagaggaagaattcccaggctgtaaggaatattttggctctgatttttatgatgtgtttgtgctcagattattgattctggttttgtaactgttgaaagtgttgtggggggtttaggttgggaatgagaagactaatgggaaaggagtaacagtggtggacattgaggatgatgattggttacctcctccaccaaagatcgcaagtaatgcacagaagacgattgacgaggattcaactttgaaaaaattgaggttgtgcacatttcactctttataggaattttcaaatgtcaaattcgaatcctagctgcttgctattgttttgttttgcttacatcccttgaatttgtattaagattatcctcagctggaaacgattgctccaacagtgtgatattgcatacatcgatatacttcttaaaaatgctagccttatttttgttcntnnnnaaagaattnnntaatttnnnnttgaccacaannnnnnnnnncaaaatgnnnnnnnnnnnnnnnnnnnnttt

SEQ ID NO: 2259 - DNA, 470 bp, Glycine max
gcaacttgcaactataacaaccataaccataaccatgacagtacaaacaagagtgttctcatgtcatgataatagatttctctcttcaacttggcatgctcccaaaccttaaccaaacatcgtttgacctgccaactgttacgtacagttttagctgcctcctatgatgggaggagtgtctggcggcggcgacgacgacgtcgttcaaatccagcaaccgaacaagcccggcgaccctttcatcatcaccgtcaattgccccgacaagacaggcctcgcttgtgatatctgcagaatcattctcgatttcggtctctgcatcgccaaaggaggtctcacgctttctccactttcattgaattcttcgtttcagatcctcttccgttgttttcttaatttaatggaccctcttttgaatatatcattcagatgtttcaaccgatggcgtgtggtgttacattgtgttgtgg

SEQ ID NO: 2260 - DNA, 505 bp, Glycine max
gactatgtacgaatcagtaaagagtgtaggcaccttttgtctagaatatttgtggccaacccggaaaaggtacaattatttatatgttaatttgttgcataacataataacatttattattattattattattattatatgatgttaactttgggttatattattaattggaagcagagaattaccataccagagattaaaatgcacccttggttcctaaagaatttgccactagaatttatggacgagggtgaaggggtgttgcagaatgatgatcatgtgaatgaagagtcatctgaaatcactcaaagcattgaagaaatactggccatagttcaagaggctaggaaaccgggtgagggcccaaaagttggtgagcaatttgttgggggcagcatggacctcgatgatattgatgcggatgctgacatcgatgacattgagacaagcggtgattttgtctgtgcattgtgaatgatgatgcttgcactttgcacactatttc

SEQ ID NO: 2261 - DNA, 390 bp, Glycine max
catctctcggcccaaatacctccctctgtgggtgacctcccttacctcgagtccctcgtcttccacaaattccccaaactcgtgggcccaatccagcccgcaatcgccaaactcaccaaactcaagtaccttgatctctccaacaacaatctctctggcccaatacccgattttttcgcgcaactcaagaacctcgacgatatcgacctttcctttaacaacctctccggccccataccaagctcgcttggtaaactgcctaaactcgcgtatctagatttgagccgcaacaagctcacgggctcaattccggcctcatttggatccttccaaaagcccgggccggctattatgctctctaaaaaccagctttcagggcgccttcctgct

SEQ ID NO: 2262 - DNA, 811 bp, Glycine max
  misc_feature (63)..(63): n is a, c, g, or t
  misc_feature (756)..(756): n is a, c, g, or t
  misc_feature (758)..(761): n is a, c, g, or t
ttgccaaattgaatgtgtccaccggaaggatctgttcattttgccaatcctctaaaatctttnaggtaatatttcacgtgcatcaatttcctgcatgttatcattgccagtgtatcccccttttcactgaaaactatgttatcctcatgctatatatgctgctgggctaattgttgaatctattttctggtcttcatggtgaatctttgtaggctactggaccaatgctgcattatgcaaatggaaacttagttacaggagatgcagcaatgaaaccaaatgtcatacctgtgcatagaatttgcattgactggtatgctaacttgatattttgagtatgcattgcttgttgctatagcctcctagtctatatatttgatgacttgtgaagccacctaaaaacagataccgaatcctgattgatcatgtgttgttcaaaactttttaatatgcaatcattacacgcttactttagtatcttttagctttctatttgcattttgctgattaatcggtataaacttttggaatccagggcaccacaagtgtactttgttggtgaagttgttaagaatttgaaggcagaggtggcaaggggagcaaaacttaaatgcagtaaatgtaatctaaagggagctgctcttggttgctatgtcaaatcctgtagaagaacgtatcatgttccttgtgcaatggacatctcagattgccgttgggatcatgtactttctcatatcaatgctattatttttaaanannnntaaaaaatacttgtgctttgcatttatctaaacttttctggggcataact

SEQ ID NO: 2263 - DNA, 919 bp, Glycine max
  misc_feature (902)..(907): n is a, c, g, or t
gcagagagcattttaatgcatgcacagcagcagattgcactgcaggtttgatgggattgtccattaaattgtatttgttaccaggatcacttgtacatgtgtttaaaattctaactgctttatacttttgatttctgtagaaacttatgttgcagccagccttagtggcaacaaaagtggtgtgtttaactcatgcagtttcttctgatgagctcaaagatgatgaagactatgatgagattcttgatgatatgagacaggagtgctccaaatttggtaatttctgatttagtttgcttgtctcactgtgaagtgtgaactaatattaattttctgtgttatttgttttacagccaatttgtagtcccacattctcatagagaatcaggcctaacttacagactgaagcctctataacctttgtcttcacatgcttgttcattgcatgtctatgaaaatttatttgcatatttcactgttttttgttttcactttatgcaggtactttggtgaatgtggtgatcccacgaccaccgcctgatggtgaacctgccgcaggagttggaaaggtgtgttgttgacctattctggaaattcagtctcctagtgtcaattatagaaattaagagcacataatttgtttgtcttatttttcccccctttcctaatgctgggttgatgtggttgtggaatcaaaataatagttaatgtgagggaccgaggatttgccagaaattactgttggaaaatgaatattatgtataattgcttttcaaggtgatttgctttaggaatagacatgctataaactgcaagtaactttgtatttgcaggtgtttttggagtacgttgatattgatggtgctacaaaagcccgtgctggattaaatgggcgaaaattnnnnnnaatcaagtagta

SEQ ID NO: 2264 - DNA, 273 bp, Glycine max
actatttaaagacacattacccttttgcaaacacttcatcacagaatcataagagtttttgtgtgctcttggattggttgttagaatggagggtcagagtaagggtagttttaatgtgatggaagggagtgagggcaaaggaagggagtttgtggtggaaaagtctgcatcatcaatagtgggaacttgtgatttggttctaaggattttggcctttttactaacccttgtggctgctgtagttattgggacagataagcaaactgccattgt

SEQ ID NO: 2265 - DNA, 338 bp, Glycine max
catgctagcgtagactctaaagtaccaagaagaaagttcaatgttggggagtgcttgaatgaggagcgtggtgttgtgttttcatcatgacttgctggggccccatttgttggatacatagcatgttgtggtagtagtaaaggttactttgttttacgtgttgagggtggaatcataggtgattctcttttctacgttgtaattgagaggtgggtggagtattctaggtttctttttcattattatttatctgtcggttgtgtgattgtatgaatgatttggattgtgaatattgtaagggcagcgcagtggtgtattctggttgatgactcgttgga

SEQ ID NO: 2266 - DNA, 391 bp, Glycine max
acttcccagatgcacctgaatctgaggtgtggccagaggcatataagaagagctatgaaggagggataatgacagcaatgtcaactgttgttgcagagtttgaacaatctggatatggtgcagtgatccaaacaccttcattgcatcctggtatgttctcaattgtcacaccatggacttctggaattgatataagagaccgaatgcgaaagttttctagaacagctcatatatttgcactggcaagggatcaaggatcagggactgtaaaagccccagatcgtatcagttataagccggcaggtgtagatgaagagaatttaaagaaaggaattgagaaggtgctgagaattctggcagcagctggtgctgaagaaattggaacacatca

SEQ ID NO: 2267 - DNA, 374 bp, Glycine max
tggccatgctcctcgccgtgttgcaaataggaatgcattagctgtcttgtttgagtcaatgctaccgtgggttacttatgaggatggggtggatggtggacctgatgatgaccaacatgatgaccacaggcaagacaatcaatgattctggatgcaactggccttcctgctctgaagggcctatttttggctggagtgttgtactcaatgatgagatgcctttcttgtacagtgtgacgcctagggagcttgatgtcttctgctattatgttgatcattgtcaaccatatgggcactctagatgcataaaaatgccatataattttgtggtgtctaagtttatggatattgatgtcaaatgttataccgttgcc

SEQ ID NO: 2268 - DNA, 877 bp, Glycine max
ctctataatggatattttctttattattattatttttattgtattctaatcatcctaatatttttgcttttatcaggtttttactaattctgacaggattcacgcgatgagggcgctggataggcttgggatcaaggactgtttcgagcaaatcatatgcttcgagactataaacccgaaccttccctattcaacccgacccgacgaattccccatcctccttaaaccttcgctcgacgccttcaagatcgcgcttgacgctgccaacgtggatcctcgtcgtacggtaagacgacgaagtcagcaacctcaaccaaaatcgtgattgatttcaataactgaacttgatccaagttaaattagacccaaatgtctcggataaaattttggattctaattttataataaaataatggtgattaagggaaaactctattaaaattagtcaaccaaattttcctacaaaaattatcataaaattaatcgtgcacaaaatcaatcctatgagtatggttataaaaaatagtcaacaaacgaaacgggtcgtcacttccttgtttcggcgatgttgttttttgacagtgaaacccaaattagattattatttaaggaaatgttagaaaggatcgtttttaattttttataagaaatcattgagatggataatgattttctagattttatgctatatattgcagttgtttctggatgacagcgttcgcaatattgccgcgggaaaagaaatgggtctccacactgttctggtaatttcctaaacgacgtcgtataatcataaaaactagtattattaaggtgattttaatgtaaaatattgaatgttataggttgggaagacaatgaaaagcaaaggagctga

SEQ ID NO: 2269 - DNA, 394 bp, Glycine max
tcctccggggcagtcccttttggaacaatgtttgctctagtctgcttatggtttggtatatcagtacccttggtctttgtgggcagttacttgggttttaaaaagccagcaattgaagacccagtgaagactaataaaattcctaggcaggtacctgagcaggcgtggtatatgaaacctgtcttctcaattcttattggaggcattcttccatttggggcagtgttcatcgagctcttctttatcctgacatcaatatggctgaaccagttctattacatctttggcttccttttcatagtgtttgtgatcctattaatcacctgtgccgagattaccattgtgctttgctacttccaattgtgcagtgaggattacaattggtggtggagat

SEQ ID NO: 2270 - DNA, 517 bp, Glycine max
ttctgtgcccatgacgattgttgtatcgggcattgcaaaaatgtttgttggtgaagttgttgaaacaggtaaacaagcatgtgatgcttgcttctaaaagcattacaaaatgcaaacaatatcaaggtcaatatgcaggactcaaattgtttcaattgtactatattttgcagctagaatagttatgaaagagaggaaggaatctggaccaatccggccttgtcatctgagagaagcatatagacgactaaagcttgaaggaaaagtctttaagagatcatcctcgaggctcttccggtagatgaaccaaatatgaatattgtgtgcatcagcatcactagtttgctatagtggctttcgggtagattaaattttgtagtctgcaccttcttgttttcaacatcttgatgttcatttaactggagctagtgaatgtgaatcaatattagaagtaaattgggaaaatttccccatttctgcaaataagaaatgtgcaatggacacatgtttaggactc

SEQ ID NO: 2271 - DNA, 580 bp, Glycine max
cccaagtgatgaagaactgatcagcttggatgaatatgttgagaacatgaaacctgatcaaaaggatatttattacattgctgctgacagtgtgactagtgcaaagaacacacctttcttggagaaaattgcagagaaggatcttgaagtataagtttttttttagagtttttaactttgtatcttttgagtacttatttctatcaattaatatatattggtgttttttgtaatgtaattttccaggttctgtttttggtagatccaatagatgaagttgctattcaaaatcttaaatcatacaaggaaaagaattttgttgacattagcaaggaagacttggatctaggttaacttctttcttctttaaactttcaataatttgattgaacaaacactcgcatttagttaaccaaatatttgttagtctctctttcgagccaattttaatgttgacaatggggtgaatttgtagcttggttcttgtttgatgttcaaattcgttacatatagtttgttctttctgcaggtgataagaatgaggaaaaggaaaaggaaatgaagcaggaatttggccaaa

SEQ ID NO: 2272 - DNA, 670 bp, Glycine max
gtaatcattgccactggattcattgcaagcacacctcaaaacattcctaccacactgaagagagatggaagtgacttctcggcagcaattatgggtgctctatttaaggctcgtcaggtcacaatttggacagatgttgatggtgtgtatagtgcagatcctagaaaaggtttgttatgcttcgtactctgtctctgagttaaacaatgagtggactggatcatgagaattggtttttagtaaccagagggagttctagctctgacatattgatgattcttttgtgttgtgtttgactgccataacatgatgttttgattaaatataaacaataatatcttatgcagttagtgaggctgtgattttgaagacactgtcttatcaagaggcttgggaaatggtgagttagatgctggaaagcctcaatgctccttctgcttgtaaaattaaggagattaacttgcaaattgtctgttgtacagtcttattttggtgccaatgtcttgcatccccgcacaattattcctgtgatgcgatatggcatacccattatgataaggaacattttcaacctttctgctcctggaacaaagatctgccatccttctgttaatgatcatgaagatagccagaacctgcaaaattttgtcaaaggatttgcaaccataga

SEQ ID NO: 2273 - DNA, 423 bp, Glycine max
aattccttgcttccttctcattttccgtccatgaataccaaggcagtaagtgtgcatgtaacgttgttgtttaaatatgcatagattttataaaatatctatttttgaagcctcccaaatgccaatatgcttggtaaaaaaatattcatatcagattccgtccaagctaaaacaggggaaacgttgaaaagtggaacgcacaggggaaacgttgaaaagtggaacgccatcgcatcgccgtaaacgttcagagttacttcagcggttgtaacctgtactaactctagagtaatcttctatatctatatcctaaaataaatcacagtcaaagcaggtgtttggttttcagttggatgtcactccaagttactcccccattttgattttaccaactgtgcttgaggctgagctatctgtatcagc

SEQ ID NO: 2274 - DNA, 935 bp, Glycine max
agttgctactcttggcaccagttatcagcttaacatagttgataacaccaaaggcacaacaacattgagggaatgaggcttgtcatatctgctgtatgtgttattgtgctattttcttatgcaggtgagttaacaacttaccctgtttgtggattttgcttcactttcacttacattccacccagacatccaactgatttgtcgatgttttctggttatagccgcgtatgatcctttggatccaaatggaaacataacgatcaaatgggatgttgtgtcatggacaccagatggctatgtagtaagtaatacaaacttcattgttatttgttttgtatttctaggccacacaaaatccctagaaatagctagacctagttgtcaagggtgcattgacagatcaaattaaaatactaagacagtgtttggattcacattaaattagattctttagaattatgttgaaatactacagttaatgtagttttatgtaaattttcatgtttggttccatgttaaagaaatgattttgggttgaagcaactttaggtagcttttatgttatatcaacaattttatagtgagttttattactaacttgtttttataataaaaatatccaaacataactcatatcacttcaaaatcagttttaatcaagatcatttttgtcaacgtgtatccaaacacatagtatagtaaactagcattgcagtttattgcaaagcgagtaaaatggatgtaactaaattgaagagtaacctttcgtgtaatgaaagcatctgtttcggtgtattgcattttttaccaggccgtggtaacaatgagcaatttccaaatgtttcggcacatcatgaatcctggatggaccttgggatggacatgggcaaagaaggaagttatatggtccatggtaggagctcaaaccacagaac

SEQ ID NO: 2275 - DNA, 320 bp, Glycine max
  misc_feature (154)..(154): n is a, c, g, or t
aaggcatgagataatcaagagggcagacgcggtgatagagcactatccattcggaagggaagatcacaggatcgttcctcgcttctggattggcatagagagcttgttcgcgaacatgattcagaagacacacaaggaccctaccattgaaganataaagagcttgctctgcctcaaacagcaacaacccgggtgggttcttctcagcaaaggatcgaacgtgaagctgttggggagtggggacccaatgctggccactgcagctgatttcgagatatggaaggaaaaggtgctggagaaagcagggtttgacgtggctt

SEQ ID NO: 2276 - DNA, 730 bp, Glycine max
tattaaaggtgtgcactacaaaacgaaggatagtcaagaattatcagcttgtgcaccccttaccgttgtttgtgatggctgtttctcaaacttgcgccgatctctttgtaatcctaaggtgattaacttttcagcttattaagcttaaatacacgatttagtttccggagtcaaataaaattggtttctctctatatgaagtaacagacacccttacaatgaatcagcattttgctattattcttggaagtttcctctcatctcccggttaaatgttcttgttagtcatgcctgtacagatgagtagtctagaattcctgattactggtattttatattgctttgcttacaggtagatgttccctctcatttcgttggcttaattttggagagttgtgaacttccttatgctaatcatggccatgtcatactgggagatccttcgccagttctgttctatcggataagtagttcagaaattcgttgtctggttgatgttcctggtcagaaggttccatctatttcgaatggtgaaatgacaaattatttgaagacagtggtagctccacaggtatcctatttatgccaaaggttctacaaattgtttttaaaccttgagacgcaatttatttcaatctcaaagagagcagtactttatttttccatctcagttaatagtgtcataatgataaggggaaaattaatgcagattccacctgagcttcatgac

SEQ ID NO: 2277 - DNA, 386 bp, Glycine max
cgcaattttttagataaatctctaaaggaattagaaagtctagtatactgcgatgtgtgatttgataaaaatttttattgtacagattccgaatgagaaactgtcattccatttaatttaattgggatgccctgaatctgacatgtctcttggaatgagtaacatgaaactcagaattatggatgtattgaatactccctaataaaaagggaattggtctatggtcaattcagtaacaaaaaatatgaaattataaatataaatttctaactgtacgtacctcgtgaaaaaaaaaaatattttttcttgtagaattagcgattccatcttttttaaaaagaactgaaattatgttcaaataagcaaatatatcggggttgcaaaag

SEQ ID NO: 2278 - DNA, 367 bp, Glycine max
attgaagatcgtaaaacaccggctttggttgaagcattaaaggatagacatgtgaaatatattgcatgtggttcaaattactctgctgccatatgccttcataagtgggtatctggtgctgagcagtctcaggatagacatgtgaactaaaactatgttttggttttgcctatctcttatgctattaaaattattctagaatccacctacagtttttttattcaaaaataagtgttggaactctaagatatgatatcaagtttatttatgtaatttgtttggtgacctattgtgaaaaatttctctattatttactctcttggatttttcaaaaaaatttgatatcagagtcaatgatttgacttag

SEQ ID NO: 2279 - DNA, 407 bp, Glycine max
gctaaaaattttcaacgctgatctcagcgacccagagagttttggtccagcagttgagggttgtgttggaattttccacactgccaccccaattgattttgcagtgaacgagccagaggaagtggtgaccaaaagagccattgatggagcactaggcatattgaaagcaggcctaaaagcaaagactgtgaagagggttgtttacacttctagcgcctccaccgtttccttcagcagccttgaagaaaaagatgtggtggatgagagtgtttggagtgatgtggatttgcttaggagtgtgaagccttttagttggtcctatgctgtttcaaaggtgttgtcagagaaggcagtgcttgaatttggagaacagaatggattggaagttaacatctctcttgcgtcct

SEQ ID NO: 2280 - DNA, 589 bp, Glycine max
gagcacttgaagttttaggtttctacaatcccgtcgcaggcaaggatgatgacaaaagaatgagcctcaaactggagagaatcaagtaagtatgtaatttccatatatttgtttaactcaaagattggaattatattacccatgtgaaatgtttctttatgaatttaataataggacactagaactttgattcccccttgtgttgtttaggtattggctttccgttggagctaagccttcagagcctgttgagcatcttctatttagagcaggtttaggacaatctcatcaattccctgttgctgctctaaatggacatatcctcaaccaagaccaaccaaccattgctgctgatcacaatggtgaactcgactctcccttctccttctgtgctattctcccatttctttctcttatttcttttaacctttattctaggtatatctccagaagctatattttctattgccctacaagtttgaagataatagctaccatacatttggagaaggtgggtggttgcaccctcttctgttcaataccacctagaaataaattgataggttatcttgctgtcgacaaactggta

SEQ ID NO: 2281 - DNA, 1179 bp, Glycine max
  misc_feature (56)..(58): n is a, c, g, or t
  misc_feature (1123)..(1126): n is a, c, g, or t
  misc_feature (1172)..(1173): n is a, c, g, or t
gctccttcttggtcatgttggcatttgcagggaggatggagttgttttagattttnnngatcatatcttgtgaatgttgatgattttgcatttggtccagtggcaagatacttgcaactcgatcatagacaggtactgtttctcagattcactatctaaatctcttgttgccttctttcttacagattgttctcattcatgctagcataccattcacaaatgcatgcatgctttgcaatttgcaaaacagttttataccaaattcaactaactttagtttttggttggtgacgggattttaagggactacagaacttttatggccaaaatgtagtcaagtgtgaaactataaggtgaaacattgatgtattgggaaaacaccataactaactgtgatgttgacgattatgtccttgttggaaataggttgcatttgcacctacagggctctcaagtcaaaacctacaagtcatgtcccccatttgtatcttagaggtttcaccttgagatatataaatcttttagtttaaataagaaattccttaccttttacttttccatatatcaaattgaatctgttttttattttaccctttttcccctcatagggactcacttatatttgaaattgccttttcttaatagatagatctcttaaaatgctaattcaaatcagcacactaagtctgctaaattcgaacagttgtgtttgttaccacccaacaatttcagattattgacaccccatttgggccctaatttaatacggtgatatgaccttgattttggaaaagtaattcagttatagatgtgttgacatttttatccatagaataatccatttgccaagctctccctttctctccaccccttaaaattttgtttggtgtcaattttaattctttaaaagtataaactcttatttgacatgctgtgtaacctgagatgttgcagtgttgcttccctcctaacctatctgcgcatacatgcaagcatggttacctgcatgctgagtatggtactgcaatcacatgggaccatgcattacagacaagtttgctgtattttgagaacaaaactcacaaccttttcacttgcaactgccactcgtttgtcgccaaannnntgaatcgactgtgttatggtggatcaatgagtggaatagggaagtnnagcttg

SEQ ID NO: 2282 - DNA, 675 bp, Glycine max
aggctgggtttaatataaaggtaacctggcttcccactttttctctttctatacattatcattgaattctccgtttttggccagagtgaaatgagtcatggatgtgatctacttagtacctttgaatattgaaatggtctactacttactaccgttctaatcatttgcttcaaattgcttgcatttgtgaattttgtttcaacctgcatggtctccctctccccctctctttcgtggaagaaactgagatccttatatggttctaatatttttcttgcttctaacttaccatgtattctgttattcgacatctgtacaggccctatttcgaaaaattgctgcagcattacctggaatggaaacactatcttctgcaaaacaagaagacatggttgatgtaaacttaaagtctacaactggcagtgcgcagtctcaacctcagccaagtggatgtgcttgttaagtatactttatcatgtgcggtccacctttttgtgtcattccttttgttttatgcagatttttctagtcttctacatcattatatgaaaagatgaaagaatatataagcgatcggggtaggggttgatacaagttgtgtctagaaaatttctgttgttagttggttttgcccgtgatactgtgtactaaagtagtaaagctgcccaaccaaag

SEQ ID NO: 2283 - DNA, 374 bp, Glycine max
cttctcttttcaatccccaactcaaatctgtgaagaaaatctcaatttctaaattgtaatttttagccctactgctagtagtagtaaaaaaaaacaattagaaagtagtagagtgtttttttttctttttttcgtttgttttacttttaagatgggtgagaagagcaacgttggcggcgacgcgattaacacgacactgcttcacgggaagtacgagctgggccggctgttaggccacggaaccttcgcgaaggtgtaccacgcgcgccacctgaaaacgggaaagagcgtggcgatgaaggtggtgggcaaagagaagggggtgaaggtaggcatgatggagcagatcaagagagagatctcagccatgaaca

SEQ ID NO: 2284 - DNA, 933 bp, Glycine max
  misc_feature (873)..(875): n is a, c, g, or t
tgctactttctatggtggtggtgatgcttctggaacaatgggtgagcttagcttctatctttgctaacaaattttcttggttttttatatgagaatcgggttgtttacagaaactattatgggatggtgtggttaattcaaaagttcttaaaattcttgtgtagccaaaaaaatgtgactaagtatcttcaaagaaaattattgagtattaaaaactattacaaatatgaaacactgacaaattaagacttttattcaatattattgtgtcttcaatttcctacacatatattggtcttgactatcttagtaaatatctttaagggaaaaatttaagtaattttgatattgttttctaatttgaattggagttttacccgtataattcacataataaaggtttgcattacaagttagcataagttaccaatatcaaactttaattcaagttagagaaccgatgaggtttaaatcagttggttgaggagtttgcccgagttgttgtaaactttctggtagctaactattaagtacgattcctacggaaaaagaaacaaacaaatctagtttgagagtaacacaataaaacatttaaagaattgtatctaagttttgttctattttctaagtttgcatatggtaaaggtttactatacccttttgtttggtacatgcaggaggtgcatgtggctatgggaatttgtacagtcagggatatggaaccaacactgcagctctaagcactgctttgttcaacaatggcttgagttgtggggcatgttatgcaatgaagtgtgatgatgacccaagatggtgcaagcctggcaccataattgtcactgctacaaacttctgtcctccaaactttgcttnnnccaacaataatggtggttggtgcaaccctcctctgcaacacttgataggcagaaccag

SEQ ID NO: 2285 - DNA, 395 bp, Glycine max
  misc_feature (325)..(330): n is a, c, g, or t
cattcacacactcaatgaagggagttacagtgaaagttgaagaaacaatggcgtatgctaatgctgcttcaactagcccaacaacatcttcaaacctctccccgcaacccatggaagggttgcacgaggtgggtccccctccgtttctcaccaaaaccttcgacgtggtggaagacccatccaccaacgacatcgtttcgtggagcagatcccgcaacagtttcgtcgtttgggactctcacaagttctctaccaccatcctgcctcgctacttcaagcacaacaatttctccagcttcgtacgacaactcaacacctacggttnnnnnntagtgaggctctgactagaatagtgcattgaaacttatgaaatggaaaatgaagactggagaata

SEQ ID NO: 2286 - DNA, 640 bp, Glycine max
  misc_feature (634)..(635): n is a, c, g, or t
ggaaggccgtacaaggcatcaaagatcatcaaggatggaccccagaaaaattcttctcctgattgctattatgtatagctcttgcttctcttcattatatattatataataaaatagtaatccaaaccaaagtagtaagtgagatttgagcaattgaagttatgtttgaatcactggtggttcctaatgaggaaagatgtttagggtaaacaactgggttagtagtatataggtaacttgtagacagttttaaggaaagttaatattgttgctctcattcctctgccgtgtattattataaactcagttattatgatccatttgcagggcttgcatggcaactatgggtatactgtattacagactagcacaacggggtccaggggatgagcttcgtaatgatgaataaatttgcatgccatggagtgagtgctcttaaagtttggagatgttcagcggctcctattttcaatattgctggttactgttgcttcttatatctgtttggcttctttatttggaccagtcgcagtcttggcaaacatacaagttgtagtttgttgataatttttcatctggaatgcctatgacagtgacatgttacataaaatcctagtcagccatctttgctctnnaaaaa

SEQ ID NO: 2287 - DNA, 407 bp, Glycine max
cagtggacttggccaacaacaccttcacgggggtgcagatctcgaggccactcgaggcgcgtgagggaagcagcaacagcaacctcgtcgcgctcaacctcgggtttaacagaatccgaggctacgcgcccgcgaatctcggcgcgtatcccgcgctgtcgttcctgtcgattcgctacaacgcgctgcgtggcgcaatcccgctggagtacgggcagatcaagtccatgaagaggctgttcctcgacggcaactttttcgtcggaaagccgccagcggggctaatggaggccggcacggcggtttccggcagcttgggggacaattgtctgcatgcgtgtccagggtcgtcgcagctgtgctcgcccgcacagaaacctagctctgtttgcaagactgtttgcaag

SEQ ID NO: 2288 - DNA, 372 bp, Glycine max
catgaaggatccagtgacggtctcaacgggcatcacctacgaccgtgaaagcatcgaaacctggctgttctcgaagaaaaacacgacatgccccattaccaaactgcccttgatagattacaccgatctcacaccaaaccacacccttcggagactcatccaagcgtggtgttccatgaacgcttctcacggcatcgaaaggatcccaacccctaaaccccccgttaacaagaaccaaatttcgaagcttctcaaagacgcttctcattcccctctcacatgcctcagaagactcaaatccatctcttccggaagcgaaacaaataagcggtgcatggaggcttctggcgctgttgagtttctagcataaat

SEQ ID NO: 2289 - DNA, 393 bp, Glycine max
tctctctcagccattcagacaataacagaaaaccaaacttaggctaagccttttaagttttgattgatcttccaagtgccacgagaaaggagaaaggcattttactttagagaggtgcaattaccatcctgcataattgctgtttggacaagtgaagaatgagcaaaccttgtgaatggtttttctaattacctctggcttaagtagctctagtatacaaacaaaatatagccttttttaggtcctaatttatataacacagtgcccagtgtacaattacacagttgctccactgcctttatattgaattatgcaccatcagtaatatactttggacttctcgttgagcattagcttacagcattaaatattgttgaccttgttcatgtcgca

SEQ ID NO: 2290 - DNA, 433 bp, Glycine max
tccgaacaccacggcggaaaccatcgctttcccggggaagaaatcaacggcttcggcaatggccaagcggaaatgtccgctccttccacggcctcctcgtcggcggtgcgctgcatcgtcgactcaattccgtcgaaggagcgggagaagctccggagaatcctcgtcgcctcggcgaagggtttctcaatcggagccggcctcaagggaggcctcgctctcttcgcgatcttggcgcgattgacgcgcaaaaagccgccaaggtaagaaaaaaatataaaaaaattaaaatggctttgttttaagtgctttatctcgtttactataactggcgtgattcgttcgtttaggaagggaattgtggtttcgaacggcgaagcgattgtggcggctctgaaggaaacgctgagatacggtttgtttctcggaacct

SEQ ID NO: 2291 - DNA, 665 bp, Glycine max
tactacgttcttcatttatgatcctcatcaatcaaaacctaaagtcccaggctatcaaatggactggaatgcaggatttgcttgtaagacaatgcttcctttaaccattgataaaaatattttctatgcatttccataacttgctctcttttgtttttttggcttatatgaacattgaagatgcaaagaatggagtgcctattggtcctagagtaagtttaaacttagtcacagatattcattatatatagatacaagtgcaacaaccatgcattgactaatttgtaagttcaatttttacaggctaattcttattggctttacaatgtaccatggggcatgtacaaatcattgatatacataaaggaacgttatggaaacccaactgttatcttatctgaaaatggtaacgttatatatcaatttcttgctttgttctttttttggcttggtgacattagtgttctgttgtttcaatgtcatgtgacatattttatggcatgtaggcatggatgatccgggtaatgtgactcttcccaagggtttgcatgacaccacaaggataaactattacaaaggctatttgactcaactaaagaaagcagttgatgatggagcaaatgtggttgggtactttgcatggtcattgctggataactttgaat

SEQ ID NO: 2292 - DNA, 350 bp, Glycine max
accttcattaactaaggatggtggagttaagaagggactgtttaaggttttttgtgatcatcaccgcgaactcgaggccgagcttaagaagatggcaccccccaatggaagggctgttcttgtcctcagaggaaggtgtggctgttctgttggtaggttggaggttccgggaccgaagaagaatcgaaagaccaagaagtaggatacagaaaagaagaaacaaaaagtcttataggaaggagaggatattggatacagaatgcagtcttaaattggtagagtagttgcttatagttatatggtcatattttatttaaaattaggttgtctttcgaataaatccctccaac

SEQ ID NO: 2293 - DNA, 529 bp, Glycine max
aatcatcctcatcttgtcgttccagctttgcgcaaatcacttaagtaagcaacttcatttaaccccactttctttatcgccaaatcttacttattactcacttcatcaactttttggcatgcagaactcttcaacttgagtacttggacttatatctcatccactggcccctcagttctcagccagggaagttctcctttcctattgaggtagaggatctcttgcctttcgatgtgaagggtgtgtgggaatccatggaagagtgccagaaacttggcctcaccaaagccattggagtcagcaacttctctgtcaagaagcttcagaatctgctctctgttgctaccatccgtcccgtggtcgatcaagtaagtctctctctgttgtattttgttttgtttatgtgaatgattaatgataagatgaattactactgttacaggtggagatgaaccttgcatggcaacagaagaagctaagagagttctgcaaagaaaatgggataatagtgactgcgttctctccactg

SEQ ID NO: 2294 - DNA, 784 bp, Glycine max
  misc_feature (773)..(778): n is a, c, g, or t
  misc_feature (780)..(780): n is a, c, g, or t
gatcttaaacaagaggttttatttttattattttattctcccttgcaaattatacctaattatgcttattattgtttatgttttactgttgatacaatttttttgttctgctatgcgaatttcatggttgttatggtgtagaatgtgaactccttgactatacttgtgatgggaaaaggaggtgttggaaaatcttcaactgtgaactccatcattggggaaagagtggtttcgattagtcctttccaggtttgagatgatactttcctgtgatggtctatagggtggttattgtgttgttgttcgattattatgttttatgtctgaatgaattttttcttatgttgcaaagtcggaagggccaagacctgtgatggtgtcacgatcaagggctggttttacattgaacattattgacactcctggtctcattgaaggggggtacatcaatgatatggcacttgatataataaaacggtacatgcttaattgcttatgtttagcatgtaacacttcacctgtaaagcatgtatttggtcttaaaagtgatttactgtgtctgtcctttctacttaccccttttcccccccttgttttgtgggaatatgtgtttgtttgagtagtttccttctgaacaagaccatagatgtgctgctttacgtggatcgcttggatgtgtacagagtggacaacttggataagttagtcgccaaagctataacagatagttttggcaaaggaatatggaacaaggccattgtaacactcacacnnnnnncngttc

SEQ ID NO: 2295 - DNA, 414 bp, Glycine max
ttggctgagatgagcattgatggggacaatgggaaaaagatactcttcaagacccctatggggcttggtaagtcctatcctgccacagcctttatgaccatagaggagaaggaaaagaacctgcagcttcagggtaaggaagagatcaaagatatatgattatttaatcacaagttcatttggattgagggtctagaaccatgtacttgataatttgtttttgatttttgaataatagatgaatctgctgagaatttgattataaaaaagtatagaatcggctagctagactggaatgtgtgttccctatatatgcaatgttgatttgatgatgatgataataatatgtattgaaagatatatgacccaaatttcagatgagaaaatcctagaaactaacagcttgtgcttgat

SEQ ID NO: 2296 - DNA, 703 bp, Glycine max
aaagaaatcatctgggaatcttgattaaatttactattcaattatgatcctgccctctgcctgtctgtttttgcttgtgctattgactatcacaaaaaaacacatttttattgttgaaatctttttttccccacttcctgccctttctgtgcaggtcttccctcccaatgaaaagattgaaagcattaatgatcaatactggacactacgagcagaggaggtaggaatctctttctgtatgtggggctagatcaagggagatagcatttagtgtaatgttgtattcttgcttttatttgttcaaatgatgataacactgcccgactcttgtaaatatataattatgttctatttttgttcaattcctcacaaaataattgttattcttacatggtcatattcaaatgtaacagattccagaagaagagaaaaatcttggttctcatgatcgtctaattcatgtttaccatttcaataaagagacagctcaaaaccaaatggtaattagtttttaattcttgtttttagtgaagttttaaaatttttgatgtctttgatattttatgctgatattaattgttttacaaaagtatttattttgtttttccttgaaaatttacagcaaattcaaaactttggggaacctttttttctggttatacatgaaggtgaaactcttgacgaaattaaagtgcgaatacaa

SEQ ID NO: 2297 - DNA, 935 bp, Glycine max
ctctctcaaactcgcaaagcgaattactgaaaccctagcctctgtttctgtgtttatttacttttattctacgcatcgaattcaattctctgtgatctgaacccgtgaaatcaatgtgcctctttcggaatcgcagagcgagcaacggtgaccgccatcatcatcgatgaagcgatcgggtcggtggcagaggactctgatcctcgctcttctctttctctccctcgttgctccgctcgtttacgtctctcacctcctcaacactctcacttccgacggtaaataaaaactcaactccttcgcactcgcccgtgcatacgccactttccttgttctgtgtgctctctctctccgttttagttgactttttgcgtttctgttaaattgcgttgcaggacgacgagattttcttgatgatttatcgagttttgtaagaatcttgcttctgaagcctgatcagtttattttattttatttttgtttatttatttaattgcttctatagctcaacctgtttggtttccgagaaggaataccagttagatggaatagaatatagtgaaacatttctttctttctctcttttttttcaaaaattttgatttaccggtgtgttgaaaagtttgccgaccgatagcttactggaacttcttgtactttcaataattttagttttggataaaatgatttttcatgtttaattattttaactggattttgttttttttatgctccatcggctgccaattgaaattctacagcttctgatgctttattgtggatttgggatttgatttttgtttgtatcttgcagacacataggtcagatcctttaaatgcaattgaacaggtagtggaacatgtttttagtttgtcttcatcttcttctctcttcccctggtgaatgggagaattaactttttccttggtatttg

SEQ ID NO: 2298 - DNA, 355 bp, Glycine max
tctctactgagagaacatagagtctatgcttatttaggtagagctctcatgtcatctgttgcaatgaattgcattgctaagacagttggtgcttctagcactgataactttcctcaggaaagcattgataatactctagagccaagagactacattaatggtagatattgctactggtcaagtgatggacaaagtaatcccaatgtgcctgagacattaacatacgagttggtgtctcaaatttgtgttattacagaaatcaatatccagccttttcaaggtactctttgaaatcttcacaaactatgtgcatggcccatctattttatatttctattcctttttgctaacaatg

SEQ ID NO: 2299 - DNA, 329 bp, Glycine max
caaacaattggaactgaaggagaagattgtgacagaaatacttccagcaaagaggttttacaaagcagaggaataccatcaacaatatctggagaagggtggaggtcaaggcaacaaacaatccgcagaaaaaggctgcactgatcccatcaggtgctatggctgatgaatgatgatcactttcttgctgcacacttcaccatgtctagcttctatcagccatctgttgtgtactccaatataataatattatcaaaaataaaataagtcatggtgtatcttcagagtgctcatattgcaatctggactttagttgatcaacgaggttg

SEQ ID NO: 2300 - DNA, 723 bp, Glycine max
  misc_feature (26)..(26): n is a, c, g, or t
  misc_feature (286)..(288): n is a, c, g, or t
  misc_feature (290)..(310): n is a, c, g, or t
tatttgtgatgctgttactacttggntggaaacaattacgatgtgaaattattctcccataatgttatcttttttctttctttcaatcccatcatcatgcaattttttttttcttctcagtactgggagaaggccaaatttccatttcatgttattccaaagcttggtgcattgcgcattgctggtggcacaatcaaggttctctctatggatattttcctctgttgtttagatatttgtatggtctatggagttcttagctagctccgattctcaggattatggnnntnnnnnnnnnnnnnnnnnnnnngccatctcttaggtcctcctaccatcaatccccctccctaagcatcagccgaagctccgtagatcttaggaatgcatcccaaagatctctagcttctcacttgaattcaccatgttccatgggatacccatctttgtcatctcttaactcaaggtacatgtctccacacattccaagtccaagcaatgcttcagtaagctatatgggttcatccagtcatcaacaacatcctctccgttatagtgagtcggctgcaagcttctccccatttgcatcgacacactcccttccagaatgttaaattgttcaattgattatatcatatgattgagacgtccacgcagttgaactagtaattgccaagtcttgaactaaaaggtggccatgtgatgaccggtggtctagttgaatag

SEQ ID NO: 2301 - DNA, 821 bp, Glycine max
tcagttagtgtcataagctgcattagaattttttttgttttctgaattttggttattctgtttgttgaaggcagtgataatcattcattcattcgtcaatgatactagtgtataggctgggctaagaatgcctttctgaactcttacatatgaatttgccttgatggccatataattataagggtaaatattcctgaaagtgtgaggtgacgacaatttgatccctgaaagataaaaaatttcagattagttttcaaatgtataaaaagtgcaacaaattcatcttgctgttaaatttgtgagactgttttattaccaagttataataatattcaaagatcaatttgacaccaagttgtaaagtttaggtgttaatttgtctttaaattatctgcatgattaatttatcgtatttttcatatttagggactaaatttgaattttctgtcattcatgaatcattttgtcattgcctcactttcaggcactaaatttgatgtttaccctaattataattcacttaataaactggcttgatttgatatcttacaacttattgcaggcttgccattagcagatgctcccaaaaagattagtggagttcacaagcgctgttggaggtacataccaaatgtagtaaaagcattagaaagctcaacaaacttaacgagctcaacagacagtggcttaaaagttgaaactgaagcaagttgatgctttctagtgactttgggtatttaggtcatcgacattataccatgccttagagttgattttcaatcggcattgttgttttcgactatggttgcattttttagtcg

SEQ ID NO: 2302 - DNA, 355 bp, Glycine max
tcaacagatacaaaagacaagttaataccggaggcatctattgaccaatctgagcagttagctttacttggtgaaaagggagttggaaatgaagctgaaaaaaagcagcaatagcgcaagttttgtaccatgtctctcccaagccttgttggttttatcgaaaaggttgggtaaattgtgccgcaacagtcaaaagagaaaggatcattattttgatgatttttcggtagttttctgccaatattcttttcattatttatctttcatttccttcgacagcatttgagggaagaggggggttatatatatatatatatttcttatctggaggaaaagtggtaccgggctttttttt

SEQ ID NO: 2303 - DNA, 370 bp, Glycine max
actccgttgatttgaatgggatacaaattcatgtgtaatctccgttgatttgaatgagcatcatcgatagaaggtagttgctttgttgcagacaaaaaaaactgaataatttctgcatgagaattgttgtggcaacttgtgttgtaataatagttccttggtcttgttccacaatgactgtgattataagaaactcacctctagtgactctagttgcagactagataaagaaattagtaatcaattattttttttatatttcacttcctttatataacttttagtgcaataactatgtaaactcacgccactattttaaccttgacgagtgttgaatgctaaaaaaaaaccttgacgagtgttgaatgct

SEQ ID NO: 2304 - DNA, 513 bp, Glycine max
  misc_feature (225)..(227): n is a, c, g, or t
ccctgcctgacctatccgccgacctgtgctaactgcagaaccttctatatgttcaagagtgttaaaacctaatgataagttcattatctttgcatctgatggactctgggaacacttgacaaaccaggaagctgctgagattgttcataccaatccacgaaccgtatgatgcttttcccacttgtcttttttccttcgatcatctttgcccttggatatgaaaannnattaagtttttcttattgcttggtgttaatataaatgctaataacactctttaacacgctcttttgaacatcatggtattgcaggattacttcttaaagcagctttaaacgaggcagctaggaaaagggaaatgaaatataaagaccttcataagattggaaaggggattaggcgtttcttccatgatgatatcactgggcctgttgtcttcattgaccacgagttgcgcggcaagaatgtcacagttcctgatttgtccatcaaagggtttattgacacagttgg

SEQ ID NO: 2305 - DNA, 1011 bp, Glycine max
  misc_feature (924)..(929): n is a, c, g, or t
  misc_feature (959)..(964): n is a, c, g, or t
gtctgaacgctcctcctctttccgttctctctctctgtggcacttgatttcgtcaaaaggtacgcgtgcttcggcgtcatagtcataagatgtttccaatttgctatcactgtattaatattatgtaccgaaaatcatgtttatgcacccaatttcaaaatcactagtttttttttcctttccctcctcaattactaaaatattagttactgctattgttactgttcaaactctggaggtttccttgatttcaatttgattttgaagactaacagatttattggatcatctccgactcccttttcaattatttttggggaattttattttgttttaattgtctcgccagtgatgtgaggttggtacgatatccgtgatgagggtaaaatatcgtttttttttctcgtcatatacaagtttttcccctcttcctgcagattctactgttttgaatttcttgtgtgttcgtcactatcgatattctattgttttagatcgattgcgaagtttgttttctgtctttaagtgggtcactttagtgtccccttaaaattagaaaagaccgattgtacttgcccctttttcaattctctaacttaattttggccgtgttcattttttttgtggggtgctttgatttgttttttggaattttgtttagcttcagctagattactggttgagtgacagtgagtaacatgcttttgactgttatgttattgatcgttgcaattgatggtgtgccttttttggttactgttccaggcaaagggatgtgttcccgagtgaatgatgttggtttgtatttgctgatgcaattggtggttatgttggtttaagaagctaagaactgttgctactacttcacaatgggtgctgcttgttgtgttgctgccagagacaaaactatacaaagtggatcannnnnntgacaatttgcatcggaatgctcgatgttnnnnnnacatggagctttcggtgggatcatcgggggcgtgtagctggtgaaga

SEQ ID NO: 2306 - DNA, 370 bp, Glycine max
atttacagctacggagtggtgttgatggagatcctaagtggaaaacgttcggttgatgcagaatttggcgatgggaacagcgttgttgattgggttaggtctaagataaagtctaaagatggcattgatgacatattggacaagaatgcaggggcagggtgcacctcagtgagagaagagatgatacaaatgcttagaattgcattgctttgcaccagtagaaacccagcggataggccttctatgagggatgttgtgttgatgctgcaagaggccaagccaaagaggaaattgcttgatggtgttctaggtcgatgtgctggggacaatgtggttgttggtggtgacattcctttgccacaaaagccaa

SEQ ID NO: 2307 - DNA, 581 bp, Glycine max
gttttttatttttaccaacaaaaaagagatttgaacccacgatctcttccttcttcattcaccttttcctgggtcaaccttatatcttctattaaatcaacttactagtaacatgaaatagtaaattttcaaattgttaattaggtgattttgttttatttacttctttacctaatgaatcatatggtgtagggagctgggcacaccgtgccggaatataagccgcgggaggcgttggatttttacagccgttggttggaagggaagctaatataaggaaatgcatcatgtggcgtaaaataaaacatacatgatcgattattaatgaatacaagttacagcagtgtattttagctttttcgttagtgatttatcctttacattaaatcatatatgcatgggatttcgcaaaaaggaaagaaaaagaaatcatatgtaagggattattattatttaactgtaatttgattgatatatcaatcctttcgaagagaggatgttggaagcttgtaatatgataagcataagcctttcgtttttgtaagtgcgggccagtcagccaggcattctagcaccttata

SEQ ID NO: 2308 - DNA, 411 bp, Glycine max
ctaatgtacaaagatcataacacactacataaaacccaacaaaagcagcaagaaaaatgagcactgcaaaaccagatatccagaaaggaccctccaacgtgtagcatgagaagtaggagagggagctgaagttgtagtagtagttgccttttcctgagagcaagcataactgcagcgacttggacgaacagctcggtatacaccggtgctcgcaaggatgtaaatgtctttgttgttgtcttcgccaaatgagaagatgtagcctaaagcaggaaggtttccaggtgcagagtcgcactgtatgggagaatcacgtgcacagctgaagggaattctgctggtgctgaaattgccactattttgcggatcttctgtggctgcccatattgctccagcgtatagatctccata

SEQ ID NO: 2309 - DNA, 1405 bp, Glycine max
  misc_feature (658)..(660): n is a, c, g, or t
  misc_feature (726)..(727): n is a, c, g, or t
  misc_feature (729)..(729): n is a, c, g, or t
  misc_feature (733)..(733): n is a, c, g, or t
  misc_feature (741)..(743): n is a, c, g, or t
  misc_feature (756)..(758): n is a, c, g, or t
  misc_feature (760)..(760): n is a, c, g, or t
  misc_feature (762)..(764): n is a, c, g, or t
  misc_feature (768)..(768): n is a, c, g, or t
  misc_feature (770)..(804): n is a, c, g, or t
  misc_feature (806)..(822): n is a, c, g, or t
  misc_feature (824)..(824): n is a, c, g, or t
  misc_feature (828)..(828): n is a, c, g, or t
  misc_feature (830)..(830): n is a, c, g, or t
  misc_feature (833)..(840): n is a, c, g, or t
  misc_feature (842)..(842): n is a, c, g, or t
  misc_feature (847)..(849): n is a, c, g, or t
  misc_feature (856)..(863): n is a, c, g, or t
  misc_feature (866)..(869): n is a, c, g, or t
  misc_feature (873)..(886): n is a, c, g, or t
  misc_feature (888)..(895): n is a, c, g, or t
  misc_feature (897)..(904): n is a, c, g, or t
  misc_feature (912)..(924): n is a, c, g, or t
  misc_feature (926)..(968): n is a, c, g, or t
  misc_feature (970)..(974): n is a, c, g, or t
  misc_feature (977)..(981): n is a, c, g, or t
  misc_feature (984)..(989): n is a, c, g, or t
  misc_feature (991)..(995): n is a, c, g, or t
  misc_feature (998)..(1022): n is a, c, g, or t
  misc_feature (1025)..(1029): n is a, c, g, or t
  misc_feature (1033)..(1039): n is a, c, g, or t
  misc_feature (1042)..(1058): n is a, c, g, or t
  misc_feature (1063)..(1066): n is a, c, g, or t
  misc_feature (1069)..(1070): n is a, c, g, or t
  misc_feature (1072)..(1087): n is a, c, g, or t
  misc_feature (1090)..(1095): n is a, c, g, or t
  misc_feature (1099)..(1105): n is a, c, g, or t
  misc_feature (1107)..(1133): n is a, c, g, or t
  misc_feature (1136)..(1137): n is a, c, g, or t
  misc_feature (1139)..(1142): n is a, c, g, or t
  misc_feature (1145)..(1149): n is a, c, g, or t
  misc_feature (1153)..(1162): n is a, c, g, or t
  misc_feature (1167)..(1172): n is a, c, g, or t
  misc_feature (1175)..(1175): n is a, c, g, or t
  misc_feature (1177)..(1179): n is a, c, g, or t
  misc_feature (1187)..(1200): n is a, c, g, or t
  misc_feature (1202)..(1206): n is a, c, g, or t
  misc_feature (1213)..(1214): n is a, c, g, or t
  misc_feature (1216)..(1231): n is a, c, g, or t
  misc_feature (1234)..(1238): n is a, c, g, or t
  misc_feature (1240)..(1243): n is a, c, g, or t
  misc_feature (1246)..(1249): n is a, c, g, or t
  misc_feature (1251)..(1253): n is a, c, g, or t
  misc_feature (1257)..(1263): n is a, c, g, or t
  misc_feature (1267)..(1273): n is a, c, g, or t
  misc_feature (1275)..(1277): n is a, c, g, or t
  misc_feature (1280)..(1298): n is a, c, g, or t
  misc_feature (1300)..(1305): n is a, c, g, or t
  misc_feature (1310)..(1313): n is a, c, g, or t
  misc_feature (1320)..(1321): n is a, c, g, or t
  misc_feature (1324)..(1329): n is a, c, g, or t
  misc_feature (1331)..(1354): n is a, c, g, or t
  misc_feature (1356)..(1363): n is a, c, g, or t
  misc_feature (1367)..(1370): n is a, c, g, or t
  misc_feature (1373)..(1373): n is a, c, g, or t
  misc_feature (1377)..(1377): n is a, c, g, or t
  misc_feature (1379)..(1387): n is a, c, g, or t
  misc_feature (1389)..(1389): n is a, c, g, or t
  misc_feature (1392)..(1401): n is a, c, g, or t
tgctgctgatcctcagagcaatcttttatttgggattaacattgacccctcttctcttatgctgcaaaatggcatgtcaaacctgagaaatataggcaatgtgaacaattcattatcgttgccattttctgcttcaaattgtggtggtgcttcaggcactgatttccccttaagttcaaacatgacaacttcgagttgtgtggatgaatcaggtttcttgcagtcttctgaaaatgtagaccaagcaaatacaccaactggaacctttgttaaggtaatatctaatgccttttgtttataggtggtatgcctttatttatatattttatgtggagccacttttgagtatcatttacctaaattaagcaacagtttattagttaaagtataggttcaaggcacaagttaaatatatttatcttcaatgttgaattggttctattttgtacagggatatttgggaccctatttttatataaacagcatattgcagctactttttatttttgtttcctcttttttgtaggactactattttttccaattagtaagtggatgctgtctactgtctaggactattactattactattactctaattttatacggtgatggatgtggtgtaattttgacaggttcacaagtcagggtcctttgnnnggtcactggacatttccaagttcagcagctatgatgagctcattagtgagcttgctcgcatgtttnncnttgnaggccaannngaggaccctaagnnncnannntcangnnnnnnnnnnnnnnnnnnnnnnnnnnnnnnnnnnnannnnnnnnnnnnnnnnntnccanancannnnnnnnanacacnnnactcaannnnnnnnttnnnntcannnnnnnnnnnnnnannnnnnnnannnnnnnncccacccnnnnnnnnnnnnncnnnnnnnnnnnnnnnnnnnnnnnnnnnnnnnnnnnnnnnnnnncnnnnnttnnnnnctnnnnnncnnnnncannnnnnnnnnnnnnnnnnnnnnnnnctnnnnncacnnnnnnnccnnnnnnnnnnnnnnnnntcccnnnntcnncnnnnnnnnnnnnnnnnacnnnnnntcannnnnnnannnnnnnnnnnnnnnnnnnnnnnnnnnaanncnnnntannnnncaannnnnnnnnntattnnnnnnttntnnnccttcctnnnnnnnnnnnnnntnnnnnccttctnncnnnnnnnnnnnnnnnnacnnnnnannnnacnnnncnnnacannnnnnnaacnnnnnnncnnnccnnnnnnnnnnnnnnnnnnnannnnnntaccnnnntccacanntcnnnnnnannnnnnnnnnnnnnnnnnnnnnnnannnnnnnnttannnntcnccantnnnnnnnnntnacnnnnnnnnnncacc

SEQ ID NO: 2310 - DNA, 549 bp, Glycine max
tgggttcggttgccgcagaagaactgaacttagatttaagatcctccttcgtccccaaaaccatcaccgatttcctccgccacctctccgccaacaacaaccaccctgccaccctccgcgatttcctctcccgcctcgaagacgagctccgcaagatccacgccttcaaacgcgaactccccctctccatgctcctcttaaacgacggtgcgtttcgcctccgcgattattttattttctgagacaaaactaaacattagaacactcctaggacagatttgtttatctgtattcgcaaacatcttcacacgccatctaaacgtcgtcgtttttctctttgttgcagcaatttccgttctgaaggttgaatcgcagaaatgctgcagggtggcgcgcgattcgccgccggtgctggaggagttcattccgttgaagaaggagcttggtgatcagagcgaggaggaggaggaggagaatgatgatgacaaggacgataacgaatgcagggataagaggaattggatgagttccgttcagctctggaataac

SEQ ID NO: 2311 - DNA, 398 bp, Glycine max
gatgtaaagatttgggatttgcgtaaaggtgaagttaccatgacactacaaggtcatcaagatatgattactgctatgcaattgagtcctgatgggtcctaccttcttacaaatggcatggattgcaagctttgcatttgggatatgcgtccgtatgctccacaaaatcggtgtgtgaaggtgttggaagggcaccaacacaactttgaaaagaacttgttgaagtgtggttggtctcctgatggaagcaaggtaacagctggtagttctgatcgaatggtttacatctgggataccacttctcgccgcatcttgtataagcttcccggtcacaatggatctgttaatgagtgtgtttttcatcccaatgagcctattattggatcttgcagcagtga

SEQ ID NO: 2312 - DNA, 450 bp, Glycine max
  misc_feature (368)..(368): n is a, c, g, or t
  misc_feature (370)..(370): n is a, c, g, or t
  misc_feature (372)..(378): n is a, c, g, or t
  misc_feature (385)..(389): n is a, c, g, or t
  misc_feature (397)..(404): n is a, c, g, or t
  misc_feature (417)..(421): n is a, c, g, or t
  misc_feature (423)..(423): n is a, c, g, or t
  misc_feature (427)..(428): n is a, c, g, or t
  misc_feature (430)..(434): n is a, c, g, or t
  misc_feature (436)..(438): n is a, c, g, or t
cgttggagttgtggaggccttaaaagaccaaggtatatgtaggtggaatcatgctttaagatcagctcaacaccatctcaaaaaccatgttggttcattctctcaggctaacaagctttcttcttctgctatgagctccacaacactaaaacatgggaagacaaatcagtcagaggagtcattaaggactgtcatgtacttgagctgttggggtcccaattagatgccataaggccaataaaaaaaattgattctttctctttcaatttctagaaatgaaacttagtctcaaaggatgatgatggttgagatttctggggtcatactgtatagtattgaaagattgcttgcctgatgtgacaaaaaangncnnnnnnncgaatannnnncctgcttnnnnnnnntcgtattgacacnnnnntnaacnnannnnngnnngtcgagtatcag

SEQ ID NO: 2313 - DNA, 395 bp, Glycine max
aagcatgggaagtttggcaagggtatgttcaagaagtggaagtgatgatattatattaattttctgtacatacaaaccgcgattctggatgctgctgcacattgcttttataataaactctactttgtttgatgtccatctatattttggtggaactctagtatttttttttatagtcaaagatgtatcatcccgttcatattctattattctagaaagtgcttattctagaaagtgaacgtcaaatagatgatgctctggatattatgtgcgagcttgcagttgctttagaaaagcattgacttgttcatgccttttctgtttttttgctttgtataccatttttagttttaacctttgttggctttcttagacagaacggagtcatcacattc

SEQ ID NO: 2314 - DNA, 633 bp, Glycine max
ggtgagtctgtttctcattatttctgtgtttatgaagagtaggtgaaagtttaagggaaatgatgcttcttttttgcttgttattcatcatgtctccctcatccatgttgctttctgacagccagagtaacatcttatgagttttggcagcatggtaatgaggtttaaatttgtgtagtttgatttggcaacacatttcatgctttctaatgttgaatgtagattgtcgcaattaaacaacttgaccgaaatggactacaagggaatagagaattccttgttgaagtgttgatgttaagtcttcttcaccaccctaaccttgtcaacctgattggttattgtgctgatggggatcaaaggcttctagtttatgaatttatgtctttaggatccttggaagaccacttacatggtatttgtattacagatttgcatgctatctcttttcaattctttatgtattgtcttctaatagtggtaattaatgtttaatatgcagatatttctcctggcaagaaagaacttgactggaacacaaggatgaaaatagctgctggggctgcaagaggattggaatatttgcatgacaaagctaatcctcctgtcatataccgagatttaaagtgctccaac

SEQ ID NO: 2315 - DNA, 383 bp, Glycine max
ggctgtattgcatcacataaggaggaaaagtacatagtatatcataaaagatgcttttagcaggtgaactcattttatgaggattacttgaaaatggtttcctgtgtcatgtgtatttctacttggataggtgttatattttacaggtgttaatgttagaatgggattttgtgacattcgactcttcttccaagccccttccccaaatccaaacaagattttttttttcatgtttcttcgaatactgtaatatcttttgtatatagtgtctgatacaggttatctgtgttgtttatacttgttgaaacagtacactcattagctatcataaattcaaatcctgtgtatttacatatctgcagtttgcataattgccagctttc

SEQ ID NO: 2316 - DNA, 369 bp, Glycine max
caatatataaactttattacaaaataagaaaccataaaggctaacatgaacttgtaaagtaaaacgatatccatattacacaagataaaaacctaaataacacactcttagaataagtcttggacataatattcttaactaaataaactgacacacaaaccaaattaactatatcatgctcaaggcttcattcgcccctcattggccatcttgaagaggttggcttgcgcttctgctgccttatttgaggcaagagatgctataaatctgtctctgacttgctgggttgtataagggaacctgttgttcaccaaggagttaagaaaggaagctgtcccttctctgtagagtgctcctagcccatcagtc

SEQ ID NO: 2317 - DNA, 316 bp, Glycine max
aacagatttcttagattcaagcatgaagttccctgcttcagtttcaccaggacaaaacattcttggttcactttgtcctgaagggagtggtaatctcttgaatttatccagaagtggtcagtccatgctgactgaacagttacctcaacaatcatgggccccaaaattcacaccgttgcaggttaatgcttttggcaactcaatgcaacatgtgcagtattctggaaaagataccgcaatggtgccaccacattgtaactcggacacccaaaatcctattctatttggggtcaacatcgattcatctggtcttcta

SEQ ID NO: 2318 - DNA, 361 bp, Glycine max
gttgggtctctctcactcacaggcacagcaacagcaccatggaaggcgcaacgatgttactgttgtcgccaatatcgagctgcaacgtgcgcagtaagcatttaaactactcactcagaaggcgtagctgttattcttctcccagggcactgaaaatagtgagcatggcgaaggagggaagcgacaccggcaacggcgtggtagaaaaagcagccatagcgggtggattgatctcaaccccagtaattgcttggtctctctatactctcaaaacaacagggtgcggtcttcccccaggaccaggtgggtcaattggagcattggagggtgtgagctacctcgtggtagtgggcatagtggg

SEQ ID NO: 2319 - DNA, 685 bp, Glycine max
catcgggtttgagattcacgctcttttttattactctggcctaacggaaaagcctccacatctacatatataaatactaccaaaaattcagttgcacactctgctatttccaccaccataacctcgctctcttcaccctcttcttcttcttcttcttcttcactttgtaactttcgaatcttcttccttccaccgcaatggccaccgccacgcttagccccgccgacgccgacaagctctccaacctcaaatcctccgtcgctgcattgagccaaatcaggtcctcactctttctcttttccgattttccgcatctcttatctcatttgcatttctcgcaatctcgaatccgaacctcatcgctgttgttgttgttatttgcagtgagaatgagaagaatggattcacaagcctcgttgctcgttacctcaggtgcgtcaactttaaccgttttaaccgttaacgttcgttacgcttgtgattgtgattttcctttcatttatcttcagttacgtgtgttcactattaattccaccgtgttacgattttccgattattgtttattttattttattatatattttttcttattaacttttgatcctttttgaacgtgcagtggcgaagcacagcatgttgagtggagtaagatcgagacgcctacggatgaagtagtggtgcctta

SEQ ID NO: 2320 - DNA, 371 bp, Glycine max
ctgatgcagtaatggctctctctaatttatcaacacacactaacaatctcagcatcattctcgagacaaacccaatcccttacatagttgatcttctcaaaacctgtaaaaaatcctcaaaaacggctgaaaaatgctgtgctttgatagaatccttggtggattatgacgagggcagaactgccttgacatctgaggaaggcggggttcttgcagttgtggaagttctcgaaagtggcacactccaaagtagggagcatgctgttggagcactgttgacaatgtgccaaagtgaccgatgtaaataccgggaaccaattcttagagaaggtgtcattccaggacttcttgagcttactgtccaaggaaca

SEQ ID NO: 2321 - DNA, 469 bp, Glycine max
cgtgttgtgcataggtctgataactcctcaccagagagtagttctctgggtcaggaaactaatgggttactcactaggaaacctgttactactactactactcgttccgcaaaatcaaacggcggagcaacctgcacgtcatcatcatcatcttccagaggcatgcaattcaggaagctttctgggtgttatgaatgtcacatgatcattgaccctagcaggtacatgttatatactaacattttttttatcacaaattgttagttgttaatttttgttaaaaaaaattgaaatctactatctcttttcaaattttttcttgctttatcactaaaccaattactttataatcaaacaatgatatattcaggttaccaattgcgaggagcactgtgtgtgcttgctctcactgtggtgaggtcttccctaaaatggaaagtttggagcttcatcaagctggtcgtcatgc

SEQ ID NO: 2322 - DNA, 395 bp, Glycine max
tgtaaaggacttcctctggccttgaagtcaatgggaagtctattacacaacaaaccatttgcctgggaatgggaaagcgtgttgaaaagcgaaatatgggaattaaaggacagtgatattgctcctgctttagcattgagctatcaccaccttcctgcccatctcaagacatgctttgcttactgtgctttattccccaaggattatgtgtttgacaaggagtgtttaattcagttgtggatggctgaaaatttcctacactgccatcaaggcagtaagagtccagaagaagttggccagcagtacttcaatgatttactatcaaggtccttctttctacaattaagcgaaaataaagaagtatttgtcatgcatgaccttctaaatgatttggc

SEQ ID NO: 2323 - DNA, 865 bp, Glycine max
  misc_feature (432)..(434): n is a, c, g, or t
  misc_feature (436)..(438): n is a, c, g, or t
  misc_feature (440)..(445): n is a, c, g, or t
  misc_feature (478)..(478): n is a, c, g, or t
  misc_feature (480)..(484): n is a, c, g, or t
  misc_feature (489)..(491): n is a, c, g, or t
  misc_feature (494)..(499): n is a, c, g, or t
  misc_feature (515)..(518): n is a, c, g, or t
  misc_feature (536)..(558): n is a, c, g, or t
  misc_feature (571)..(577): n is a, c, g, or t
  misc_feature (579)..(580): n is a, c, g, or t
  misc_feature (584)..(585): n is a, c, g, or t
  misc_feature (589)..(594): n is a, c, g, or t
  misc_feature (597)..(604): n is a, c, g, or t
  misc_feature (606)..(623): n is a, c, g, or t
  misc_feature (629)..(633): n is a, c, g, or t
  misc_feature (635)..(646): n is a, c, g, or t
  misc_feature (648)..(650): n is a, c, g, or t
  misc_feature (652)..(658): n is a, c, g, or t
  misc_feature (661)..(697): n is a, c, g, or t
  misc_feature (699)..(700): n is a, c, g, or t
  misc_feature (702)..(718): n is a, c, g, or t
  misc_feature (722)..(722): n is a, c, g, or t
  misc_feature (725)..(729): n is a, c, g, or t
  misc_feature (731)..(739): n is a, c, g, or t
  misc_feature (744)..(744): n is a, c, g, or t
  misc_feature (746)..(751): n is a, c, g, or t
  misc_feature (755)..(758): n is a, c, g, or t
  misc_feature (770)..(775): n is a, c, g, or t
  misc_feature (779)..(790): n is a, c, g, or t
  misc_feature (794)..(794): n is a, c, g, or t
  misc_feature (796)..(800): n is a, c, g, or t
  misc_feature (805)..(808): n is a, c, g, or t
  misc_feature (814)..(824): n is a, c, g, or t
  misc_feature (830)..(838): n is a, c, g, or t
  misc_feature (841)..(844): n is a, c, g, or t
  misc_feature (850)..(857): n is a, c, g, or t
  misc_feature (859)..(862): n is a, c, g, or t
agtgggttaggaaccacttgtctagcaaaggagatccttctgacattcttgacacaaagcttagagggagggctgatcccaccatgcatgaaatgctacaaactctagcagtgtcctttctatgtgtaagcactagagctgatgagaggccaacaatgaaggatgttgttgcaatgctcaaggaaattagaccccttgagacctcaagggcagaccctgatgtattgaagggaggtttaacagcacatagttcaccaccacctcctaagaatgtggtctcacatggatcttcgacatgttcctacaatttctcggataactcaatcaattgagcatgtatgaataagtttgcatctcatggagaagcaaacttattcatacatgctcaattgattgagttatccgagaaattgtaggaacatgtcgaagatnnntnnnannnnnncttaggaggtggtggtgaactatgtgctgttanannnnnttcannnctnnnnnnctgcccttgaggtctnnnnggtctaatttcttgagcnnnnnnnnnnnnnnnnnnnnnnnctctctcggctcnnnnnnntnnacgnnaaannnnnngcnnnnnnnngnnnnnnnnnnnnnnnnnngggatnnnnntnnnnnnnnnnnncnnntnnnnnnntcnnnnnnnnnnnnnnnnnnnnnnnnnnnnnnnnnnnnncnnannnnnnnnnnnnnnnnnggtntannnnngnnnnnnnnngtaanannnnnnctcnnnntttccccccctnnnnnncccnnnnnnnnnnnncttncnnnnnccctnnnncctttnnnnnnnnnnntttctnnnnnnnnnttnnnncctccnnnnnnnntnnnnctc

SEQ ID NO: 2324 - DNA, 691 bp, Glycine max
agctcctacaaatgtaaaatcatattctatagctgacctgcagattgctactggatccttcagtgtggagcaacttcttggtgaggggtcttttggacgtgtataccgtgctcaatttgatgagggaaaggtattccttacctgttgtttgctgcaaatacacctctatatctaatgctggtagcagagatatataattccaaaatagaattgtcacattatataattttggtagaaggggtcaaatctgaatagtttcaatatgaaagcatgtgaatgcatgtgctgatgatgcatcttttaagtcttatggctatacaagtataaaatcaaagaagtcggagaagtcctgctgcatgtagatgccacacgtacagccaatagctcccaataaataccatggacttttctataatagaccatgcctagaatctatgtatatgtttattaattgttttgatttggttttctcctgaaaatgttgtaggttcttgccgtgaagaagatagattcatctgtccttcccaatgatatgtctgatgattttgtagaactagtttcaaacatatcccaattgcatcatcccaatgtgaccgagcttgtaggttattgttcagagcatggacaacacctactagtctatgagtttcataaaaatggatcacttcatgacttccttcacctacctgat

SEQ ID NO: 2325 - DNA, 387 bp, Glycine max
gagacctagtattagtatcatgtagtggagaaaaagggttgttgatcctaatagctagacaaggcatgttgtagtagtcatggggtggggaagtccttttgttgtagcatgtaatttggtttagacttgtagtatgtcatcaattagatggataaagagagaatattgttatctacccgaggatgtaacaatgtttgtttctctgaataaaaagttcacatctgtcttttggaataaaactagtgaattactgtcttgtttcttgaaatgggaagaagagtaggaggaaggattaattggatcggtgtttctaatgtggctggaaacttctaaatctgaagggcactttttggagtctgaagggtgtctaatgttgctggccactta

SEQ ID NO: 2326 - DNA, 349 bp, Glycine max
gcttcctttacaccgcgtttggatctccgttatacaaaaccattaaaatgtagcgagagaaaaacaaaaccgcaaaagaaaatcagttaatttattaattttatttttttatggctttccacgaccatctccagcacgaaatagcgttccagcgtttcacggaggagcaagagttgaccgagaacagagacatgcagcagaggctcccacctccgacatggctcaacaacgttaacgcgcgtcaacagaatttcctcgacaccgagaagagcgtggatcggaacaaccgaagcgagagcaattgcgaatccgaggatttgagggaatacaaagcggtacattctaatat

SEQ ID NO: 2327 - DNA, 715 bp, Glycine max
cagttttgataaatgaagcatgatgcaagcatcttatgactatctatctatttatgtaaatatttggtttgatttaattactcatttggttgttatacctgtataatctttatgttttagtctctacatctagaaactactcgctttagttcatacacatacactttttaactcgattatccttacacatacattttttaattgattttagtccctacaattttagaagacagactaaaacagattaaaaatgtatatgtagaaactaaaatgtataatttctaggtatagagattaaatcgtaaagattggccaaataaattatcaaacctacttggtaccaacaagtcatgtttgatacacatggttatttatccatctaatattcaaatctgtttgttcaaattattccaggtaatgtcaaatcaagaagcagctaattgtataaaaaatataaaggatgctcggtcttcagcaaagcgccttactgaagaagcagttaacaggaaaagcaccgatgatatctcctgcatcgttgtgaaatttcagtgatctcaaggctcgcatgatagactttgatccagcaacttgcaagtgtaacataaacttcggtgtaatgaataaaacgataatgcttcatagccatcaggtggtgttattatgttgagtcattcatgcaaattaaatgggacaactgtgttatttaaagtaataa

SEQ ID NO: 2328 - DNA, 465 bp, Glycine max
  misc_feature (453)..(453): n is a, c, g, or t
tcttcataatcagccacctgctggtcgtggccgaggtactgcacctcatcctcaacatgatttgcagccaccagactctggacccaaaaaacccattttcttcaaaagagaggatagtgtttctccaacagcgtcaaatgattttttgccacccaaaagatctgttgatcatgcgcatgataacaaacttccaggcagcataccaggggtgttgtctggacttggacgaggaaagtccatgaaacaaccagatctggaaacacaagttacagaagaaaataggcatcttcgcactcggcaagctcctggtgctgcttcatctgagactgtgcccaagagatcgccaataccaagccaggaagatgcaacgaggaatgcactgaaaattttgtcacatggtaaggatgatggaagatataaatgatgagaaagaaggaagacctgatggtgcantttcgtcgctct

SEQ ID NO: 2329 - DNA, 637 bp, Glycine max
gagcaagatattgttccactttgcaggtacttgtcgagggtgtccataatgtaaaatgttgtttctttggagaatttgctgatttgtttcgtgcttcccagtcataattgactttacaagtttagacaggttaaagctctaccttacaagtggaacttatggattatccatgatttaataacaaatgtgtataaaggttttaacaattactatttcaccaaaaaaaagtcaagattaggttgtcagtttttgttttgaagcggctcctgtcgtaagggtcataagcatttcttcaggaaatgacatcactcttttctgcaatttcataaatcaagttggattgctcttatgtatctgataagaaatcaggcatttaaggatattgattaaaaagctaaaataataaagtatttgttgtgaatatcatctaataaaagtatttcataagtatttattgtcaccatttaattgtgaattgtttttgccggtgaattaacatttctggaacctctcatgtattgcaggaacaactaagataaaaaaaaatttgaaagtaatatcggttcatttgaagtgaaacacagtaaagatgatttaaaggagattatagatgctgtaccaatatctgaggtggcag

SEQ ID NO: 2330 - DNA, 416 bp, Glycine max
  misc_feature (394)..(394): n is a, c, g, or t
  misc_feature (396)..(396): n is a, c, g, or t
  misc_feature (409)..(409): n is a, c, g, or t
ccgatgacgtgtctgtcgtcgtcgagcaggtcgaggcgctcggtgctggtggcagccggtagccctgagatgacgtggacatcgcgggtggaccccacggcgagctggaagccctccttgacgtggcagctcttgatgaagtgcttgtaggcctgtgggttgtcgaagcagcgcacgacggaccacaccgcgtgtggtggcgcgtggatgcgctgcgcgaggagggaggagctttggcgggtgggtgtgacggagtaggtgtggtgctccagcacggagggtttgaggtcctcgaactcttcagcagttaacccgggtgggggatccaggtggcgccgggtcggatcctgctcctctgcgctggagttgtgcgttttttccatagccaagcgancngagggagtgagangagtgag

SEQ ID NO: 2331 - DNA, 701 bp, Glycine max
tgttggtgcgcatgattcgcactcgcctccctgcagcagtccgggcaaaatcctgccccggtatacatagcagctgggcgatggcctcctcatcgaacccatcagaccggttcctcctctggccatactcgcattcctggccctcttccaacaccaacggatatcccaggagctggccgatagcgtcggcatcaaacgggatccactgaccccttacccaggagattgttgataccacatagtttatggtattcaaggaaccagatatagtagtttcactgatgctaaacattagtttaacctaaaaaatgaattctttaaatattttcaggatgtatggcactgcgaaatatgtaatcgcaagcctggccgtggatttggtaagttatgttttttggggttattttttctgcatttccctgctcagtctatttttggttgttcactgtttgaatgttgtcatcttaaaatatttgtcaaatatatgtaaatatgattgagttgtgctattcactttctgaatggtcaatttttttttcttttccagaagcaactgttgaggttcttccacggcttttcaagataaagtatgaaagtggtactttggaagaactactttatgttgacatgcctcgtgaatatcataattcctctggtcagattgttctagattatgcaaaagcaatacaagaaagtgtttt

SEQ ID NO: 2332 - DNA, 387 bp, Glycine max
  misc_feature (381)..(381): n is a, c, g, or t
agaagggtcattgaagatggagaggctagagatgtttgagatggacaagagtaataatgagcaagaaagtagtgagagctatggcacacaggttgctgtggcagttagggccattcaagaatcaatgatctcacaccactttggagaagggatcttggaaagtttgtttgagaattatgcgagattggtagatgaagaaatggctaaggaggatattagaccaatctcttttgttctggttctcagaaaaatatgatactagctatgattattattattattgtacaaaaatattaattatatattaatgttattaattattttggtttgcagtattgagacgtgtttaaattgcagtcatttactgcccatcactgtaancaacat

SEQ ID NO: 2333 - DNA, 805 bp, Glycine max
actgcatatggatgaaccaccaagttgtaaggcacatagggccaaatctcagccttcttccctgttgatttggccttcttcagcaccttgtttggttcaacatacccagttactgtaactttctgctgttttcggtttatctccacagatttcacccctgcaattattaatcaccattcatttcattatcttcatgttgaataacactgataaataaatagataatagatcatgataacaatttatgtaactcaccacttagtgaagagagagcgtttttgaccttaagctcacaaccatcacaatccattctcacctttagctccacggtttggaactgcttcttcttcttcttgtggtggtggtggccactgcccattagatcagacaagtactccaatgtacctccaactcccatttctgtatgttatgaatatgaatattggaacaagattgattagtgaactaaacctcttaagtgtgccacaaaagaacttcgatgagagtgaagcaagggagcatatatatatagcagcacaaaggttgatcattttctagagagaccactacaaattcgtacaatgttttttacaacattattattttctatctctatctctctgtcactttaattatcttatccgagacccttttctttcctctttcgtctccatgtaaaacagtttgtacatgactttaattattaatggaatataattacacttatttgaatgtataaaaacggataaattaatgttgaaaaacagaaggaagccagctctgaaacgaaaaaagaagtagtagt

SEQ ID NO: 2334 - DNA, 400 bp, Glycine max
ctgcttcccaagtaagaaatgctgcacaaaagagtgactgcaatgttggtcagttggatccaaacttgtatgatgatgctgggtttgaatttgatttggagacaaaaaaggatgaagataatgagagtggacagtaagaactaggttccatttgtaggtcaatgtgtctcactgtaatgtttagtgtatttttctggaagaaaatacaaatcatgctttgtaaattaaatttcacgcaatccatttgtacatattaatgtagatatagatgcattcttctctcccggtctgagagtcataaacactgcactccacccaacagaaatgctttgacatgcattacacgtgtggtcatggatgaatgttgggtgcaagattcttgtcgatgttcaggttgcta

SEQ ID NO: 2335 - DNA, 1149 bp, Glycine max
  misc_feature (210)..(212): n is a, c, g, or t
  misc_feature (416)..(418): n is a, c, g, or t
  misc_feature (522)..(524): n is a, c, g, or t
  misc_feature (528)..(533): n is a, c, g, or t
  misc_feature (553)..(554): n is a, c, g, or t
  misc_feature (571)..(573): n is a, c, g, or t
  misc_feature (593)..(596): n is a, c, g, or t
  misc_feature (601)..(602): n is a, c, g, or t
  misc_feature (625)..(626): n is a, c, g, or t
  misc_feature (636)..(637): n is a, c, g, or t
  misc_feature (642)..(644): n is a, c, g, or t
  misc_feature (1072)..(1079): n is a, c, g, or t
  misc_feature (1108)..(1122): n is a, c, g, or t
gattgtttttgtgattcataaatttactgcaattccaatattcttatccagtgcctgaaattgttgcaggtgctcaaaaattaggtcatgcttttgatgcatgaactcactcacttttttatgcttataattcttccgtgcaccttgtttctgttgagtgagcctttgaattctgcactcgttgttgctcgcagaactagatacaatatnnntttggtattcgttcgcgtgagttttacctgctcaacaattcgtactgtagatattatcttagaatagtgttcatacttttccatcatctatactatgcattcttcttggcttggttatgtttggtttccgtttcacctcctacaagttatgtatttggtgatatgcttggtttctttcaaagtatgttttcacacttacatttnnnttgaaaccaagtttcaattgaaagcaatatcaagcttgctttgctaactcggtttgcaaaattcattcattcatactcttaagtttaatccaaacatgcacttnnncttnnnnnnatatttgctgttccattccnnaattactgactttattnnntagatagtggttgttacttnnnnacttnnccttgttccatgacaacctagcnntggggctctnngttgnnngataaataagcatcttaaataacacttgaccttgtgagaagctacaacatctgaaagagcattggcttgtttatattggtgcctctatctttttatttctttgtatttgtgtcattcctcaaggttgaggtgagtctttttttcaaagtgactaattggtaactgtaaaatctaacagggtttcaggaaaattgatacggattgctgggaatttgccaatgagaactttgttagaggtcaaaagcatttgttgaagaatatacgtagaaggaaacatccacacagtgcagatcagcaaaaagcattgccacagcaagacaattgtgatgaaccatcacaagaagcaccgtatcatggcctttggaaagaagttgagaatctaaaacttgataaaaattcgctcacgcaagaattggtcaaacttaggnnnnnnnnggaatctgctgagaataagttgctgctcnnnnnnnnnnnnnnnaaggaatggaaaagcatcagcagcaga

SEQ ID NO: 2336 - DNA, 434 bp, Glycine max
  misc_feature (412)..(424): n is a, c, g, or t
  misc_feature (426)..(430): n is a, c, g, or t
actctcctgggttcgccagaaatacaccatctacaactactgtgctgaccgcaaacgctaccctcaagtctctccagagtgtgctagagaccgtgatatttaatttgaataacgtgatattaatgcgaagtatctatcagttttactgagtattattatcacctctcagccatagaacctaccaagacatataatttaatataagcttccatctcctatttttattaccactaccataaagttcccatctacttaatttcatgaaggccgcacctaagtgctgatacaaaattcaatttggggttattgcttgtattgttgataatttatgtcatcatctattgctgttgttatggtatgtataccagtttgaggtatgtaacaaaagatatggcaatgtgcctaaaaaaannnnnnnnnnnnngnnnnngggg

SEQ ID NO: 2337 - DNA, 195 bp, Glycine max
acttttttttctgctttgtatcccctttaccctagcctgttctcatgactgaaaggacatccatctctctctgcattaccaagagatgatgatgatgattagttagccttagtgtgtaaacgtataaacttgtaattatgagtaatcatatcatttgtattaagttgactatatacttttttactgcatcttagc

SEQ ID NO: 2338 - DNA, 644 bp, Glycine max
tttgaccaacaaatttattagcagagaattagagaaatgactgatggaggtgtacactacagttttgaatgtactggaaacgtggacgttcttagggatgccttcttgtctgctcatgaggtacattgctatattcaagctagttttttaaccccttatttatggtttcattgtaatagttaatattttaactaatgttttataaactcattcctcattcgaaaacaaggatcaatttcaaactcatcacaaaagattttactagctaaaaaccattaccttacacgttcaaatttggtgtcaatttttgtgacacagggttggggattgactgtagtattgggaattcatgcatcaccaactttgcttcccatccacccaatggagctcttcgatggtcgcaacattgtaggatctgtatttggaggtttcaaagggagaagtcacttgcctcattttgcgaaacaatgtggacaaggagtaatgatcatcactacttgaatttcttttataaaattatgcaatgagttttcatgagcaaataatgttatattcttttattatattattcaatttaacagaactcatgcatggactaatatttatttgttatggtgctaactaaccatttaggtggtgaagct

SEQ ID NO: 2339 - DNA, 598 bp, Glycine max
  misc_feature (577)..(577): n is a, c, g, or t
  misc_feature (582)..(585): n is a, c, g, or t
  misc_feature (589)..(592): n is a, c, g, or t
  misc_feature (594)..(595): n is a, c, g, or t
atgctgccaaagggcttgcatttctccacagtgcagaagcaaaagtgatatatagagattttaagacttcaaatatcttgctggattcagtatgtgaacttttaatcttttaatcttataatgaaagaaaaaagatctgatgaatgtagaaaccatttggatagcagatctgaaatgtgttgacttgatcacagaaatataatgcaaaactttctgattttgggctggcaaaggatggaccaacaggtgacaaaagtcatgtctccaccagggtaatgggaacctacggatacgcagcacctgaatatctagccacaggtaatgttgggttcatatttcagaaccattttccttttctgagtttgttagttattctagattcagcctttgggataatggctaaaaaaacattgttagtgtaggtcatcttactgctaagagcgatgtctatagttttggggttgtcctgctggaaatgttgtctggcaagagggctgttgacaagaatagaccatctggacaacacaatttggtggaatgggctaaaccttacctggcaaacaagcgtaagataaanacacnnnnactnnnnanngtt

SEQ ID NO: 2340 - DNA, 412 bp, Glycine max
atttttctgttgctgactatgtgataagaatctgtgagtggagacagaagattgggaaagaaaaatgctaaaaggaatgattttagattacaagaacctcaatctgcccagaacaagtactcaggaagccgtaaattgaaagacaagaaagggaatggacaaaagggttcatatgctaatcagccagtgtcatttgtatcaagtggcttaatcaattcagaaactttacaagttacagttgttgatgctgaagagacaaataggaagggtgtcaccagctctgctaatataggttcgtttgaagaacacactactggttttggttcaaaaatgatggctaaaatgggatacacggaaggagcaggattggggaaaaatggtcaaggtatggcacagcctatttgagttattc

SEQ ID NO: 2341 - DNA, 466 bp, Glycine max
atgcccgctctcagaaagcgaaatcgattgtcggagtccgatgccatatccaaccacgacacacctcatgaacagaagaagaatatgtctgagtacgagctgtcgagagagcagagaatccgcgaaaaccgcgagagaatgggaaagctgggaatcttcgacctttccctcactctcaagctcaacaacaaaaacaaaagatcctattcctctcacaaaccccaaacccctccttctcttccaaactcctccgtccccgttcgccgctcttccaggttcttttccgatcaatcacaatgcacatttttatttatttttgccctaaaaatccgaatcgtgtttctaggttgcagaatgtgactcctgttagttactccgaagttcccccaaagaaagacgagtttaagaaaaatggaagggtggtcattgaacaaggtgccaagccagaggtgtactctgaagaaca

SEQ ID NO: 2342 - DNA, 631 bp, Glycine max
cgaaataagaaaaaaaaatttaaaagggcaacaaataagaatttgcatgaatgatagtaacaacactgcatgatgcgggctcctgcaccacatttaaggaacctccgttatatttttcttttgatggcttggatgagaaccaaaggtgaggattacctcttgcaaaaagataagtgaatccaatcggggcataataaatgacaatttgctatcaaatatgacaattatcagctccaattaagaaaaccagcaacatagattaaacaaatgctggagtgtgaagcattacccaactgtgcatggcatttgcaatgattagagaccatgttggcagctttgaaagcaagcgcctgaaaggagggataactttaactttcttgggcttagctgtctccactgaaaaagacttttgccttctattcaatatatactccagctcatattttgatatctgaggactctggtcaggagtgcttgatgttgcagacaaccacaccaacacccaaagaaacccagacaatccaaaaatcacaaagggaccaaatataccaccttgtgacatgagaatgggagaaagtgtgagccctattgcacatccaagcataaatccagccattgagattcctacagc

SEQ ID NO: 2343 - DNA, 327 bp, Glycine max
aagttacttttacaaagtgggatgaactggtgtgttgatagtagggtttttattgtgtgctgcagtgcttgtagtcttttgaaactaagatttgggggagaaaagagggggaaggggtaatgttcacttcaatcgcatttttatccgccaaagaataatgggtttttggttatttttacttgtcagagcttttggaacatgttttttgtatcgcaagcatattatgaagtggtacagggatattatggtgtatatggtttgtttaatccgggaaacctagtcttggatattgataataaatggggaacttggctttattgtccgaaa

SEQ ID NO: 2344 - DNA, 409 bp, Glycine max
tgtgcttgtgctggccaagcacaccgtgctttcactctcccacatgcagctcattgagctaaggggttggcaaggttttaaatatcagtcgtggtcgcgttgtgatttcgtcacgtttgttgatatcacgacaaatcgtggacaagtgcggccgatatggttccgattgcagttgcatggcagtcgcatacaggtaaaaaatcttgatgttgcagacggatatttaaaaccttgggggttggtgatgcataaagacactttgaggaagttcccttgaagggtttgatagttttaggtgtcttgttgataagtttaagttgaatgctgcatcatgtcatgttgattctagaacagcttgagcttggtgcttgagttttcttttggtctctgactttcatgtgaagggtca

SEQ ID NO: 2345 - DNA, 330 bp, Glycine max
acaaggaatattttgcaatcttgattgaatatgagagtggtgatggtgacctagacaaagttgaactcagggaagcacatgcttccgcccaatggtactccatgcagcgatcatggggtgcagtttggaaacttgacaaagggtcagcacttgtggcaccattctccatcaagctaaccactctcaaatctggcaagaccattgtggctaacaatgtgatccctgctgggtggattattgatcagacttatagatcaattgtcaatttttaatttcaataatcgaagttgtccatttgtttggatctatcatcagcttgtggttgtccta

SEQ ID NO: 2346 - DNA, 374 bp, Glycine max
  misc_feature (68)..(69): n is a, c, g, or t
ctttctctcttctcttctttcttatccattacatgcccggtagtttagaaccgttggatttgggtgtnntataccctaccacttcagatgcccaatctcgctcgaactcatgcgagacccagtaaccgtctgcaccggtcaaacctacgaccgcgccagcatcgaggcatgggtcagcaccggcaacagcacgtgtccggtcacacgcgccactctcacagacttcaccctaatcccgaaccacacccttcgccgccttatccaagagtggtgcgtcgctaaccgcgcttttggcgtcgagcgaatccccactcccaaacagcccgcagaccctgccttagttcgctctctcctcaaccaagcttcttcacttc

SEQ ID NO: 2347 - DNA, 287 bp, Glycine max
tgttcacagtacacatgcataccagtttgatggctatgaagatattagaccatattgatataaacattcccacacctaaagagaaatctgctgagctcaagctggcaaccaaatggaagaaccctgaatcttctattgatttcagtactatctggtcaaatgaagataatggtttgcttaaattaaatgatgttagccctcataaatatgatgggcttgaaggaaagaaatctactctatggaatgaaagtaaggggaagtgccatgttgatatgcaacctaaggag

SEQ ID NO: 2348 - DNA, 389 bp, Glycine max
gaagcatgatgcattgtgcgagcattgtctcggctccgtcctacgcgttcccttttctctctggctccgcttccactactccaactgcgatctcgctcactaagcgcagttggaagccacctccgagcatggcaaaaggcccagtcagagccaccgtttctatagagaaagagaccccggaggccaatcgtcccgaaacgtttctcagaggagtggacgaggcccagtcttccacttcggttcgggcccgcttcgagaagatgataagggaggcccaggacaccgtgtgcagtgccctcgaggccgctgatggtggggcccagttcaaggaggacgtttggtccaggcccggtggcggcggtggcattagcagggtccttcaagacgaa

SEQ ID NO: 2349 - DNA, 489 bp, Glycine max
ggtctcctaaggaggcctgaagcacggaaactgcttgataagatgtataatggacggctacttccaaactcttagaaggtaaattttctgtcatgatgcttcataaagtcactggtgtctagaataataatcttttgttgtcgttattcactgtactacatccttttcagccgtaaatctgagcaaagggcttgctaatgctctgctttttggcacaatgattgggatgttcttcaccagttaacaaagccagtgactgcattggttatcaacttctagcacagatcatgtggaggactttgcttatatttttggtctggatgcattccagaactctaaccatcggcttggtcatcaaccttatgtttttcatggttctgtatgaaaaaaaggtccattattcgatgctacaatcctcataatcatgcagatccaattgacttacaaaatcccatgtataatgtaaaccttgagcaaatacttccagca

SEQ ID NO: 2350 - DNA, 386 bp, Glycine max
gtgcttgattgtggggaagagaaagagggtttgagacatgctgcaaaagtgagggatccatcaagttcaagagtacttaacttgtggacaaatgcccctggtgtgcaattttacactgcaaactatgtgaatggtgttcaaggaaaaggaggtgctatatatggaaagcatgctgggttatgtctcgagacacagggattccctaatgccataaaccagccaaattttccttctgttgtggttcgtccgggcgagaagtatcaacataccatgttgtttgagttttcacttgagtgatgtttgttggagtggcatagcaatcaggtagacatcttgatctgcatattatgatttagaacctgaacttagtaggcttctcctgaata

SEQ ID NO: 2351 - DNA, 434 bp, Glycine max
  misc_feature (399)..(399): n is a, c, g, or t
ggtcaagataatgaggttgcatcaattgatgttagcattgggaacatttacatgtcgctttgtcgttttgacgaggcgattttctcataccagaaggcgcttacggtgtttaagtctgccaagggtgagaaccacccttctgttgcctctgtttttgtgaggcttgctgatttgtaccacaggactggtaagcttcgcgagtcaaagtcttactgtgagaatgctcttaggatttactcaaagcctgttccggggaccaccgcagaggagattgccggtggcttgacagagatttcagcagtttttgaatctgtcgatgagccggaggaggcgctgaagctgttgaacagggcaatgaagttgttggaggataagccagggcagcagagcactattgcngggattgaggcacgaatgggagtgatgtattacac

SEQ ID NO: 2352 - DNA, 329 bp, Glycine max
gcttcctcatgccaccacactcctccatgcccacatcaaaaccaagcacaaaaaaccctccaccaccaccaccaccaccaccccattaccccataaccattcccccaacagaaggaagctgatttcaacctttctagccacttcaacagcagcactactagtgcatggagtcaccagcaccccacaagcactggcccagagctggggcacgcactccttcatcaaggagcacttcttcgagccggggctctccccggaagacgcggtggcgaggataaagcagactgcggaggggctgcacagcattcgggaggcgctggagaccatgt

SEQ ID NO: 2353 - DNA, 368 bp, Glycine max
caaacatgtctctgattccatcattgctaagcaacagaaacatcatggaccccttctccaccaacatctgggcaccctctgactccgacagcgaggtttccgccttcgtgaacgcacgtgtggactggaaggaaaccccggagtcgcatgtgttcaaggcggacttgccggggctgaagaaggaggaggtgaaggtggaggtggaggaagggcgcgtgttgaacatcagcggagagaggagcgtcgagaaagaggacaagaatgagaagtggcaccgcgtcgaaaggggtcgtggaaagttccagaggaagttctggttgcctgaggatgccaaagttgatgaagtgaaggcctctatggagaatgag

SEQ ID NO: 2354 - DNA, 530 bp, Glycine max
cagttggcgtggtgcagaaggtttctattccttttctttttacaaataatttcattgtaaacaaatttcttgtctatgcatgatgattccatgtggcttaaattgctattagggcctgcggcctacaattcccaaaaatacgcacccaagactttctgaacttcttcagcggtgctggcaacaagatccaacgcaaagaccaaatttctctgaaataatagaaattcttcagcagatagcaaaagaggtaaactattactgaaatttaaaaaccaactaaaagttggacctgttaagcaattttcagtttcattttttcttttcctaccaggtcaatgatcacaaagataaatcatcccatggctttctctcagctcttagacgggcccatcattgatattgatataagagtattacacgaaagtatagcctttttgctcctgtatagtagtcatactctgaccaaatatctattgagttggttgtttataatactcttgaaagattccattgtattgtgcttgccttaa

SEQ ID NO: 2355 - DNA, 404 bp, Glycine max
tgttgaaagcagacgagtggcctgtttgtgcatttatttctcaagattgtcgtccagcaaatccatcggaagaagcgcacaatgttcaaacatcgtatgaagtgtgggagaagacattagagatgattggccttccctcagatgctgtggaaaggcttttagatggggaagaagttaaatgccgttatggacaagaacagtaatctaatatacaatatctcccttaatctgtaagggcacttccattatttatagctagtaatgagcattttcattctgaatatgtgggagaagaacccttttatatttttttaaacatgatatgtatatccattttgatcatatttatgtactcaaatgccacctgctcctcctaatgggagaatttagccagctttgacctt

SEQ ID NO: 2356 - DNA, 348 bp, Glycine max
agctttccttcaatgctagctagaatttcaattcactgccaaaaacacatattatattgtcatttaataacggtttagcatatactgaattaactcgtaatattcatcatttttcccattttttttccagcgcaccttagaaacgatcacgatcattgtaagcgcaacacaactattatgcacgggagttatccatgttggagtttcagaagttgttgcgcagagaatgggaggaagagtatgagtttcagctggtgcaggcttatacgaatactatctttcaggaaaattatcctctatgactgcagaattaattgtaactctttctttgcacagagttgtttcaaa

SEQ ID NO: 2357 - DNA, 396 bp, Glycine max
gcgctgcctgctggagaattcgccgaccgggttgaccttaataagatgcccgaacccgagaattcggattgtgactactgggacagggattaggagtgttgtttagttgttaatttggagtttttcaaaaacaaatataaaattataaccttgttttaattaatttttttttattggggaaaaggggttagagggcacagcaatggcctatgatgccagggagttgggttgaaaaagagggagtgagccatgttaaccactcaagtaattataatattataatagctactattctactgaagagtaaaaaaagatggatgttaggtgtttttatgagttgtatatgtgaagagaagggaccattggggagggaagacgctgttgtggtcactacta

SEQ ID NO: 2358 - DNA, 954 bp, Glycine max
tcagctatcatgcatgggggaggaactggcttcggttttgatctccccttgttccagaatgaaaatgatagttgcagcttggatggaatctgataaaccaaacaacaaagaaaaatattcatgaacttgccagtcttcaatccagacttgtaaagcaaacaagttttctattctacacattgaaatgaagtggaattaagatataacacatatctaatgctgcttccagacaaggtactgcaagcacagtagcacatacacaatcactagcaaattcatctgccttcacaaacaaatatatggaatataaagaataaagtgcatgatttgtgagcaagagatactgctaatctcaagggatgtcagtgtagtacaagagtaaggtggccagatatttcaatacttgaatagttctagcattcttattttccacaacaggggaaccaaaaaaataagtgtttaggccttccaatgaatgccaaatgaactcaatgacatgtaaatcggtatggtatctgagaagagataaatcaaatatactatcagctaactggttaaagtgttcaattaaagaataataaaagaattaaagcataaaaactgtcttaaaaatccattaaaatagcttaatgatgttgaaaatatgaaaattataatttgttgttgtgagatgaacagtacaattccctgattattcaatgggaccaggatatatacgagaaataaagcatataacttgaacacaagaatcggtttcaaaatataagatggagtcatgtataaaaaaacttgcataaaatgaaggttgggtatcataactcacagcagagataaggctgctagaagcaaatgcaagtgaagatgcagaaaatggagatttcccaggttttcccttcagctgatctgttgtctgtccctgctcaacggacccaaaacttgattgtgcactattat

SEQ ID NO: 2359 - DNA, 310 bp, Glycine max
  misc_feature (303)..(303): n is a, c, g, or t
actacactgacgagggccagggtgcgaagaagaacatatcccctccgttggagtggtacaacctgccggaggggaccaagaccctcgccctcgtcgtggaggatatcgatggatccgattcagatgggcccatcatgccatggacccactgggtcgtcgcaaacatcccggccacggtgaagggcctgccggagggattctccggcaaggctgccgagatgggcggggattacgcgacgatcaaggaggggaacaatgacctgaagaagcccggttggaatgggcccaggctgcccacgcctngccacag

SEQ ID NO: 2360 - DNA, 690 bp, Glycine max
aaacaaatgaactctcagagttatttgaagatcctagccaaggaattaggatgaattactaccctccatgtccccaaccagaacgagtcattggaatcaatccgcattctgattcgggtgcccttaccatccttctccaagtcaatgaagtggaagggcttcaaataagaaaagatggaaagtggattcctgttaaaccactctctaatgcttttgtcatcaacgttggagacatgttggaggtaacaagagcacaaaatcattttcatatctttttatcatttggcatttaaataatcttggaacaatgcaagtataagaaaaattatagtgtacacaatacacattaagtttgattttcatacaccatttttttttatactgtcaattaatcataaatcatttctgatatgatttttaaagtaattatcataaaagttaacaaacttatcatacatgacaatatgtgatttatttgatgatactgtagaaaacctttatacttacagcacactctatttaaattaacatttagcctttaagaatttttaaccatatggtaaatgctttgacagatactgaccaatgggatttaccgaagcattgaacatcggggaatagtcaattcagaaaaagagaggatttccattgccatgtttcaccggcctcaaatgagcagagttataggtc

SEQ ID NO: 2361 - DNA, 395 bp, Glycine max
ctttgccgaagttctgactcaaatctatcacattgttagcaagaaagcagtagaggtggctgaaaatggaaccacatctgtgcctgccaaaggagagaaaattgatctgaaaaatgatgtttctgctttgaagagagttggttgctgctcaagctaagattggaaaacatagttcaattggttggtatcggctctgttgtacgtgtaatattctgagaaatacgaactagaagaaaagtgaaatttaatttgtcatagcatgttagactctttgtgtaaccttaaaactaagtttggtgtttcaataggagctgctggtgaagcaagttgattgctagtcttacttgttgtagtgcttttattattgtttttgaaatgttttcacatgcaaagag

SEQ ID NO: 2362 - DNA, 363 bp, Glycine max
gctgttctcctcgtcatgattccaataggttcgtgatgggtgccttcaattaatgactcacgaagtaacagataggcaccactttaaatgaaagtagccgtggtagttgttttcctactcatggatgggtggattttaattactttgcaggttgcagcatatatagaattaactgatttgcgtctgcaacatcttgttatgttgtctttattagttaataattatcttaatttgtatggacttcttttccacatgctagactattgaaaatcaaggactgttgtgttttaatttgttttaggttgtacatttcgaactgccttatgttatgcttatcgtccgtcactcactcattagtttaaa

SEQ ID NO: 2363 - DNA, 380 bp, Glycine max
ttgggacaggcttgctttccagcatatagtgtatatgaattgtagcaatccagtgactcagaatgggaagtatgtggatactgcttcatacgtcaactgggactccaaagacaagtacatatacgctattgctggtgacttaaaagcagaggacttccaagttggttgtcacgtaaagctggttgctctgacatcttggtggggtttggatacaaacaattattcctactctgccatgcacacggggctagtctatggatttgagatttcatggatgcgcctcatatgtgagcagcactgtccaagtaaacacggctgctactactacaactgctttttcgactctgtcagccaggagcttaattattgggacggggatt

SEQ ID NO: 2364 - DNA, 376 bp, Glycine max
ctgtgcttcttcggaatcaaactcaaaccctccccgaagacccttcgaacccatccccatccaacccgtctcctaccccgtcaagcccaaacccgcaccacccgaacctcaaccttcacccgaacctcaatcacaatccctccccccttcctcgccggactcgcaacgcgcttggacgcgcgaggacatccgctacgtgaaggacgtgccgtcgatcgcgccggtggcgtacgcctcgcgcggcggcgtggcgcctctccccgatgacagagctcccgtggaggacgcggcagagagcgagaggaggatgatcgaggcggagaatgaaatgaggttgcgaatggccaaggccgtcgaagaggaaagaatgaaggtg

SEQ ID NO: 2365 - DNA, 763 bp, Glycine max
cagatgccaaacattacgttcacaattggaaataaaccttttgtcctcacaccagagcaggttaggtttgaactttccataaattaaattacattgtgaacattggggtcgggaaagtacctacataacttggacaatattttggttttaggtaaaaatatggattcaatttcaaagaaaagccaacagtaatagccattcaaaatgacctgggcacacactaatactgaaaagcaaattcaactacaattatgctattatctctgtagatagtttaaggccaactattttaattatttttgtgattctaagaatgctttttttgtgttttcagtatattctaagaactggagaaggcattacagaagtctgccttagtgggtttattgcttttgatgttcctcctccaaagggtccattgtggtatattaacttttcaaattatttatcaattgaaaaatcacatatgcacacagtagaatggtacagaacaaccatgaatgaagggaattacataaaatgttgttaagctatgttccctactctgatgcaggattcttggcgatgttttcatgagggcatatcacaccgtctttgactatggaaatctccaagttggctttgccgaagcagtctaattacgctttctggaggattttctttgtaaatttgttaagcgtgttgtaaataagctgttataattgtagctctggttactttttgaaaccacgaatgtatttatccatttaagacgtagaagtat

SEQ ID NO: 2366 - DNA, 369 bp, Glycine max
tgcgcaatgtcgtttcccttaaccctggagacccgaatgacccaccactgtggacccagcttggcgagattgtcgaggttcagctcgtccatccacgagcccttctgcttcttgggcttttccatgagcctctcctccaccacctccctccagttcttcgcgccgctcctcgtctccctcctctcgctcctcgcgcgcctcctctcgcgcgcgctgagctgcgacgcggactccacgggcgctgagggggtggaggaggctgagagggtgaagaagaagggtctcgttggcaggagtgagacggaagggagatggagtgcgtcgtggaagcaaggtgggttccatggaagaaacacccccctcatatct

SEQ ID NO: 2367 - DNA, 385 bp, Glycine max
gatattctttcttgaattctcatctgggttcattccttttctcatgcgttgacaaaatcttcacactttcaaagttggtaactgataaaacttgaaaataaatcttccctttttgtgtcacaaccatgggttgttgtatgagtaaaaaagggtcagagccagaagaacacattgtttacagacatgttgctggtgctgggggtgctggtgtgtacaataatcacaagagccatgaacccccttctcatcaaccttacccattacctgagaagcatgccccttggaggcctccaccaagcccaaaacatgttcacaagcatgacacaatcactgggaagccatttgaggatgttaaacagcactacacacttgggaaggaattgag

SEQ ID NO: 2368 - DNA, 713 bp, Glycine max
  misc_feature (56)..(56): n is a, c, g, or t
tcataccattatggtttgataaacacaactcgtacaattagacttcaaaattctgntccagttatcaatggcaaacagagatatgctgtcaatagtgtgtccttcatacctgctgatacaccacttaaactggctgattactacaagatccaaggggtgttctcccttggaagtatccctgactaccccactggtagtggtggctaccttcaaacttctgtcatggaagccgatttccgaggctttatagaggttgtgtttgagaacactgaagacactgtggagtcatggcacgttgatggccacagcttctttgtagtagggtaagatcacctaactcattcctttctgctgcaaatttgataccaaactgcattgtattacagccttttgattctactagctttctgattagctagttaattacatgtttagttagttactagttcaataagctttataaatgatgcatgtagcacactcatttatatcttttttaattcaattaatacgatgatttacttctatggaactctttgtattctttgagatctatgatctttggcctcatcaacttggaattacatgtatctgtcgaaattctgaccatgagttctatctttgttttcttcctttgaacttacaaatatacacatttttgtcatactaattcaacattataataatatgccctattcattgtaatgagcaga

SEQ ID NO: 2369 - DNA, 328 bp, Glycine max
ttcttcctcctctccactttctcgcaaatttcccctcactttccgggaaaaaaacagaactccaatcacacctcacaagctccctttttcagcaaggcctaccaccaccagagtggtgttggtgaagtctcaggccacagcacctgcttcttctgaggctgtggcagtgacacctgtgtcttctgagatgaaggcatgggtctatggggaatatgggggtgtggatgttctgaagctggactccaatgttactgtgcctgatgtgaaggaagatcaggttctaatcaaagttgttgctgctgctcttaaccctgttgatgccaagagg

SEQ ID NO: 2370 - DNA, 460 bp, Glycine max
  misc_feature (394)..(399): n is a, c, g, or t
  misc_feature (401)..(402): n is a, c, g, or t
  misc_feature (406)..(409): n is a, c, g, or t
  misc_feature (444)..(446): n is a, c, g, or t
  misc_feature (448)..(448): n is a, c, g, or t
  misc_feature (453)..(456): n is a, c, g, or t
taccctcggcgagaccacgctccgcgtgaagcgcaacctcggccacttccgcgtgaactacgccatggtcgtgctcctcttcgtgttccttagcctcctctggttccctatctccctcgtcgtcttcctcgccgtcttcgccgcgtggttcttcctctactttttccgcgatggccccatcgtcgtgctccgccgcgagcttgacgaccgcctcgtcctcgcggcgctctccgccgtcaccgtcgccgggcttgtccttaccggcgtctggctcaacgttgtggtggcgttgctcttcgcggcggcggcggtggcgctgcatgcggcgcttcggaacaccgaggatttgtacgtggatgaattggaagtttctgatggaggtttggtttcatcnnnnnncnntgtnnnncactccaatcgtaaaatgtaggatcctggatctgnnntnggttnnnnctct

SEQ ID NO: 2371 - DNA, 332 bp, Glycine max
gttttgcaggggatgcaggcgattgaggtggcgatgaagaggttcttctacgcctataagcaggttgtggcggttatgatggggagctccgaggccgataatgggttcactcagatattccttgaacccacttatttccctagcttagatgctgccaagacctttctcgcttattattgggaaaataataatcaaaatgtggttccctgctagttaattaaaaaattaatcaattaattcctagtcatatatacttacttactcacacaaacgggaaaacaaagagaaaaaaaaaaggactaaatttttgtaataggttggtgtaaacaaat

SEQ ID NO: 2372 - DNA, 470 bp, Glycine max
gactggaatgtctgcatttgcgtggtcggtgatcttaggaggagccgtttttgtttccttatcctcttttgttcgttctttaggtttgcaaacgccattgctgttgcgtcgaatgttgtttttgtgagggaaagaggcattggaaccacccttggtgtgacctacacctccagtgctgtgacgccctcgactacaaacttcaggagatgggttcagagcatccccaaggctccttctccgacttagctttggtgattttggccgagtcagtggcagctgtcactcaccacgccaaactcaatgaatcatttaaatcaaaaaactcttcacattggaatgaacccaaaatgaatgttatgcatgacaacaaatgcataccttctttagttcagtcttagggggaggcgcttcatagtagaaacttggtactggatttgctttaattaccaagttctttctcaactgcttga

SEQ ID NO: 2373 - DNA, 574 bp, Glycine max
  misc_feature (221)..(221): n is a, c, g, or t
  misc_feature (250)..(253): n is a, c, g, or t
  misc_feature (256)..(266): n is a, c, g, or t
  misc_feature (272)..(274): n is a, c, g, or t
taggtctgcagcaaggacatttgttcttggtgggctttctgagaagtatcatggaatgtccaatttctgggtgtcagaccgaattaatgtatgaattctgtctcaagctttgttttctcgtgaagtttcttattgtaagttgaaacaagaattccttgtaatgtatctcgaataaaagagtgtgaggaatgtagaccaatacgagtggagaagcagaatancttgcccttatctatctacaatcctaacnnnnccnnnnnnnnnnnggatannnagacgtaggcttgtatttgtctaccaagtttgcaacagatgctcgaccatccagaggaaatttgaggcaagtttttaactttctaattggtggaaaattcaatcatcctctggacacgggaagagatgagtaattggaattgcgagggcagatgattgaatgaatatttttggccattcctaaaactttccgagcttaataccttggaatcttggattttgcattgcgcagatgtgaaactattccaaagtcagttttcagagaattgttgtatgcctaagtttatgcgaaatttgacat

SEQ ID NO: 2374 - DNA, 491 bp, Glycine max
  misc_feature (481)..(484): n is a, c, g, or t
cgagcacgcaacgacggcgatgggagcgtccacttcggcggagccgagagtgtcggcggagcagaaagaggcggaggccgtcacagcctccaccggagctcttcccctgcttcagaaagccttctccaagctcgccaatcccgagaccaacgccgttcccttagaaaatctccaggtactactcgaaaatctaaaaaactttctcattttcaataatctttatattgatgacgtgcaagctcgctgttttcacttttcagcaatgcttcagtttcggtcgcgaaggtcgaagttattccggaagcaacgtgccagattcgtttccggtgttgttagatcacttagcctcatccctagttgatcaatttttcgtgcctgacaaagagggaataatttgggttgaattcgtgaggggttacaacaagtgctgtgctagggtgtccgcgtcggtttctttgaatatgctcatgagagtgttcgnnnntatttca

SEQ ID NO: 2375 - DNA, 374 bp, Glycine max
ctacacttttcactaaaacaaaattgattaatgttagggttttggaaagccaatttcagagcagactcgaaaccctagattccacaaatccatgccagcttgatctcgcagcttccgtcaatggcgatcatcggcgacgcgcttcgccaggcgttcatgccgaagcgcgagtacgagagcctcagagaagaagacaaggcgtggggcaagcttcagaggcccgtgacggtggcttccgttgccgtcatcgtgctcgcaatcgccgtgtccactgttatcagtttgaaaatcgtgtttccgagtagcgatggaagaagagcgttttgcgtcgatcgaaggcttcaacctattcaaataggtatgaaaggcggttc

SEQ ID NO: 2376 - DNA, 668 bp, Glycine max
  misc_feature (556)..(565): n is a, c, g, or t
  misc_feature (606)..(608): n is a, c, g, or t
  misc_feature (610)..(613): n is a, c, g, or t
  misc_feature (627)..(633): n is a, c, g, or t
  misc_feature (646)..(646): n is a, c, g, or t
tcgatgtgagtctctagttagtggcatgtttggtgataaagctatgcaattacaatgttgttttatgtatttttttagtttagcggataaagctagacataacatagtgtctgcttttgtcaaatactatgtaagtgtgtagtatgtagtttatagtttttctattgccttgaatggaccatcccagggtcacgaatccacctttttctttttagatttgggggcagaattacgtattttgttgttggcccaaatgctatgaaagttggaagtctattatggaagtttcttgttggaccataccaaaacaagtagttgaggccagctagcctaatttagaataaacaaaaactttgattaacgtgttttccatattactcggttaaaattaactcttctaggaatatttgtaactataggtcttagaattccatacaatttgctagctttgaaaggaacttcctaggtctgatattttctgatgaaaagtttgttaaaaaagttttttgggggcatagacaattgataaagttgtgtgtaaaataacaggaaaacnnnnnnnnnngctttgaggagttgcaacagttgtttgaagacatgtttgannnannnnttggattggacggnnnnnnntctcttgcttctnctgattgctcaacttcatctgc

SEQ ID NO: 2377 - DNA, 336 bp, Glycine max
gtcgctttttgataggcgttgcgttctttgtcagtttctattgccgaaggacgtgtcaacgtaagcgtgtacgaattgcaatgttgagctcttttgtcacttttgtgacttgaacagctacgcaatatttcattcgtagtctgttccatggtctcgttgtgccattcctttttgttcaatttttttttttattaacgttgcttcttttggtgaactctcccttattattccatgggggttgttctagtttccgaagcatatataaattaattcgtctcgaataaccggttttaaacagcgtggtgtaatcttctctaagctaccctatgctacctg

SEQ ID NO: 2378 - DNA, 405 bp, Glycine max
atgtcttagagttaaaaataaagaagaggatccatagaccataggaaactctgaaattgattgaatgatgtgatatgatatgcagataaaaagagcttatcatacatttatagcaagaaaagttacagaaaactaatagatgcagcagctgaaacagagaaccctacttattggcaatataaacactaatgtatcatccttactcttagactggttcagtaaccacaacatgatagtttcgaaaacaaagttgaagaacagttcgtgaagtattgtagtttcacttttgattgctttactactttcctagtgcttttgcgacatgtgtgttctaatacaagaccctgatgtatatggtatacttgaaatggtggaactaatgtctttgtcaattcccttctttcg

SEQ ID NO: 2379 - DNA, 361 bp, Glycine max
tcctagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaatggacccagcaaagtggttttcctatgatgtctgcttcttctctttcacgtttgtctgctttctcttcttcttctccttctccttcttctggagcctcttgggttggccacaaaagaggcagagaagaagaagagaatagtacttcacataacttgatgcaacaacaacaacaaagtgctccaagactcttcagaaacaa

SEQ ID NO: 2380 - DNA, 631 bp, Glycine max
aataccttgattaaatatttatatagtgaatagcagcaaagtggcaggagcttgcgtctgcaaattctatgttgtttgatttgcgtgagtgaattgggaagatgctgtgtctgggtcgattcggcggggtctcttacggttggagttggaatcggaggagggacaacaccattaacaggcccagatggcgtttgatggcccaggaatcaccctctctcgactcagacaaaaccgccactgctgggtccctctccttcccttttctcttctcttctcttctctttctttcgctttttcctttcttcattcttcctttctattctctccgcagattctgcatcattgaaggccccgaaactgtacaggattttgccaagatggagcttcaagaaattcaggacaacattcgaagtcggaggaacaaaatcttcttacacatggaagaggtcactccttcttatgacttcttatatacttctgctgtttcttggagcctttcattccgttggatgttctattactttttcttttgctctatttttttttataacagatattgagatggtcttcatgcccttttctcaaacagcttcctcttattttgtaggttcgcaggcttaggatacaacaa

SEQ ID NO: 2381 - DNA, 623 bp, Glycine max
tgattgttctcgtatatatagactttgataattaggtaaatatcatggttcagcagttgctagttgctgcataatacctcacacaaaatactagcattgagcttctaggattatatatatagatgagagttgtggaacggggttactgggtactactaaataggcatatccgtgtctagaatttagcaacctcagaagttatgcttttttccctgtcaaactttggtagatttcatctatttccacctgtgacaatatgaacaattttgtgagtatttctagtgtacaccactatttaaatagactgcaataaatgagagtaagcaaagtaaggaccaaaataagaggatatctgatcacctgataatacttgagcagtttgtttcttttcttcttcagtgttgcagtcaccaaatctctttccatgtcaaattcatgcggctctaatatcacccccttgatatgttcaaagcccctcagctagttttatgaaggacaaaaaattgaagaggacacaagacaattagagaatcatataccagatgttatatgattgcaagaccaaagtctttctagttttctgtttgttatgtagcctccatgcttcatagtttataaatctt

SEQ ID NO: 2382 - DNA, 559 bp, Glycine max
  misc_feature (9)..(9): n is a, c, g, or t
ttacatcancaattgcaaattgctgcaaaggtggggtgctcagttcatgggcgcttgatccaaccaatgcagtttcatcatttcaagtcagtgttggtagagctggaaccacaaacaaaactgtcaaagtccccaaaaacttcaccttgaaagcaccaggaccaggttatacttgtgggccagccaagattgtggcacccactaaattcattacttcagacaaaaggagagtgacccaagcactgagtaagtcataggactttttatgtcattttcacagatctcaatatgattacctatttttctcttgcctccgaccaacctcaaacacttcttttaacaaggttttgttggtaacaaaatctgggactcgtgttactaattctgtgcttaaatttaaaacaactgaaaattacagttggtacctgtaactatcagctaattctagcaatctgttatatccttaacatcactcttgttttttgcagtgacatggaatgtgacatgcacatactcacaatttctggctcagaaaactccctcttgttgtgtctcactt

SEQ ID NO: 2383 - DNA, 366 bp, Glycine max
tcggatggcatagtccccttttcccctggtaggattggggctccgcaaatatttgtaatatgtaatcagtggtcccaagctttggatagaatatctgaaaaggaagttgttgattccatgcatgtatttaccatgagtgtgcttcagatatgggaacaagataagctagaaatgcataggcaggtgatgaagaacaaggatcttgagagaaaagtgagaaatatggatagagatgaccagaagctgcagaagcaaattcaagcgttagagcgaaaggtggttctggtatctggagaaggcaaaggtctctcagtttctgagaatatcatatatcagagtgacaaaagcagcagtctacaggctagc

SEQ ID NO: 2384 - DNA, 723 bp, Glycine max
  misc_feature (55)..(56): n is a, c, g, or t
  misc_feature (709)..(710): n is a, c, g, or t
agctgagagggctaatttgttgtagaaaaagctgaacaagacaaaagaagtgctnnccttagagctcaggtaaaaatagttgtcccatttttacatttaagaggattcttaatatttctacaactggctaccatactttttattatttctgaattgctaccaagccatgcaaattaaataaaaaaagaaaattgacatcgtgaatgttactaataactagtttagaacttcatcaacaccaagaaatattaatgaattttcttctactctttgcttccctgccctcttgaatggccctctggtggtgatgcatggatgggctatcagtgaaggacatcaaatttcctttttagtggttcctttttttctacaaaagaatacagagggctatttttcaactctattgtttatatatatatatatataacctgttccttcccttctttttgacaaacagggtgaagccaagagtgcccagttgattggtgaagctattgccaataatcctgcgtttatcaccttaaggaaaattgaagcggcaagggaaatcgctcacacaatttcaaattctgccaacaaggtttacttgaattcagatgatctcttgctgaatcttcaggagttaaatttggagcccagtgggaagagatagttgtgagaaagaatttacttaattacttaaacctctttttccctagtatcattcatnncacctgcatggcg

SEQ ID NO: 2385 - DNA, 1033 bp, Glycine max
  misc_feature (982)..(987): n is a, c, g, or t
  misc_feature (1025)..(1026): n is a, c, g, or t
agtagctttgaatgctgttaactctctagaaggtgctggtgtgtttgcatttgaattgttcttgactaaggatggacaggttgtgacttttttcttcatcaactctggaaatgcctcaatgtttttgttttttgttttttcttgactgctgaattgacttctttttacaagtaaattttctgccgttgcaatgcaaatgcattatatttgtttgtcaatcccctgatagtgaccatgcctgtgtttcttcacagattttattaaatgaagtggcacctagacctcacaatagtggtcatcacacaattgaatcttgctatacctcacaatatgagcaacatttgcgggctgttgttggtcttccacttggtgatccatcactgaaaactccagctgctatcatgtacaatatattgggtgaagaagaggtactatcagcataaagtatttccccattttccattcctttcacctttgtcattaatctgaacaaaagtctggttttctcccatacctgatgaggtgatggtattatatttgtttgggattcattattattattattatttggtccatggttggaagagagtttgaaattgaacgtcagaacgtaagaaagtcaaattagatgtaaaatcttctctgctgtcatgaacctgcaaacaatgattgactttttttcatgttatatatttggttcatagttggatgaaggttatgcaattaaaggctgctgtctgctgagtgctccttttaattcatttacttgttttgaaaagatcattctctttagttaccattgtttcatactctagtctgttaaatttgctaaatgattttaggggggtcttggttttcaattagctcatcaattgatcaaaagggcattgaccatccctggggcaactgttcattggtatgataagccaggtaaacttatagttaagcagcaatttcaggttgattactcccctcttgtttnnnnnnaatcacttgtattttttttaaaaggcatttaatcactnnatgacta

SEQ ID NO: 2386 - DNA, 377 bp, Glycine max
taaggtcatgctgaaatttcgtctagggacagatttgcaacgggtaatggtattcccatttctataagatgtaagaagttaggcaacgaggaaataagcatgcaacgagatcacaaccggagagataggttgcagcagacatttagggaaccaccttccatggagcttgagccaaagcgccttaaagtccgaggcccttcatttttaggcttagagagcagcagatcgaattgatgtttcaagttggctcgaaatgactgtggaacgccatcaagagtctgactttgctaacttcattttagcttattggctttctaacaatacagtaaatccaaatgattgattgagggaggaagcagcggcaagatattaacgta

SEQ ID NO: 2387 - DNA, 392 bp, Glycine max
actacttactcagctgcttggggtacccgtaacattgcagacaaaaattcaatttaggtgccggtcacataaagaaggttgtgcacaaatcttacacaaacatgttttttggatggcaaaagcttcttctgttgactggtagagtctcatatccttcatcttgctcatggtttggtttcagtggctttcaatagcatgcttgtattatgttaataaaatgccacagtttggtttcatgtgttttagtcggagtagtgttgataaaattcctggttgtatgtattgtgcttcaaatttcaatttttaagttggaaaaacaagtgcttttactttatttacctatgttgccacctggtattgtacaacttgtagacttgatgaaattggactgc

SEQ ID NO: 2388 - DNA, 448 bp, Glycine max
tccagctacatttcttcatgcctatacttgtctacctcttgcatatgcaaccaggcaagctgctggtgctatcttgcaagacgttgctgattctggtgttctgtttgctattctgatgtgcagacacaaggtttaacactgaatttgtctagttgcatgctaatataaaatgataaaataattcattaaagattgaaagcaggtaatcagtctagttggtgctcagaaagcctctcttcatccagatgatatgctgctgttggccaactttgttatgtcatcagaatcctttaggtaagcagaactgacactattttatcttttagatagcatctcagagatggtttgatagtatagcttacttttcattcagtctagacttctagttgatgtttgatggtatagttttctatatattcagtctgcttgacacaaacaataaaacttc

SEQ ID NO: 2389 - DNA, 347 bp, Glycine max
atgctctactccaaagatcagaaggtagcaagtcgtgtggggcataaagtcctagataatggtaaaaaagtccgctaccttataaaaactggagaaataattgatagttcagagaactggaagaaactgaaggaggctactaagaaatctgaagaagctgctgctgctgctgcctagttttacttatgtaattcattcattcactggtaatgtaactctagcaatactagttgtgatctctgctccattttgtgatctaatgtatatttgtggtctgtctattgatctccataaaatgaaacctggctgatcaaatttgtatattgcttgttgagcaattgagtaaa

SEQ ID NO: 2390 - DNA, 355 bp, Glycine max
tgctgctagctccaaccccatttccattattgggaattatcaacagcagacattcacagtggcttatgatgttgccaattccaagattggatttgcacctggcggctgccagtgatcacaaagctagccagccaaggattcaatttgttaaatattacttgcttgcaaaaatatatttgctttaataaagattgatgaacaactgatgtggcatgtgatgtatcttagtgagcaaataagacaaatgacaattaaatgctcacatgaaagttgcaattgtattagatttattggaaaattttactttggaagtaaatagtataaatcgcatagcggcatgtatagctgcatatta

SEQ ID NO: 2391 - DNA, 412 bp, Glycine max
  misc_feature (375)..(375): n is a, c, g, or t
  misc_feature (377)..(377): n is a, c, g, or t
  misc_feature (381)..(383): n is a, c, g, or t
  misc_feature (393)..(394): n is a, c, g, or t
  misc_feature (396)..(396): n is a, c, g, or t
  misc_feature (401)..(403): n is a, c, g, or t
tcgcttccgcagcgaccagtcctccccggaccgccaccacgacatcgagatgggcgccaccgcctccggcggcggtcgcggcggcgaggtgaaccttgacaagttcttcgaggacgtggaaggcgtgaaggaggaactaaaggagttggaaggtttggctcagagtctaaggagcagccacgagcagagcaagacgctgcacaacgcgaaggcggtgagggacctgcgcgcgcgcatggacggcgacgtctcggcggcgctgaagaaggcgaagctgatcaagctcaagctcgaggcgctggagcggtccaacgccgcgaaccggaacatgcctgggtgtggaccgggttcgtcctcggaccggacccggacctncntggnnnacgggctccnnanaaacnnnaaggatgct

SEQ ID NO: 2392 - DNA, 416 bp, Glycine max
attttcagatggatcagccccttatccttctgacaatgttttgagcttttgttactcatgtaataagaaattagtgaaggaggaagacatttatagatacaggtttgtcccaagcatttctctaagctactgttacttcagttgtgtcaaaagcattagttgtaatatattgtatatcttgcagaggtgagaaagcattttgcagttttgaatgtggatcagaggaaattttgacaggggaggaattggagaaaacttgtactaactcagcagagagctctcctgactcaagttaccatgatctcttcctcacgggtctgcttttgtccaaataacatgctttctttttacttcgttgagagatactgtgaataattttgtttacaaacagcttcctatgtggatttgtttgtgca

SEQ ID NO: 2393 - DNA, 490 bp, Glycine max
tttgccattcgtgcgagcattgtttggaggtctacgaagactgtgctccgaagaaataaacatggcatcaaaattgtttaactctaaactatcttcagagctgcacaagctaaaccaaagtttgcctcaagccaaggtggtgtatatccatatttacgactctttgctcaatatcatccaaaacccaaccaaatatggtacaaatctattcctaggccccttccctttctttcacaaaaaaaaaccttgtgttaaatatttacacacatttgttccaatcctaaatcctttaattgaatttcaggatttgaagttgctgacaaaggatgctgcggcacagggactgtagaggcggcttttctgtgtaatatgttagatccaacaacctgctcagatgattctaaatatgtgttttgggacagctaccatcccacacagaagacataccagattcttgttggtgaaatcctcaacaaatatacaagcaact

SEQ ID NO: 2394 - DNA, 388 bp, Glycine max
gaatgtggtcaggaaactcttcaacaaataggaagtcttcctgctccgcctttggcattgatgcaagtcaaccttgatgagaaagaaaggtttagggatctgagggctcagaagagtcttaacaccataagccctagctcagaggaagtgaggacttattttaggaaggaggaggttctcaggtactcaattcctgacagagccttttcatatactgcagctgacggtaaaaaatctattgtggcacccttgagaagatgtggtggtaagccaacatcaaaagcccgagaccattttatgttgaaacgtgatcgcccaccacatgttacgattctttgtctagtaagagatgctgcagctagattacctggaagtattggcactagag

SEQ ID NO: 2395 - DNA, 750 bp, Glycine max
tactggtggcaggaagtcatgctgacatttgggttatcaatgtggaggatggacaattacctggcaggggcttggtggcaataatctcactgttggtaagccaacatgcttaatttggtgtgtttaaaattactctgaaaactagaaatctctttccgggtgacttaggagtgtgtatataagcttacttgaactctactctacaggataagtaattagtgttacatgttaaaaagcatcaactttcaacagtcttaaaggtgtatttggttttccgttcaaaagcatgaaacaaacatttaatccaatgactccacgtccatgtattcgcttgaacatgccttggaacatgcatgcaccaactgaaaactaatcacacactaaaacctacatgggttaacataaaaccactcatatacacagcaacttgagatatttgatcatacgtttcttttctaggaaagttacaaaatattgaagaaaaaaattccattttccatgcaggtacaacaatccttgaggctgtaaaacaaacgattgatcctgctactaaagttgtcttcaatgaaaatcccgactccaactttgtcaagtccaacaacttctcttgtgccatagtcgttgtaggtgaacacccttatgcaacaacatttggtgatagtttgaatctgactattccagagcctggtccaagcaccatcaccaatgtatgtgggtctatacaatgtgtggtagttctcatcaccggcc

SEQ ID NO: 2396 - DNA, 784 bp, Glycine max
  misc_feature (743)..(746): n is a, c, g, or t
  misc_feature (748)..(750): n is a, c, g, or t
  misc_feature (759)..(764): n is a, c, g, or t
gtttcgtatatttgttgtaccatgcactggatatttcataccttaacagtaaatttttttcattctaatttggcggaagaattcttgttttgtttggaagatatccgctgattggtttttctttgtttagacaatggatatctcaaagatggctcctggagatgcttcattcacagtaccttttaagcttgtagctgaacgtgacgactatattcatgctcttgttgcatattttgatgtatcgtttacaaagtgtcataaattgatgggcttctctacaggttaattccattttacttcccaagttctctttatctgagtctttggttttgtctattacatatttacatctagtagagatgcaagtaaagttcctcttgctgtaatgtaatctgttaattggcaaaaatatattttgtacactaaatgctacttcctgataaaaattaaatgcattagcttcttgaaaaatagaaaggggagagaataaaattagaaaggatgaacaataagttggttcaatggtgttttagaatttgcatgtagaagtttcatcgaacttcaacatttgttctgaactaaactgaataaaattgacgtttattttgaaactatgctggatttatttgctccaacaaatggttgccgaaacttgtgtggaagcattcttccacgatttttattgtttgtcatgagacgatgcctttgttgtaaaagtcagggaaatccatttgagtgggggnnnntnnnatgcttgtnnnnnnactcaccttttgagcattta

SEQ ID NO: 2397 - DNA, 380 bp, Glycine max
gatatatggctccagaattgttttataataatattggaggaatatcccataaggctgatgtttatagctatggaatgcttttgatggagatggcaggcaagaggaaaaatctaaatccccatgcagagcgttcaagtcaacttttctttcccttttggatttataatcatattagagacggggaagatatagaaatggaagatgtcacagaggaggaaaagaaaatggtaaagaaaatgatcatagttgcactttggtgtatacaattgaaaccaaatgaccgtccctcaatgaacgaagtagtcgaaatgcttgaaggagacattgaaaacttagaaatacctccaaagccaactttgtatccaagtgaaacgatcaca

SEQ ID NO: 2398 - DNA, 496 bp, Glycine max
aaacaaatcccacttttcaggtgagcttaatttgggaaaaacaggtgaagagtccttaagtgatgaagagtgtgttaagaaaacacattcactccttcgtgaagtacatgaagcaattttcaatgaacaggtaatttgttctttcattattgttgttgttggctttgcttgtctagtttgtccaatattcttacttgaacatttgctgttggtggtttgttgctttggattcttatgcttccaggtgtttgatctggtgaatcgagaagcatttaacacagttgcaggtgtcagtgtgactggaatacgggaaaattatttacaattaagcttaggtcaagaaacctctgtgtacttaacactagtgtccaatagtcaagatcattctacagttgaaggtgaactcaccgataacgcagaaaatgcaattttacctctggaatcatctgatggaatgaagcgtgaagccaaacagaacacctctaacaaagggcag

SEQ ID NO: 2399 - DNA, 387 bp, Glycine max
cagctggtgattatatgctcaaacctctcggttttgattggattaaaagttcagtgaaaattggggagatattaaaggatccaaatagtcgagttaggaaggccattgataacgagtttccagaaggtgataaaccctttgtgtgggccttcaatcttcaagtcccaaccaaggataactatagtgccattgcatattttacaaccaaagagtcagttcttgaggattcgctaatggacaagttcttgaagggtgacaatgcattcagaaactcaaggcttaagctgattgccaacattgtaaaaggtccttggattgtcagaaaagctgttggagagcaggctatttgcataattgggcgtgccctttcctgtaaatattgcacag

SEQ ID NO: 2400 - DNA, 858 bp, Glycine max
ctgctctcagtcctatctgaagaccctttccacgttgagttttgcaggtaccataccgcctcaacttctctttattattactattttttgttcccaatgttatattattggaagattttttacgagattcgattagttccacttagcagtttaatttatattaattttagtaaataccttatgcttggtgggaaaatattgaattgacgctgttactggaaacactgcctagtgtgcatccgttgaaactcagtggttcacccttttgcaattctgttggtgcagattctaagacactcaaggaagagaagagggaagaattgtttgaaactttaaaactcaatgattctattggatgggatgttgatgtcattgacccccgggaactctccgctaaaatgcttaagaagtaaatcaatatagcttactccttcaatgtttcactggaattctcttctatttcctgagtgctcttcttgttgtaatttttgacaggaataagattaacttgaatgagatttcacatagctctgccatgggcctcattgatagggtactgaaaatgggagtgcttctaactgaggtaaaaacctcgcccaacttatatgtaattattaattaatataaactgtaagctgattctgtggttcatctatagctcaaatgattagaggttcaatataaggctggtgcctatagcacctttttgttcatgattttcactttcaatgagagcagtgtgcttaatttcttcccttggacattaagtggaattaagtgccaaaagagagtatatagggtgtggtattaagtagtaagcagacgataattcaattactgagggagaagtgcataatt

SEQ ID NO: 2401 - DNA, 378 bp, Glycine max
ttttacaagtatttggagatgggtctccaaaatttcgaggactaccaggtatgtgctatcacagtgggtgtggttggtgatgtatgcagagccttggaggagaaaatactgccttattgtgatgggataatgacccaacttcttaaggatttgtctagcaatcagttgcataggtccgttaagcctcctattttttcatgttttggagacattgccttggcaattggagaaaactttgagaaatacctgttatatgcaatgcctatgcttcagagtgctgcagagctctctgctcatacatctggtgctgatgacgatatgacagaatacactaattctttgagaaatggaattctagaggcatactcagggatcttc

SEQ ID NO: 2402 - DNA, 724 bp, Glycine max
actcttcttctagagattggtgtcattcctcaggtaaagtatatagtatatatgttctctcaattgagctaacactagttaaattaggagcataattctaaaaacttaactttaaaagaatatttgatcataatcttgtaggttgctagtgctacagcaacatttgtgatgatggtttcatcatctttgtcagtggttgaattctaccttctcaagaggttccccattccttatggtaatttatataaactcttggtagttattttcttcaatttgctaggccattaatactatcaatctagagtctcttgattttgatgtgatcttatttataaatataagcataataactctagcatacttcattgtatttctttgcagcattatacctcacctcagtgtctgttttggctgggttctggggacagttctttgtaagaagattgattacatgtcttgggagggcatcaatcattgtattcatcctctcaggtgtcatttttgctagcgccctcaccatgggtaaagaaaactaaaccgacctcatctattgatctatattagttttctgcttaagtactaactatatattaatgtaagtatgtaacacattttgcattgaagtgtctaattgtaacatttttttttcaggtgtcgttggcattgagaacagcattcaaatgataaacaaccatgagttcatgggattcttaggcttctgttc

SEQ ID NO: 2403 - DNA, 685 bp, Glycine max
gccgcaaaggcgccactgccggacgctttccttcagttcctggagaccaacgggctcgacccttccatttacactgctattgattccaccccacgatacattcggtaattccaattttcaccattttctcaatctccttgcttcacttcatgccttttaatttgaaacttatttttcttcttatcgtgccttcaaaggttgaaacccggtttcgaatcatgtattgaagaggttgaagcagaggtgaaatgcaaactcgaaaaattagagtggttaccgggattttactctcttccacctcacgttcaaattgctggttctagggcataccgagaagggaaggtaactgatcatggaatattagtttggcttttcatagatcaaccaagtagtttggttgctacaaattttatttaaaactcaggtattgttggattttttatgtgtcagatatatggaattgatgcagcttctggagctgcagttatggctttaaatatatcacctggggatcatgttctcgacctgtgtgctgctcctggtacatatttctttctttacccactcatgcttgtattctctatcttcttattgttgaaaaacaaatgagtgagattaagattgctttatttcaggaataaaatgtataaaatggttatgtttcaatgatgatttttcatttttt

SEQ ID NO: 2404 - DNA, 386 bp, Glycine max
atactaacactttcttcaacccatgcatacatgaaaaattaaagcaagccttaattagataaataggaaactatactaaagtgcacttgatccaatcaacttggttaacccaaaagtgattgccatggccatccaacccccaaacaagaccctcaaagcagacctcaacactggagccttacccaacacagcccctaaccaaccaaacaccaccaaagcaaaagtcacagcagcaacaatcactccaagcctcaccttatattcccttataaatgacgctgcaagcaatggcaccattgcaccaacagaaaaggccaaagctgaggctgctgctgcttgcaaagggtttggcaaactctctttctcttcattggtgtcttcctctg

SEQ ID NO: 2405 - DNA, 1040 bp, Glycine max
tactctacaacttcagataatgttgaaaattgaatctcttctttcaagtgcaaattttaatcaccttttttctgatttttttttatgaattgcagctttcaaacaaccaggaccaccccggaaaccatgatgaaattgacattgagttccttggcaccactccagataaaccatatgtcttgcagacaaatgtatacataagaggaagtggagatgggaatattattggaagggagatgaagtttcatctttggtttgacccaacacaggattttcacaattatggcattctatggaaaccgaatgagataatgtaatgttttcatgcactctcatgctcataacttgaccaattttcaacttccttaattatgaatttattcgtccacgcgtacatagccatgcctatattagtgacacatatgaaatttgcactacccctccaagaatctaacttaaaagaagtgtctaatcatgaattgtcacctagtaaaattgttgacttttttccatagctactttaaaagtatgataatttttaattagccaatagggtaaaaaatttatactctaaagcccaatttcaacatatgtgaattatgcttttatgtgtgtggcttaaccactatctagtcagaattgcttacgtttcctcccaattattaagttgaaaagatgatattgttttacgattattttacaatatgatcccgtctaatagcccttctaactttttatgaatctatatcaatagagatgaatcatagatatagcaattttcattcatagggcattatgaaatgatgacaaggaattttcacgcgcgctggctactcacatgattgtgatatatagagtcttgcttgaggaacttgattattgtatgttgcttactactttgtcttataatggaaataatatgtgcagattttttgtggatgatgtccccataaggaggtatcctaggaaaagtgatgccacatacccctcaaggccaatgtatgtgtatgggtcaatatgggatgcatcttcttgggcaa

SEQ ID NO: 2406 - DNA, 850 bp, Glycine max
agagaagcagaacgcgaaggcaatagatgaggaacacgacgtagtaaattttaacggcgcttcaacgccgtccctcgttttcagcagcgacgacgatgaagccaaccaagatctcagcctcaagatcgtcgaaaaggccatgcgaatgcgcgccgccaaacacgccccaaacgacgacgtttcttctccgttttcgcagaaatccgaactcgcagtgcccctaaacgacgtcgtttcggatttgcccagcgcaatcgctgattccgaagtgacggaaaagaagaaaacggccaagttgaagagggaggcggctggggatcaaagtgtgagtcttatcccctgtttggcttattccttttttgaataaaaaacgtttttttacactatttcttgttattctcacgttgatttgaattcttctagtctcaactagattctgattaaattgaaagttgaatcagcggaaaatattgaactgaaattatgaaattttatttataaattgtattgcaacatttacctgcaaaaacctctttatatcctaaacctatttaacccaaaatcaaggttttaaattatgggagatataaggttggttcagtggttggggagaggtagtggattcgaatccctcccacttacatttctaacaaaactaacaaattaacattttctgataattaaaaaaaagaacaaggttttaaattgtggtggtggttgcagttttgtcacggataaacctcaaaaaccttgacgtagcaggagcagccaaaatcgtgatcatggactgttttttgaaatctcttttaatgtaattgaaccaaattcaaactcccacttggacaatcat

SEQ ID NO: 2407 - DNA, 1124 bp, Glycine max
  misc_feature (1111)..(1116): n is a, c, g, or t
ggcttctttcacctttttttgcttcatgggacttttgatgaagactatgttttgtgttttttctcaattggctctcagaattttgttctttcactgtgtgtgattgacttcaaagtttgaatttttatgcttgcaatggaaatgggtcatgcaagttttattttttaaaaatattatgtaggggtggcttgtttttgtttttttccttgctttaaggtttgtgttgggttatttgttgcattctttttgtgggttggaattgttggtagaaagtgtttgcagggtctttaacttagttaggatggttggatcttggtatgtttgattgctcgtgtgctttcccattgatggtgtttgtcttaatgggggtgtttgggagttgaatttgatgcttttgtttgaatttgtaacttgcatttagtgtgtggagtttcatctatatgtggtaggttcgacttgagaagtgtgtcattgaaatagtgcagcttagtctttggatgagaccattagcacttggaagaattgtgattgtagtttgcagtctggtattggtaatgaaaattggtcgttaactgtgagtgattttctgatcctgatgcatatcaaagatttcatcactaattttgtcaaaatcatggtcatgatgaaatcttttcatttttgcatagaatcttgtaagagattgatctgcataggcttaaattttggttatgcaattctaattctgtcttgtataattactatactctgcagtctaaacccttgaagaatttaaatggtcagatttgtcaaatatgtggtgacaccattggattaacggctactggtgacctctttgttgcttgtcatgagtgtggcttcccactttgtcattcttgttacgagtatgagctgaaaaatgtgagccaatcttgtccccagtgcaagactacattcacaagtcgccaaggttagcttgtgcataaatgttatatgttttggtctttccctcatcggaatttacaatgaacaagatgaatctggatatcagagggtgctgaagtggagggagatgatgatgacgaagacgataaagatgatctagataatgggatcaactaggccaaggaannnnnnccaagtcg

SEQ ID NO: 2408 - DNA, 289 bp, Glycine max
cgataatgacctttacataatgtaaatggcatttgattcttcttagatcttgcttgcttgcttgatccttatggctcagttttccatccatggatagtcctgtgactgaagtcgcacaggatacgtgatctatgatgcatcatcatatgtagcttaacatctttttttacatttttgttctttccccctatttttggacactatcaagataaactattttgtgtggaacctaccttaattgttgcagttttgttcccaaaccaaggatttaaaaaaaaaaaaaaaaaaa

SEQ ID NO: 2409 - DNA, 491 bp, Glycine max
ttctggtcttatcgctgttgaattagtcacattctacatttcccctaattaccaattcaatatttcactataataggcttcctaaattgcctagtagatacctggtatacatattaacaaccataatgacaaacctgcattttaaagttttgtagaagtttgtcaaattccatcctaactgttttggagtacaatattcttcctgtatgagtatgcagaatgcaaaattagttcccaatggtttactttttcggtagttagagtttcaactactattttttgttgtgtgagaatgtgattgggaacacttatatcagtaatagataacatacagattcttatgttaaatgtgtttgtgaacttcattttatagattatgaattattgaactggtaagagatgaagtaatttttatttgcatgtttgggaaattgcagactctccttaatcccctgtacttacctggctcccggatcacgtcatcacatttt

SEQ ID NO: 2410 - DNA, 465 bp, Glycine max
  misc_feature (424)..(460): n is a, c, g, or t
ggtttcatcgttggtgcgaacatcttggcggggggtgcatttgatggtgcatccatgaaccctgcagtgtcgtttgggcctgctgttgtcagttggacctggtctaaccactgggtttattgggtcggcccatttgctggtgctgccattgctgctgttgtctacgagattttcttcattagcccaaacactcatgaacagctccccgtcacagattattagagcttaactctctgccttcctttgttgtcactgctctgtgtttttttgttttgcatttgcttgttttcaaatgttggttctctgaactttgtaacatgaacatctttttctttttttttcattatgaaatgttcatttcatctaaactaaaattattgtgttagccaagcttccttgaaattatcccaagatcacccttctnnnnnnnnnnnnnnnnnnnnnnnnnnnnnnnnnnnnnaaaaa

SEQ ID NO: 2411 - DNA, 414 bp, Glycine max
agttagcctcttcatttcattttcttctttcctcaaaaagactcaacacacccctgttttatgctctctttctgtcacttgtgtttatccaagcacaccaaaaacagagaaaatgaggatggattatttgaagcaaaagtttcccttcaaccacagaaacctcttcctcaaattgctcctcacaatcttcttcataggcctcgctttccgcatcctcttcttccactccctgtcccctcagatttcccctgttttggaatccccatttcctgagaaagtgacattaccagaacctcagacttcaactgttccagaagaagaacatgttcccgaacctccacctgttatagaacatgtttccgaacccccacctgttctcgaacatgttccccaaactgaagatcaactgtctca

SEQ ID NO: 2412 - DNA, 391 bp, Glycine max
ctggccttggatagaaaacttcataggagatgtgatactcttctgtctttgcaacacccccctacatacactgttggcaaaaggcaaactgttcacaatttgttaatcccccaatcagaattggagaaaattggagctgaacttcactacacacaaaggggaggagacattacatttcatggtccccaccaagccatcttgtatcctatcatatcgctccgtgacataggacttggcgctcgaagttttgtagagaaaattgagttaaccatgattaaactggctgctatgtatggtgtgaaagcttgtcctggacaaagtggcgagactggggtatgggttggagaaaggaagataggtgcgattggtgttcggatatcaagtggaatca

SEQ ID NO: 2413 - DNA, 368 bp, Glycine max
  misc_feature (349)..(350): n is a, c, g, or t
  misc_feature (365)..(365): n is a, c, g, or t
cttgtagagtacattaaaataagatatcgtaatatgcccatgtatattacagaaaatggtgggtgaacattgattacataactacaaaaaaatttctgttttcatttctgctacgcacaatttttttgaaaaatgtcattgtcattgtatttctatttttttaatgaaataaaattaaacggaagccactctatcatttctactttatttctggttttctaatgtttgtatcggaatgaaagcatcttcgaaaacagaaacaaagaaaagggagttgtacttttatgattgttaatgaaaatatgaaatgaaaacaagaaaggtgtttccaaaatctcattttctcccnnttgtgttttaacctngca

SEQ ID NO: 2414 - DNA, 404 bp, Glycine max
tttacgtgatctttcagagggagagagaaaaaaatgcagaagcatggttttgcatcaaagcgtaacgtgttgccgtatcaaacgccgaggctaagggaccactacgttctggggaagaagctgggacaggggcaattcggtacgacgtacctgtgcacccacaaggttacagggaagctctacgcgtgcaaatcgatcccgaagaggaagcttctatgccaggaggattacgatgacgtgtggagggagattcagatcatgcaccatttgtcggagcatcccaacgttgtccagatacaaggcacgtacgaggattccgtgttcgtgcaccttgtcatggagctctgtgcagggggagagcttttcgacaggatcattcagaagggtcattacagcgagaaaga

SEQ ID NO: 2415 - DNA, 393 bp, Glycine max
gtccctccttctcaagcctctcccatcatgggcatctgagatgtggctgtttccccttttgttttctcaagagttgtctgtgagaacaatctccaagctgttcaggaactgtttttggattggttttctgtgtcaaattcccataggaatgtctttggtgaggaagagtctgacttcaagagtggagaatgttgaggacagccttgacatgtcagtgttggacttgcctgagttggccttggattgcattcttgagaggcttcccccctctgcactgtgtcgaatggccgctgtgtgccggtccttgagggagaggtgtgtgagtgatcacctttgggagaagcacatgaggaagaagtggggtagagttattggccctgctgcttatagaaa

SEQ ID NO: 2416 - DNA, 381 bp, Glycine max
agctccgaaaatgttgtgtgatctgcaatctaatgggagccacattgttgatgggaactggagggccctagggaagcttcttatatactgttcaggatgcacaaaaggtggcttgttcaatagcattcagattcctggtcactttgtttatcagacacgattttctagaacatcaggaaagagctttcttttgccacaatgcaggactgatgttttgtatgtatgtgatccttgtgagcatcttgaccaaggtgaggaaggagatgtaggattcttccgtggcattttcaagtcatttgcaacctcaaaggtcaggaagatgcttattaataaaggtgccaagctccatccaacagaagtctgcccttattgtaaggcaaa

SEQ ID NO: 2417 - DNA, 595 bp, Glycine max
gcgtttctgaagccaatgacttgtcggttaaatataatgaagctcttcaatccatgttaaaggaatggcaattggagaacagggacataggttactcttactttgatacttatgctgccatccaagacctcgttcacaatccaacttcatacggtatatattaacacattgttcaatatctatttacattatatatttataatcactttacaaaacttgttattaaaactaatccttaattaattactgttgatttcatgtttataataatttctaatcttatagaatatattaagtttagaaagttgctaagattgaaatgaggagaaagagaattttaaaggaattcaagacccttttttcaggatttgctaatgtgaaagctgcatgttgtggatttggtgagttgaatgcccaaattccgtgcctgccaatttcgagcatgtgttccaatagaaaagaccatattttcagggatgcattccatcctacagaggcagctgctcgcatctttgtggatgaaatttttaatggaccttcaaaatacatatctcctattaatatggaacagttactggccatctgaattggcagg

SEQ ID NO: 2418 - DNA, 305 bp, Glycine max
gaggaagtgatgatgacgacgacgacaacgacaatgaagaagatgatgacgacggggaagatgaggaggaggaggaggatgaggaggaggacgaggaggagacttcacagccacctactaagaagagaaagtgagaatattcgtaggagattgtttccaggcatttgagtcgagcttagttattaggacagataaaatagcaacctctttcagtagacctatcttgctttatttatatgtcaacgatgataattattatattatttctcattgtttctacgacgttaccttctttcagccagtta

SEQ ID NO: 2419 - DNA, 371 bp, Glycine max
ttctttgttgaacaggaacaaatatgaatacaagtttattaaggagatagttgaatcggtgtcaaacaagtttaatcatgatcatttacatgtttcggatgtcctggttgggctagagtcaccagtgctagaagtaaagtcgcttctggatgttggacgtgatgatgtcgtccacatggtagggatccatggactcgccggagtgggtaaaacaacacttgctatcgcggtctataattctattgctggccattttgaagcttcttgctttcttgaaaatgtgaaaagaacttccaacacgataaatgggttagaaaaactccaaagcttccttctttctaaaaccgctggagaaattaagttaacaaatt

SEQ ID NO: 2420 - DNA, 392 bp, Glycine max
ttatggggttcaatgccaaggacttggtgtataatgctgttctttcatttttcaatcatcaagtttaacactggatagaatgaatcaagttgtatgaaaagagtgccttcatgtattaggtagctatcattgagatcaatctaagttatctagtggagattaagtaacggctaattacaaaagtaatgaagtattaattatcactagtgatttgctttggtgttgcaaatggctattgcatctatctattgtgttgcattgtaatgcagaggaaagtggcttttggcttcagttatctaagatgaaaaacgtggatgagatcatttatcaaaagaattataaaaactatgtttccaaaccatgatgaagcatatgtatatgtatgtgtgcaa

SEQ ID NO: 2421 - DNA, 549 bp, Glycine max
aatcgctctgctggttcatcaggtttgctatttctcttaccacatcacattccatttgcagggctctttttcccattcaactgagccgtgattttttaaagaaaaataactcttgtcatatagctttctgggaagactaagttaaatttatttcaggaatacatgattgcgagtcaccagaagataaatctaaatgggaatgtgtaagaaaaggactttgctgcatatgctgtgaaagcaatatcgattctttgttgtacaggtaatattcataaccagtaggacagatttgtagccagtttgcatctcaacctgattgtaatcactaagagtatccttgtgcttctgttgcagatgtggtcatttgtgtacatgttcaaaatgtgcgaatgagttgcttcaaagcagaaggaagtgcccaatgtgtcaagctcctgtggtggaggtgatacgtgcttattctatacaataatttgacattaatataaaggtcacacttttaacaaaatacaggattctaacaagttttatttcctggacgtttccagg

SEQ ID NO: 2422 - DNA, 347 bp, Glycine max
gacgtgatcaactctaccatatgatacgatgatgtcttatctttttcccttagcttcttcctcttacactcattattatttcatcatcaacaacaaggtgactattgcatctgcatgtcttccttcctacatcatcaaaaaaccacttggatttcacccttcaaacctccacaacaagtgtttctctaagtccaacgcctccacctccactctcacgggcaaggcatcatcatcatcatcaaccatgatggactttgacttgtatgaccttctgggcattgacagctcttgtgatcagacacaggtcaaagtggcgtatcgctctcttcagaagcgctgccaccctg

SEQ ID NO: 2423 - DNA, 409 bp, Glycine max
ccattccagaggctcgtcagagaaatcgctcaggatttcaaaaccgatctccgctttcagagcagcgccgtttcggctcttcaggaagccgcggaggcttatctcgttggactctttgaggacactaacctctgcgctattcacgctaagcgagttaccattatgcccaaggacattcaactcgctcgcagaatcagaggcgagagagcttaagtttagggtttcgtgtcatttgacattaaaattaggttactgcttattgtaattcgtgttttcttcaaatgcctctttattgtaagattcatcttatttcatcaggtatattcccatatggatctgcacaactgagtttatgttgaaaaacgagataattctctaattttatatatccttcggtgatgatagcaaa

SEQ ID NO: 2424 - DNA, 439 bp, Glycine max
cagtatgattattaccagagggttttgaacgggatattgtgaaatagtttgtcgatggtgatcgtttgcttgttcccttttgactaagcttgcacggtgattgttcatcaattagtatttgcattttcaagtcattggaggatggttggttcactgtgttatggctttggagtactttgtgagacgtaagaattaaaaggtggcagtgtgcagcgtctattctcctgtagtagtgagagattctgactcgcaaaagtacttcaacagtctgaggctaaattttgagccgagtccttttgattttcccatccctgtttcttgtgaatgaagctctgctacctggagaaattgcatcagcctcctaaatgctgagtttgtacagtgattttagcgggagtacggaccagattcatattggatgccagattcatattggatg

SEQ ID NO: 2425 - DNA, 644 bp, Glycine max
  misc_feature (554)..(558): n is a, c, g, or t
  misc_feature (598)..(599): n is a, c, g, or t
  misc_feature (603)..(604): n is a, c, g, or t
  misc_feature (621)..(625): n is a, c, g, or t
  misc_feature (637)..(638): n is a, c, g, or t
  misc_feature (640)..(641): n is a, c, g, or t
tcttgggcaattcagacacaacataaaagaaagctaagttttacacaagaaatttggctaaggaaatccagttacaaggaccaacatagagagagtggaagatgggtagagaagtgcacattacccgtgcactccatcaatttattgtattttttagctatagcactagacctagctagttggagattcccaaaaaaggagggaaaagaacagcagcataatcgtcggtgcagatttacacttgaaaagacgatctatggtgatacaacttcagcattattttaatacactatatacctgcaatcacatttcagaacagcaataacgttagttcataagcaacaatagaatttgagactctttcaaaatagaagatagatggccaataaaagtgagtgatagtagtagaaaatggttaaagttgctagaccaaatagcatttgacatatttaaaagttaaaagagacagaatttgagtgcgcttgaaaaaaaaaactaacttacagctttatttaaacttatcttgtactataagcttttgtgtaagcatctgnnnnnacttatgaaaataacttataatttcttgatatgccgtttnnagcnngtttctgcaagctttcnnnnntagcttacaaanncnnctg

SEQ ID NO: 2426 - DNA, 374 bp, Glycine max
ttgcggaggctggtgcttttctgatttgccagtcaaattattaaatcacttgttcacatagatcagctgatgccatcatcttagtatggattcacaacagctcttcagtttcggtggtgttactagtgcaggattaccttacatgtcttcttttcccactgttccatcgctacccaacagtctacttagatccttgaaatatgacacaggaaactcacctaattcacccttttccacttattttgattctgatactctttcagcattgagtgacggccaggagcaatacagcccaggagaaatcctctctggtgtcagctcttcactggaaaccaaccattatatgtataatagatcaatctccactttggaca

SEQ ID NO: 2427 - DNA, 745 bp, Glycine max
  misc_feature (62)..(62): n is a, c, g, or t
  misc_feature (691)..(692): n is a, c, g, or t
  misc_feature (696)..(698): n is a, c, g, or t
  misc_feature (738)..(740): n is a, c, g, or t
tgttttttcacgcttctcatttatctataccttttattaattttacaagaatttaattacantacaattttgtgtacaatagttccattaaggttctaaccaagacttcatacatattatcccaaaccactatgcaaagtacatagtgtaaaagtttttcacattattatttaatcataaataatactgtattgtatgattactaacttttataatcaagtggagtctaatttagttagtttaatagacactgagttattgtaaattagctggtatttattttcatattttaaaaatcaaaagaaaaaaaattattgatttttataataattattttaaaaattaatttatgttaatatctgattattatttaaaaatctttaaagatagagtacatgaaaattaaatttattttacaatgcttactctcgggcacactttcttacaatattcactttatttatatagaggttggtttatggagcaaaggcagaggcagcaattgctattggattcgatgacttcatttcagatgcattgcgaggcactggattctaccagaaagcacaattggagattaaaagggctgatggcaaagcggcaaacattgctgaagaagtttttgagagaaccaaggaaaaattccgaatgtattaattgaatctccatgtttcctaagccgttaggtatnnacannntgatgaaatctgagttcacataaataagctcattgctctnnntgtat

SEQ ID NO: 2428 - DNA, 137 bp, Glycine max
  misc_feature (12)..(12): n is a, c, g, or t
gaagcttctcanagagttgactcaacaaagtgcaaaccacaagagtcctcttcatcagataggtattctgatctcactgatgactctttgttgttagtccaagccatggaactctcaggacccaggtgaattaattg

SEQ ID NO: 2429 - DNA, 509 bp, Glycine max
ttgccaagccgttgacactgcaactctagtgattcagcaacccaatgggaaagtagaaaggttgtattggcctgtgagtgctagtgaagtgatgaagaccaaccctgatcactatgttgctcttcttatctccaccacattgtgctcatccaaggacaatgaaaattgctcgagtaagagtgacaataccaccaaccctgttcgccttacccgcatcaagcttctcaaaccaactgatacccttatgcttggccaagtttatagactaatctcagctcaaggttagttgcaactttcagcttgagttttgaccctttgttttttctcttttatgttgttgtttcatcttaaaatgttttatatgctttgtaccaaatttgaacctttatgtgctgcttttttttccagaggttatgaagggtctttgggaaaagaaacaagcaaagatgaagagaaacttgtcggaatcagcacaaaagccaaatctgatgaaggaaaggacagacaaa

SEQ ID NO: 2430 - DNA, 898 bp, Glycine max
ttgtagtttggagcaaactgcaggtttaatcatcctgatcctacagctattggaggaggtgattctccttccggttatggtaatggaagttctatttcgttgcaaggtgtatcacaatcatctatatcctcatggtcttctactagaccattaaatgaacctgctccttttgtgccggtgatactttcacataatccaggggtttctccccaaagttctgaatggaatggataccaggtaaatcaatggattaaatgccaataaactatcttgctagggacattctattataatgttatcagtatatgatggaaaattagtctgccaattttctttcacagtgttaatgtcctctattcctgcaacatatagtacatagtgagatatagatatcggttggctgttagcacacttgtctgtaattcccagtgtgttatttgtacagtgaatactgaacactgaatagtggcacgagttatatactatttaaggattgagatttatatgcccacatcagtttcttaaaagtcagagactgttttctttctttatgctttatgttctctcctcttcctcttctctcattttctaataaatcctcagttgtcctactattcaatattttgctgtctgtcttgattcttgttgggctggctttggtctattggatttaaagcaagaaacttttatcctcctccctttctgtgagttgaatattatgcctgttaacccttataattgattgttttccctgcaatttgatcaatttgtggtttgtacaggcaccagtctatctatctgagaggagtctgcatccaccttcaacatatgtcatgaacaacccagctatagaatcaaatgtttatatgcaccatcaaaaacaaatgcaggtgaagag

SEQ ID NO: 2431 - DNA, 514 bp, Glycine max
attctctccggagaatggtgcatttgtgaataacaggcatgatactcaagctgaatttagtaaacctgctaagcaacatgctaattcagatgattcaaatcacaataggttttgcctcttgctttcttagcatctaataattattcatctcatgtaaattttgcttcaattaaaatgtcaactccatcctgggatttggacacatctctaattgtgctaagtttgtgtgacatcttatttaaccagaggtgcaagtcctggaagaagtcctaccagggattctggggagctaaaccaaggacgtgctttgttgttggctagtcctggcaaaaaaagtcctggccaaaaagcatctgaacctcctgcccccaaacatggtcagggattttcaaaaagcccttcaccaaatagcatgcctaagcgtattaaaaaagggcgtggctttactgagcgttatgcctttgcacgaagatatcgcactccatctccagagcggtctcctcctcattcatat

SEQ ID NO: 2432 - DNA, 330 bp, Glycine max
gggaccctcctccagtatctaggcttgtcaaaggttttggctgggagggcaaagaagatgaaggggaagaagacgtggaggaagaggaggatgaagaagacgagtatgacaagagggtcaaagaggttcatgcaagtggagaatttcaaatcagttaagcagtataataattcttgtgtacttggttaaagtattatttttttttatgctagaagtcatctatttatgtgtactataatttataataactactataaaccatcgaggcagtctaacttatggcactttccatgtaatgtattagtattacctgtatcaccatggaagccg

SEQ ID NO: 2433 - DNA, 360 bp, Glycine max
ttttctggtaatgtgcctggaacatcatcaaaggatatcatggacatggttctcatgactcaatattttgacacaatgaaggagattggtgcatcctccaaatccaatgctgttttcattccacatggacctggtgctgtgagtgatgttgcttcacaagtaaggaatggtcttctccaaggaaatgcaacaacagagtcttgaagacatacacatatatcatcataccatgatttcctcctccaggcacttgtagtttagctttgcaactaaatctttatatatgctactattatgaatcatccatggcaagttggcaactaatgccttctatatgtatatggtcttcctaatcaacca

SEQ ID NO: 2434 - DNA, 373 bp, Glycine max
cttgctctctacttgagcatctttggtgttgggagctttataagtggctttctcatttctgtgatagagaaactgtctggcaaagatggacaagacagttggtttgccaataatctgaataaggcgcatgttgattacttttattggctacttgctggactcggtgtaatgggattggccttgttcatttgctctgctaaatcctacatttacaatcaccaaggaatcagacgagaattgtgaattgtccggttctgtcaattttagctttactgtatgggatgaaaaattatattctgtataaggtacgagtatttgtgtataaaaacctctggacctggggaattgtcaattcatttgcattctgttccag

SEQ ID NO: 2435 - DNA, 823 bp, Glycine max
atggtgagatagtctctgttaagatacctgttggaaagggctgtggttttgtccaattcgcaaacaggtaatagttctggccttctcaaatttttgcatattgacagataacatacttttttttatctctttattgatgtaatgataacaacattattctgaacaacttttccagaaataatgctgaagaggccttgcagaagctaaacgggacatcgattggcaagcaaacagttcgtctttcttggggccgtaatccagcaaataagcaggtaaaactctcactaatgcaatcccacattcgtattgtcattagtctgttaatctacagaaataagtattgtttgttgaccaataatccacctagtaatactgtatattgcaccggtttaaagaaaacggcttctattttggccccttgtaatcatttaaaataaaaatgatcagaacgttttctggattttctgttaagatcaatcgataagagcttaattttgtaaatctcatttccccataaaattctttgcaagtgctagagcactagattgtcttcatgctgccagtcattagattgcatttgtgatgattcactctcaattggtatatctttgcattgcagtttagaatggatttcggcaacccctggactggggcatattatggggcccctatgtatgatggctatgggtacgcattgacccctcgtcatgatcccagcatatatgctgctgcttatggggcttaccccctttatggaggccaccaacaacaagtaagctgaacgaagtgcagtacagtgctggagtaccattcacaacaagtt

SEQ ID NO: 2436 - DNA, 1089 bp, Glycine max
  misc_feature (1077)..(1083): n is a, c, g, or t
ttcttgctgcaccaataggcctttcgacttggatgaagctattattaggcgatttgaaagaaggtacctctactagttcttgactttaaatccatccttcatcttgtcactacatttctactttctccatatatgctgatggtattagtacttcctcttgtgagtttatgttaaaggagggcaacacgataggcaatgattgcatacatagctatctatgatgtatgtgtatgacaatctgaataccttgaagttgagttatttatttgtcatttaaatctattttaattttaatgcaggattatggtaggactaccatctgtggagaacagggaaaagattttgaggactcttttggcaaaagaaaaggtggacaacgaacttgagtttaaggaacttgcaactatgacagaaggatatactggaagtgatctaaaggttgctgctattcttttatattgttcacattggatataacactatcgtgtaacaagtgctttttgttttccgtgcttttaattatatcatttattcattgtcaacctgtccatcgtagaacttgtgcacaactgctgcttatcggcctgttagagagctaattcagcaagagaggataaagagtctggtaagtggcaattgtataatttattttgagtttaatggcgatgcactcatcattcaatcacaaatcacagttaacataactctttaagataatggcgatgccctcatcattcaatcacaaatcactcatcattcaatcacaatttattttgagtttaacggcaatgcactcatcattcaatcacaaatcccagttaatataactcttaagataatggcgatgcactcatcattcaatcacaaatcacagttaatataactcttaagataagtttgttcaagtcaacaaacttatcataaacggtgttttttgattggatgacagtgtttacactagtaggtaatgtaaacactttcttatattaatcctaccgattatgtgttcatcatgctaacctcctaatgctgttttttatttttccttcttggggggcaggataaaaagcagaaagnnnnnnnggacag

SEQ ID NO: 2437 - DNA, 360 bp, Glycine max
aaaactgtgaaaacgctgcacaacactgttaactgttaagtgtttaacgatatcattatttcttctctatttctttttctttcttcttctttttttaaagttaaaatgggttgtgtcttccggtttttttgtttcaaattcgggtgtcatggacttagattcaagcccgtgtttttggaattgatatgcatggatgtgtatagatcactagggtttttcggacggcaatggttgaatctatgtgatatgtatatatgatatatgttaatgttaatgttcatataaatgatccaatgatgtagttctattttcttttttcattctacctagcaagctcttgatcgtggattgatggtgttc

SEQ ID NO: 2438 - DNA, 402 bp, Glycine max
  misc_feature (394)..(395): n is a, c, g, or t
ttgtcatggtggttgtggggtcgtagcaacaaggagaaagaacctgttgtttctggtggctctacactgaattcatcttctgaatggagttttaaggaaagagagagtgttaagtttccttcagtgaagggaacaaagatagctccttctcacaggaaggttaaaaggaaatggcagagcagggaagagaggagacatgatagagagtatgatgttgtgttggtgccatctgatggtgatggttgtttgtcaagctctgaatctgatgactcagatttttccattgggtggttggagcctcatggctctgatttccttcagagtgatgatgatttggacaatagttttgctgtgctagttccttgctataggaaggaggtggagagttcaaacnntgagctt

SEQ ID NO: 2439 - DNA, 412 bp, Glycine max
cctcctgcagctacttcacccagcgctgatgctcctcatattgaaaatacaaatactgctgagccagtattgagtaaaagccttgtcgaagaggtcgagaaggtgaaccctgctccagccaatgctcaagaacaggttgcttctagtaagggtcaagaatctccagatcaagttgacccaaaggttgatgaagtctctactgggaacaccccactcgatctagaagccattaacaaaatgatcgaagatgaccctttgagtgctattgaaaatatcctgacagggaaggtttccatttgttctaagactccacaatctatcactcagtcagaacaaccaaaagttcaaggctcccctgcagatgttctgtcaaaagagctaaaagacttaatgcagatctttagcttaggtg

SEQ ID NO: 2440 - DNA, 481 bp, Glycine max
attaccttggtgagctcaacagcacaagtgaacaagaaacaaagatacgcagtgaacagtgtttcattcacacctgctgacactcctttgaagctagcagattactttaacattggagggattttccaagttggaagcatcccagatagcccttctggtagacccatgtatcttgacacctcagtcatgggtgccgactttcgagccttcgtcgaggtcgtgtttcagaaccatgaaaacatcatccagagctggcacattgatgggtactcattttgggttgtagggtaagctgctttcatatctcacattcactatatatactatctccaccattctttagttttatactttcataacactaaaattttaacgtgacatcaatttatgatgatgtagaatggacggtggtgtgtggacgcctaatagtcgtaaccaatacaacctcagagatgcagtatcgaggagcacaacacaggta

SEQ ID NO: 2441 - DNA, 380 bp, Glycine max
agcccttccgtcggacctattcgccgccgacgaactcactaagccctttgacttcacgcaaatcatcaccgaagaaaccggaaccgccgccgctgccgccgccaccgtttcccgctcccaagagatcaaagactcccctctcgccgccacttctccgcccaagaagaaggtgccgccggcaaccaaatcggcttgaaccgccgtatgcatcatgatgagtctgctcctgctgctgcattttatgtctgtcattttctgtttttctttttctttcttttctttttgtttgaaataaaaaatgttaagatgacagcagagaaaagctcaaggcattgtaacatgttcctcttcttcttcttcagtgtttgagaaacttccga

SEQ ID NO: 2442 - DNA, 575 bp, Glycine max
atatactataatcagtgcttaaacaaaacgaaattgcaaattctaatatcctcaaacacaaaacatttctgcaaaatcaaaagccgaagatgacaataaaaactgagagaggtagagagagtgtgtgaaatggcaaattctaatattccatctagaacagagaggttccttttcccttcttgtcaccaccgatctcaaaatgcttgcacctctgcaggcaaaaacagaaggaggaaagcaagcatcagccacgcgatcaaaacgacaaaaacaaaaacgaaacgacgggaagagacgcttataccttgatagcgtgctgcgagacatgcttgcatccctgacactggagcctcaacacaattttcttggtggttttggcctaattaattaaaggtaaattaggaacaaaaatcaaaaggcagtgtttgggggaagggaaacagtagtaaggcgacgtacctttttgtggaaaacaggcttagtctggccaccgtaaccggactgtttgcggtcataacggcgttttccctgagcggcgatgctgtccttgcccttcttgtattgggtgaccttgt

SEQ ID NO: 2443 - DNA, 362 bp, Glycine max
ctacgcggtgcggatgatatttcggggatttagggtttgggttgacgagcgcgacatttcgatggacgcgaattaccgtaaggagttgatgagcgcgttgtttggagagaataacaataacaacaacaagaagggacacgtggcgcttccgcagatttttataagggggcggcacgtggggggtgctgacgtcatcaagcacatgtgggaggtgggggagctggagaaggttctggaagggttgccacggaccaaaggagggtttgtttgtgagagttgtggggatgtgaggtttgcgccgtgtgggaactgcagtgggagtaggaaggtgtttgatgaggatgaagaggtgttgaagagaa

SEQ ID NO: 2444 - DNA, 1036 bp, Glycine max
  misc_feature (941)..(941): n is a, c, g, or t
  misc_feature (979)..(984): n is a, c, g, or t
  misc_feature (1027)..(1027): n is a, c, g, or t
aagcataataatatataaatacttacatgtcctctcaagaaaaatactgcaatatattaaatctaacgatttgctccaataaattacacaatgcttacatctccaggcagaagtcatcttcctttggtttttctagagatcgaaagtgaacaacctaaaatacataaattagacagaaaaattagcaaataccttacagtaaaaacataatgaaacttgcacagtatattggttacacacatacagatatgtgcaggcatggacaaaagggaaagaggaggaaggggcaaaataacatgactaaataaacgggtagtctcatttaggcatatcaatccatacaaaatgccttcaattgaaccccacaaagaaaaatacctggcgattgtgcacatattcaaggtatgaaggcacatctggatagcggacgtgttcattgtctatagcaggagctttctgaaagcatataatatctccatcttctaactgcaaatttagaaaaacaaatcaataaaccaacaaaagatgcagtaacttaaagtgcatcaatggtgtttataatttacctggcttgctcgaaatgttactttcttatcaataggttcacacataacatttggctcaaacttaatttcttgcacaataatagtaggcacagtaaattcacaaatgccacacgattcaagtcattcattgagataagaacctaaagatgaaaaaaataaaaataaaaaaaggtccttctttagaggtaagactcatgcagaatagatcttttttcttggaacataatgcactttatttgtcatcaatcatcagtaaatttaattattaaacaaatgagaccaagaatgctaaatccaagccaaatatctcaataagcatattgtgttgagatcatacaaggatgaactacagtctcaattttcaaggcattttanaactcataaaataataaacaatataacacaaacctcannnnnncaatctcttcatcaggatcataaccagccattttattaacctngtaagattc

SEQ ID NO: 2445 - DNA, 335 bp, Glycine max
cagcagtggattgagagcacaagaaatgcaacgaggcctcattttgatgaagttcatacaatcctctataagctcaaaacgaggctttctgagcagcaatctaatcaggcagatggcgtgatgcaatctaggattagaacccctctaaattcaaagatgtgaacaaacaaccatgccagtaacgtgcctgtgacaacttatatatgtgtgtgtgtgtgtgtgttggctgcaagtatcactgtatcaggtttgaaacatcaaagatgaagtttatgtctgtattgagaccccttaatctaagtaagttgggcaggtaataaatgtgatttccacat

SEQ ID NO: 2446 - DNA, 736 bp, Glycine max
  misc_feature (711)..(712): n is a, c, g, or t
catcagaaacattagcatcagaaaatgggtgagaatcagaggactatggagaagaagggggagaaaagggtcctcatcctcttgctcaagctggaactggttctttccctggaggcttcattgggaaacataggttgcaagcagccataaccaacctcaataaccaaattagtattttgcaggtcatctcaactcatcatgcctcttttttgtgtcaatttggtgatccatcttattttgttcaatttatatgcacaatttttttctcttcatcttaattctcctagaagaagaatttgataaatgaactatgatgagcaggaagaattggaaaaagttgaaacaattggtgaatcctccaccgtttgcaaggagtaagcaaagccaacatataagactatgatattattattctttcttatggttcttcaaaccttagagtttaattattgttcataatctaaattgaattgctccatccattttgtgctcttgcagtttaatttcaagcgttgaatccattccagatcctctccttccattgtaagaaattaatcctcttgatgttcatgatattaattttaagggtccaatgttgcgttgtatgtgttttttaatgtactagtaaagaaagtaaataatatattataatccaaaaggtaaaaaaagaaaagatatttgaacaaaaatgattaatgtattagagttaannttaaggtaaaatgtttgtttgcag

SEQ ID NO: 2447 - DNA, 402 bp, Glycine max
aactatatttcaaccagccgcggcgactaaacaacgaccacaccctcaaaaccatttccaactaccaactactctctctatcactctcccatggcttcctcttccctctttctctcactctctctcaccctttgccttgtttcctctctctgctatgctcacaaatcttccttaaccctacctgtgacaaaagacgattcaacccaccaatacctaacaaccctctcttatggcacccctgttgagtctgcaaaattcgtgcttgatctcggaggctcaatcctctgggctgactgtgcatccagaaccaccccatcttccacccttgccccaatcttccaccgttcaattcgttgcctcacggcaaagggtcctgaaattgagacacatagatggctctcg

SEQ ID NO: 2448 - DNA, 789 bp, Glycine max
  misc_feature (742)..(742): n is a, c, g, or t
  misc_feature (755)..(756): n is a, c, g, or t
  misc_feature (767)..(767): n is a, c, g, or t
  misc_feature (769)..(772): n is a, c, g, or t
  misc_feature (774)..(775): n is a, c, g, or t
  misc_feature (778)..(778): n is a, c, g, or t
  misc_feature (780)..(780): n is a, c, g, or t
  misc_feature (783)..(784): n is a, c, g, or t
tgtttgatatcctgagaggaggaagagacaggacgcattgcgaatgtatggaatgaggtttgatacattgtccttatccccatctaaacgaaacgggcttggcaaagaggaggaggaagggctaacttggtatgaaggaattgggctgggaaatgatgaagaaagaggacttggattttgagaagaagaaaagggaatgtttctcatggagctcccagcaccattggctagaggcggcttgcaaccctattcatccaaaacacataaccacgttaccactgcgaattcatctcattaaattaacaatttagagtctaaagtgaacaactctaacaatctcagtagttggtgagtaaatcatcacttcatattatctattgcaaattaatcacattaacattaacaatttagagtctaaagtgagcaacactaataatctcagcatccgttcatattatctgttgcaaattaatcacgttaacgttaacaatttagagtctaaagtgggcaactctaataatctcaaatagttgatgagaaaatcaacatttcatattacttactgcaagttaaccacatcaacaactaacagtctaaagtgagcaactctaataatctcagtacatgcattacaagttctgaatatgttgaaatacacataattctttttttttttttctttagggtttaaatttttttcccccccccaacaaaaaaaaatccccatttttaccccccaaantttggcccccaannttttttccccntnnnngnnttncncannaaaaa

SEQ ID NO: 2449 - DNA, 402 bp, Glycine max
ccaaatattgtccagaactccaatatacagaatataactgggccaaattcagttgggaccactattagccaaaattccaacttacagaatatgtttcctggttctcagagacaaatgccaggaaggcagcagattgttcccccacagaattcacagcaatatctttaccaacagcagtttaagcagaagctccagcttcaatctcagatgcagcagcaacaacaaaaccttctgcaaccaaatcagttgcaatcttctcagcaatctattatgcaaacttcatctgttatgcagccatccatgatgcaaacatcttctctatctagcataccacagaatcagcagtctactaatgttcaacagccaatgcagtccatgccacagcagcattcacaagttatc

SEQ ID NO: 2450 - DNA, 442 bp, Glycine max
  misc_feature (419)..(422): n is a, c, g, or t
  misc_feature (424)..(424): n is a, c, g, or t
  misc_feature (439)..(439): n is a, c, g, or t
atttgttccaacagttacttttgcagttgtgcttcacttgttacattacagtttttcttcatggatggcatgttttgattagtttcttgtgcctttgccaggatgtcagttcatctctatccaagaaatatcctgaactatacatggaaggaataagaaatgttttcttcaaatggaaagttgtggccatatgggctttcttttctgtataccagtctctaatattcttctattttgtgagtactacaaatttaagtgctaaaaactcagcaggcaaggtatttggactctgggatgtcagtacaatggccttcacttgtgttgtaataaccgtcaacttgcgactgcttatgatttgtaattcgatcactagatggcactatattagtgttggtggaagtatattagcctggtttaannnncngaaaggaaagctganatg

SEQ ID NO: 2451 - DNA, 759 bp, Glycine max
  misc_feature (10)..(10): n is a, c, g, or t
aggagaacancatggtgagcacaaaggtgaacacaaaggagaacaccatggtgagcacaaaggtgaacacaaaggagaacaacaccatggggagcacaaggagggacttgtggataagatcaaggacaagatccatggtgatggccatgacaagggtgagaaaaagaagaagaaggacaagaagaagaaggagcatggacatgaccatcatggtcatagcagcagcagtgacagtgattagatcttatatgttaaggtaatgttttgtgttttttttattcgtagaaattcaacatgttatcaaataccctctcacccatatatcctcctatcaatgttttgtgttctgatgatgcgtgttctcttatactttatcatttagtcaacggtttatactatgatcattatctcaatatttataatgttattgttgggtctatgcttttggttttgggatctaacttttagcatagacactaggatgaaattttatcattatgggattattctaggcaattccctccccgaaaaggaaagaaattagtacacgctttttactttttttctttcgatatctgtatattggggattataaatattatctatctatttagtgagaagcttgaattttgttcttatctactcgcatattttactctctagtgttttaattttgacataacgactaacacttgttccttttatttttattttttctttcttgcagcaggtgtacggtacgatggtagtgaggagcca

SEQ ID NO: 2452 - DNA, 577 bp, Glycine max
ttgtgtttactgcgtaaaattatgtgtgctttgtgaattttggtgtcactcttttcctaacgatgatggaagttttgttcaaacttgaattttcgtgcatgataacagggtcagaaagagtgttcctattacgtgaaaactggacagtgcaagtttggtgcaacttgtaaattccatcatccacagcctgcaggcgtccaagttctagcaccatcaccagttcctccagtttcacctctgcctgtacctgtaccttcaccaatgtatccaactgtacatcccccatctggtccttcacaacaacaatatggtgtacttgttgcaaggccacctatgctacctggctcagtagtccagggtccctatgggcctatggtagtgtcccctaccatggtccctttttcaggctggagtccttatcaggtaggtcctccatttcgtatgaactgcttactatagttatatgtacattcattgaagttgttaagcatttggtgcaggctcctgccacaaaccctctacttccatccagcactacatctaatgttggttctacacagctttatgggaaaaaaaa

SEQ ID NO: 2453 - DNA, 408 bp, Glycine max
ttgttttcttgatgataatgggaggtacattgttcagaagaccaaagatagtgaattgggaacccttttgggagatgattggatcagaaaacacgctgcaaaagttaggcaattccatgtgcactatcaaagatgctcgtggactaaggtattagggattttgaagcttgatagtaatggctcatcattgccccctaatggcttggcaaagtcaatgaaggagacgctcaagttgtttaacacagtttttgaggagacttgcagggagcattcttcctggtttgtctttgatgaacagctcagggaagaaataagaatttcccttgaaaaaatcctgcttcctgcgtatgggaactttgttgcgaggtttgagagtgttgcggagcttggaaagaatgctgacaagta

SEQ ID NO: 2454 - DNA, 409 bp, Glycine max
gaagtgaggttgatctcccctttgttttacaaagacttgtctgtgaagtccatctctaagttgtttaggaaccgcctttggcttggttttcttggtcaaattcccacaagaatgtctctagtgaacaagtcttcaaaggtggagaatattgaggactcccaagacatgtcagtgttggacttgccagagctggtgttggaatgcattcttgaaaagctccctccaccttcactttgtcaaatggccggggtttgccgttccctaagagagagctgtgtgagtgatcacctttgggagaggcacatgaaacagaaatggggcagagttattggtcaagctgcttatagggagtggaaatggcatgctgcttctaaagggaatgttggaactcttagacatggcaagcaaa

SEQ ID NO: 2455 - DNA, 411 bp, Glycine max
tcgggtagaagaacctgccccggaaagactttgggtttgagcaccgtgactttctgggtggcgaggcttttgcacgagtttgaatggctaccatctgatgaggggaaggttgatctaacggaggtgctgaggctctcgtgtgaaatggctaacccgctctatgttaaagttcgccctaggcgtggattaagtacttaataataataataataataataataataataataataatgttaagtagcaggtgcatggccctttggagccactaaatgttaagtgaatccatgaatcaaggtagaaagtttgagttggctctgtctctataatatgggtcaacgggtttttgttttttttttttttccccctttttttttttaaattgaaaacccccagtttttcggaaaagga

SEQ ID NO: 2456 - DNA, 408 bp, Glycine max
gtggaaatctatcaccctgtggatcaattaattaacgcgagtttatgaaatccaattaaatgttctgagaacaaacgaagaacataagataacagacagaaagcgcttataaatggctttccacgagcatctaccgcacgaaatcacgttccagccgttcgcggaggagcagcagcagcagcagttaggtcagagccgggacatgcagcggctcctgccactctcgggcggggcgccgacgtggttgaacaacagcaacgccgccacgctccgccagcagaatttcctccacctgcagccggaatccgccgcgacggcggcgcagcaaaacgacgacgttcgtgctatggatcggaaccggaccgagagcaactctgaagcggacgatttggcggaatacaaagcaga

SEQ ID NO: 2457 - DNA, 414 bp, Glycine max
ctctcccctttctccgagcagtgcctcatcctcgacgaccggcccaacaaggcccgcgtcaccaaagcccaggcccaagccaaaatccagtccgaatccatccccgtccacaaagtcctcaagctctcgaaactcgcctccgattaccgccccttcgaggcgaagcgaaaactctgcgattcttatgatttgttttttgcagagaagagcattgtgccgctcctgccgcggcttctggggaagagttttttcaagaagaggaagattccggtgccggtggacctgaagaaggggagctggaaggagcaggtggagagggcctgctcgtccgcgatgctgttcatgaggacggggacctgtagtgtggttagggttgccaaggtgaggatggagagggatgagattgtggagaat

SEQ ID NO: 2458 - DNA, 420 bp, Glycine max
gaccaggaattttatcttgattatgaaggttgccaagaaatgggttgtggtgaagaagaggaagaacaaaaactagatgctcagggaatagataagcaagctgaggagttcattgctaaattctatcagcaaatgaggctgcagcgccagatttctcttctacaatacaatgaaacacccagatcagacacaagttgttgagcatacttcgttcacttttttcttctttttctattgagttttgatgccattgtcaatgtagaacattttagttcacgaaatgtgagagagagcgagagagatctatatgtacggcgggatgctgtaaataccaggagctacctttgagttctagtatttacattttttcatagttataatttcaataaaaaatactacagtctaccgggctgttattca

SEQ ID NO: 2459 - DNA, 387 bp, Glycine max
aacctctacttcccaatctaaagatagatgttcctcaagttgatgttaacttgaattggcttcatacaatttcctcgtaatacttgcttcatgcagttcaggttgtctttcccaagagtccatgatcacaccaaaaagcaaaaacaactaaatacagttttcacattggattatggtaaaaggaaacatcccccttattaatcagtgctgaaggggatttgctgttaaggaactcatcaaacacaaaacctttatgaatatccaagttcaacaaagagattcataattttgtgatcagctaagatatccatccttttatatatccatcaattggatggaagaaagacagcttgagtgtcaactcactatgtccgaagcatctaatgg

SEQ ID NO: 2460 - DNA, 386 bp, Glycine max
tgcagccacaagctcacgtgttgacagagaacctctctcagcacctccttcagaaaccacataacaatcaagaagtccaagcacaacagcagcaacatacttatcaagactcgctcttaattccgagtgatcaactccatcagagacaacactctggcattccttcaccatcatattcaaaaccagatttcttggattcgagcatgaagttccctgcttcagtttctcccgggcaaaacatgcttagttcactttgtcctgaaggaagtggcagtctcttgaatttatcgaggagcagtctgtccttgctgactgaacagttaccgcaacagcaatggactcaaaaatatgcacctgtgcaggtcaacacctatggaggcactgta

SEQ ID NO: 2461 - DNA, 392 bp, Glycine max
ttgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctctacccttcgtacctctttcccaaacttgaagaagatgtggattactccgacccgcctgaaagttcttgtaattttggattttctgaggaagatcacgccctttggacctgggcatactaagttta

SEQ ID NO: 2462 - DNA, 389 bp, Glycine max
tggacctgaagcatgtgggaaagggtttgtgccatataaaagatgcatatctgttgtgacagctgatgatagagaagagcaatgtatccatctttccttgtagcttataccccactggatttttccttcaaaaagtgttccctttgtcatgatgagctgtaatggttgttttggttgctgctggatgtgagttggtatgatataggaaggaaaaaggggtggctgaaaattttgatatttccgttgaattgcactgcactgcacattctccagctgttcaaatccgtaaacttgccttttctatttttttgacttccaagtttcaacacattctccgcgggtccaagcccgtgtctgtgcgcggcacttaggagctgtgtccgtgcttc

SEQ ID NO: 2463 - DNA, 687 bp, Glycine max
cttggtaattcattccaggtatgataattctacctcttcctatataataatgtagcctccataaagatccttctggatgtgtttactgtcataaataaatgtaatatctcttggaactattcagtaatgttttaatatttaggcatattcagattaatcaggtagaggaagaccaagaaaaatagaaagaaccattttaaaatgatttatatgtaaataacctcttacctcgataaagaatatattgatttttggcagaacactatggcgacatttatgttgagacctcagcaatggctttgtttgttgtattaagaataatgttgtcaaagtgaaatcatatgcagtttcagcatgttttcttttctatgaaactagtggttaatgcattgatgtttccgtgtaaatttctctttccttacttgattcagtttatttcaggttgacactgtggcataccacttgtcagttctgaaggagatgtatcctaatggtatcaatcttctttctctcttttctggaattggtggggcagaggtagctcttcatcggctcggcatccctctcaagaatgttgtgtctgttgaaaaatcagaagtgaataggaatattgttagaagttggtgggagcaaacaaatcagaaaggtaatctatatgacattgacgatgtaagggagctagacggt

SEQ ID NO: 2464 - DNA, 396 bp, Glycine max
cagcttttaagtccaattatttttcatgagggtaggtttgctcaaaggccaactcctctagctgccctcttgaccttcctatggctgccaattggcatcatactctccatcttaagggtctaccttaacatccctttgcctgaaagaattgcttggtacaactacaagctcttaggaatcagagttattgtgaagggtacccctccaccgcccccaaagaagggtcaaagtggtgtcctatttgtttgtaaccaccgcacagtattagaccctgttgttacagcagttgcacttggaagaaaaattagctgtgtcacatatagcataagcaaattcactgaaataatttcaccaattaaggctgtggcactctcaagggaaagagagaaagatgct

SEQ ID NO: 2465 - DNA, 542 bp, Glycine max
tgagagcacttgagcctcactccactgttgctccctgggctctagagtttgataattggttgaaagatgctcttcttgaaggaaggtacacttttttctgtcttgatgttcaaatctgctaaatgtgtagttgaccttgctacggatgttaagtgcatggatctaattaccaagaagctaatcattgaatgttatagagtttggctattcgtggattggttgttaaagctttcaattgcttttgtagatatgaagatgtaaatcattatgagcagaaagcaccacatgcaaaaaaggctcatccctggccggatcacttttatccgctgcacgttgctattggtgctgctggtgaagatgcaaaggccaaacttatccacagcagtattgaattgggcagtctctcttatgcctcttaccagtttacatcagccgctagctgaatttcttaatacagaatagcttctgttcagttgcataccctggctcaaaacacagttattcaatatttatgaagatgtttggcttgctagtttaggctt

SEQ ID NO: 2466 - DNA, 350 bp, Glycine max
ttgcctcgttttccgctcagatctcatctccgagattctaccaccagtattttttaaatttattttaatctctgcttatcagatccgaaacgcttctagatttaagtttatcgtctctatgcagaaagtgtgatttatgcggtagatcccgatgcagagaatctacatctaagagaaatagttttagttaaaaagcttctgatgtgctttttccttgtttggatttttacttgacctgcttcctttcattgattaataatcaagctgaaattttttatatttgagaactgaaataaataatcttggatttattacaataatgaatttactgtatcggtataggttaagct

SEQ ID NO: 2467 - DNA, 1522 bp, Glycine max
  misc_feature (550)..(550): n is a, c, g, or t
  misc_feature (553)..(555): n is a, c, g, or t
  misc_feature (566)..(567): n is a, c, g, or t
  misc_feature (569)..(571): n is a, c, g, or t
  misc_feature (573)..(594): n is a, c, g, or t
  misc_feature (601)..(610): n is a, c, g, or t
  misc_feature (612)..(612): n is a, c, g, or t
  misc_feature (616)..(630): n is a, c, g, or t
  misc_feature (634)..(640): n is a, c, g, or t
  misc_feature (643)..(645): n is a, c, g, or t
  misc_feature (647)..(659): n is a, c, g, or t
  misc_feature (661)..(664): n is a, c, g, or t
  misc_feature (666)..(671): n is a, c, g, or t
  misc_feature (673)..(673): n is a, c, g, or t
  misc_feature (678)..(679): n is a, c, g, or t
  misc_feature (682)..(701): n is a, c, g, or t
  misc_feature (704)..(709): n is a, c, g, or t
  misc_feature (712)..(717): n is a, c, g, or t
  misc_feature (721)..(727): n is a, c, g, or t
  misc_feature (730)..(739): n is a, c, g, or t
  misc_feature (743)..(743): n is a, c, g, or t
  misc_feature (748)..(762): n is a, c, g, or t
  misc_feature (764)..(770): n is a, c, g, or t
  misc_feature (774)..(791): n is a, c, g, or t
  misc_feature (793)..(795): n is a, c, g, or t
  misc_feature (797)..(806): n is a, c, g, or t
  misc_feature (810)..(816): n is a, c, g, or t
  misc_feature (819)..(819): n is a, c, g, or t
  misc_feature (821)..(821): n is a, c, g, or t
  misc_feature (827)..(827): n is a, c, g, or t
  misc_feature (829)..(849): n is a, c, g, or t
  misc_feature (859)..(861): n is a, c, g, or t
  misc_feature (864)..(878): n is a, c, g, or t
  misc_feature (880)..(882): n is a, c, g, or t
  misc_feature (888)..(897): n is a, c, g, or t
  misc_feature (903)..(910): n is a, c, g, or t
  misc_feature (913)..(926): n is a, c, g, or t
  misc_feature (933)..(939): n is a, c, g, or t
  misc_feature (947)..(949): n is a, c, g, or t
  misc_feature (953)..(959): n is a, c, g, or t
  misc_feature (961)..(966): n is a, c, g, or t
  misc_feature (969)..(975): n is a, c, g, or t
  misc_feature (977)..(995): n is a, c, g, or t
  misc_feature (1000)..(1002): n is a, c, g, or t
  misc_feature (1004)..(1015): n is a, c, g, or t
  misc_feature (1017)..(1020): n is a, c, g, or t
  misc_feature (1022)..(1040): n is a, c, g, or t
  misc_feature (1046)..(1048): n is a, c, g, or t
  misc_feature (1050)..(1065): n is a, c, g, or t
  misc_feature (1072)..(1081): n is a, c, g, or t
  misc_feature (1083)..(1104): n is a, c, g, or t
  misc_feature (1106)..(1118): n is a, c, g, or t
  misc_feature (1120)..(1122): n is a, c, g, or t
  misc_feature (1125)..(1134): n is a, c, g, or t
  misc_feature (1137)..(1139): n is a, c, g, or t
  misc_feature (1141)..(1150): n is a, c, g, or t
  misc_feature (1158)..(1164): n is a, c, g, or t
  misc_feature (1166)..(1183): n is a, c, g, or t
  misc_feature (1185)..(1186): n is a, c, g, or t
  misc_feature (1188)..(1191): n is a, c, g, or t
  misc_feature (1193)..(1202): n is a, c, g, or t
  misc_feature (1205)..(1205): n is a, c, g, or t
  misc_feature (1207)..(1208): n is a, c, g, or t
  misc_feature (1211)..(1215): n is a, c, g, or t
  misc_feature (1217)..(1226): n is a, c, g, or t
  misc_feature (1229)..(1230): n is a, c, g, or t
  misc_feature (1233)..(1234): n is a, c, g, or t
  misc_feature (1237)..(1243): n is a, c, g, or t
  misc_feature (1257)..(1259): n is a, c, g, or t
  misc_feature (1262)..(1267): n is a, c, g, or t
  misc_feature (1271)..(1274): n is a, c, g, or t
  misc_feature (1276)..(1282): n is a, c, g, or t
  misc_feature (1287)..(1292): n is a, c, g, or t
  misc_feature (1294)..(1295): n is a, c, g, or t
  misc_feature (1297)..(1301): n is a, c, g, or t
  misc_feature (1303)..(1303): n is a, c, g, or t
  misc_feature (1305)..(1335): n is a, c, g, or t
  misc_feature (1343)..(1348): n is a, c, g, or t
  misc_feature (1350)..(1354): n is a, c, g, or t
  misc_feature (1357)..(1368): n is a, c, g, or t
  misc_feature (1370)..(1372): n is a, c, g, or t
  misc_feature (1377)..(1380): n is a, c, g, or t
  misc_feature (1385)..(1386): n is a, c, g, or t
  misc_feature (1388)..(1391): n is a, c, g, or t
  misc_feature (1397)..(1404): n is a, c, g, or t
  misc_feature (1410)..(1412): n is a, c, g, or t
  misc_feature (1414)..(1416): n is a, c, g, or t
  misc_feature (1418)..(1419): n is a, c, g, or t
  misc_feature (1421)..(1428): n is a, c, g, or t
  misc_feature (1430)..(1432): n is a, c, g, or t
  misc_feature (1435)..(1444): n is a, c, g, or t
  misc_feature (1447)..(1449): n is a, c, g, or t
  misc_feature (1453)..(1457): n is a, c, g, or t
  misc_feature (1459)..(1465): n is a, c, g, or t
  misc_feature (1467)..(1469): n is a, c, g, or t
  misc_feature (1471)..(1473): n is a, c, g, or t
  misc_feature (1481)..(1488): n is a, c, g, or t
  misc_feature (1494)..(1505): n is a, c, g, or t
  misc_feature (1507)..(1512): n is a, c, g, or t
  misc_feature (1514)..(1518): n is a, c, g, or t
gcgcttttttgaagtcggagaagaaacgttgatgctgttgcgtaaccctgcgttgacagcgtcgctgctatcagccaccacaaagaagctctacaaccaccgttattctacacctgctgcattcatggcgtcttcaggtttggtcttttgtgtgctctcagatatatcttataatgttagatgggtagagtaaagttcaagtttaagcctttaatattaattaaccaattcatttgttattgaacaattcgatcgagtaaatcatgaatgttgagaatgaaatagttgctcctcctttttttatcaggtgtcgcgtgcagtttgctggttttgtgtggcaaatcactggcagagaatgaaactgctaaagctataaagaccaataacacactgaagctccctgaggatgaaaaactctcactcgttttgcattcggagatggataaatcagttatgcaagggtttttccaagttcattcctatatggattctctttccaccaatcaatttggcaggcttctcgtttggtctccagacttaaaaaaaaatnacnnntcccccccccnncnnncnnnnnnnnnnnnnnnnnnnnnnccgaacnnnnnnnnnncncttnnnnnnnnnnnnnnnaccnnnnnnntcnnnannnnnnnnnnnnncnnnnannnnnntnccacnnacnnnnnnnnnnnnnnnnnnnntannnnnnaannnnnnctannnnnnnctnnnnnnnnnncttnctaannnnnnnnnnnnnnnannnnnnnctcnnnnnnnnnnnnnnnnnntnnncnnnnnnnnnnaccnnnnnnnttnanccaccncnnnnnnnnnnnnnnnnnnnnntcctatatcnnnctnnnnnnnnnnnnnnntnnntcactnnnnnnnnnnttacannnnnnnntcnnnnnnnnnnnnnnttccttnnnnnnnttaattcnnnactnnnnnnntnnnnnntannnnnnncnnnnnnnnnnnnnnnnnnnccttnnnannnnnnnnnnnncnnnncnnnnnnnnnnnnnnnnnnntttcannntnnnnnnnnnnnnnnnncctattnnnnnnnnnntnnnnnnnnnnnnnnnnnnnnnnannnnnnnnnnnnncnnnccnnnnnnnnnnctnnncnnnnnnnnnntcctcatnnnnnnnannnnnnnnnnnnnnnnnntnnannnnannnnnnnnnnttnannaannnnnannnnnnnnnnccnnccnnatnnnnnnncctcacccccctcnnnacnnnnnntccnnnncnnnnnnnctcannnnnntnntnnnnntnannnnnnnnnnnnnnnnnnnnnnnnnnnnnnnccatcatnnnnnnannnnntcnnnnnnnnnnnntnnncatcnnnnctctnncnnnnattccnnnnnnnncacctnnntnnntnncnnnnnnnntnnncannnnnnnnnnttnnncatnnnnntnnnnnnnannntnnnataccatnnnnnnnntctacnnnnnnnnnnnnannnnnncnnnnnccac

SEQ ID NO: 2468 - DNA, 358 bp, Glycine max
tctatggtgaagagttctggtgatcggtctcagaagaccgatggaagcgctgatggtttttctgggaatggacctgatttttcttttgaggaggctcagaggtcaaatatggttgccccaacagagtattcatctctggacgatttgctatcttcacttcgtttggtggctcaagaaccccttggagattacagcttcctgaatcctattgtaagcttcttctatgatttcaggaattcgatagttgtggctgatgattctgtaaaagatatattttgtaaagaaaaagttggtactaaaaggaagaaaccgctcacggctggattgcccgaaacatttgaatttgaggatatgagtg

SEQ ID NO: 2469 - DNA, 997 bp, Glycine max
  misc_feature (49)..(49): n is a, c, g, or t
gtaagctcattccctaatttgcatcttaaactcttaatgtctataatanctctgtgttgtatatatgtttcttttttgtattattttagtggttactttgttagttttttaggaggaggaattggaatccaaagtttttaagttttattttcttccttcaaccatcaaatctacctgataactatttattgagttgtaaatgtgtttgactattaagtacaaaacacctcttttgttcaaattaaagcatcatggtgaacacatttttaataccaacacttatttgatactttttattaagcgtttcactcaaaaattactttttttaccttcaacacttaagtttattatctttgcataactaatatacttaaagaaaatatatatagaaggttgattttaaaaaaatagatatttttaatatattactcatactttatttaattaaaatctttctatttatttgcatgtgatgttcgatatcctatattttagacattcaccatatcagaacaaaatgtaattaattagaatctctctttatttgaatgtgatgttccgatatcctatattttagtctaattagacattaatagtatcgaaaaattcgtgttggtgtaataggtgtttgatgaattaatatattatatatgttggatgatgcattaattaatgattgtgttttgtgatagcagaggtggtggtgcagacggagggaagagtgtgtgagtcacaaagccacgggttccatggtttgtgtaatagagaccacaactgtgctttggtctgcaggaacgaaggtttctccggtggcaggtgcaaaggcttccgccgccgctgcttttgcaccaggatttgttgagatctcatcaaacactactcttgccatgcaaattaataaatcatagctaggccaaataaattgcatctactctttatccattagggagctagctaccacaaccaactcatacttggtcattggattgcttccctt

SEQ ID NO: 2470 - DNA, 466 bp, Glycine max
tgaaggaccacattgatgagtttattaatgcttctatggatgaacacaaaacttgttttaagaaaacaattcagaaggttggtacctcaaatttcatgtgaaaaaatattcatatcacctttatcgtttgctgatgttgtgtggtttcggatcaatctcagatgtttggtatgtccaaggctgttgcagaaggtcagtccaatgcttccaaagaagttgaaagttctctgcctcttcagacaactgtacaagactagatttcttgcttttgaaccactaggttttaaccgaggcgtgtggttataccacccagatatttagttatattaggctatttgaaactaaattttgtttgtgaaaactacattcatgggttgttttttgtttttactagtatggtttctatgcttaagtattgttgaattatggtagctgatccaatttctaaagtgagtcccaaccatca

SEQ ID NO: 2471 - DNA, 391 bp, Glycine max
attgtgaaactattgcagatggtctgacagaaaagagaaaatatttggttaacatttaagcctgaaaagctattcatttcctgactcgataatattttgatttagtatacctgtcagaagactagttctttattcaggcttcaatgattaatagggtataaagcttaaatgggttcaccatttggcattgcttctgaggcaagcatcaatgtacaattgtgaaccaaagtaagctgaacaagaaatgtacatagcatgtacaaatgtaggcttttgaactgaagcactgatgaagctggagcatgcaagtctctctcaaatgcggtattgcacgctactagtggttttctctaatgtctgatccattacttctgtatatagcacgccctcc

SEQ ID NO: 2472 - DNA, 385 bp, Glycine max
ctgccggttggcgttgaccgtgatcacgagtattgcaatccgagggctgagaagtgggttgggaaaatggggaagatgagggagctagggtggagggtgttggtgagtgggaatggaggggaccctgtgattgatcgtgagaaggacttggtgttgttgttggaggagaagggtgtggttgtggtgagtgattttgatgaagaagggtgccatggggtggagtttggtgatgaatccaaagcaaaccaactcattcaggtagtcaaacgttttgtttcatgaatccaaggatagtacaagctcatgatttttctcttttctttttgagatcatcctagtatgaaccttatgttagttcttgtcttgtgcttacctttcctcacaa

SEQ ID NO: 2473 - DNA, 1572 bp, Glycine max
  misc_feature (51)..(53): n is a, c, g, or t
  misc_feature (90)..(91): n is a, c, g, or t
  misc_feature (1512)..(1513): n is a, c, g, or t
  misc_feature (1557)..(1557): n is a, c, g, or t
actttgtttcaattttcagtcacattcagattcaggtattcaatatttttnnnaaatggcttcaatttctccttcttcaagcaatacttnnccgagtgctgctgatctgacgaagcaattgaggctccatgaagtcgccatcgccgagctcaacaaccagccttcttccagagtaacctcttttttcttttatccttcaatctaactacttttaatcatccatttcaaacacgaatacctctccctaccaatttcatgttccagacataggattagggttattttttgtggtttcgttataatgcaaacaaaccattgagatagatatttcttcaacactccccaaggtagaactaacaataaatcatgcgtttaacctagcctctgatgattaagtgcatgtttggatgtcagttgggagaactcaaaactatctttattttcggtttaattacctatttagtccatctaattttcaaatttatcctttttagtctagtcaataagtgaatttttctcctgttaaaattctttaactatgttaaggactcctcttacttgtcattgatttaggaactaaaaaattcacccgggactaaaaaatcgaatcacttattaattataggaaaatttatttagaaactgacgaattaaataaataattaaacctttattttcaaagcaaggaatttttcattcttcattttgtgcattgaaatttgagaatgtgattttggaattccaaaaccacattctcgacctttatctagacataggctaaaactatagacataccaagtgtcatggtgttcgtcgcaagagagagaattagagaaaaaaaaagagtatattgtttattcatgtgacttgtgtacatttgttcagagtcttgttacttagaatccttgaggagcatttgttggtggaaaagttagtcatgtcaccggtcatatgttgattgtgttgggtatcctatattattggtagtgctttataccgggatttagctaatttagtgtcctttgtgatgattccagacttggtgtttatcccgggtatgccgacttaagagtatagaaacgattatgttttgcagaacacctaggatttaatcctagtcttttttatggaaaaaaatgttaataagagaagtaaaatgtgatgcagcgatttttatgtttcgaagaagagtattctctgtaggttcattctatctataattttgttttttttgtttgttttttttaattttcccctactttctatgaaatataggctgtgtaccagagagatgggaacatattttttcgtacaaccatccaaacagcaactgcaacggagcagagtaagaattctccgcatcttctcacttctttcttctttcttgagaaatctgaaattctgaggtgtcaaactattctgaattattattatttctctttttcaaaatttgtgttgggcagaacaacttgaatcagcccaagcgaagctaaaaagtctgaattgatggtnngggagtaatgaagcagttgtaataaggatatattttagtttganacttcattttgtaaa

SEQ ID NO: 2474 - DNA, 376 bp, Glycine max
gagttcttggaagccatggaccaaagggagagggaaagggtggcacaacaagacaattggaggatgcaagaaatggcaaggatcaatagggagcatgagattcttgttcaagagagatcaacagcagcagccaaagatgctacagtcattgcattattgcaaaagatgtatggccaacaaaaccccacacaacaagttgaagtagagccaccaccacaacagaagcaaacaattccccaatcgctgcctccaatattaatgccaaacaataatttcgaggtcaagaaaataaataatggtcacagtgttactagtactactactggtactgttgctactgctgctactactactactacttcgccggtgaatactt

SEQ ID NO: 2475 - DNA, 415 bp, Glycine max
ggttaaggaggcagctagagcagtgagtgtcaacttcctctacatttcttttttatttatcaactacatattctatccatgtacacaatttttgtccatctgcctttggatcctcttttctatcgtttgatgtcagtatagggagagtagaattctactatcttattttgggaggtttgacattgctttgtgattcaggtgagtgaacgtgatgataaattgcttgccgagcacatggctaagctacgccaagataatgaagaggtcagtggtgatgaagacagtgaggaggaagaagatacaggaatgggcgaggttgatgtggataatggtgccgggataacagagtgacaaaaaacttgtgggtatagtagtaaggcatagatagcagagtccggctttactaattctgtct

SEQ ID NO: 2476 - DNA, 386 bp, Glycine max
aagtatggaatagaaattttggcggagtttcatacaaatctgatgtttacagctacggaatgatgctactagaaatggtgggagggagaaagaatattaatgcggaagcaagtcacacaagtgagatatacttcccacattggatctacaacaggctagagcagggtggagatttgagacctaatgaggtgatggcaacggaagaaaatgagatagtaaagagaatgactgtagtgggtttatggtgcgttcaaacctttccaaaggatagacctactatgactagagtagtagatatgctagaaggcaaaatgaattccctggaaatccccccaaaacctgttctttcttctcccactaggtcagtgtcagaatctcccacaaga

SEQ ID NO: 2477 - DNA, 668 bp, Glycine max
caagtgctagaattaccaacaaaaggcctttgtctgaaacctctgaggagtgtgcttcaaagggttctagtgctccacatgtggaaactgaagcagcccctcctgccaagtaagtttataattaacatattattattaagggttaagacttaaaggtctttaatttatttatctcatgttttttgttgatgagtggggatgcatgctttgaagttcttcgtatttttatgaatattttgagtttggtgatttattgaatgtgttgacatgtattacagggctaagatagtggggtggccaccaatcagatcctacagaaagaacagccttcaggagaatgatggtgctgggatttatgtgaaagtgagcatggatggagctccttacctcagaaagatagacttgaaggtctatggaggctacacacaactcctcaaagctctagaaaacatgttcaagttgaccataggtgagaaagagttttagtttttgtttgttttattgagatgaaatgaaactacttagtcaaattttataatatttgtgaaaatgactgtggttatgttatgtttatggctttttaggtgagtattctgaaaaagaaggttataagggatctgactatgcacctacatatgaagacaaagatggtgactggatgttagttg

SEQ ID NO: 2478 - DNA, 229 bp, Glycine max
cctaatcaccgcttcgagctctgtcattgtctcaagttccaggtttcagcgatttcgatctcgcatagcattctacaatggccgtgagtaccttcttcttgcactacccgaacttaattatcttccattttatttcattcacttaatcatcttggcagcaacgtataagcctgtttactatgctgatattagtgttgccacgtattttttatgtggggggggggggggg

SEQ ID NO: 2479 - DNA, 471 bp, Glycine max
aatgaagcttttaattggtggggttgtacacaacaatgaagatactcctgtcaaggatgaatttatacgtcttccagctgaaataaaaaatatggaaaaggattcttttgtctttcattttgattgtggaaatgtagattatggtatcaaagaagataaaattcccaatatcaaagtagcagccctagcagcacaaggagtctccgagcttatgcctcctgatgttgctaatgcattttggagttctgacaaagtctcttctaaggtgagatagggataagtaatatttaagctttattaaaaaaaaactaaccatgcatttatatgtagttctgactgatgcttcatgtagatctccaaaagcatgcgtgatattgtcagagttgctatgagtcaagcacagaaaagaactaaattatctggggatacaaattttagccggattatctgttcaagaggctgttcaagagg

SEQ ID NO: 2480 - DNA, 389 bp, Glycine max
tggtggatccagcaaccccaatagacctagaactgacgatgaagaagataaagaagaagcaaaggaagaagacaacttctacagagctgccagaaatctcaattcagacatctacatgccttatagaagcatccccaatagacccagcaattccaatggacccttgccttgcaatctcaacaggccctgaacaggagatgtcaaagaaaaagaagaaaaggaagagtaagcttgaaagtgaagcggcagaactcaatgaacactacaagctgcctgaagctgctccgcctgaggcccctgttcagaaatctatataccatacagatgcaccctcaatcgacccagtgggcccatctccccctgttgacacagaaaccccaatagaccaa

SEQ ID NO: 2481 - DNA, 676 bp, Glycine max
tctggacaaggtggagaagaatttaagaatgaagtggtggtggttgccaagcttcaacatagaaatttagtcaggcttcttgggttttgcttgcaaggagaagagaagatacttgtttatgaatatgtgcccaacaaaagtctcgactatattctctttggtaggaccatctttctgaattctgtgtctactttacatgcctgctttgatttttattttttttgcttccagtttttgccctgttggcctgttcagtatatacataataatcgtcaatcgaccacaattcaggaagcgatgcgtaaaaattaggacagttatccgttggtcaaataataaattgtatatatttttcatgcaatcaaagtgtcgcaatgtttcttccaaattactacatttttatttgatatttttcatatgacttgaatattttgtccaatttctagatcctgaaaagcaaagggagttggattgggggagacgttacaagattattggagggattgctcgaggcattcaataccttcatgaagattctaggcttagaattatacatcgtgatcttaaagctagtaacatattgttggatggagatatgaatccgaaaatctcagattttggcatggcaagaatatttggagtcgatcaaactcaaggaaacaccagcagaatagta

SEQ ID NO: 2482 - DNA, 457 bp, Glycine max
  misc_feature (432)..(437): n is a, c, g, or t
gattttacaacaggtgagacttatttcttgttttgctagtatttttttccccttattgggaaattcttgactgattactttttgcctaattacaggtgcctggagaatcattgaaactgaaacagctcaaagttcttattgatgaacattcatcttcaattttgtctgatttttcttcaagaagagagtctgttgcttacttgaagcaaaaggtatggttaccttaatcatatatcatagttagacaattcactttgaatcaagagatgtaatgttattgacaaatgctccaaatatgtgtataaaattatcattccacaaggtgtcaaggattattgttgttatcactttgataagtcttaaactatgtgaataaccgaaatttgattgattcacagattaatgttcatcaaacatgaacaaaaaaaaatnnnnnnagggctaacttaaatctttt

SEQ ID NO: 2483 - DNA, 396 bp, Glycine max
agtggatgaagctatttcacataaagttaacactgagcctaccacaaatgaagatgctgcaggagagtcctcaactcagtcccaagtcccaaatgatgctactgtgagcagcaattaaaactcaactcagtttatcttcctcatcccaaaatacttggcccattctagtttttggccctgtgcgactcttgattttgaaagggtttttttggaggggatggtaggataggttgtttggaagtttgattcctatctacggtgactgagatcgattttggtagcaattgaatcaaaaagggaaataaataagaattctttggaattattatggcctaaaaagataaagaaagttaacgagacacaagaaatctagaattttgatggaggtgaattgag

SEQ ID NO: 2484 - DNA, 565 bp, Glycine max
tcttcggagacgtctcggttatgctaccgagtaagtcttttacaccatctcccatttactctctattactactaacacccccccccattcccttttctttctttcatccaggcagcttgccttctacacaggacccacaggtatccctcttttatttccctttttctcttaaggcccgtatcctcttttcaactcactcgtgttgctttctgcagttgggggtctgcttaatgccacctttggcaatgcaactgaaatgattatatcaatttatgcattgaaaagcaatatgataagggttgttcagcaatccctactcggttcaatcttgtcaaatatgcttctagttcttggctgtgcattctttactggtggccttgcccactacaaaaaagtacaggtttttgataaggtacgtatcatcatcacctcattcgttattgctgcctccttatgtcacagagacttcacattgtactccgcctttgcaacaggcggctgctgttgtcaattctggcttactcttgatggctgttatgggaatactatttcctgctgtgcttac

SEQ ID NO: 2485 - DNA, 584 bp, Glycine max
agtttcttcaatctctcattggtattctacttcttcttcttcattaaagcatacaaacacttcttttttctattcacaatctcagcttctccttgttctctttttctatagctcaatcccgttatgcagcgcgtgccgggtcactgaatcgggtctcggggctccgattcttctccgtttccacggaagagtattccaagagaaactatgcaaacaacgttgccgagtacaacactgttttgggttctctcactgcacaaagaaggtgtctctctctctctctctctctgtccacttttttttgtttaaagaaacaaaaaatgggttaattaattaatgtgaggcaccccatttgattcaattttgcaaagttaatttttttttcatatagggtttatttgtttgtttggtaggaatttcttgctgagggatgtgtacgatgatatgatgcttgatggggtgaagcctacgcgtgacactttccattcccttgctgttggaaccatgaaagcagctagaatgcaagatgctttctacttcgcggaccaaatgaaaatcatgggtttgcttcctgatgttacttt

SEQ ID NO: 2486 - DNA, 1096 bp, Glycine max
  misc_feature (459)..(476): n is a, c, g, or t
  misc_feature (483)..(486): n is a, c, g, or t
  misc_feature (493)..(493): n is a, c, g, or t
  misc_feature (497)..(499): n is a, c, g, or t
  misc_feature (501)..(512): n is a, c, g, or t
  misc_feature (517)..(523): n is a, c, g, or t
  misc_feature (527)..(535): n is a, c, g, or t
  misc_feature (546)..(552): n is a, c, g, or t
  misc_feature (554)..(554): n is a, c, g, or t
  misc_feature (556)..(558): n is a, c, g, or t
  misc_feature (560)..(562): n is a, c, g, or t
  misc_feature (569)..(571): n is a, c, g, or t
  misc_feature (580)..(592): n is a, c, g, or t
  misc_feature (594)..(597): n is a, c, g, or t
  misc_feature (599)..(599): n is a, c, g, or t
  misc_feature (605)..(627): n is a, c, g, or t
  misc_feature (629)..(631): n is a, c, g, or t
  misc_feature (633)..(643): n is a, c, g, or t
  misc_feature (647)..(648): n is a, c, g, or t
  misc_feature (651)..(652): n is a, c, g, or t
  misc_feature (657)..(658): n is a, c, g, or t
  misc_feature (662)..(662): n is a, c, g, or t
  misc_feature (664)..(665): n is a, c, g, or t
  misc_feature (667)..(672): n is a, c, g, or t
  misc_feature (675)..(681): n is a, c, g, or t
  misc_feature (684)..(687): n is a, c, g, or t
  misc_feature (691)..(694): n is a, c, g, or t
  misc_feature (698)..(701): n is a, c, g, or t
  misc_feature (703)..(734): n is a, c, g, or t
  misc_feature (737)..(739): n is a, c, g, or t
  misc_feature (742)..(747): n is a, c, g, or t
  misc_feature (753)..(753): n is a, c, g, or t
  misc_feature (755)..(766): n is a, c, g, or t
  misc_feature (769)..(780): n is a, c, g, or t
  misc_feature (782)..(785): n is a, c, g, or t
  misc_feature (788)..(788): n is a, c, g, or t
  misc_feature (792)..(806): n is a, c, g, or t
  misc_feature (808)..(815): n is a, c, g, or t
  misc_feature (817)..(817): n is a, c, g, or t
  misc_feature (819)..(824): n is a, c, g, or t
  misc_feature (831)..(837): n is a, c, g, or t
  misc_feature (840)..(844): n is a, c, g, or t
  misc_feature (846)..(851): n is a, c, g, or t
  misc_feature (856)..(858): n is a, c, g, or t
  misc_feature (860)..(860): n is a, c, g, or t
  misc_feature (862)..(864): n is a, c, g, or t
  misc_feature (866)..(866): n is a, c, g, or t
  misc_feature (868)..(870): n is a, c, g, or t
  misc_feature (874)..(874): n is a, c, g, or t
  misc_feature (876)..(881): n is a, c, g, or t
  misc_feature (883)..(894): n is a, c, g, or t
  misc_feature (896)..(897): n is a, c, g, or t
  misc_feature (904)..(904): n is a, c, g, or t
  misc_feature (911)..(915): n is a, c, g, or t
  misc_feature (918)..(919): n is a, c, g, or t
  misc_feature (922)..(932): n is a, c, g, or t
  misc_feature (934)..(939): n is a, c, g, or t
  misc_feature (941)..(941): n is a, c, g, or t
  misc_feature (945)..(952): n is a, c, g, or t
  misc_feature (954)..(955): n is a, c, g, or t
  misc_feature (958)..(958): n is a, c, g, or t
  misc_feature (961)..(971): n is a, c, g, or t
  misc_feature (973)..(980): n is a, c, g, or t
  misc_feature (982)..(983): n is a, c, g, or t
  misc_feature (994)..(995): n is a, c, g, or t
  misc_feature (998)..(999): n is a, c, g, or t
  misc_feature (1002)..(1002): n is a, c, g, or t
  misc_feature (1005)..(1007): n is a, c, g, or t
  misc_feature (1018)..(1025): n is a, c, g, or t
  misc_feature (1027)..(1027): n is a, c, g, or t
  misc_feature (1031)..(1034): n is a, c, g, or t
  misc_feature (1036)..(1042): n is a, c, g, or t
  misc_feature (1044)..(1044): n is a, c, g, or t
  misc_feature (1056)..(1061): n is a, c, g, or t
  misc_feature (1063)..(1066): n is a, c, g, or t
  misc_feature (1069)..(1078): n is a, c, g, or t
  misc_feature (1081)..(1087): n is a, c, g, or t
  misc_feature (1089)..(1089): n is a, c, g, or t
  misc_feature (1091)..(1091): n is a, c, g, or t
tcgcgttgtttcgccgcagcaacggcagcagcttcagcgaaacctaattccgggaagtcaaacggcaccgccacaacaagcctcagttttctcactccaatcggtcgttacggcgccgtttcatcagtgtcgaggtcgaataagaccaacagaatagtcgtggaagctactcaaggtcttacttacagggacgccggcgtggacatcgacgccggctccgaactcgtgcgcaggatagcgaagatggcgccagggattggaggcttcggcggtttatttcctctcggtactgtttgacttctttttttatttttcactctttcttttcgttacttataattggattttgatttaacttgttttctgaataggtgactcgtacctcgttgctggtaccgatggcgtggggacaaaggtgatgcttgccttcgaaactggaatccacgatactattgggannnnnnnnnnnnnnnnnnggggaannnnggggggngctnnntnnnnnnnnnnnngggcnnnnnnncggnnnnnnnnngccacaagatnnnnnnngntnnngnnnttttttnnnttaattatnnnnnnnnnnnnntnnnntnttttcnnnnnnnnnnnnnnnnnnnnnnncnnnannnnnnnnnnnttgnncanntactnnacananntnnnnnnttnnnnnnnctnnnntgannnntgtnnnntnnnnnnnnnnnnnnnnnnnnnnnnnnnnnnnnaannnaannnnnnagaggntnnnnnnnnnnnnacnnnnnnnnnnnncnnnnttncatnnnnnnnnnnnnnnngnnnnnnnnantnnnnnnttatttnnnnnnnctnnnnntnnnnnnttatnnnancnnncntnnnattntnnnnnnannnnnnnnnnnngnntttattnttttttnnnnntannatnnnnnnnnnnncnnnnnngncctnnnnnnnncnncanttnnnnnnnnnnncnnnnnnnntnnatccccccttnntcnnccnccnnnccccccctttnnnnnnnntntatnnnncnnnnnnntnctgtttttttcnnnnnntnnnngtnnnnnnnnnnaannnnnnncncntctcc

SEQ ID NO: 2487 - DNA, 369 bp, Glycine max
gagagatcagccaggacactgggaaatatgtctttggggttgaggacactttgaaggcactggagatgggtgctgtggaaacactcattgtatgggaaaatttggatattaataggtatgtgctgaaaaatggtatcactggtgagattatcataaaacacttgaacaaggaacaagatgctaatcaaagcaacttccgtgatttggccacttctgcagagttggaagttcaggagaagatgcccttgcttgagtggtttgccaatgagtacaaaaaatttggatgctccctggaatttgtgaccaacaaatctcaagaggggtcacaattctgcagagggtttggtggcattggtggaattcttcgtt

SEQ ID NO: 2488 - DNA, 319 bp, Glycine max
gatcacctggcaaggcaaccattcaagttcaaaacattgaagactttacatggttgaatgcaagttacagtcctgttcttaaacagttgggttcccaatccatgattgattattacttcaaggctcatcgagtaacttctgattcaaatcttaagtttcggaatccaaagtatttgtctatcttgaaccacctccggttctatctgcctgagatctttccaaagctcaacaaagtgctgtttttggatgatgatattgttgtgcagaaggatctgactgatctgtggtcaattgatttgaaaggcaacgtaaatggtgc

SEQ ID NO: 2489 - DNA, 350 bp, Glycine max
ctgctggagtttttactaaaaatatggacactgccaacaccttgatgcgagcattgcaagctggaacggtatggatcaactgctatgatgtctttgatgcagcaataccttttggtggatataagatgagtggtcaagggagagtaaggggaatctacagccttagaagctaccttcaagttaaagctgttgtcactgctttgaagaatcccgcatggctgtagttttcccactacctaagtgttcatgttcataatgtcttatctagaaaaaaaactacatctttcatggaacattcctaaggcattgaattagccaaagttattacacaactaaagcttttctgtgcc

SEQ ID NO: 2490 - DNA, 614 bp, Glycine max
ctcctcaccctcctcatcttatccccacttcttcaagacactctccacaactttcttgggccacaccgtaaccctcaaatatgctgccacttccgcaagcatccctccccgttcactctccgctcacatgtcatgggacggtcctctctcttccgtcaaattgatcattcagggtaaaaatctcgaggtatgcttgggttttggttttacccgcacatgctacccccactttttttttcctctcttaaaagcaacaattttgaacctggcctaatctgttatctttcgcggtgtttagctcactgatgcagtgaagcagcatgtggaagacaaagtggggaaagcggttcagaagcacagtcacctagtgagagaggttgatgtgaggctttctattcgaggaggaggtgaatttgggcgaggacccagaactcgtagatgtgaggtgagtctattttcattttaaagttccaattttggtaatctggggtgggattaattgcagcattacacacatacatgcctagtgggttcaattctttgatttggatttgcattaggtgactttgttcacaaaaaggcatggtgtggtgcgggctgaggaggatgctgaa

SEQ ID NO: 2491 - DNA, 622 bp, Glycine max
tgcttgataaagttcttgatgaatctagcaggaagattctttgctgtgagttctccaagataatgcaacaggtacttgatagtaaactacactttctgttagtttgggcttttggtccttggagttagtactggattatgtatgcttgcatagaaatgagtaacatctataatctttctaaacataatgatgtgtaaattttgaaaagcatgatgagtttggtgtttcaaaatctaggatacatctattccaatttgcttaattgtttaccctttcctttgctatatattctgtttatcttatgtgtgacattctctacttttctgtttcttttcagggttttgcatatctcccagcaggaatatgtgcatcaagtatgaatcggccagtatcttatgagcaggctgttgcatggaaagtcctcaatgatgatgattctaatcactgcctagcattcatgttcatgaattggtcttttgtataatggatgaaccatctagaaactacttattttatctgctactaatttatattcagtacttaattatcagatgatactatcacagacaaatgtactaatgtcagcttttctttatgccctatgtatggagttacttattcg

SEQ ID NO: 2492 - DNA, 393 bp, Glycine max
gccatgtatcaggctgggaccttgagtgggaaccctttggccatgactgcaggaatacagaccctgcagcgtattaaggagccaggaacttatgagtacttggacaaaatcaccggtgagcttgttcagggcatcatcgaagctgggaagagggcaggccatgcaatatgtggtgggcatataagggggatgtttgggtttttcttcacagaaggaccagtgtataattttgcagatgccaaaaagagtgatacggacaagtttgctaggttcttttggggaatgctggcggaaggtgtctatttggcaccttcccagtttgaggctggcttcaccagcttggcacatacttctgatgacataaaaaagacaatagccgctgctgagaaggtt

SEQ ID NO: 2493 - DNA, 418 bp, Glycine max
gctgactttcgtattcgtgtgtcttcaatagatggtatttttaaatagaaagcatagttgacaatttcttgaatgttgttgtttcttgccttttgaattatctccaagacttcaaataagttggctctctcctacaattttttaaatgctattatgttcagtattgagaatcaaacaagacttggtctcaggcacaacaggtttttcaattttggactagttctgatttgcatacttatatagaggcaaaaggggtatcctctttttcattatcctctattcatacatatccaaagacaacaacatttcctttcagtacccctattagttgaatcagcatggcttcatttccttcaaattctgcattggaacatagcatggccagtgcacaacaaaacagtaaccctcatgcttcctc

SEQ ID NO: 2494 - DNA, 217 bp, Glycine max
tccctcactgataccggcaacttgtacttcatttcccctcgtcagagccccgattgcttgctccctccctacggacaaacccattttcatcgccccaatggacgatgctccgatggacgccttatcctcgatttcctcggtattgtacaaattcctccatacccacttgctttttcagtcaatttctggcataaaagttcattctttttgctgcttt

SEQ ID NO: 2495 - DNA, 593 bp, Glycine max
aatactcatagtggacttagaatttttaacccggtggatgagctacttaacagaaccccaattaaaaccaatgcaatgcaagctatgaggaagggacctcaaggcaagaatgcctggcctaaaggtataatcacatgtggcatgactttcataattataggaacggaggtggctccatggtgcaaaactggtgggttaggagatgttcttggaggtctaccaccagcattggcagtaagcttactgttgttgcttattaattgacatattggtgttcagtgagtgcaagactctctctaatcagtccttctctagggttttgggcatcgagtaatgactattgtgccgcgctatgaccagtacaaagatgcatgggatacaagtgttgtaattgaggtatattcttgactatatataagaagtcatgtttttaattttatcttggtagaagaggttttcgcctaattgtgttgttctatagttaaatgcattgtgttctgctgcttactattacaggtgaaagtaggagatagaacagaaaaggttcgcttcttccattgttataagaggggagttgatcgtgtctttgtgga

SEQ ID NO: 2496 - DNA, 570 bp, Glycine max
ctaatcatgttcttgtacaaataaaactgggggtgaatttgcttacactgcaaaaggcctactaaaggaagagttcttggatgagtgtattgccctcaaccgtgatcctcaaaattatttctattgcaaagcctgtcctcttgaaagatcaaagaatgatgattgtttagaaccatgtaaaggacatttaaagagaaagtttattaaagagtgctggagcaaatgcggctgtgggaaacattgtggtaatcgggttgtccagcgtggaataacttgcaagttgcaggtgattgtttaattaatcttttccactactacagaagtgtattttctttgatgttgaaattaatggggtgacaatattacatatttacattgtttatattctcaaatggattttttccttgatagaagtttatttagatatgccttccattttatctactgctcaggtgtttttgacttcagacagaaaagggtggggtcttcgtaccttagaagatcttcaaaaaggcgcatttgtatgtgagtttgttggggaaattttaaccatcaaggagttgcatgaga

SEQ ID NO: 2497 - DNA, 364 bp, Glycine max
  misc_feature (349)..(355): n is a, c, g, or t
accctatctgctagctaggtttaatgattgaatttgaaaaaagaacactggtacgtactatgtttatactatgtacgaggttaatttatttagttcatgagaaaacgtagaaccagtggaggaaaacaacagagaaagattgcaccaagtgtgtcctgcgtcttagggaagagtttatggtgaagccagagaggaggatctcggagatcactggagaagacatttgtgttgtctctcaatcattcataactgcataacatgtaagtatgaacaaaaattataacaatccaattcaagagaaaaagaatcaaactttgagaggaacaaggtaattgatgatatgtgggannnnnnngtttctgtg

SEQ ID NO: 2498 - DNA, 336 bp, Glycine max
cgccttctctgctgacaaatcgttgagcggggccaaactacgagagatgagtggcagtaacatctttgctgatgggaaggtagaagctagagactacctaggtggtgtacggaagccacctggtggcgagagcagcattgccttggtataatttattagggtctaactcatcttcataccgtcttgttttgttttaattaatttttagtggggatgtgttattatattatttgaccttgtattctgggttttgggaattggtgtttttaggtttcttgatgtcttttgaccaaaaaggaccatctgctaattggttgtatgtccataatcctgggg

SEQ ID NO: 2499 - DNA, 335 bp, Glycine max
ctcttctcgtctgatcatcttcctcttcacatcatcctccttattactagagttatcattcctagcaacagctttctcatcatctactagggttggatttaacgtgtccatatttgtgggctcattcttcactgaaggatcatttcccttttgacgcttaacaggagatttttttacatcatccttctcttgctcatcttccctctgcctctttttctgatttcttttgatcacaaattttatgcgcagtttctggagaaaaatggtaaaccaaattgtaaataggctgcctatgaagaatcaagataaatatcaactataataaaaaaaaaaaa

SEQ ID NO: 2500 - DNA, 530 bp, Glycine max
gcaaaagaaggatttaatgttgaagctgctttccagtgcatagcaaaaaatgcactcaagaatgaacctgaagaagaaatgtgagcattcctaaattctttttaagttttctttatgcatggtattattcagtaatgatttacaattatttacttctaaaagttccaagtgtaatagtttacattttactcatcacaaagctaaagtgtattttatgttgattgtatcaggtacctgcccgacacaattgatgttggtggtggtggacgacagcagagatctactggctgtgaatgttaaagtgcagagaattctatggactagctttagttgcttgttttttgccaaaatacaagcgatcctcatggattattagcctgcaagtactttattacctatgcaaaaccaaggacaaaattccaaattttattttgtatctatctagtggattagatgtccaacatgtttatttttcttctatttattcttctttatctttaatgtttgtgacaaatgttcctccatgtcag

SEQ ID NO: 2501 - DNA, 373 bp, Glycine max
cacctcccaccgaatcgctgccgtacgcggcgttccaccgcatcggccgccacaaccgcccgccggttgtgtatgctatcggcgcggcgaaggcatgttgctacacgcagttcgatgggagccctaggttcctgtaccgtggacctcactgcaattattactgccactgaggcgaacgaaccgattttattcactgtaaatacagctgcaagagaatcgctattacgaagttgattccatacaaacgatgatgacgacgaaaaatatcaaaggaccaaaaaaaataaaatagagagaaagagtggactcttaaatacaattaatattttttttaattttgataaaactttagacatggatgagttgaggttca

SEQ ID NO: 2502 - DNA, 372 bp, Glycine max
acaaggatgaactgggtagttggtccacactttttcagaggcatcgcttcctcttatctgctcttgttctgctaactctcctctgcactgtttatctttactttgctgtcactttaggggccagtggcacctgttccgggttgactggagcccagaaagcttcatgccatatggagcttgttaaggattctgtggccaagggtaaactgaagattctttgatatttcaaaatattattacaagaaaatttttttctttattttgtgcctgagtataggtgacatgaaatccaaatatagtctctggctacagtatcagtgtgactgtgatttgtatacatactatttatcttggtatttgtgggccaaaagg

SEQ ID NO: 2503 - DNA, 822 bp, Glycine max
  misc_feature (780)..(789): n is a, c, g, or t
tgtttctgatatggagattgttatgggatctcttggtatcaggggtaagttctctttgcccaaccgtgaagttttctcttcacctcaattgcagtctttgccctttcccttcccgtgttttcactccccagcctgaattagtttgatcttgatttgcaggtacgacctgatgatgtatgctcacaggttggtttatgtttcaaaagggctaaatcagagaggttaggatttggtcttttaaatttgtaagaagcattttttatatatcaatgttttgtatgctctttttgtcatatttgattcagtatacttcgattgagtaatgatttaaagatgtttgatggatgcttaataattctggctgtgagcttaaagtcaagttctgagtataatcaagtatacaatatgcagaaattttctgcaaaaataattgtcaaagaacctctattaccaaccaatttctcagggcttgatacccttcgtaggttacaattactggtttatacatttcttcttttgctattgggagagtttaggttctattcttgcttataatgctatcagattttgggtgaaacagactccaaagtttactttgaatcctaataccatgcagcaatggaattgagatggtgaccgaaaagggacaaagagagttatcagctaaagatactgctttgtgcacttcctgtcagatgcttgtggtttggattcagaatcaactaaaacaaaagaagaccaaggagatagtattcaactatgtaaatcaggtaggccttnnnnnnnnnntgtccagaaatccaagttgtgggttacatttat

SEQ ID NO: 2504 - DNA, 493 bp, Glycine max
  misc_feature (467)..(469): n is a, c, g, or t
  misc_feature (476)..(478): n is a, c, g, or t
  misc_feature (480)..(480): n is a, c, g, or t
  misc_feature (485)..(485): n is a, c, g, or t
ctaagaccacaaagctgtgttgcgcgttgaagagcgaagaaggaagaagatgtcgggtatgggagatgggtacgtgggcaccgcccaagacgcggtgaggattcgacggttggagaagcagagagaagcggagcgtcgcaaaatccaagagctgaaaaccaagtctgcctccgccaaggaccaacccggtcttctccaattcggttccagcacttccgaggtaggttttctcttcttctacccttccatttcccaatcatctttaataacttcttatgtatctttgtatgtttcagattctagagactgcctttaagaaggaaactgtgggtttggtcactagagagcagtatgtagaaaaggtaccttccctctcctctcttctatcctcttctcttgtcttttcaatccctaatttgtgacgttgctgatttaatttttgcatgcgttgattgtagagggttaannncagagcnnnantgagnaagaagag

SEQ ID NO: 2505 - DNA, 945 bp, Glycine max
  misc_feature (18)..(18): n is a, c, g, or t
  misc_feature (20)..(20): n is a, c, g, or t
gtgtctcaatatgtgcangnaatacaatttgttttttttggttatctattaccttatttttctttgataaagataatttttttcttaaataattcggacacgtgtttgatttgttaaaatcataaccaaaagtatacttgagttaattctgaattgaaatctcgcgttagtttaaagaaattcaaaactcgatttatataaacagttggcaacaatacacgtttctagatattgctttcaagtttatcttaactgactctagcttctgggaaagtattatttgctatttttaattgcaaagatggctgctaacgtgactcaacgtgttcatgagtcatgaattgatcctataacagtggagtgctgtctcctaatttttttgccttttaaaaaattacaaaaattctgcttaaccaaccaaccactttttattggttttggtctctgatttgagcccactgaatttgattttaatctaggcccaccaatagttcaaaataagtaaaaaattgtccaccaaaagatgttggatggaagcttcatataccaattaagaagtttcttttatttttattaattgggattaattattatgattcattctattcattctaaagtttttttaaaaccatttcagggtttaatcattgatagaatccaagattcaatttcacaagagggtaacaagaggatgatctatcttggtgatggtagtggtgactattgcccaagcttgaggctaaaagagagagactatatgatgccaaggaagaactttccagcgtgggatttgatatgcaaagaccctttgcttgttaaggctgaaattcatggctggagtgatggagaagagttggagcaagttctgttgcacttaatcgccaaaatttcaatggaggaaaattctcagttcatttcatctgattgcaagctacagactctctc

SEQ ID NO: 2506 - DNA, 398 bp, Glycine max
ctttagagaaaagaagattgtcaactttaatccgtgatctatcctaaataaataaatgtcgatgatctcaaccacgttcaatttgtgactatgataaatgtcaggcttcagaaggaattatcactgtaaaatatggattgcaaacaggttaacattgtttgatgaaggaccgaatataaaaggataaattgtatataaattcctgaactttgggcgaattatgctttgtccttttttatgaatttcaactgtacaatgttcgagtacaaacctctcgtgatttctaacgtcgatctccttcgatttattcattgaagaaagttaatgtacgatagggaaaaaataaagatatcaaatgtaacattactcgagtttgtttgggtgttgagggtgtattt

SEQ ID NO: 2507 - DNA, 528 bp, Glycine max
ctccaagtcccttctctttacctttaccatcatcatcagctttggcttgtgcattctttatgcatctgcagaactccagagatttgcacactcttccaaacatgatggtgctcttagcttcttggtgcttggtgactggggaagaagaggtgcttacaaccaatcactagttgctttccaggtttgcttttatgtttgtgtgattcatgcaaatatgtgtgaaaactgaaaacttgtattccggcacattaattaatgttagattattttttatgttctagatagaatttcgtttatagcatctagttgctcctcgttgtagttattatcctcttcttttatggtgaaaaaatgaacttttcagatgggaaaggttggagagaagcttgatatcgactttgtagtttccactggagacaacttctatgacaatggactgactagtgaccatgacaacgcgtttcaagaatcattcactaaaatttacacagcaaaaagcttgcaaaatcagtggtacagcgtgttagg

SEQ ID NO: 2508 - DNA, 583 bp, Glycine max
caacattcttctagatgaggagatgaatccaaagatatcagactttggtcttgccaaaatatttgggggaaaagaaactgaagcatgtacagggagagtaatgggaaccttgtaagttcaccaagtatatttgattgtaaatgtgtcgttgtttatttactgagtttaatattttacacatgcttggtgcaaataacaataattttttggcagtggatacatggctccagagtatgccttggacggattcttttcaaccaaatccgacgttttcagctttggagtagtccttctagagattctcagtggaaaaaagaacactggattctatcagtccaagcaaatttctagccttttgggtcatgtatgtttcttgtgtttcacttttgggttatgcatattttagcgatatgttgacttaccaataatttctatggacatattgtatcaggcatggaagttatggacagagaataagctactggatttaatggacccatctctttgtgaaacatgcaacgaaaatgaattcattaagtgtgcagtcattggactcttatgcgtacaagatgaaccaagtgat

SEQ ID NO: 2509 - DNA, 268 bp, Glycine max
actgctggatgcgtttatttaagcattaaactctttttggttaggaggaaactgatgtccatgattctgtccagacaagactacactagttatactcttattatttgatttatccaaattcttcatagacatctagtatttgtcctaaacattttgtctatccttttctcttttggaatataaacattttccagactttggtatgcttttgccctaaactatttgtcgtgtaatatggaattatgagagtataactgttgcacttacg

SEQ ID NO: 2510 - DNA, 319 bp, Glycine max
atgctcttgcagtgttgcagtgtagagcggtgtattttgacctgttagttcgtattgcagtgtatattttgataatttcatgtagatttatgctggctagtggttatatctgtcatttgataaatgttaactttatgtggattgagtatcatatgacttataatccatttcttaagattttatatttatagttctaattgtgtaccaattatgttagttgtccatcaatggacgtggctcatttggcgtgactttgcaggaatagttaggggtttgatctccatagcacacatcattggagaggaaggaggagtcttaa

SEQ ID NO: 2511 - DNA, 395 bp, Glycine max
agtggatcaactgtttttcccgaccctgatgggttcatgatcgagatatgcaactgtgatagcctccctgtgattcccttagttggtgaggtggcaagatcatgttcccttgtgaatcttgagaagatgcagaatcagcagcagatacagaaaatgctccagcaactttgatgagccttttctgttatgttatgtgatcagagcatcctcacggatcacgaggacttgttgcttttttttttatgtggttgagttgtcaatgtgtcattctgttccttttgttttgttttctttaattgtgttatataataataaacaatctgccaaatagatcagcgcttttgcaaccattgattaaagggtttcatagggaagttggttttgctgctctcaat

SEQ ID NO: 2512 - DNA, 643 bp, Glycine max
ttatccaccacttaactcccacacttagaaattactttagacaatcccagaccacgtgtctatagttttgaccaatcttaagttacatttaaacataaattttcatttaaaagaaattaataacacttaattatgttatatgttacttggagattgattagaccctgatggtccaagaccatcccctcaacttaaaaaagagagaaaaagtattcaaatccaaattagtgctttgtatacttatctaattaactacagggaatttaattttctgattcagggatgttgaaatcatgaatcttcaacaacaacaaagttggcttcagattgttaaaggagaagaaatcaatcatttagctaaaggtgctcttcatctacaagaggatttaaactacaataaatggctttaactcattccaaaccaatcaggcttttgtcactctcaaaggctttaacagttacatgcagtgctaatatgtatcagaaaggaataatagcacaagaatatgcagtaattggtgaatcaaataggacatgtgctgtcttcagcacatttttcatgcaagttgtacaaattgacagtgcgtggtgatgcttttcttatatacttttcttttcaatctgcccatatagtttcacatca

SEQ ID NO: 2513 - DNA, 306 bp, Glycine max
  misc_feature (243)..(247): n is a, c, g, or t
  misc_feature (256)..(260): n is a, c, g, or t
  misc_feature (269)..(271): n is a, c, g, or t
  misc_feature (279)..(279): n is a, c, g, or t
  misc_feature (281)..(281): n is a, c, g, or t
caggttcattctcgatagctcaactgtatcaaaataaccccttgcttctgtgtggaacttagatgctttttctgtccaaaatttcagggtgacttgagtggaacatagttatagtttttataccttttctttcccttttgacttgggttgtaaatagattgttcaatctagctgattaggaaccgagtcaatgcttgtcctattgtgtatcttggttttaatttttttttttttctgtttggnnnnnaattatatnnnnnttcttctgnnngacaactngntttactgtttttgttgattgttgga

SEQ ID NO: 2514 - DNA, 356 bp, Glycine max
ggtaactgatctgattatgtacacaaggtggttgtggtggtgatggtgggagcaaaggctgaagagttgattgagcaaaggtgtttgtttctcttcaatttttgctcatttttgcattttggtgtcttgtcattgagcattttttttttcctttctgaaaaatgttaatatgggggtagagttcagtttggttggagggttggaagttggtaagttcatcacgtgggggtacaaattgtatagagagaaaataaagacttatttctttctatgttttcctctaatgtactagtactactctggaaaaccaaaagtgtaaaacgcttatttaaatatgatggtgtacaagttgctca

SEQ ID NO: 2515 - DNA, 617 bp, Glycine max
aaattggtcgaagagggtaaagtcaaatatattggattatctgaagccagcccagatacaataaggagagcacacgcaattcatcccatcacagctgtgcaaatagagtggtctttgtggactcgtgacattgaagaagagatagtccctctctgcaggttagttcaagttcatggcactgcagctcttcttgaaaggagggaaaagaaagtggtttagttgttgttggctgtatttttgtgttaatgcgacttcaattttttaatgcttatattggtttcagggaacttggtattggaattgtaccatatagtcctcttggtcgtggcttttttggcggcaaaggagttgtggaaaatgtgcctgcaaatagctccctggtatatagcattttagcatgtacataattctgctgcataccatggaattgttgataatgacaaattatcaaatagcaatgatcaattctcaatcttgagtgaaacattggttggtttgttgtctgttaattgcaaatacttgtgtgtttaagctgaagtagtgatgcagtggatgcagaccatatttgtttttctccataagagtataaaattatacattttcttttggaaaataac

SEQ ID NO: 2516 - DNA, 407 bp, Glycine max
tcagtcccactcatgctccttctttagattcgactaggttagaatcagatactgatgcttcagacaatgagaaaatagactcttcccctgaccccgtgatggatacaggtatcattaaccctgatcagaaaatcttggttaatgaaggagaaaaaaatgccagtgcagatattcattagaatgagaaattacaaaccttgggcctttgaaataatatacaggcactaaggtagccagatgctgtgacattcttattttgaagttagaatcaagagaccttttgttaatttgatgttggatttaacatgatcacagatgtttttgccttgtgaattctatcttttaacgggcatgaaatgcttgcttgtgcagtcagcagagttttgctgctgttgtggtagacaata

SEQ ID NO: 2517 - DNA, 493 bp, Glycine max
agacactgattgacatatcaaaatgcctaaaacactacactacccattattttggtttctaacctaacatttataattggctactgcagcttgtgttggcaaatcctgttggaaatgtgatggaaaaattgcataagtcaaatattttggattcttttggattaaaaggagtctatctcacagtgggagaagctgtggctgacatttcatcaatctggaaagctcagccttgatctcccatcaaggacgggaaagagaagttaaaggaaccataaaacttaaggggataaactttaaccttttgtttttgcctgcgatgaatacttgtttaaattccggagagtctaatttctgttagtagaaaccttcaaaacaatattaccccgtaaaaagaaaaaaggagtgccttgaaaatcaaggaccttgttcttttactagagtgtttcttatctcaggttgatcagctgatgcctgccgatgttactccttataa

SEQ ID NO: 2518 - DNA, 494 bp, Glycine max
aaatattctcaaaattgctcatacaaggaaccaatgaagaaattggaggtgatcaaagtgtttacaaataagttataccttgacaataaacaggtaacatatattggacaaatgtatttctttttcttcagatatgggctattttacactagtaattatattacttataaattattcttttgtattaagttgcagattccaagaaggcactgttgtgatgtgttgccctctaacgctggtgactcaatggaaattgcaatcagagaatgcaaatatgaagaaatgatttacatgcactagaacatatactttaaatctctttcaccttgctcaagcagcaggtatccttgatgagtgttgctacttaggtagtgtatatagaaagcaagagattgtgtaagaaaattcccaatataaatttgaactttcatatatctaagatagcaatttacagaagcataaaagaatgcttctatcgggtttccctcttgtgt

SEQ ID NO: 2519 - DNA, 584 bp, Glycine max
ccattttcttccctcagaatttggtcaaaactctttccaaatatgatcataggctttggtactacgttgggtcgtactcagagatttatgagggctcccaggtttttggttttggaatggcttttggtggaggtggttttgccatcagttcctctctagcacaagtcctagccaaggtttttgattcatgcatacaaaggtattctcatctatatggaagtgatgccagggtgtactcttgcataacagaactaggtgtgggattaacacatgaaccaggttttcatcaggtaacaattagttccaagaatttaattagaatttacttttgtcatccaatcacatattgtcatgttagttaagtctattgatttttataataactattttcaaaatcatatcggatattggttgatagtgtaaaagtttatacactgaaaatgtgtagaaattaactgtggtttgaaaatgtgtaaaaattgggttaggttgatttgaggggagatatatttggcctattggctgcacatccattaactcccttggtgtccctacatcacccagatcacactgatcctatcaaa

SEQ ID NO: 2520 - DNA, 605 bp, Glycine max
  misc_feature (9)..(9): n is a, c, g, or t
cttcctccncccgtaagcacacttacatttataaaagttctctctttttattttattctcttgtaagtaattatggaaaaagtttacaacattttaaatgtttactgttaatttaattcaaagataatacatgttgtgctgaaataactttgtttggatttcagttatcctaaggattcggacaagcacatgcttgcaaaacaaacagggttaacaaggagccaggtaactaaactaatggtatttgactctttcatttggtgaatggttcttcctcttaataatgtttgttgtgttacaggtttcaaattggtttataaatgctcgagttcggctttggaagccaatggtggaggaaatgtacacggaggagatgaaggatcatgaacagaatcggtctgaggataaatcaagcaagagcaatgaagattctgcttcgaaaatgtcagccccacaagacaaaggtccttccaatgaaaccgaagctaagagtttcaattccaaacatgaggtttctaagagccgagaacactgctatggtttcagtttctaggccatcaacatcaccacttggtgtgaatgtgagaaaccaatcaggattcaac

SEQ ID NO: 2521 - DNA, 333 bp, Glycine max
gaggtgttaaatattatttcctctgttttcgaacgcttcgagagaaacatgtctctgtttctgcccttcatcttcggcttctctgacgccacctcaggacgagatagcgacgacccagatcacgaaactgctcacacagaaggttcactgcgtcaaagaataatcttggtgaaccccttgactcagggcatggtggtgatcgacggcggtttgagcctcgaagctctgtttcgcgaactcgccaacgggaaaggtggtcgaccaccggcttctaaggagtccattgaggccttgccaagtgtggaaattggagaagataatgaggatttggag

SEQ ID NO: 2522 - DNA, 1177 bp, Glycine max
  misc_feature (482)..(482): n is a, c, g, or t
  misc_feature (513)..(515): n is a, c, g, or t
  misc_feature (523)..(525): n is a, c, g, or t
  misc_feature (535)..(537): n is a, c, g, or t
  misc_feature (539)..(546): n is a, c, g, or t
  misc_feature (549)..(560): n is a, c, g, or t
  misc_feature (564)..(567): n is a, c, g, or t
  misc_feature (570)..(579): n is a, c, g, or t
  misc_feature (583)..(590): n is a, c, g, or t
  misc_feature (592)..(600): n is a, c, g, or t
  misc_feature (604)..(611): n is a, c, g, or t
  misc_feature (622)..(632): n is a, c, g, or t
  misc_feature (635)..(641): n is a, c, g, or t
  misc_feature (646)..(661): n is a, c, g, or t
  misc_feature (664)..(668): n is a, c, g, or t
  misc_feature (670)..(671): n is a, c, g, or t
  misc_feature (677)..(679): n is a, c, g, or t
  misc_feature (681)..(705): n is a, c, g, or t
  misc_feature (707)..(707): n is a, c, g, or t
  misc_feature (709)..(726): n is a, c, g, or t
  misc_feature (728)..(751): n is a, c, g, or t
  misc_feature (753)..(755): n is a, c, g, or t
  misc_feature (758)..(768): n is a, c, g, or t
  misc_feature (776)..(776): n is a, c, g, or t
  misc_feature (778)..(780): n is a, c, g, or t
  misc_feature (782)..(786): n is a, c, g, or t
  misc_feature (788)..(798): n is a, c, g, or t
  misc_feature (800)..(808): n is a, c, g, or t
  misc_feature (815)..(818): n is a, c, g, or t
  misc_feature (823)..(850): n is a, c, g, or t
  misc_feature (856)..(875): n is a, c, g, or t
  misc_feature (879)..(884): n is a, c, g, or t
  misc_feature (887)..(893): n is a, c, g, or t
  misc_feature (896)..(898): n is a, c, g, or t
  misc_feature (902)..(904): n is a, c, g, or t
  misc_feature (906)..(906): n is a, c, g, or t
  misc_feature (910)..(915): n is a, c, g, or t
  misc_feature (919)..(919): n is a, c, g, or t
  misc_feature (921)..(921): n is a, c, g, or t
  misc_feature (926)..(939): n is a, c, g, or t
  misc_feature (942)..(945): n is a, c, g, or t
  misc_feature (947)..(951): n is a, c, g, or t
  misc_feature (958)..(968): n is a, c, g, or t
  misc_feature (971)..(983): n is a, c, g, or t
  misc_feature (985)..(985): n is a, c, g, or t
  misc_feature (989)..(993): n is a, c, g, or t
  misc_feature (995)..(996): n is a, c, g, or t
  misc_feature (1002)..(1010): n is a, c, g, or t
  misc_feature (1019)..(1021): n is a, c, g, or t
  misc_feature (1023)..(1023): n is a, c, g, or t
  misc_feature (1028)..(1041): n is a, c, g, or t
  misc_feature (1043)..(1044): n is a, c, g, or t
  misc_feature (1047)..(1065): n is a, c, g, or t
  misc_feature (1067)..(1069): n is a, c, g, or t
  misc_feature (1072)..(1076): n is a, c, g, or t
  misc_feature (1081)..(1085): n is a, c, g, or t
  misc_feature (1087)..(1089): n is a, c, g, or t
  misc_feature (1091)..(1091): n is a, c, g, or t
  misc_feature (1093)..(1104): n is a, c, g, or t
  misc_feature (1106)..(1113): n is a, c, g, or t
  misc_feature (1122)..(1122): n is a, c, g, or t
  misc_feature (1128)..(1140): n is a, c, g, or t
  misc_feature (1143)..(1163): n is a, c, g, or t
  misc_feature (1165)..(1171): n is a, c, g, or t
gtctgagtaagtccagatgtgcatactcttcagtcaatgaacattataattgagcaaagcttctattaattttaataattttagttaataaaccaaaatctatgttaaatggtttttatcagaaataccattcccctagttttcaaccctgatatctgtttgtaaaattttcaggtcttcagagccaacaggatctggtgcatcttttagaccaggaacttggcaacctccaacttgagctttcattacaaccaagggccttgctgagcttgtattagccatgcgctgttttgaaaaatccatgcgtgatatatatttctccctcaagaattttgatataattcatgtgttatcaagtttctagaaatcttaattcattgataaacctttttgcttaaagaatatggccaataaaacaacctgctttatgcatttgcaatgagtttgcttgctgtaatgagtaaaggggatgtttggtttgnttgttttctattttcattttcactgaaaatnnnaaatggtnnnggaaatgtgnnngnnnnnnnnctnnnnnnnnnnnntttnnnnaannnnnnnnnnccgnnnnnnnnannnnnnnnntttnnnnnnnnataaggccacnnnnnnnnnnncgnnnnnnncgaannnnnnnnnnnnnnnncannnnntnnttttcnnntnnnnnnnnnnnnnnnnnnnnnnnnntntnnnnnnnnnnnnnnnnnntnnnnnnnnnnnnnnnnnnnnnnnntnnnaannnnnnnnnnnacggcttngnnnannnnngnnnnnnnnnnnannnnnnnnnttccctnnnnccctnnnnnnnnnnnnnnnnnnnnnnnnnnnngcttannnnnnnnnnnnnnnnnnnntgannnnnnccnnnnnnnatnnntttnnngntttnnnnnngaananttaannnnnnnnnnnnnntgnnnnannnnnggtcatnnnnnnnnnnnaannnnnnnnnnnnntnccannnnntnntttttnnnnnnnnnaaacatccnnntnttctnnnnnnnnnnnnnnanncannnnnnnnnnnnnnnnnnntnnnacnnnnntcctnnnnncnnntntnnnnnnnnnnnntnnnnnnnntatctcccnattaannnnnnnnnnnnnctnnnnnnnnnnnnnnnnnnnnncnnnnnnncatttt

SEQ ID NO: 2523 - DNA, 352 bp, Glycine max
tgcagtgacgatcaaaagcatgttacaaggtacaacatctggctgccagaagcatcaaaagcatgtaggacacaaaaaaagaaaaagcttactcccaataacagccatttaccacttttctagtggttttcccactatatcaggaggaaaagagataaggattgagtgtctgacatacatacatgcatacataagttacaggttatcaaattggagatactaaaactggggtatttccaatcgcaggctggagactggctgcatgctcgagttgtttccacgcttccttccgcttctctgccgccatgtttagcattacttcttcttccttgaattgagaatgagaagccag

SEQ ID NO: 2524 - DNA, 731 bp, Glycine max
gcttgtgtggggagaaaaaacccaaatcaaagaaactagaagggcagccctcaaagaatctcatggcagaaagaaggagaagaaagcgtttgaatgaccgtctttccatgctaaggtcaatagtcccaaagattagcaaggtgattcaaaatatatagtattatgtttttattttttctttttttacctcattcttaccttgtcaattcctttttatgaatgtctcaaccaatggaaatgaaattggatttctcaagtaggttgtcttttcatgattgttattttttttttactaacacttgcatttgttgtttgatttgttctataaccttaatttgaactaacatgagaatacaaactttgacagatggacaggacctccattcttggagacacaattgattacatgaaagagcttctagaaaggataggtaagttgcaagaagaagaaatagaggagggaacaaatcagataaacctcttaggcatttctaaggaactaaagcccaatgaagtaatggttagaaattcccccaaggtatgcttagttctaaccagtcagtcaaacccctaaactgatccataatcacaggccaagttcctgaacaaatgtatgtatgtgttgtaatgtttttgcagtttgatgttgagagaagagaccaggacacaaggattagcatctgctgtgccacaaagccaggattactactgtccacagtgaacaccttaaa

SEQ ID NO: 2525 - DNA, 646 bp, Glycine max
  misc_feature (637)..(639): n is a, c, g, or t
gaagaggtttccgccgttccgccccttgaaatctctatcaacgattctagccagctcacgctctcgtttcgcggccaagtctatgtcttcgacgctgttacacctgataaggcactttttttcttcttctcttttataatcactgtctcttttaagaatgaactaatttatgcttcttcttttcttcactgttacgacggcgccgtttcaggttcaagcagtgttgttgctgttgggaggaaatgaactaacttcgggttcgcaatgtgcggagctatcatctcaaaatcagactgtatgtttggatgcttagagaattttaggcttaaacatctcagaaattaagaagggaaaataaattggaacttattcaaagttaaaattaacgtatcaccttaatatttagacaagttagatgagaaagcttctgtaaaagttaaaatgtgtaagttgattttaacttatacgagagacgctcaattcattttactttcttatatttttgtcctgtgtaagtgcttggagcagttagtttattcaaacggatctttgtgaaggtattttctaattaattgtttgtttgttgatgatggatgtagggtgaggaggaatatcctgcaaaatgtagtctaccacnnncgagcag

SEQ ID NO: 2526 - DNA, 319 bp, Glycine max
gagtctatgcctcatgtctcatcctcaacccaaacaatgcatttttgaacatatttactttgcacttcccaattcggttgtttttgggaggtctgtgtatgagtctcggagacaatttggggagattttggctactgagagtcctgtggactgtgatgttgtgattgctgtgcctgattctggtgttgtggctgcgcttggttatgccgccaaagctggggttccgtttcagcagggtttgattaggtcacactatgttgggaggactttcattgagccctctcagaaaattagggactttggtgtgaagctgaagcta

SEQ ID NO: 2527 - DNA, 744 bp, Glycine max
  misc_feature (583)..(585): n is a, c, g, or t
  misc_feature (590)..(593): n is a, c, g, or t
  misc_feature (634)..(636): n is a, c, g, or t
  misc_feature (640)..(648): n is a, c, g, or t
  misc_feature (653)..(657): n is a, c, g, or t
  misc_feature (659)..(663): n is a, c, g, or t
  misc_feature (668)..(668): n is a, c, g, or t
  misc_feature (672)..(680): n is a, c, g, or t
  misc_feature (682)..(682): n is a, c, g, or t
  misc_feature (710)..(716): n is a, c, g, or t
  misc_feature (718)..(719): n is a, c, g, or t
  misc_feature (724)..(725): n is a, c, g, or t
  misc_feature (739)..(739): n is a, c, g, or t
agcccactcccctctacacagtgagagaccagcagtagttgactttggaacactctcactgggagatgcaaaggggaaaaactggacccttgggtgcctctacctcatagggcattgcttgtcctggtctgcttggcttgtgctccaagcacctgtactcaagaagtacccagctcgtctctccgtcacttcctatacatgtttctttggactcatccaattccttgtcatcgctctcatcgttgaaagggatgcccaggcttggattttccaatctggtggagaagttttcactattttatatgcggtcagttactactatctatatactactttcatttcaacctaccctctcttttttacttttaaagaagataaattgaaaaaacaaaaattgtgactagctgaaaattttcttcaatttaagagtatataaaattattaatatttctatattaactttagcttaaaaatcaaaagcgcgtaattaatgaattatcaatatgcaaaagtctctccatatatataggcccagcctaatttcatagaaacggaacaaattaaagttggtcgatcgctttannntaaannnnatttctctctatcgttgtctgtatgcgtttgagttgcgaannnattnnnnnnnnntattnnnnnannnnnctcangcannnnnnnnntnctggaaaaaaaaaaggggggggcgcgcnnnnnnntnnctagnntttttaatgataanaaaaa

SEQ ID NO: 2528 - DNA, 375 bp, Glycine max
  misc_feature (5)..(5): n is a, c, g, or t
tttcnctacctcgccaacaagcttgcagaaagaggacacagaatctctttcttcatttcaaagcacacacatgcagccttacagcacctaaatcaccaccccaatctcatcacccttattccaatctgtgttcctcacaatgattgtggcctaattccccatgttgctgaatccatcacttcagaagttccttcctccactgcctcactatttgagaaggacattgaagtcctcctccttgagctaaaattaaacattgtgttctttgatcatgcatattgggtaccaagaccatgcttaactcggtgcctaggcattaagtccttagtgtattatgttataagcatttcatcattggcttatgacttatcatgt

SEQ ID NO: 2529 - DNA, 745 bp, Glycine max
atattggctatgtacaaatgaccaataaaaataagtgaggagcaactgtattttgtacagaagtgatgaagaataaaatgaacagcaagaggggtacaaagaaatcagtctccctcgtctggcctaacattgaaattgatgggatcattgggatggtgatgaatttgacggtgccactgatgctttgcaaatagggcaccagttctttagctgtagccactgctgtatgcaagccacatgatacgcatgctcgcattgcagactccccacttcatctgcagccacatattcctcctacagatcaagtcaatttatcaaaatcagatgttgtaacaataaagtgcatatcagtttgagacagataatggctagtcctagattcctttttgcaaaggagggaaatgtgtggcattaagagcttatacatctttacaatgaaatatacagaaagcggcagagacttttgccgaccaagatttaatttagctctgctggaatcaaataccaattttgtgatattgtcaatcaaatgctgcagaaagcaggtagatcatcaatccatcatggacaataagctttgagtcatgatggtgcttaatgacaccctgactgcgatggaaggttcaaaacgagagaaaaatacctggcaaatgctgcatttggtatcatccttatgttcattgcaactctcagctgcattttcagagggtggggactggtagaaacttttctttaggcattctga

SEQ ID NO: 2530 - DNA, 401 bp, Glycine max
ggccttcttcgacccaatgcagataaagaagacggaaatgagtcggaggcacagagtgttaggcaatcgacagcctcagattccactgctcgaggtccccaaagaccagttttttctcctggttcaaattcccagcaacatgatctggaagagaaatctcgtagacagacacctagagagcaaccaccttcaaggcaaaccatgcagccaaagccaccatattatagtcaacaacaacacccttccgataccatgtctggctctgttggaggtggacaacagggctttcatcaacaaagttttgacatacagcatcccccacaagaatcttcccagtttgctgacagacaacaagcagttggtccagagaccccatttcctgagtatccaacaatgcaaaa

SEQ ID NO: 2531 - DNA, 1047 bp, Glycine max
  misc_feature (37)..(38): n is a, c, g, or t
  misc_feature (1034)..(1042): n is a, c, g, or t
tacagcatgaacttatgttttgaaagtatcatgttannggtatccatagtttgcagcaggactaagagcagcggaactgctacttgagtggcgggcttccaatctagccttgcaagttaattattttgcattctagaggtattgttgctttattttatgttgccttaatgataatggtggaaatgagttaagcttcacaatggcatttcttaacttttaagcttaatatgccgaaaattacatatcttatattttttgaagaagttatggaatttggatccttgaaattattttggctaattatgagttgcaacttgtaatcctatatagttgaacacaagagctcatgaggctggctcaaatagctcataagcctaactctagctgagcatccgctactcaattggtaaaaatagtctcagttataattttcagaaaagacaacaaatttaatggtcgcaagatttcttaaagttgctagtagattctgttaatttcatgatggtattaactgcccaagtttattagtgtgcaattcacacgtttggtatctctttaattacagaggcttgcaatagtatataacttttgttacaagtgtgacattgtctgctatattttattttgccattgttttgggtatttgggtcccatttgcacatggcataaaggtcttgcttttgctctctaagtgtaaggggcccggattccttaacgagttgttctatgttggtctgaaattaaaacgttggcactgcaaactacaatattctttagttaggttttagctcttaacaaattttatgatgtgcaggtcatatatagtcatgctcaccaagttgtgtctgagtcgctccagatggcgaaggaaactggaatgtgcaggctgcttttccatttggacatttacactagtgtatttatacctaatgctacctgtactcaagaagagttgcagtagtattggatcgatggatgctggaataggtttctagcagccattttaggaataaacttctgtaaaaaggaaaatnnnnnnnnntcaaa

SEQ ID NO: 2532 - DNA, 566 bp, Glycine max
aagattaacagatgagtcgggagatactgatactgctgtattgaatgacatcatgcgtgaagttgacactgacagggtttggcaatcttgctcataactcattgttttattatccatttagcaggttctatacttcttattgacactgccaatgcaatgtaaacaaaagcagatatgcttgcatttctcataaaatgtgattgatataataatcatgttacatctcatatacgccccacatgttttcctcaagtccttaaaacgattttctatttttctgtgttcacaggatggtcgtatcagttatgaagagtttgtggccatgatgaaaactggaactgactggagaaaagcatctaggcagtattcaagggagagattcaagagcttgagcataaatttgatgaaggatggctcacttcagcttcatgatgatattagtggtcaagctgtagtggtttgagtccgaaattgtaatcttagtgctcactcagtttctcatcttccttcaccacttaatatgcttgaaaacatggtttctttactctccctgaaagcaaacaaca

SEQ ID NO: 2533 - DNA, 387 bp, Glycine max
agcctcacaagctgcccaccattttcagtgcctaactacatggctccaaccctttccgccagggccaaagtacgtgctagtagtaatccaagagaaaggcttggtggaactccaactagtactgattcaaagaggagactctcattccctttgtcacaaggaattgggtctttcaagtggtccaaagggttctcaaacaaggatcaaagagtcccagataaatttcagtcacttgaatctataggaaacgtgagtgtggattcaacggtgtctttgcccgcaagggtggtgggaagaaagccttttacaagatttgtgtgatttattttgttttattcttttttttaaccattttattttgtcaatgctggtggtgttatcagtaaa

SEQ ID NO: 2534 - DNA, 814 bp, Glycine max
cgttgaaattttactgcttttgttcacgaattctcgtcaattaagggaccgggttgactttctgttagaaaactcgaggaaaaaataaagctcatttcaccctcccctacccccttttgttgtagatcttataggttttgctgcaattaatatttcccttcagtttggatccacgtaaaggaacataattttcataattttacctttttttattatttttcttttcaatttttgtttcctttgcaacaatacaaccggggtattcgtggtttggtttgtgaagccgttttgtttgttattgtttacaaattaactctaaagcgcacgcggtaaccagagggatcgtgatcgcgaaagggctcaggctagaaccggtggtaaaggcaagcagaaagatgatgggttgacccctgaacagcgcagggaaaggttgggttgatgtcatttatcacacatgctttgtaatctctcacaattttattttattttttaaaattaattgtgtaacgttgatttgtgtgtgaaatgttgtatttttttcatgggcagagatgcgaaggcgctgcaggagaaggcggcaaagaaagcggcacaggatgcaggagggaataatgcaggtggaaccaaaaaataggcaataattcaatgagtggtttgagttcgacattgttgtttgtagacatggaatttatggaaaatttatgttgcgttattcgtggagtatgatgtgtttattaatgtaatttgtgacagatgaataaataagttgtgcttctttgaaaggtgttgtcgctggggggctgaatcaataact

SEQ ID NO: 2535 - DNA, 1111 bp, Glycine max
gttaccacagcggttttctgtttcattctctaagtgcttttggaaatgattgtcatccaaatgtgaagaatgaaatctgcacacagtaagtattcctctggaagtattgccatgtcttttatataaacaacaccattcaggttttgagatatatggaagaaagaacaaacaataatgtgtttttttttcaattgtctgatgatcaccgaaggatcaatttgaatcctttaagaaaaaataggaattatagaggttcaattttgatgcaatcgctgttttgaaaagttttaagttggttagacaatgtatgaatgtcaaattcattaaaatgacatgacaactcattattggttcatattagagtaaaactttttctttgttgactctacattaaaattaaaaaattcaacgtaaaaaagaaaaaagatcatatgatttgttctactataattcaggtcctccacatttgcgtttttttcttctgcatttattttttgagtttaattctctgaattatggagtttatttggtaataatctcacttcccttctaaaaaaaattgcatcaaaaataaaaagtggaagagaagagaaattcacttgagggatattccttatcatctcaacatagcctaaaatgttttaacctttaggatttatttggtgttcccctaaaattgaaggtgaaaaacagtttatactaaaatttgtataaataaccaattttaagagaatatataacttttaagcaaatagttatttgcaagccttacttgtatttcaaagcgctaattagttcatgttggtttctttgtttatacagctttgctaactgtgagctacgttcaatggttatcattgacagagggtgagcattttatttgcgaaaaaacttacacttagatttctacagaaaattcacctctgaatttcatttattatttttgcagtatgattggttcagatgagtcctctaccaactatcctggcaaagttccatatggccttgaccttcctagtgacgttgctgaccagaagcatccagagaatgggcaggcaaactgatagtggaattttcttcatttttatgatttcctaattacatttatgat

SEQ ID NO: 2536 - DNA, 398 bp, Glycine max
ctgtcttctccggcggcttctctctctccgccagagtcgccgccatcggtgaacgagatggtggcttctctgcgtaatttgcagcttgggaaaatgaaatcgatgcctcataatagaaacgtgtcggtcgggtcgccgaggggatcggtactccgaccgggttttttaagccttccaacaacgccaactcagcaaccggttcggtctggggtgaagtgttttgatgtttgggatgagagttttgaggaggaaccggttatggagagggtggagtcagggaggggaataagggctaagatgtttgagaagctcagcaaggagaattcactcgacgcctcggcttcgcctccggatcttgggtgggtctcggagcttgttaagtgagaagccagtccttg

SEQ ID NO: 2537 - DNA, 412 bp, Glycine max
cttctgaaagctcatgggatggatcatcagccaaatcctcaaaatcaactagggagagaagggggaggaaaaatacttcctcaatagcatctcctgtttatgcgaagggtaagaatgtttcagaaacttcatctaatcgagtagatgatgaaaatagagagtggactcctttgtcgaccatggcatctaacatatcagaaagaagcatttggcccacatctagtacttctatgcatgttccaaggaatcaaatatctggttttgaaactgcccagacaagtggatcagattctccattacccatatctccggtgcttttaggtcctggttctcgccaaagagataattctggggttgttccatttacattttatcctactgggccacctgttccctttgttacaatgcttcc

SEQ ID NO: 2538 - DNA, 374 bp, Glycine max
  misc_feature (367)..(367): n is a, c, g, or t
tttgattggtgtggtgttgtttttctccacccttaaagtaatggttgtaagccttattgctatggcaattggccttctgatgcagccttgtctcaaatttgttgagaagaagaggtggatgaagttttcccatagttctgagctccctgattttggcaatcaggaggacactcgcactttggtgcattaatctgtcctgtttcaataatatggagatgatttgttcttctaggtcttcaagcatgcttgttaagtttatacttctctgaacccaacaaccatagaagggcagctttttatcctacacctttggtaattcaactgtttgtctatgtttttagtttgatcaatagatgggatgccaaanggtggtg

SEQ ID NO: 2539 - DNA, 627 bp, Glycine max
ttgagcctctcattgccgtgcacaatatgatactgtcgcatgccaaggctgttgaattataccgcaagcactttcaggtatttgttgtcacactttctaggttagttgaaaaaggactaaaggctaagaagggtgtttaatttgtaaactactcatactaatccaggcaaagcaaggtggaatcattggcattgttactcataccttcatgtatgaacctcttagagatgaagaatgtgatagacaagccgtgaaaagggccttggcttttgttgtagcctggtaagttgtgttaataagtggcatttaaactgcatataccattatgtactttattaatgaaaagaattagcagcaccagatccttgaaattttgtgaaaactttttctgctctttcaaaggtccttagatcccttggtttttggtgagtaccctcctgagatgcactctattctcgggagtcagttgccaagattctctcctgaggagaagagtctcataaaaggcagcatagacttcattggcatcaataactatggaactctctatgccaaggactgctccctcactgcttgtcctcttggaacagatcgtccaatacgaggcttcgtagaagcaactggaac

SEQ ID NO: 2540 - DNA, 406 bp, Glycine max
ggaacaccaccagtgtcttaccctgcggttttggacactggcagtgaccttatatggacacagtgcaagccttgcacacggtgttacaaacaaccaacacccatttttgatcccaagaagtcctcttctttttccaaggtttcatgcggtagtagcttgtgcagtgctttgccttcttcaacatgcagtgatgggtgtgagtatgtttattcatacggtgattattcaatgacacaaggcgttttggctaccgagactttcacttttgggaagtctaagaacaaggtttccgttcacaacattggttttggttgtggggaggacaatgaaggtgatggatttgaacaagcttcagggctggttggtcttggacgtggtcctttgtctttggtttctcaactcaagg

SEQ ID NO: 2541 - DNA, 342 bp, Glycine max
tcttctgtggggttctgatccatgaccgaataacagtggccaattcttccacagtaatgcaccctattaatcatacacaaatgttatacataatagcataaccattatgtgtgtgaaaacatatcaaatatgatttaaaatcatagatagatagtgcataaattaattagaaagaaattgctcaccatctccatctttgtcaaacaagccaaaggcttctttgatctcaccaatctgttcttcactcaggacatctgccatggtgttaatgtttgtacaaaaacaatattttgtgactcagaaaagagagagagagagagagagagagagagagagagagaa

SEQ ID NO: 2542 - DNA, 716 bp, Glycine max
tgtcagcggtggttgctggttcctcctcttcattctctgccaccttcacccccataaggagcccctccttaaaaaactctcaactctctcattccaaggcactcacttcacctcaatgccaggttctactacttactatactttgcttattacaagaaattgttacataatttgagatcacgtaattgaacgttattaactttttcttataaattgaaaatctcgaatatatgttgcgtgaagatttttaagtaagcaccatggacacatgattatttgggaccacgtaataatttatccattgctattgattaagaaatagaattcattttgctcttgtatctgcagaaaacatctttacaagggctctcacttcatgaagccaaaaggggtgtttcagaatccttcctagttgagaacaacaatggttcctccattgctggaaggagacttgagatcacagcacgaactgctggggcttcaaagacaattgaggtggaggttgacaagccacttggcctcaccttaggccaaaagtctggtggtggtgttgtcatcactgtgagtatctagcacccgtctattcaattgaatgatttcctatttgtgaatgaggattgtttatgcaatgcttgttgtcttctataggctgttgatggtggtgggaatgcagcaagagcagggttaaaggcaggggaccaagtcctttacactag

SEQ ID NO: 2543 - DNA, 385 bp, Glycine max
  misc_feature (90)..(90): n is a, c, g, or t
tcggttgcttgggcgcctcacgagttgggtctttgcttggcttgtggctcatctgatgggaacatatctgttttcactgcaagagcaganggtggctgggacactgcaaggattgatcaggctcatccagttggggtcacttcggtgtcgtgggcgccatcgatggcacccggagcccttgtcggtgctgggttgcttgatcctgtacagaagctgtgctctggtggttgtgataatactgtgaaggtatggaagctaaacaatggactctggaagatggactgcttccctgctcttcagatgcacatggattgggttcgagatgttgcttgggcacccaatttagggctccctaaatctaccattgctagtgcatcgcaggacg

SEQ ID NO: 2544 - DNA, 456 bp, Glycine max
gattggttcttcttccacttccaacgccatgcctctttttggaattttccagataccctcatttatggacataatcactgacctcgccatgttcattactccgctatggattgcggttatcgtcggcgtcgtcgtgggctgggcgtggaagcccaaatgggcctttcaccccaaagacgctcttctcaagtttcgctctcctcgccctcccaatccccaaaacgacaccgcttttacctactccgccaccaggtttgcaaattgccgaattctaatgctaatgcaaatgcaaatgcaacatctcataatcttcatttctaatttcagttcctccgcgcgtgagaaagacgcgagtgggagtcctgtggtgacggaagacgatttgctgcatctgtggaagttggttgaggaaaaagacggagggcgggcatggattcagatgatggaccgttctac

SEQ ID NO: 2545 - DNA, 384 bp, Glycine max
aaatcgcatgtcatgggcagtgtttgttgcgcctccacatcaggcagtgatagggcctcttccttctctcatcaatgatcagaacccacccaagttttcaacaaaaacctatgctgagtatcgctatcgcaaattcaataagctttcccaataagggaccaaaacatcatcacttgtgttgtcacggtgaaataaatttgtaagccatgatggaggataacaaagtaggagctaactctccattttggttaacaagtgtagctaatttctattatgcttttgaagtaaacagggctttgtccccttggcatttggtacatgccatattccttaataatacaataaggctatattcctgttctacttcattaagagtcactgagt

SEQ ID NO: 2546 - DNA, 996 bp, Glycine max
  misc_feature (330)..(333): n is a, c, g, or t
  misc_feature (869)..(871): n is a, c, g, or t
  misc_feature (958)..(960): n is a, c, g, or t
aggaagggaccaatcactagagccatgagcaagaggctccaagaggaattgggctagagctgctgaaaaaggccctagggttctcatgaacctcagggtagactaggatgtcattatatttgatccttgtatttagggctccatattgtaggtagggtaccctagaaatataagattttttagcccttgtattttagggcacctagactagtttttgtattaggggtagttttgtaatttcacatgcactaagtgaatatttgatgtgtgtggatggaaataaatttaattgaattggtagaagcccaatccaattaaattttagagggnnnnaagtggcatagattggaagagaccggaagaaaaggcaacgaaagaagcgatagaacgcgttccgctaagcattaaataaaagccgttaaattagaatcggagatttaagctggaggaggatattctgaaatcccatccaatcgaaggctgtgaagtgtgtgatgcactctatccttctttctcttgaacccataattccatgactcggcgttgctcccactgcagcaacaacggccacaattcccggacatgcccttcgcgtgggggcggaggtgtgaagcttttcggggtcaggctgacggatggatcaatcattaagaagagcgccagcatgggcaacctaaacctctcctccgccgccgcacatcaccaattccattcatctccttcttcttccaacctcacatgcactaagtgaatatttgatgtgtgtggatggaaataaatttaattgaattggtagaagcccaatccaattaaattttagagggggaggtgagcatttgcttactacaccccattgccacatcatatannnacactttgtgcatgtccttcatgctttacatgcctcatgacacctaaacacacttagtggagaatcttggaattgatcttggattannnggctgaaccataactaaaattcactaatcataatta

SEQ ID NO: 2547 - DNA, 235 bp, Glycine max
  misc_feature (53)..(56): n is a, c, g, or t
gtgtgaggttgatgtattcggcattcgaaggcgatgtggatggaattcccttnnnnttggagtctggtgtgagtgtgaattacaaggatattgataatcgcactgctcttcatgttgcggcgtgtgagggcttcactgatgttgttgatttattgctccaaaaaggtgctgaagttgaccccaaagatcgatgggggagcacggtaactaagctttttttttttttttttttttt

SEQ ID NO: 2548 - DNA, 412 bp, Glycine max
tggcaatgtcaatttctctttcaggacaacttgtaacatgcgtaattgcactcaaccaaggccggctgatcataattcggtatgatattatatgtaatgtcattttttttttaaaatgtgattttcatttcgttaatgatttatggttaacatttatttgatgatttctttttatcaatttctctctttttgcttgtgtttcttattgtgctttcttttatattcctattttctgttcactcgtgttccatgagtttttttcccaaataatggggagtatagagggtatggaaatcaaatgttcatacatacataaaggactgaggtgtagttatattatgcttcctttagagctacttttatcatcaaatctctatgtattcatttactactatccaaaaatctgctgcca

SEQ ID NO: 2549 - DNA, 365 bp, Glycine max
catatttccttttctctcttcttccttccttccttccttccttccacaaatgttgcactctcactctcaccatcaccaccttctcttctccagtctccctcttcgtctctcactcaccaccacccatcacaactcttctttaccatctcttcattttctccacagacccatcatcaccaccaccaccacaacaactactgtttcagccattcctcctactgctgcatggcttgcaaagctcacaacacaagactttgcccactttgaactcccttcttcccatcttttcacagatgacccttctaccattcaggttgcttgcagtgttcttctcactggtgccatcactgtcttcttctttcgct

SEQ ID NO: 2550 - DNA, 305 bp, Glycine max
tggtaagtttcagtttttctttttagttggatttcttcagagctgatgaatgaatgctttacttttactttatagtgagcaattctttgatacctgttcttataatatgcttatattatgtggaataattgtaggcgtggaatcatcgtcaatattcaaatcctactgcagaaagcctctctagctttgagcttttcctgtgtgggttggctgctggaacatgtgccaagctcgtctgtcatccacttgatgtggtcaaaaaaagatttcaggtagattttagaatgttgaacccctcatccccc

SEQ ID NO: 2551 - DNA, 385 bp, Glycine max
tcgaatcgcttaattttgatttagttttccaccgcaacgcggaacctctttctcgaactggctaactctcaggcaagtggctcggacgctgattccagcaacacgcggctggtggttgcactgtatgacgccctaaactccggcgactccaacgccgtcgtcaagatcgtcgccgccgacctcgagtggtggttccatggtccgccctctcaccagtttttgatgcgcatgctcaccggcgactccgccgccgacaactccttccgattcgttccgcagtccatcgccgccttcggctccaccgtcatcgtcgagggctgcgactccgcccgcaacattgcctgggtccacgcctggaccgtcactgatgggatgatcactcaaa

SEQ ID NO: 2552 - DNA, 1375 bp, Glycine max
  misc_feature (426)..(426): n is a, c, g, or t
  misc_feature (438)..(438): n is a, c, g, or t
  misc_feature (445)..(445): n is a, c, g, or t
  misc_feature (498)..(499): n is a, c, g, or t
  misc_feature (566)..(573): n is a, c, g, or t
  misc_feature (581)..(583): n is a, c, g, or t
  misc_feature (589)..(594): n is a, c, g, or t
  misc_feature (603)..(603): n is a, c, g, or t
  misc_feature (605)..(607): n is a, c, g, or t
  misc_feature (612)..(617): n is a, c, g, or t
  misc_feature (624)..(624): n is a, c, g, or t
  misc_feature (627)..(627): n is a, c, g, or t
  misc_feature (640)..(641): n is a, c, g, or t
  misc_feature (646)..(653): n is a, c, g, or t
  misc_feature (656)..(660): n is a, c, g, or t
  misc_feature (669)..(673): n is a, c, g, or t
  misc_feature (675)..(675): n is a, c, g, or t
  misc_feature (687)..(691): n is a, c, g, or t
  misc_feature (693)..(701): n is a, c, g, or t
  misc_feature (710)..(711): n is a, c, g, or t
  misc_feature (726)..(727): n is a, c, g, or t
  misc_feature (741)..(745): n is a, c, g, or t
  misc_feature (770)..(774): n is a, c, g, or t
  misc_feature (776)..(787): n is a, c, g, or t
  misc_feature (796)..(799): n is a, c, g, or t
  misc_feature (802)..(809): n is a, c, g, or t
  misc_feature (813)..(816): n is a, c, g, or t
  misc_feature (820)..(824): n is a, c, g, or t
  misc_feature (826)..(831): n is a, c, g, or t
  misc_feature (834)..(834): n is a, c, g, or t
  misc_feature (838)..(850): n is a, c, g, or t
  misc_feature (853)..(857): n is a, c, g, or t
  misc_feature (859)..(861): n is a, c, g, or t
  misc_feature (863)..(868): n is a, c, g, or t
  misc_feature (870)..(875): n is a, c, g, or t
  misc_feature (877)..(880): n is a, c, g, or t
  misc_feature (882)..(891): n is a, c, g, or t
  misc_feature (893)..(893): n is a, c, g, or t
  misc_feature (895)..(895): n is a, c, g, or t
  misc_feature (897)..(901): n is a, c, g, or t
  misc_feature (903)..(906): n is a, c, g, or t
  misc_feature (909)..(909): n is a, c, g, or t
  misc_feature (911)..(922): n is a, c, g, or t
  misc_feature (930)..(946): n is a, c, g, or t
  misc_feature (948)..(950): n is a, c, g, or t
  misc_feature (952)..(955): n is a, c, g, or t
  misc_feature (959)..(962): n is a, c, g, or t
  misc_feature (969)..(975): n is a, c, g, or t
  misc_feature (977)..(1001): n is a, c, g, or t
  misc_feature (1003)..(1005): n is a, c, g, or t
  misc_feature (1009)..(1011): n is a, c, g, or t
  misc_feature (1013)..(1013): n is a, c, g, or t
  misc_feature (1020)..(1030): n is a, c, g, or t
  misc_feature (1033)..(1056): n is a, c, g, or t
  misc_feature (1060)..(1074): n is a, c, g, or t
  misc_feature (1076)..(1076): n is a, c, g, or t
  misc_feature (1081)..(1087): n is a, c, g, or t
  misc_feature (1089)..(1098): n is a, c, g, or t
  misc_feature (1101)..(1113): n is a, c, g, or t
  misc_feature (1116)..(1124): n is a, c, g, or t
  misc_feature (1126)..(1137): n is a, c, g, or t
  misc_feature (1142)..(1144): n is a, c, g, or t
  misc_feature (1148)..(1163): n is a, c, g, or t
  misc_feature (1167)..(1174): n is a, c, g, or t
  misc_feature (1177)..(1181): n is a, c, g, or t
  misc_feature (1199)..(1210): n is a, c, g, or t
  misc_feature (1212)..(1215): n is a, c, g, or t
  misc_feature (1218)..(1220): n is a, c, g, or t
  misc_feature (1223)..(1232): n is a, c, g, or t
  misc_feature (1238)..(1243): n is a, c, g, or t
  misc_feature (1246)..(1250): n is a, c, g, or t
  misc_feature (1253)..(1256): n is a, c, g, or t
  misc_feature (1262)..(1265): n is a, c, g, or t
  misc_feature (1267)..(1269): n is a, c, g, or t
  misc_feature (1274)..(1278): n is a, c, g, or t
  misc_feature (1280)..(1291): n is a, c, g, or t
  misc_feature (1295)..(1295): n is a, c, g, or t
  misc_feature (1301)..(1307): n is a, c, g, or t
  misc_feature (1310)..(1320): n is a, c, g, or t
  misc_feature (1323)..(1330): n is a, c, g, or t
  misc_feature (1333)..(1340): n is a, c, g, or t
  misc_feature (1343)..(1343): n is a, c, g, or t
  misc_feature (1345)..(1348): n is a, c, g, or t
  misc_feature (1351)..(1364): n is a, c, g, or t
  misc_feature (1366)..(1369): n is a, c, g, or t
ccccctcctggcaccacgcccccctcttctgctccgccgtcaccgccaaactcctccccttcaagttccccggtttcgacctctccctcctccgcatcctccaccccggcaccacccacaccgtcaccctcccctccctcaccctccacgtcaccgtcatggacgcctgtcactgccccggtcggtaaccctatcaccctcccccttcctcccccaattcttcttcacacactttctaattctccctttttcttccaacaggttccatcatgctccttttccgcggcgacttcggctgcatcctctacaccggcgacttcaggtgggaagccacgtgcgagcgagcaaccaagtcccggcacgtgcttcgcgacgcgctccggcacgttcccgctgttgacgttgttcaccttgacaataccaaanaattaggacganaacatcnatgacatgaaagggaaaccatgaatttgaaaaccaaggacaatgaccatagannatactaattaagtggtgtcatgtcatgtagtcatgacacaataggttagagcttcaacatgaatgtnnnnnnnncttctcannnggatgnnnnnnaaaccatgncnnnatatnnnnnngagttanacnaattggcagagannctgannnnnnnnatnnnnnagaatcttnnnnntncaaaaggatacnnnnntnnnnnnnnnaatgaggcnnatggagaaaatgccnnctttggcaccaagnnnnnccactaccctccatgtccccatccnnnnntnnnnnnnnnnnnctacctcannnnatnnnnnnnntatnnnncctnnnnnannnnnnaangcannnnnnnnnnnnncannnnnannncnnnnnntnnnnnncnnnnannnnnnnnnncntnannnnntnnnncangnnnnnnnnnnnnaacatacnnnnnnnnnnnnnnnnncnnntnnnnctcnnnnaaccccnnnnnnnannnnnnnnnnnnnnnnnnnnnnnnncnnnttcnnntntaaaaannnnnnnnnnntannnnnnnnnnnnnnnnnnnnnnnntccnnnnnnnnnnnnnnnantccannnnnnncnnnnnnnnnncgnnnnnnnnnnnnnccnnnnnnnnntnnnnnnnnnnnnttttnnncctnnnnnnnnnnnnnnnncccnnnnnnnnatnnnnncctccctcccctttcttnnnnnnnnnnnntnnnnatnnnctnnnnnnnnnncttatnnnnnncannnnnacnnnncacatnnnncnnntcctnnnnnannnnnnnnnnnnactnctctcnnnnnnnctnnnnnnnnnnntcnnnnnnnnctnnnnnnnntantnnnntcnnnnnnnnnnnnnnannnntctctc

SEQ ID NO: 2553 - DNA, 357 bp, Glycine max
ctccatttggtcactatttggtgaaccaaaccgggagaggaaatttggtcagagacaggaagcatgtgagtgcttggtgggatgatattagtaacagacctgcttggcagaaggttcttcagctatataaataccctgtctagttagttcgatctaccccaacattccaagatggtgtgagggatgtgccttcagtgttttctgatacctgtttgagaatataatggaggctatctgcaagatgtggacctgtagttttttttggatttggatcttttcctcttcttgaataataacattggatggtgaaaacataaatttaaaattattgagcagtgtgattagttgttgagtcca

SEQ ID NO: 2554 - DNA, 379 bp, Glycine max
ttccttgtacggtgaggacaaatggaccttaaaagtgtggggtgatgtcagtcatctgaacgaaactggatttctagagtctggttttggaggtgatagaaattctggttaggccattgtttcctattgaaggtaataaaggtttgattgtttcccatccgaagttaataaaagattagagaaagagcagaaaatggatattaatcagtggtgctaaatatgattttggcccctatttatgttttgtatcttagcatgcaaatatatggtcaccatgtaaggatatgcctaaactatttaattttgtggaggtgatgtcaatctcctttatagaattgtttcttttaaaatcttttcgaagctttcatggagtgatgaa

SEQ ID NO: 2555 - DNA, 637 bp, Glycine max
tctctcgttaagtggaaaaccaagtctgctcaccagttaacggaatccgaccaattcttctcagatatcgttacaggtaactaaataactaactcaccactttttccgcatcatatgtcacattatgtaccaccagcatatgcattaactttcgtgagggttgttttagtttaactaaagatgttgaattgagttttgttattgatgtaaaactatatatataaaaaaacaatgttttgagattgagattgtaacatgcatgcaggtccattcgagaaatttatgcaggtgacaatgatcaaacccttgacggggcagcaatactcagagaaagtggcagaaaattgtgtggccatttggaggtctcttgggatttatacagattcagaagccgaagcaatagacaagtttctttctgttttcaaagacctaacattcccaccaggctcctctatccttttcactgtctcacccaatggatcattaacggttagtcttactcatgcatcatatgccatgtttattctattctaataaaactagtacttttttgtttcaattttttaatacatgtaaatgtaatgaaaacagataagtttctctggtgatgaaaccattccagaagttacgagtgctg

SEQ ID NO: 2556 - DNA, 987 bp, Glycine max
  misc_feature (922)..(934): n is a, c, g, or t
aaagcaggtgatataaagagtgaatattttgtagcctaaaacaatggaaagattttatttcttttgcatcatgaatagcacaaactgcagatactgtacaaccttttacacaaacaaaatgaactaacattggcagcaggccgggccatagctcaatagtcaatctagaagggagaaagagggaaactatttcaaaagtagtggggcccactagtactatttctcacctatttctactcatctcttctctatttctcttcaaccaaaacctttacttttcactttattcctcccctatttccactccctttttatttgcatctacactatttctctcctctctaccaaacagggcataagggatccaagtccttccatacagtggttaaaatgacattttaaagtagcctacaatgtgcacgccactatgaattgcaaagggaatcagacatcaaattcatcgtgcaaaactttgaagttcagtaccttgggcttcttcatatttgcattaaggaattgtgaaacttgttttgagccataaccattaatcaatctagcttccccattggcatccatggtatcatcattaaaatcatcatatgtttcgagctggctgtgaaatttgtaagtggctaataagttccaacatgcttgaaacaagtagtgtaaaggatagaagagtgaagctatacccattaactggtctcaaacgctttaatgcattactaggctttggagcaatggagctgtacagacccttgtttttcagtttttcctcgagggaagctctaacttttagcatttccaaactctgtgcgccaatgtgatccttctgccatgttaaggtttatttcagtcaaattaataaccttttacaccaacaaaaataaatcaaatataaaggtacactcccagtatactnnnnnnnnnnnnnatagaaacaaagtaaaagtaaaaaagcatcacatgccatgatctataattacc

SEQ ID NO: 2557 - DNA, 1123 bp, Glycine max
  misc_feature (1054)..(1055): n is a, c, g, or t
tcatcttaatacaatccttgcggtcaagtaggctcagggagatatttcttaagcaggataatctcattcaaggtaacatttttttttgggtatatataacagtcctatcacctgtgtttactttaatcaaattcaaagtggctgaaatatcccatggttttgtgcagtatttttacttaataaaatctacttaaaagtttcaaatgaggtttttctatcacagattaacatcatccaaactatggatcatgtgcagaaactcagcgtgcttttaaacctatcaatatgactccctaaacacctgaaagcactcatattcaatgtagggaagttttctgcacatgcccgagtgggtcaatatacactggtttgtgcattttggtagtgcagaagttgtgttggtgtagttgggtatttttgcatatgacccaaagttggagggctttcttgaagcctatatcaatattgtagaatcctgtattggactaatttcttgaagcctatatcttttaggtggatgcatctcaatgcttgttatgcaatattatatcatcaatttatttaggaaatgcagtccagtataatgttcataagtatgaggacctatgttggccaatgtgtttggacttgttgacaataatttaccatttcttgactgtagtttatatatgctcatccccatctagatgttaacctatttctgtgccttatttattcacagatggctgaatatacaatatcaatatatggtaggaagcaaagtgagtgggaccaactagccagttggatagtgaataatgatttgtacagcgagaatgtcgtttggttgattcaggtattctttaattatttgtttagagcacagattggttttatttctcataatgatatggcaacaatttattatttctcccaatctacaaattattttggactgctaaataataagaatttggggagcttttcctgcttttcatttattgccttaatttgctcagccaattatatagtgttagcaattgatggtagttcttataaatgtcttgcagcttcnnacggttgtacaatgtgtacaaagaaatgggaattgtgacatcattccagaacatgctcgacaatattc

SEQ ID NO: 2558 - DNA, 405 bp, Glycine max
gatctggtaaatgatgaggccaagccagttctaaagccggcactgtccataggacaaatattgagcaggaagttgatgatgccggaagagtatgaagccagcgagatgcatagagaaagaagctcagagagacggaaggtgtctcttggccagatgctaggcaaacaaatagcggatccatcctttgacaggcaagctgagaaggaaaatggtcagaagccgttttctgcaaagagaaagaaatttggatttggccgattctcccttctattgacaaaacaacaaaagaagaagaagccaacactgaacttgaggtgaataatggcttgctgttgtgctgactaaacaatgagattatattgcatctttttatctgttctcatctcatcctcttactgtgctcga

SEQ ID NO: 2559 - DNA, 420 bp, Glycine max
aggtaagaataaactgaagtcaaatcctacctcatttcaaggtaatgataagattactcattattgttatgtttgtgttaaatcctggtcaaggtttcctttagaagacctttttgggaggaaacgtgcttatctacaaaacaagaatagtgaaacagaggacgaggaggatggagatgaggatgatgaagatggacctgacgaggatgaggatggagatgacgaagaattctcaggtgaagaaggcgatgaaggaggggaccctgaagatgaggctaatggtgaaggaagtgatgatggggatgaggatgatgatggcgatgacaacggcgacgaggaagacgatgatgacggagaagatgaagaggaggatgaggaggaagatgaagaggagaccccacaaccacctcctactaagaa

SEQ ID NO: 2560 - DNA, 1158 bp, Glycine max
  misc_feature (1092)..(1095): n is a, c, g, or t
ctttctgtgctgtagagccttgcgatttttcgggctgatttcgatttggtttcatattttgtttagatatgaatatgatgttttgttttcttacttcagatttgtttggagatatgctttgagccaagtaccactccttgtggtcacaggtaaatatcaaatcaaaagtcaaacaccccaccagactgaatttcttatttgaatcattgaaattgtgctagaaatttcctttatggtacccgatttaatttttaatataccaactcctagatttatgatctagaatgtacaatttttcagcttttgcagaaaattgtgctagaaattttccttttagggggtagccaatttaatttttaatacatcaactcctaaattctaatctagaatctacaaattatcagcttctgtagaaaattaaccaagaaattttcctttaggggtacccaagtaatctttaacacatcaactcccagattttctgatatagaatatgcaatttttcagcatttgtataaaattatactagaaatttttgttgggggtacccaatttaagttttaatgcatgaatttccagatttctgattcctattcttcaaaattgggtacccaagtaatctttaacacatcaactcccagattttctgatatagaatatgcaatttttcagcatttgtataaaattatactagaaatttttgttgggggtacccaatttaagttttaatgcatgaatttccagatttctgattcctattcttcaaaattgcagcttctgtagaaaatgtctaagatctgctgcagacaagtgtggcaaaaagtgcccaaaatgcaggcagctaataaggtgttagtctattaatattttgttgattatgcaaaatcacatgttcgtaaatcttaattaatgatttctgttccacaagcattctattttgtgctaccttattcctataaaccttcatggtatattgcagcaatggccgaccatgcactgtgaacacagttctctggaacacaatccagcttctgtttccacaagaagttgaagcaagaaaagaagccagtgccttgaatagtctccaacaannnnaaaatatgagtccagaatcagcattttttgctaatctaaggaatgacagacgacagccttagg

SEQ ID NO: 2561 - DNA, 398 bp, Glycine max
  misc_feature (380)..(380): n is a, c, g, or t
acgagcgcttcctcgccgccgtcggatccggcctcgccggacttatcatgctctccgatcagctcaccctcagcagccaattcttccaccatcaccacggcaccgccgccggccacgaccacgaccacgaccaccacccctgcgtcgtgtgccaggccaccttcgaggacggcgaccaggtccgcatgctcccctgccgccacgtcttccaccgccgatgcttcgacggctggctccaccactacaagttcaactgcccactctgccgctctccgctcttctccgacgagcgcgtggcactcacggagcgccgcctcggccagcaactcatctcttggttctccctacactgatgcggccacagctttcaaggaattgtngttcatgttcccttattc

SEQ ID NO: 2562 - DNA, 400 bp, Glycine max
ctgtaaatgacattgttgtatttttatcatctgtgcagaaagtgttgagtatcaactttggtttgtatagatatttagatagtttggagaggggggatgaagtgaactactgtatgtagttgttttggtacaattgatttgtgtgaaatagtttcactttttttttgtatgcttaattgtttacattttgccctggccccctcctccttaggttgtctttacactttatagagatattattattgccttcaccctgatggacaaggaaaagtgtgacatcctcatgcaaagaagtcagcattgcaatgacagttatttccaagctgcctttggagtgtaaacaaaactccagggaaggcagcagttgaggctggaagtggctgtagcaagtattgactgg

SEQ ID NO: 2563 - DNA, 374 bp, Glycine max
ttgaatccgttattgtttgttccactctcattgtatttttgtctaccctatacattatgactcgtccacggcccgtgtaccttgtcaatttctcatgttacaagccagaagaagctcgcaaatgctcgaagaagatattcatggaccagtcccggaagagtggttttttcacagaggaaactcttgaattccagcggaagattctggagagggctggccttggtgaaagcacttactttccagaggctgttctcaatgatcctcccaacccttcaatgaaagaggcaagaaaagaggctgaggctgttatgtttggtgcaattgatgagctgtttgctaagacttctgtgaagcctaaggacattggaattctg

SEQ ID NO: 2564 - DNA, 299 bp, Glycine max
cctcttcctccgactaccgttctcctcctattttgaccttagtccatgggaaactgcagcagcggggccggagcccccaccacctactccgacgaccatccccaccacaacggcataaccgtcctccctcccaactcaaacccttcaccccaactccccaagcccccaccgacctcctcctcctcctcctcgctgggccgggttttgggccggcccatggaggatgtccggtccatttacatattcgggcgggagctggggcgcgggcagttcggcgtgacgtacctggtgacccacaa

SEQ ID NO: 2565 - DNA, 315 bp, Glycine max
gagttgttgcggctctcttctctgcacactcagaatgcagtccacactcttcaaccccacccattcccttatccccacttcaccacactctatcagatccaattctggtcatgcttctctctccgttcgcgcctccatcgccgtggaaacccccacggagacggtgaagctgaacaagtacagctcccgcatcaccgagcccaagtcgcagggcgcctcccaggccgtgctctacggcgtcggtctctccgaggacgacatggccaagccccaggtcggcgtctcctcggtctggtacgagggcaacacctgcaa

SEQ ID NO: 2566 - DNA, 465 bp, Glycine max
gttcgctactttcccaaatcctagttacttataagattaaaaaaaatcaaataaaaaattatttctgaagccgtttgaggttgtttttttttaggactttcggtttcagtttatgaacacggttagggttggggagaggccgttgaatttgacctacgcgcacagcaggggcgacaacaggaccgtcttggatggaacctttgtgtatgattctgcgaacaaggtttctgccaattacgcgctcgactcagggaactgcaagcttaagtacacctatgttcacaaggggttgaccacgtttgagcccgcctatgacgtggccaagaacacgtgggacttcgccgtttcgcggagggtctacggcggcgacgacacgttgagggcctcctaccagacatccagcagggttctgggagttgagtggtcgcggaatcccaaacacactgctggcttcaagattgtaga

SEQ ID NO: 2567 - DNA, 402 bp, Glycine max
atgctcaaggttttcctcaagtcatggccctttttcttcggtttcaactgcggcggtctattgccgtatccatctctgaacctggggaaaattctgagccatccaattcaaattctttcttcagaggtctgcaggtcttgttggccgacaatgacgatgtaaatagagcggtgacgcagaagttgcttcagaaactaggctgtgttgtgacttctgtttcttcaggattggaatgccttagtgtcattggacctgctggatcttcctttcaagtcattcttttggaccttcacatgcctgagcttgatggattcgaagttgcaacgaggattcgtaagttcagaagccggaattggcctgtgattgttgccttgactgctagcacagaagatttgtgggaaa

SEQ ID NO: 2568 - DNA, 614 bp, Glycine max
cgaggcaacttcacactccttttaatctttcatcctatctttgtattgttgaaccctccattctctgcaacattcttcggtacgctcccattttttttccttcttgtatagctcatatctattatcagtgcattgtcgatttgattctgtgaattcgatttctatacggtagctgttttcgaagcatagttacgtttctttaggatctacctctcgacaattttattgtctgtatctaattcgttaactattatttttaatttattaacttctgaatcgaacaagattgttgaattattcatttcccctgtcagattcaattgctcttgtgaaattcctcctttattagcggctaaaccctaaatcagaactttggtgtggtgtgttgacttaattgagtgtagaaatagaataatggtgaaagcatatacacaggaacacgtctacaagcacccttgggaacgtgtaacttgtgcatcttggcgcaagtttgctgaccaagagaacaaacgcatattatcccatattcttgatgttgacacattgaaccacagccttgacccttcatcagggatgctttacacgacccgtgctatcacgatccattgtcctga

SEQ ID NO: 2569 - DNA, 363 bp, Glycine max
gggtggcgctgccgagggtgttcgtgaaggggaggtacgtgggtgggttggaggagttggtggagctgaacgagacgggtcgactcgggaggatattgaatgcgacgcgtgtggagagggggattgggaggcaaacgtgtggaggttgtggtggggctaggttcgttccttgcttcgactgtgctgggagttgcaagcttcttcacagagagaggtgccccaattgtaatgagaatggcttggtccactgccctgcttgtatttcataacttccatatctgctgtttaattttgttattcaaatcaccactagaatcatacatatttcacaccttgtctctctctctaccatcaacccttcca

SEQ ID NO: 2570 - DNA, 337 bp, Glycine max
caaaacaaaacatccaatgaggaataaaaccactattgttcgggtgtgaatcttgtacttcagcctgcagtaacatccaaggtttctaaatccaacccaaagaaggaatggggaaaaatatgaataatgagaagagaaaaaagattgtagagcaaagcaaaagcaaagattggtatggttattcgagtttattctacgtctgccttacaccaagtgtagaactgtagataaaataggttctaagtagtcttaaattaattttggaggatatggaccagcaagtttagctgtctgaataatttaagcccaagttgttgtgttgatgcccagatatgaa

SEQ ID NO: 2571 - DNA, 340 bp, Glycine max
  misc_feature (138)..(139): n is a, c, g, or t
  misc_feature (159)..(159): n is a, c, g, or t
  misc_feature (210)..(210): n is a, c, g, or t
gatgatcctatactgtccaacttttttgctatgaacaatcactggcatctgtgcaagcatttgaaggggacaaaacttggggagctcttgggggattcttggttaagggagcatgaacagtataaggactattactcnnccttcttcttgagggacagntggggaaagcttcctggacatttgagtagggaagggttgattcttttctcnggagggcgtgccactgcccgtgacctggtcaagaaaaggttgaagaagttcaatgaagttttcgatgagatgtatgcgaagcagacaagttggatcatgcttgaacgagatctgagggagaagacatgcc

SEQ ID NO: 2572 - DNA, 347 bp, Glycine max
  misc_feature (86)..(86): n is a, c, g, or t
  misc_feature (107)..(107): n is a, c, g, or t
  misc_feature (126)..(126): n is a, c, g, or t
  misc_feature (157)..(157): n is a, c, g, or t
  misc_feature (164)..(164): n is a, c, g, or t
  misc_feature (175)..(175): n is a, c, g, or t
  misc_feature (252)..(252): n is a, c, g, or t
  misc_feature (284)..(284): n is a, c, g, or t
gagacttggacaatgttcagaaactcactggcatcacccttgacattgtgagtggtttgtcccacatcctcgagaagttcgggttnaagtttaatcttaaacccgcntctcgccgtcttctcggcnaggatgggttgcccacttggttctctgctgntgatcgnaagctcttggntcgtggatggagatcacgtatcaagcccaatgttgtggttgcccaggatggctctggtcagttcaataccgttgccnatgctattgcttcctaccctaagaataaccanggtagatacattatctacgttaaggctggtgtctatgacgagtacatcaccgttcccaagagt

SEQ ID NO: 2573 - DNA, 430 bp, Glycine max
tctggttctatttttggactgaaaagtgataagccttttggtcttggtttatctaacaatggaagttctcttttgggggcatctggggcctctgctgtttctaagaatgagggaagtggtttagcaatgcaggaggttgttgttgaaaccggggaagaaaatgaggaagtggtttttaatgcagactcagtgttgtttgagtttgctgatggaagttggaaggaacgtggaaagggagaactgaaggttaatgtttccagtgaaaccaaaaaagccagacttctaatgaggtctaagggaaattttagattgattttgaatgcacgtctctaccctgatatgaagctcacaaatatggacaagaagggtgttacttttgcctgcctcaatagtgccagcgaagggaaaggtggtctttcaacatttgaaa

SEQ ID NO: 2574 - DNA, 410 bp, Glycine max
tggggagtttccatcagccaaggtgtcctttggtggtggttccacagctggaaatatctcacagtggactattgatgaatttattggcttaaacgagttcagtcagaattatgattacatggaaggatcatcaagggtatgttcatagttgttgaaatataccctcttagcctagtatcccctgatcattggttttgtagagtttctatcatttaatgctttgtttttttgactgggttagtattgcagagttcagattcatcttttgtcatagattgtgtatactagtgccccttcagacacactaacacacgcgcgcgcgtgcagggagtaaaaggacagggatggggctgatccggtcttctgagggaatatgccctgttaacatggtcacatgactaaacaactgg

SEQ ID NO: 2575 - DNA, 471 bp, Glycine max
tcttctgaagaggatttctctggcaaagttggtcagtcaactgttcttagaattacaggacttggatcaaagagggttggattgattggtcttggtcagtcaccttccactccttcaccttttaagggtcttggcgaggccgttgtggaggctgccaagtcttctcaagcaagcagtgttgctgtcgttcttgcctcttctgaaggactctctgctcaatcaaagcttagcactgcttatgcaattgcttctggtattgaatttgtggtttatatttgggtgatatatataaaagcttgtgatttgtagttatgcttgacaatgtgcgggcttgaaatgtgccaggggctgtgctgggattatttgaagataatagatacaagtcagaagcaaagaaatcaacactaaggtccattgatattattggtcttgggacaggacctgaactggagaagaaactgaagtacgcag

SEQ ID NO: 2576 - DNA, 1018 bp, Glycine max
  misc_feature (437)..(439): n is a, c, g, or t
  misc_feature (442)..(443): n is a, c, g, or t
  misc_feature (466)..(467): n is a, c, g, or t
  misc_feature (473)..(475): n is a, c, g, or t
  misc_feature (512)..(512): n is a, c, g, or t
  misc_feature (514)..(514): n is a, c, g, or t
  misc_feature (957)..(958): n is a, c, g, or t
  misc_feature (996)..(997): n is a, c, g, or t
  misc_feature (999)..(1005): n is a, c, g, or t
tttttgtcaaatgtttttcaaattcaccttctcgctgtggtaataaataataacttgggcatccaataatgttggaaacttaacttcatatatcaacaggcgttgcaggacagcagcgcaagacgcaagaaactgaacatgctcaaatatgaatctgtacaatacctcacttgacctcgttattgttctttgttagctcacatttagtgacatcaatgatttcttacatcaaggcatgtaggttttgatcaattacagttgttcagaggttgtgtaagctgcttattctgtcacttttattcttaattgtagctcaagagggaattactgcttctatctgtgggtattggattggcttgtagtggatattgcttggttattttgtccgtacaggtaaactttacatttgcatgctctgtctcaaaataaaaataaannntcnnatccatttgctattataattcannaccagnnnatttttgtgcttcttaccactcaattatgttctcttncntcatgatcagtctaactttagatggatgccaatgtcttaccataatgatttaacttcaaattttgctgatgtgtggctgtttcctaaatgtgtaggttgctataagttatgcgattggagtccttttcaggtttgttattggattttattatatgtggatactgtcttaccgaagtattcattgatgagcttaagggccactagtgtgactgttagagccttagttgatattgttcatcattgtttctttgtgggttagagaaaagaaaagatgtagctgttcttacgattgcttattattatacttaactggtatatcattttcaatgcagttgcttgtaccttcaactcttgtatcaacatgcagacaacctatccagtgaagatgttcctcaaatattcaagaaaaagaagtcaaagaagtacaaatgaaaacttgtgcnntgaatttgatctaattgtgctagttagcattctctctnnannnnnnncttatcccttgtt

SEQ ID NO: 2577 - DNA, 405 bp, Glycine max
tcttcaactcttcatacataaaatctatgctatgtctcatattagcattcaagaccaagaacacaaaaaccacttaattagtccttctcacatccaaaatcttgtgccagcaaatcaaacatggcatccatgactatgcttcagaccatgattcctaagaatgcaccgaacctccctcctcgtgttggtgcttcttccaacaacactactaagatctcatttggtggctcaggtagggtactgtggaccgggattcagaggaacaggaataataggtcttcttcgattgtagttgctgcagttggagatgtttcatctgatggcactgcgtaccttgttgctggtgccattgctgtggctctagttggaacggccttccccatcttcttctctcgcaaagacaca

SEQ ID NO: 2578 - DNA, 552 bp, Glycine max
  misc_feature (486)..(486): n is a, c, g, or t
  misc_feature (488)..(488): n is a, c, g, or t
  misc_feature (522)..(525): n is a, c, g, or t
  misc_feature (531)..(535): n is a, c, g, or t
  misc_feature (542)..(546): n is a, c, g, or t
gaatccttgctctactcagcatggcttcgtttaccttcaagtgttgattcccaaaccagaaaggttagttagtgtgaactaccaacagtaaaacatgtttaagctggtcattgagatagctcgatttctctccttagaggctaattgttcaaactttttcgatttgacaatggttgcagatgttcattgaggaagtcatggaactggtggagctgaacccattaaggaactcactggttggattgcctggtgtgagtggtctctcaactgaacagcgcaagaggctgactattgcagttgaattagtggctaacccatctataattttcatggatgagcctacttctgggttagatgcaagagctgctgcaattgttatgagaacagtcaggaacactgtggacactggaagaaccgttgtctgcaccatccatcagcctagcattgacatatttgaagcatttgatgaggtgagtgacgacaatnanaaatgaagctgtgtcatgtttagtttctttctcnnnntagacnnnnnatctaannnnnatattt

SEQ ID NO: 2579 - DNA, 422 bp, Glycine max
cctacacctatggttttggcacaaattgggaagttttatcctggtttaacccaagaacagatagtgggcattgtgaatgggtttggtgagctcaaaggtgctaagtgtgaggacattgatgtggcaaaggctgcattgtacttagcatcagatgaagcaaagtttatttcaggccaaaatctcattgtggatggagggttcaccagctttaaaaatcttacattcccttctccagatcaaactgcttaacctcaactgttaattgagtataatttctatgcattattgtcggtgtaaatcaaccaacgaggaatcatgttaggtatatgacaattataattggatgagtttaaaatttctttatattgtcagtatatagactattttctcttgttgatttatgtaatgtattatggttggtt

SEQ ID NO: 2580 - DNA, 402 bp, Glycine max
atgcaatatttgaagtcaaagcaacatcaatgcccaatttcaggtagatcattgttgtctgacaacctttacattaatcctatgccaccattgcgtttctctttaaccaaatcttggtgtcaggttgcccaaagatattgcaggcagataagctggtgcaagatccgttgttaatgattgagattgaggaaatgcgcaaaatgaatagagaaactgacgtagaagattataccatgcttaatgaagattagtgattgttcaaaccaactgctgataggttttatctgtaaattcgagtagtttcttctgttacatactcgtcaatatttttggctgtctacgtttgatttcaggacaattgtaatttcccattaggcgtgccagactggttagttaaagtgg

SEQ ID NO: 2581 - DNA, 920 bp, Glycine max
  misc_feature (904)..(906): n is a, c, g, or t
ggttcctcctgtatgtacaattgtacattgaccatcatttcaattttctcaggatcataatagactctatgaaacatctgtccatgataaaataaaatgaaattggtgagcaaaactttctgattttgaaagaatttcaaaaccaagttaaaaatcaatttggctccatttcaattagatgcattttgtttcgaaatttatgtttgaaaataaaaaattaaaaactcataatcatcttaaacaagcccaaagttattgcacgtgtgaatgtgtcatgtaagttgggaaagatctccggatggttaggagtattagtgtaatataaagatatctgctttattttttctttagtctttaccttgatctcctactttttagtaaacatcatctggtataaacacattaattcagtagttttccacatttctggctagagcagcaaacctatcacaaatgctgcatcaatacttttttgtttaacttttaaattgcgatagctactgctttcataatataacctgtagctactatattaattgcagatcccataatttttaatctcatttccagtattattgttctttggtttacagttatgatatccaatccggcactcatgacccttatgaagattgtatttctgtcatgagactatacaagagaatacgatctcaacttcatccggaggaagaccatggaacaatgactctgagtaacaacattgttggcatgcctgatagctggatatctagggaacttgacaacctcacaccagatgaactttatgccatgtcaagatcagattataagtgttggtgcttggatttgataccaagattgtcagcctgaattattgatctttgcatttgtccataacatatcataagcatatttcttcaagaannntgggaatggagcat

SEQ ID NO: 2582 - DNA, 961 bp, Glycine max
tacaaaggtttcctgaacacttaactttgaattgacagaacatgagaataataaatctgtattctcatcccaaggagcatggtagatttctgtaactattttttcttcttatagatgtgaaagaagctagaacacaagacaggtacactcattagtgaagattactaatgcaaaattagtaatcttttctactactcttattgaataatgcactttgggcaactagatgatttataccttgattaagtgtcaccaaaaccatgcctcatgtgtaaacacaagtaaatttatatttagactttgtaagagagaggaggataacatgttttatttttgcctttgtcatcttaatctttcatgactaattgctgacattgatccacatgatatggcacattgctggcacttatccattttgcttgtattatatggggctctaccaaacttctactagtctattttgtattgttgacattgactctagctggctgcatgcatatcttaatataaatattagctctaatagatctattttcatcttccatacaatttctgtagtctcaattatagtaacagtgcaagatctattttccacatcttggatatctttggctaaaagattgaatattgtgttattccttctagtagtcaaggggaacaatgaatgcactagcagccaccaacaggaactttaagttggcctctaggcttctgggattggattcaaagcttgagaaaagtttactgattccattcagggaaatcaaggcacgtaaaattgcttcttgtgtgttttcatgtccttgttctggcaaaattagtttacttgttttcactatactgtttcatatagttcaccaactctagttctaaataaatgtttcacaataatgcaggttgaatgtaccatacctaaagatgatggcaccttgcaatcttatgtagggtcagggttcaacag

SEQ ID NO: 2583 - DNA, 403 bp, Glycine max
  misc_feature (382)..(389): n is a, c, g, or t
  misc_feature (392)..(397): n is a, c, g, or t
ttgggcaggtttgagttttagtgtttgaagcattcaaatgatcttgagttggagttggagttggttatcttagtggcttggatgttagatgcctgaagcctgcgttggaggattgcaattgcatactaaagagggttcattgttcatagcttaacaccaaaaagtgtggggcacatgctacagctacatacccgaaaaaaattacatattctttgtatatgtgttatatttgtgtttgataattccattggtaaatgtgatttttctaactcgtgtgcagaaaaccagttataggatttgtctcattggcgacatgaacttctgagaaagtttatagaaagtctaggcatctgctagttgaagcaaaactatgtgtaaatgnnnnnnnngannnnnnttcctc

SEQ ID NO: 2584 - DNA, 296 bp, Glycine max
tttgactcgttcccttgaagcgaaattatttgtgttgcttttttcttatcactcttgcaaccttttcattgttgctttgggagaacaaagaagcagctaaattcttttttacaagagtagattttttttctatcataatttttggattttttttttcaagaaacatacaaaaataaaattatatacccaaatgtaactcacctaattttaaaaaacatacaactttgttgtgcataatgtaaatttgggttggggatccaaatttttaccgtgttttcaattttttttttcaaaaa

SEQ ID NO: 2585 - DNA, 733 bp, Glycine max
tctcactgcaagtcgtgtgtcagtattgctttcttctgctacagcctatactgctagcattcatcaattcttgaaaaattatgaagatctcagcatctttattttgactggggaagccttttgtggaattgaagcagttgaatttaggcagaagttaaaggttgtttgtgaaaactatttcatagcttttcatcgacaaaatatgcatgtaagtgaccttaagccttttcatggttgttagagtcatataatgttgatcgtgatttcttatgtagttcttttgagtctggtacgtgcaaaatgcaatgtcatttctatcctcctatgtctgcacggtgtctccaagatgatgatggtgttccggctatcaataagattttaataaccgacagattgttacattcatgtaaaattttgttccataaattttaaacttgtttacttctgttgttctttctgggtgcatgtagggatgtctaacatgttcttatttgtggttctgttactatgtaatcactaagttgttgtttgggcttgttgatatgccaagctgtgcatctgacaatatcagtaatctgtagtcttggataaatgattaaatgggatttcctttttcctttttaggctctaaaaatggttttggagaaagagacttggctaaaattacctccagatacagtacaaatgatcagttttgcaggtcttattggtgatggagcaccgttgatttctt

SEQ ID NO: 2586 - DNA, 385 bp, Glycine max
atcgtgataaagatcacaatagggagcgggataggtatagagatagagactcagatcgtgaaaggtctcgggagcatgatgttagaggttatcgagatggaggaaggggggtggattatagggcgagaaatggaagaaatggaggtagagacaggtaccgtgatcggagcaggtcacgctcccctggtaagcatagccacagaaggtcttcttgaagtccagtttgctcaaattagtggaatttcttgatagatgtcagaatttaattttaaaaaggtagtctttaatatcccaagacttacataaaatgtgcttttggagagttttttttgtcaccttcaagggtgaatttactcttttcccatctcagagctttgttgaaact

SEQ ID NO: 2587 - DNA, 311 bp, Glycine max
ctgtactaacttgttccctcgttaaccctaatcatcaactcaagcagtgaatgaatctgtggacggacgagaactcctcggtgatggaggccttcatgtcgtcctccgatctctcctcaatctggccctcgccggcgccgccgcaatccacggcggtcttcaatcaggacaccctccagcatcgcctgcaggccttgatcgaaggcgcccgagagacctggacctacgccatcttctggcagtcctcttatgactattctggctccactctcctcggctggggcgacggttactacaaaggcgacgacgac

SEQ ID NO: 2588 - DNA, 382 bp, Glycine max
ccagttccaccagcggcttcttcagtctccggtcaccaaattcggtcgattccagcagggtctcctccacccacggctcttcctccgcttgcggaaagttcgatggggtggccatgtggttcatcaacggcgtcacaaccgctttcttcgcctccttgaaccgttgctcttgcattcgcatcgccaccgaagaagacggcgacgatgccaacgacttgccgttgatgctcaacgacggaaacctccgccaggatggcgtcgtcgttgcgtgcaccaccagcaggagaaggacgggtaaagggaagaagagtgaagctgttctcgtcgacgacgactgaaaaaaagtggtaacaaatacgtactacgtaccctttgatgaggc

SEQ ID NO: 2589 - DNA, 396 bp, Glycine max
atttcaagaaatgttgttgtgacaagaacaccaactcaagtagctagccatgcccagaaatactttcttcgccagaattcggtgaagaaagagaggaagagatcaagcattcatgacataacgactgtggacagtaactcagcgcctatgcccattgatcagacttgggttcctcctccgggtggttcactgcagcagtcacagcaatacccatcaagcaacatgcatgatcaaatgggtacgtttgggtattcaaactatggctttgacatgtaaagaatgctagaagcagtgtgttctgtatatagtgctgtagctttgattcataaggttcccctctttgtaaagttttatggttttgctagctgacaagggtgattgggagtattgctagag

SEQ ID NO: 2590 - DNA, 381 bp, Glycine max
gttgattgattctcgatgtagggccactgttggtgttgtatctaatcctagccatggggatcgcaaacttaggaaggccggacacagccgatggcttggtcgaagaccagttgtccgaggagtggcaatgaatccagtagatcatcctcatggtggaggagagggtaagagcaagagtggtggacgatttgggcgaggatctctcactccttggggcaagccaactaagagtggctacaagactggacccctgaagcgcaaaaggtagtaggataccatattcattatagctgtttctgatgtttccttatgagatgcttgtaagttgtaataattgtggaaactgtcattcctatttaggaaattcattgaactgattag

SEQ ID NO: 2591 - DNA, 401 bp, Glycine max
tgaagatgccaaaagcattcagccaggtaactttgagcgtcattggggcatgttttacttcgatgcacaacccaaataccaacttaaccttgggtcagcacgaggtaacgggctagtaggtgctagtggtgttgatcatttggctaaaaagtggtgtgttttgaaaccctcagcaaaccttaatgatgaccaacttgcacctagtgtggcctatgcttgtcaaaatgctgattgcactagtcttgggtatggaacttcttgtggcaatttagatgtgcatggtaacatttcttatgcttttaatagctactatcagataaatgaccagatggatagtgcatgcaaattccccagcctttccatgatcactgacaaggacccttctgtaggagattgcaagt

SEQ ID NO: 2592 - DNA, 597 bp, Glycine max
cttaagtttgctttggaatctttttgggatggaaagagtagtgctgaggagctgcagaaggttgctgcagaccttaggtcagccatctggaagcagatggctgatgctggaataaagtatattcctagcaacaccttctcactttacgatcaagtactggacacaacagccatgctcggggcagttccatctagatataattggaatggtggggagattgggtttgatgtttacttctcaatggcaagagggaatgcatctgtaccagctatggaaatgaccaagtggtttgacaccaattagtaagtaaatcatccccccttctaaatttgagttttgcatatattttgattaaacatgattaaaatgaaagggttagtgtatgaatgattttgatggggacaggggactttgaaagggttagtgcatttgattttaatatataaatgcaaaattgaatgtcaattgttttgatgtttgtcatagttctaacaaacttataatcccttatggtacagccattacattgttcctgaattgggtcctgatgttaagttctcctatgcatcacacaaggctgtcgatgaatttaaagag

SEQ ID NO: 2593 - DNA, 516 bp, Glycine max
ctgtgcagttaaggactacagccggaggaggaaatttatgcagacatttttccttgctccccaagagaaaggcttttttgtgctcaatgatatttttcactttgttgaagaggatccagttcaccaacaacaagcagtcttgttacctcaaagcaatcttgatcctaaattgaatgcttcaagtgcaatcaataagccaggtaagtacttgcaccagttgtgttcatgtacctgaaggtcctgatttgaaaaagggaaaaacttgcatcaagttctcaaatcaaacaatgatatgtggaattgtgggtatttttctctaccgctaatcttgatttatttgggattgctttacagtgtccaactacttgctgggtagagatatccaagctagggactatgttgctacaaatgaggtcaaagaaaatggtgtagttgataattatggattttcagagcaaagaatgcaacgggcccctgattctgagcatattagggaggataatgctgttgaagagt

SEQ ID NO: 2594 - DNA, 205 bp, Glycine max
agaaagtcaaggttagatgatgaggtggagctagattcagaaggacgcctgattatccatgaggaagtggaatggaggaaggaaaaacatgcagatgaagattttgattctaggagtgagcgtgatagtcacatatctgcaaagtctggaactaaagcccagaagaagagaaaaacatcagattccggttgggcttacacaggga

SEQ ID NO: 2595 - DNA, 429 bp, Glycine max
attggtttgaaaaacaattgcactttctgcggcgtcttccgtcgacaggcccttgaccgaggtgcttctctcttgaaagtggacaaagtcgttactgggcacaatgccgatgatattgccgagaccgtcctcctcaacctcctccgaggagatgttgcccgattgagtagatgcacctctataaccaccggtgaggatggccccattccccgatgcaaacctttcaagtatacttacgagaaggagattgtcatgtatgcttatttcaagaagctcgattacttttccaccgaatgtaaccttcctttcttttcctcttattttcccctctaactgccaaacaaacatttcactctctctacaattccaggcatttactctcctaatgcatatcgaggttttgctcgcgagttcatcaaagatttggag

SEQ ID NO: 2596 - DNA, 663 bp, Glycine max
ttcatttttgtttgtgtatgtttgtcgatagcatttttgaatttagcttatgccatgcattgcaatgaagaaataaggtattgttgcttttccattctatagttggcatgttattgtacttcaaagtcttttaggtttagttgcgtgcaacagaaattgaacttcaaacatttgatatgcccatggcttgtcggaaatcttcaataattcttctgtactttacactttttttcactttctttatcacaggttccgctgttgaacttttgtgcatcctcaattggtttgtgaaaaggacaaaatgcaatttatgatttcagagcatctgtataaactaatctgcaatttcaactggataagaggttgaagttactctgtaaagaagacatacagaagtataagttgaacatacagacgtaaaatattatgtttagaccccaatgttctttctgcattgtacaggttgatttgtttatttcatggatataattcttatatccaaatgatgttcagttgtccatggttcttatgtaatgcaaaccattagcccttcggagtttctggagttgggaaatggtcttcaaagattgataggcaaataccaattatttcgatccacttagttggttgcttttaatgaaggagcagattcaggatagccta

SEQ ID NO: 2597 - DNA, 285 bp, Glycine max
catctggctgattttgctttgtgtaaagtatgttatgggaaggtgtctggaagtgagactaggaagagaagataaattaattgttggtttatattagttttaagattttttggggttatggattatgttagttaataacgttgacttttcttccagttggtggaaactgggaatgggttagctagtaactacattaatttaactttggggactaaagtaaattgtatctaagattttttttttactttgcagtaaactttatcttttgtgatttctgaagtgatc

SEQ ID NO: 2598 - DNA, 603 bp, Glycine max
cttgcttcacccaaggcttccactacttcggcgtcttcgacggtcacggttgctctcatgttcgtattctcaaactattcctctgcttaaatagtaatggatctggttgtggttgtgattcttagagaagttgtatcgttttcgtttccacaggttgcgactatgtgtaaggagcggctacacgagatcgtgaatgaagaaattgaaagcgcgcgcgagaatttggagtggaaactgacgatggagaacggattcgctcgcatggacgacgaggttcatcgccggagccagagcaaccagaccttcacctgcaggtgtgagctccagactcctcactgcgacgccgtcggatccaccgccgtcgtcgccgtcgtcacgccggacaaaatcgtcgtctctaactgcggcgactcccgcgccgtcctctgccgcaacggcgtcgccatccctctctcctccgatcacaaggtcattctcctttccaattccaattttccttcatttcatttcctgagaaaaagaaaaacgttttcctaacgtaaccgtttttggatccgttttatgcagccggatcgacccgacgaattactccgagtccaatcc

SEQ ID NO: 2599 - DNA, 400 bp, Glycine max
acttgtccaacaagaacaagaagccaagcaatgcagacgaggttcacttccgcggagtccggaagcgcccctggggccgctatgccgccgagatccgcgaccctggaaagaagacccgcgtctggctcggcaccttcgacaccgccgaggatgccgcccgcgcctacgacgtcgccgcccgaaacttccgtggccccaaagccaaaaccaacttccccttcctccccgacaacaacaccaacgttaacctcaacaagaagaacaacaacgttaacgttaaatctgacagtcccagccagagcagcaccgtggagtcctccaccccggagcgtgaattcacgcgccgcgccgcccccgccgcaatggatcgctttccgttcctacccatccagcagcaaat

SEQ ID NO: 2600 - DNA, 421 bp, Glycine max
cctctttgccttgagtttctaaggagtggcaaaattgatgtgaaaccccttataacgcacaggtttggattctctcaaaaggaagtggaagaagcctttgaaacaagtgctcgtggtggtaacgccatcaaggtcatgttcaatctttagatactggactgtgactttacaaactgtcgtatgttgaacaaagtaggtaatttacatgttcatgctcatgttaaataccaatgtattgataacacgggttatgaataaagtggtttcaagaaggacttgtaaaacatgtgaatggtaactgcagcatctacagattcagttatgaggtgaaactttttcttaatatgtaaatgagtaaaccctcaaatttgtctagtagtaattgagaatttcaatgcacaataacaaactgttgcttcca

SEQ ID NO: 2601 - DNA, 402 bp, Glycine max
gaccaagcccaacaaaaccagcatgattagttcctccgaagcagagaaagtagaggatggttttggtttggagacaacaccttcggcctcgtcctcacgctcttcctccgccgggagaagctcgaagcggtgggttttcttgaaggactttctccgaagcaaaagcgaagggaggagtaacaacaagttctggtccaccatttccttctcaccaaccaaagacaagaaaaaccaaaatccaccaaacaccaacaaaaacgtggcttcttctgaaaccacgcagaaacccaagggaacgagtagttctcagacttgggccaggagaataagtgggaagcccacgaacggtgttgggaagaggcgcgtgccagcctcgccgcacgagttgcactataaagcaaa

SEQ ID NO: 2602 - DNA, 395 bp, Glycine max
atattgcatttgcaggaacaggaaccaccccagaggcttttactgcaatcagtttcggagggagaaggatccaaagtctcttctgtcgttgggggttgtaaacaggaagatatcagttcagcaaggagtgacattttggattcagatagtccacattacaccgatggagttcactctgcgctgctagagcatggtgattcttcttatgtgtttgagcctgatcaatcagatatgtcacaagatgaagaagataacctcagcaagagtctctacccttcgtacctctttcccaaacttgaagaagatgtggattactccgacccacctgaaagttcttgtaattttggatttcctgaggaagatcatgtcctttggacctgggcttactactaaaa

SEQ ID NO: 2603 - DNA, 377 bp, Glycine max
tttgatgatgaaccaaaccgttcctcaggcaaagctgttgtgggctggctcaagctgaaggcagctttaagatggggtatttttattcgaaagcaggctgctgagagacgggcacaacttgttgaattggatgacccatagagatcttggggggcattactgatctttagtgatctgaacaataatttttctggttatagcatccaaggcttcttagtctttcctgacattcagaattggtgtcatgctgaaatctcatagcaggagcaaggatatgaaatctggactgaattatttggtgcagacttaactcaaagattcaactgtcccttgatccataaacagttgggcatagactttactgctttgcttgtgat

SEQ ID NO: 2604 - DNA, 643 bp, Glycine max
  misc_feature (549)..(549): n is a, c, g, or t
atatgataaagagctcgcggcatacgatcatagaaagcagcttgagttttcaaagttctcaatagatgatcttaatgtcaagtcagtacctatatatgatggcattcacacaaataaagttatgaagagaaagaaacggaaaaaagctgaagaaagtgatttatcatcatatgtgtctaatcatagtatattctcttactacggtatgacatttcttggttggttgtagtatttttggcccatgtgatgctcctctctaatctttgctctttttctgtcccattccagagaacaaaaaccgtggcgcttgtattgaagattttcgtggtgatgccttgagtgagtgacagtagtgtacacaatgctgctattgttatttatttgactattaaaatccatcttctagttaaattgtgaatcatagaaggtgaaaaaattatatacacaggtttttatctttattttcatgtgtttattggtatgagtatgaccatttttgtgaaacaggttttaatcaattgttatttgcttccactttccatgagggtntaaaatttattctctgttttgtttcattgatatcaggaggtaatgcagagattaatattgaggagttaaagtttaatgataagctgccttctgt

SEQ ID NO: 2605 - DNA, 342 bp, Glycine max
ttttcgcgagcccaatacgttattgacacaaatggcgaacccgttgacaatgatgatgagtattacatcaggccagccataaccgacaacggagggcgtttcaccttgatcaaccgaaacgggtcgtgccctctctacgtgggtcttgaaaacaccgatacgccactgggttatccagtgaaatttacccattttgccctcaacgttcaagatgaggatataagggtgaacagcgacttgagaatcgaattcgtggaagtttccacaacgtgtgtgcaatccacggaatggagggtgggtgagaacgacacgaggagtggaaggaggctcatcatcactggc

SEQ ID NO: 2606 - DNA, 784 bp, Glycine max
  misc_feature (57)..(61): n is a, c, g, or t
ctctgctagctcctttttcatggtgccaatggacttataatcacgagctaaaggatnnnnnacctccaccacctacacccataatttttggaggaataaatttaccatctagtggcatgtgtagctgaagtgaaaaggctatggcgaaacaataatatgatcaaatggacaaataatcaaaattcatatagaccaaacatgatacaaaattcatcgaatgatcaaatatgattctcaaacacataattaagtgatacaaattcaaaccttttcatgaagaagcatgatggtaagcaagtcttgcctagctcgccaatcacagtattgaatatcatatcttgcaacttcaagggcttgatatacatccaaaaacttccctttatactgcggcactttagatcgtggatcctccacatcaaagagggcactccatgcattcttcttatctatctcttctccatatacagcaaacactctaaaccttccttttaaaccctgaaatttgaattacccacaacaatgttatctacaacaagggccagaaaaaatatagcctacgaatatgatcacgggctcatagctaaaggattaaggatcaaggagcccaggggttagtattcagcaatgaaaccaatgagaaaaagttccaaacattatgctacctacaaaaaagaaagcctgcataaaacaaataacaagaacaattctgaacacttaaacacaagttggtgtgatttgaagtgagttagacctttttggtgtcaagtttggatgatttggagaa

SEQ ID NO: 2607 - DNA, 386 bp, Glycine max
ccattcatccgatgagttcgagaggagcgaccgcagtgctatctcgagccagcaggattcggtcgaagctgcaaacggcgctggaagccaccgttttggaggtggacgacgtgtcgtaccagcacgcgggccacgccgccgtgaagggtagttccgacaaagaaacccacttcaacctcaacatcgtctcccccaagttcgagggccagagcctcgtcaaacgacaccgtctcatctacgacctcctcgccgacgagctccagagcggcctccacgccctctccatcgtcgccaaaactccccacgaaacaaacccttctgagtgactccttgggagtgtcaaagttcaaagcttttcccctctgagtgccgaaatctttggtctt

SEQ ID NO: 2608 - DNA, 144 bp, Glycine max
atctgaagtgatcgtacgtacgtaaaggcattgcttctacaagtttttgctccctcaaacaaataggactagagcaagatattcattcaaataagctaaaagttaataacatatagtttgttatcctctttgtttttttttttt

SEQ ID NO: 2609 - DNA, 380 bp, Glycine max
tcatggatgtcccttatttatgatccttacttcatgaaaaagcaccttcacctgtcgtctcgaagcacccacttcacccatcacaggatcatattgagtgccacaaccgctgagtttcacctcaaatcatgttctctgagttccttgttcaacaacctttcaaccgtttgtgatgaacttaactaccctgtgaagaacaagtttcgccacgatgggattgttggctcttgtaatgggttgttatgttttgccataaagggtgattgtgtgcttctttggaacccctccatcagggtctccaaaaaatcaccacctttggggaataattggaggccagggtgtttcactgcctttggccttggctatgatcatgttaatga

SEQ ID NO: 2610 - DNA, 390 bp, Glycine max
gttcaaaagcagaagaggaaccagaagtgccaccacggccataaaggtcaaaccacagactggtaatcattcttttgaaatcttggtaattccctgatacaatttgcttggatgcaagatacttgtgaagatacttaattggtgctgttctactgatttcttctatgaaagaagcttgctcttgtctctcttcagatgtgactacttccttacatccttgatgtggattgtaattatctaaaagtgaaagaaaacgggcaaatgtaggctttctgaatacatcatcgctaacccaagtaaacaagctcccctgtgccatatcttccttttggtatacctttttcccttctccacagtcaatttcatagtgtaagccaggtaccaaacgaa

SEQ ID NO: 2611 - DNA, 298 bp, Glycine max
acacactacacaaccaccctgcaattaatacagaggaagtgaaaacattttttttcaaacaggttctggatcacttcaactacaggccagaaagctacacaacgtttcaacaaagatatctaatcaatttcaagtactggggtggtgccaattctagtgctcccatatttgcatactttggtgctgaatcaccaattgataactcccctaatggcgtgggatttttaactgataacgctgcttccttcaatgccctcttggtatacatagaggtattgtatttgtatagatttttttt

SEQ ID NO: 2612 - DNA, 334 bp, Glycine max
gaaagttcgatctagctaaaaatatatatgactattctctttctatgtaaaaataatatgcttgactccctctgtaagtattttatgcaattgtaagctgatgaatgatgatgattggaagatgaagaaatgtcatcatgtgattgttgcaagccgtagttgtttattccctattccctaagtccagggaagggttcctcaattatttaagtcatcaacttgatcatggggtgtctataaagtggcctggctgatatttttaaaaataaaatagaaatggctgtgataaatgtggatatcgaatcagagatgtcaggtatatctaatccagagg

SEQ ID NO: 2613 - DNA, 446 bp, Glycine max
acaggtttgccgtgattgtagccgtaataggaaagataccacttgacgaacttcttcaacccggtttgcaaatcggtcgtgggcttgtacccgagctctctccgggccgaactaatattcgcgtgagtaaaaggaacgtcaccgtttccaggcatgtccacaatattcctcttcgccttcaccttcaaatgccgctccaatatactcacaagagtaggaacagtaaccggcgaagtattccccaggttaaatattctatacggagcgggtccacgcttcttcccacccgacccggtactcttagccgaagtatccaacgacccgacgcaacccttcacaatatcatcaatgtaggtgaaatccctagccaggtcgacatggtttttaccgcggtaaacggtaataggtttcccttgtaagatgttcctggtgaaagagaaataagc

SEQ ID NO: 2614 - DNA, 479 bp, Glycine max
agaagaaggggtatgttgagttcgaggagtcgccgccggacgatttcgatccggcgaatccgtacaaggacccggtggcgatgctggagatgagggagcacatcgtgagagagaagtggatccaaatcgagaaggccaagatcattagggagaagctccgctggtgctaccgcatcgaaggcgtcaaccacctccagaagtgccgccacctcgtcaaccagtatctcgagtccacccgcggcatcggttggggcaaggacggtcgccacccatctctccacggtcacccttctctcttccaatttcaatctactagggttttaggaattctcaatttggaaaattatgaaacatttgatgatttccttaatgctgtttggaatttatattcttccttgtctgttgatggttttgtgatgattcattgtttaattttctgaaacagctcccaaggttgaccctgttgagtctgaatgacc

SEQ ID NO: 2615 - DNA, 687 bp, Glycine max
  misc_feature (678)..(679): n is a, c, g, or t
attagtctgtcctagcgaggttcaaagtgtacgatcaaggccaaaactaccgaaactgttgccatcacataaaacagaaatgctgttgaaaaacaaaagggggggatgaaaacatcaggtaatagaccggaatataggaattaacttcaagggtaaattaaaacaggttaaaatccaacctggttgagtggccagatcccatatttcttggacagaactcggagtttgctcttgtggtgcatggatgacaataacaattgatcccacaatgcaggatacacaccccaatacccccatcttcggaagccgttccttcaacaagaagtgagacaaaacagcactagcaacacataccggatatgttagttctacaatccacacaaacacaaaattcatcaaaacaatcaaaattttaattaaagctagagtacctgacaataatactaagtgcaccaaggggagtaaccagaactgccggagcatagatataagcaacaaagtttgcaatctccccaataatcactgtaagcaaatagttcaagatccaaaatagtttcatttcaaaattcaaatcaacaaccttggataaagagagagagagagagagagagagaagaaatcaaggtgccacacttacttgtcaccatgccagcccaccaaagcggctctagtagatanntatagcca

SEQ ID NO: 2616 - DNA, 429 bp, Glycine max
ggatgttgcagtcaagcaacagctcagtctatgccattggagatgttgcagcatttccagtcaaagcatttggggaaacacgaagacttgagcatgttgattcagcacggaaatctgcaatacatgttgtttcttccataatggaaccaaacaaaacgggagaatttgattacattccttttttctactccagagtcttcacactgtcttggcaattttatggggataatgttggggaagttgtctattatggagatatgtcaggtagtgcatttggggcatactgggtaagcaagggtcaccttgttggggctttccttgaaggtggaactaaagaagaatatgaagccatagccaaggctactaggttaaggccagcaattgaagacttaaaaaacattatctccataaaattgtcaagacagtgtg

SEQ ID NO: 2617 - DNA, 537 bp, Glycine max
  misc_feature (404)..(404): n is a, c, g, or t
  misc_feature (406)..(406): n is a, c, g, or t
  misc_feature (408)..(415): n is a, c, g, or t
  misc_feature (417)..(417): n is a, c, g, or t
  misc_feature (423)..(425): n is a, c, g, or t
  misc_feature (440)..(445): n is a, c, g, or t
  misc_feature (448)..(450): n is a, c, g, or t
  misc_feature (452)..(454): n is a, c, g, or t
  misc_feature (456)..(467): n is a, c, g, or t
  misc_feature (471)..(479): n is a, c, g, or t
  misc_feature (484)..(489): n is a, c, g, or t
  misc_feature (492)..(497): n is a, c, g, or t
  misc_feature (512)..(518): n is a, c, g, or t
  misc_feature (520)..(524): n is a, c, g, or t
  misc_feature (528)..(532): n is a, c, g, or t
tgggatgctttagtttttaaagagaatgtagcattgccatctccttcccctccccttaatggttttaaattcttaagcttgtatatatgctttactatttattttcgattgtaacatattcaggtagtttgcgcaggttcaattttcctgtatctcctttaattctttcatgagacttgttcaaatttagaaagctagtttttgtttcgtaaaaagcataaaaagtttcttagattctattctggcaagttgtggttaagttccgatgagttgtgatcgagttcctggtcttcgtagaatctttgatctcctactccagtgttggggaggtacttacaaaaaagactctgacgatcaagtcagttgagcccaaggtgtttgtgtatgggaagataaaaaaaaancncnnnnnnnntnccttcnnntgggggggggtaccnnnnnnccnnncnnncnnnnnnnnnnnncttnnnnnnnnnccctnnnnnnttnnnnnntcctcccccccttcnnnnnnntnnnnncccnnnnnccccc

SEQ ID NO: 2618 - DNA, 434 bp, Glycine max
tggaagtggaggtggatatggcagtggtagtggctataataggggtggaaactatggaagtggcggttataatgttactagcagctatagtggtggcaatgctgaaactagttacactggtggtggtaatgctagtaattaccaattcaatgaaaactctggtggagattttggctcagctagcggtgaattcagcagcaaccaaaatgacacagcaggtgcagacaatgatgaattcattgagccacttgaagacaatgtgagggagaacaatgatggacctaccgactacgctcagaaccgctgatgagaattttcaccttgcctagagcaagtaacacctggagtttatgataaacaaatgtgtttccaatttctttttccaccctcttgattttcatatgttcattggcttgaacttgatagtttgtctg

SEQ ID NO: 2619 - DNA, 957 bp, Glycine max
tatgccctggtatcattttcaatcttgctttatttgggaaataacttcattgataataataatgtttgtggacttatgtttattattctagttcagtttatctctacccatttgctttattcacaagactattgtttgggtagagattctatgtatgtacataaaaggagtttagaatttgcaataaatgaccagcctaacatcaattttttggtagcagtgataataatcaaaacatacccaccactaacactgcaaattatttctttacagaccataaaaacttcagcactgccactagggacctatcatcatcacaaaatgatacacatgcagctgcaatcaagcatgattcttctcagaggagctatgcatctacagagtccgatgaaagtaatgcttcagtttcaagtaccatattcttttatgagttttaatttctatgcactcagtgtaaacgattttacattgttaaccaatcatgataaataaaacttttaaaataattatcataaaaataaataaatttatcataaaatttataattagatgccaatatgaaaattctttacatggtgagtgcataaactatttactcttcttttattctaacacaaaaaatgatttacttgatttagcactccatgcatcttattattccacaacttctttatctttctttctttcttttgtttacaaattaatggctcactcaagtgcccttttgtgccttttttcttattcagggggtcattggaagagaatagcttatccatttgagttggtgaagcctggaggagttgaaggggaaacaaccctcaaagatataaatcaccagatgctgatgagtccatcaaagccaattccacaccctgtgggagattctctcactcattcatgcatttcaaatcgtgcttttggaatttcaggtaaagcagtggcagctcttactaggat

SEQ ID NO: 2620 - DNA, 743 bp, Glycine max
  misc_feature (722)..(726): n is a, c, g, or t
gttttagccctcgaccctctcactctctcacttcctcttccctttcacacttcttcgggagcacaagaattaactccaattcttcctccatttcacgccaacatgctccaagaagaaacttttccgttttcgccatgtccggcgatggtacctatctctctctctctctctctctctctctcttttctaactacgctaatgttacgaatgtggactcggtttcttagaagaaatcaaaatgaatgttatggaaaaaaatgcttttttttctcttcaaattctgtttttttgtttttgttttttgggtttggttcatttatgtatcttccttaaaatttgtgttatgcttgaattttggcttgagtttatcatattggggggaaaagacatcatttgtctgtgttatgttgaggttttaaatgatataaggtgtcttaaaagataatggtttttggtttttatatttcctggggtccaagtttactctgtgactatgaaaagtagtttgatttctttcacccttttgaaaatggccctttttaactttgcttccagatgcaaagcggagtgttccattgaaggattaccgcaacatcggcatcatggctcacatagatgctggaaagactactacaacggaacgcattttgtactatactggaaggaactacaaaattggagaggtgcatgagggaacagcaactatggagtggatggaacannnnnaagagagggggattacc

SEQ ID NO: 2621 - DNA, 771 bp, Glycine max
gcatagcaaaagacacccgcattcccctggtttcatttactggaagttcaaaggtatgttatgtactaagtagttggacatgatattttatacaggaaacaattcaactaattgaataggatgtataaatttatagtgttaaaagatgttgatgtcaccttaatagtgctcagtttagttgcctatggtactagtggtatcagtcttattgcagtcactgtctaacacactaaaatatcacccttttagtgaaattacttccatgtgtcatgtactgtgtaatcatgtatgttgctcttgtgccccctattaaaacaaaactatgcaaacatatctatgctgtttagttcataatgatgcgttcctgttatataggttggcttgatggtccagcaaacagttaatgagagatttggcaaatgcttgcttgagttaagtggtaacaatgcaataatagtcatggatgatgcagatatcaaattggctgtacgatctattttgtttgcagctgtgggtactgctggtcagcggtgtacaacttgccgtagactggtattagaaccaatttaaaaaattgaatttcatagtttttaatgcaatcacatgtgatttttagaaggtatatttaatttttcatttagcttccttgtactgcagtttctgcatgaaagtatttacgcagatgtactagaccaacttattggagtctacaaacaagtcaaaattgggaatcccttggagaaggggactctagttgggcccttgcatact

SEQ ID NO: 2622 - DNA, 296 bp, Glycine max
gagttttgggtttagctaatggctatttatacataaatacacatttggaagaggcggtgattaattggaattgaaacaaaaacaagtggcattgagaagaacagaaacatcatcaacacaaacacaacaaaaaacagccaaagaggaatacctcaacggaacttcctcgtttggctttcagtgtctgtctctcactccttaccacaaaaccctacgcctttaccccttgcttttatttatccttcaacaacgcccgttccttgttgcttcttgccagaagaggatttggatcggag

SEQ ID NO: 2623 - DNA, 409 bp, Glycine max
acaccttcaaccagaggagttatcatcctcactgcttgcatttaaatcccatgtgtccaaatcaattgaccaactagcatcggatttgaaacccggatcagagacccccctgtccttaacatggtttggaaagtgtttcggcctcttgcccttcatcaacaaggcttttggaaagcttgttgtggatattgactacccaatgagtaaattggagatcttttccattgaagagtacctcagctacaccttgagtttgctagagcttctgaattccatttcttctcgtctttctaatcttggccaagctaggctttctctggtccatggtttgaccctggtggagaactcaccttctttggctacaaaacatctgaaagcgattcaatttcaacaagggtactctttcacc

SEQ ID NO: 2624 - DNA, 831 bp, Glycine max
  misc_feature (826)..(826): n is a, c, g, or t
agaaggttacttttgtctttcattattaatatgcaagcatatagtatagtgattgagtggacttaattgaacaaataggatgaaaaagatataatttttaattatatacactgtttatttgatggaaagggatttctgattaactactagctgttaatatgaggtttagacctcaatatcaagtagaagaaagatgctttatcccattaggttgttaaactgtaaatgttgttcttcatttgttatatgcataggattgttgtggttttatctgcccataaatgggacaaaaatggactttattttgtccttttaagtcattatatcaagaataacatcattctcagctagcttaattactattgtcattgctgattgcaggacttgttcagttcttgtctgaatgaatcacgtttgtctaaaatttctgtaacattagtatgactataaaatgttgagtttaatattcatgaactgtttcaggttcttgaggaaatgagaccctacttggttggggctgctgatggaactcttgaattggtggccattgatgagccaattgtgaaggtccgaatcacaggtcctgctgctagtgtcctgactgtgcgtgtagctgttacacaaaagttgcgagaaaaaatacctgccatagcagcagttcagcttttatgatagtttagttcaaaacaagaatagaactatcatggcattcttgtcatttttcatgtacaacaacactaatggaaataatgtgttgcatgtgatgtatagtatatgtggccgcatgattttttttttaattcttaaatgctcttacaggggaagnaatgt

SEQ ID NO: 2625 - DNA, 359 bp, Glycine max
tttttcccgtagttggtattttgtctagtgtagttatttctttgagaattaaaaagtattcaacccaagtttcagtatctgaaatcgcccccaagcaaaactaacactgatgattcgtgacacaccttatatggtagtgaagagccggggggtaccttcgaaaaggtcaagagtcatattttgcggagttagtattattaacactatacacatattactataaatgtttttgttgtgacttgatcaccgtgttgtatggtagctgtacttcagttcagttatttaaactttggttgggatttttttgttcaatttatatttgaaacctttttcactagataaagtagtggaacgtgcgc

SEQ ID NO: 2626 - DNA, 400 bp, Glycine max
cattggttggtgctgtctgggaagcctgttctgcccttaaaaagactccttccacaaatattacagcaattgggagaggaatgacacaggttgctgtttcagtgaaggacgttcttcgtgagatgaaagaattgaaacctgtttcatgtgatgatcaagttgacgaagctgctggtgagagttgtgcagaagcagcgtctgagccacatgatgataattcaagtgaaggtgatctagggaatgacctgtcacctgaagagatgaaagtggctgaaagagcaattgaggttgtctctaatacgctttcatttataaaaatacttattcactccatcataggcttgcttaagctggaaaaaccaaatgacaacagcagttttgtaaattctctggagaagtt

SEQ ID NO: 2627 - DNA, 692 bp, Glycine max
  misc_feature (638)..(641): n is a, c, g, or t
  misc_feature (658)..(658): n is a, c, g, or t
gggcgtgacagccaaaagttcggggtagagcagtttgaaatgcgacatttttcgaaagatcgtccatttttggaaaacctggttggtctctctctcatggatttttaagaaacattacatattgatatcatatagataatagatgtttactacctaagttcttttgtgatgttaaagacgaagttgattattaatctcaacttcaaacacaatatattttttttttcttcagtaaaaattaaaaacaacacacactttatccaactaattaagggagttagtccctttgattcaaaaactttatgaatcccattaattagtatgggtttatactgcatgtctttgattataaattgtcatttaggatgaaaaaattgttaattttttttaataattaaactcttaaatttaaaaaatgtaaacgggaattttctttgtaacaatacttataattgttgaaaaattggcattttatcattttttgctccctatcctattccaaaacttctatacccttttgaggtacgtttgtacgtaccaaattaaatactactttatcctaaaaaaaactgattttctgaaaggaaaattaattgagtataaaataaaaagtcctaaataccttcttaattgcacannnncatgcaatatatataanacctctttggttttcaaacattttgatttttttt

SEQ ID NO: 2628 - DNA, 385 bp, Glycine max
ctaagagaaccaattaatggagaaaatgagagtggtactaattactctattgttgtttataggtgcagcagttgcagaaaaagctggtaatggcaaagctgccaataatcctgcagaagatgctagtgatggcgaagccattaatcttgtagaagaagctggtggtattggtgatgccattactcctgcagaaggcaaagccactaatcttcaagcgtatgagtcagctagattcaaaaagtttgtgacacattgcagctcacatgttgctcaaacatgcagtggaaatgatccattgcatcatcaggaaggtggccatggaataaacgttccacttgggttgtcattttgcctttttgattctatggagaaatgcttgggagaa

SEQ ID NO: 2629 - DNA, 367 bp, Glycine max
acagagggaggaggcaacacgtgtgttggaggtcattgttacaggctagtctttgttgtcatgactggagcatgcattgttggcttcttcttagacattctgttgtcaatcagaaccaagaatatttacaccaagatttccatgagcaagaaatccctagcaacatccaataggcagtgattcagaatggtatgacattcctgggattgatgaactttatgctcaagtgatatctcaagatctgtcagcaaggtgacttatcctatcagatagttaaaactcattttttcaataaaggagggccgtttgtcatgtactgtaatttttatttatttatttttatgatgtgtttggaaggatcagtgag

SEQ ID NO: 2630 - DNA, 383 bp, Glycine max
tttcctttgatgcccttacttacaacgaaatgatgactctttacatgtcagtggggcagtttgaaaaggtcccatcggttgttgaagaactgaaacaacaaaaggtttcccctgatatctttacttacaatctatggataagttactgtgccgccattcttaatattgatgaagttaggaggattcttgatgaaatgagtcatggtgctggttctaatgaaagttggataagatatttgaacctggccaatatatatattagtgtaggtcatcttgataacgcaagttccaacacacttgttgagactgagaaaaggatcacccaaaggcaatggataacttatgacttcttaatcattctatacggtgggttgggaagtaag

SEQ ID NO: 2631 - DNA, 955 bp, Glycine max
  misc_feature (709)..(711): n is a, c, g, or t
  misc_feature (750)..(751): n is a, c, g, or t
  misc_feature (898)..(899): n is a, c, g, or t
  misc_feature (937)..(941): n is a, c, g, or t
aaataagagaatgtggtgtcttttctggactttgtttgccccttatcaattttgcgatttaaattagtgcatcgtgctatgttttttctcatccatttcatgtgcctagtctactggctaggaaatgaaactgaaattgattctgaaatgctttagaggttgactctcagtgttgttaggttgtaatgaaaaatgtaaagtcaaaatcccttgattatatgaaataaatctagtaattacagcctgaaaatccttcctatttactaattacacagcttgaatttatctgttgtttacaaaaacatatccttctagtttcttgattattgtgatttcattgtctggtttttgttgttgttttggtgggcagcaagaagcaaaagttatgaacacaaagcaaggaaatcaagaccattcaattagatcaagaaccgagggaagttctagcaggtattttactgtcttggaattctttgtatttgtttttttgttctcctttttcctttatgcactttgatttattcatttctgatgtgaagacattgtgcacaaggtgaaatttcttaaatgtttatttttttttagctcacatttcttttttcttctttgtaagttggtaagcatgtttgatgtggtgttattatcattggtttctacagctttatttattcttgtaaaatttcattatttcttatgtttatattgggtnnnattttgctttttgtaggtatgctatgcagaagatatctnntgagcagaagaaaggagaggatgatggtgatatgcatcttgctcgcaagatcatgcagaacaagcagtttagggcttctactcaggctgatgatgaatatgactttgaggatggtccaagcagaaagagtagaaagaagcaaggagnngatgatcacaagagtatccaaaagaagacaaatcgatnnnnnctcagcaagagcgc

SEQ ID NO: 2632 - DNA, 1060 bp, Glycine max
  misc_feature (62)..(64): n is a, c, g, or t
  misc_feature (998)..(1002): n is a, c, g, or t
  misc_feature (1031)..(1033): n is a, c, g, or t
  misc_feature (1053)..(1055): n is a, c, g, or t
ctgtatatatccgtaagatttcacctgtttcatctttactggaactggaaaaaaagcctttnnnttcatcactaaatgtggataaattgtccttttaaacttgtttttgttcttcacactggataatgtatgccaaatgaggattagaagaagatttcttttgattctgatcttattggaataatgagcaaagctagctgaaaattacatatttttagctagatagaagatctttgtggttggtatcaatatttcctttgacagttggaaaacacggtttccagtattattgttatttcttctgctttattattgttgttgtcgtcattgtttattctgttatgttaaatcttaaatgctagagagttgatactacgcttttcttgcatgtgtccttaccaaaaactaattaagattttcttattctgctagttgggaatgatatttaacaaggagaattaattgaattgaacatggaaagaattaatgaaaattgagggtatataaatgtataataatttaagcaatgtttcacccaattgaaacatgaattcacttgaaagttaagtgatttataaatagcacaatcaacttgtttcataatttcgtttcttaattatgattattgtgattcttttgtaagagaattatgctttcatgaatttatataaagaaacactaagaattctaatttcccaatagttgtggggctttaattcagtgttcttatcatgcatacattctctaaatccttgcagcaagaccaggatttcaaaagcccgagagtagtacaccatcaagaaaatcatacttggagcccatcgctcttactgaaaagggcttactttcagcagatttcgttctggaagatccagattctcactatatatatgtttgtaaaaagataaatgacacagagatagacaataatacctgcataccaattaacagctgatgttttatagatctgacttacattgaagcactgatgaaggtannnnntatcctcttcacaaactttgatgtgcatnnntagttatttaagtggttgcnnngtcat

SEQ ID NO: 2633 - DNA, 824 bp, Glycine max
aaggtatgtgagactatatgagtttgttgttttgtctctttggtattcttctctattaacatgatataataagaaacagatgactactttataattgagcggtgttatacttgtaccactggattcatatttttatttacaatttcgatctagtttgagtgattatctaaaatgttatgcagtgtgcccctcatccaccatcagtgctcatgggagatgcatggacaaaaccatactctcgagaatatgctgccttcccagcttcctggcttcgtgtttctaagttctggccttccacaggtatgacatgatgatccttttcataaatcataattaacctaccacattatccactattgtaaggctattctctaaagttggtgtggaactttttactttaatttaattctcaaaactttcccttctctgaggggataggaattgattctaaatgtcattaaagtgtggcatattaatagtagtcattctaattctcacttggtgcattttcggcttgaatagttgtgtttgacaattaaatagactaataaatgtaaaatgttgctgggttgtatcaggacgtattgataatgtgtacggtgatcgcaacctcgtttgcacccttctcccaacatcacaggttgttgaagaacaagctgctgcaacggcctaatcttttcttccattgacaagtattttcattttttaaattgtacataaactcttcctatcattcaggcgttgctgcttgacctttgcttcattatatcataatgatgatgatgtaagtttcattcagccacataaccatacctaaacacagc

SEQ ID NO: 2634 - DNA, 394 bp, Glycine max
tgctttgtctgatcttacctttgatgtaaccgagccgcaatgggaggatgcttcagcacattttaatttgcaaaagtttccttcttatgagatcgattgggattctctctgaagactctttgtttttttatttttatgtctagtcttgtgggtaattaataatttagttataattaggattgctcttgtggctgctgcaattgagtttttgaagattgcagtgctacttgtaggatttggattatgttagtcttttttctttttcttttttttttaaatttgcttattggctattcaatggtcaatatgatgtaaatctctctaccttggtcagctggttttttttttttggttggccctggaaaaagattccgggttaaggcttttttaaaaa

SEQ ID NO: 2635 - DNA, 345 bp, Glycine max
aagaaggtgaccatcagtgactgtggtgagcttccaaatgcttgaggtggttcttgtgtaattttgttggttattccttctattaacttgttgagttgagaagggaaagaggggcggggaagaagaaactttggctttcttaaattttagtctgactattcttaaaatatgttctgtaacaccttattttcacactgaacctacaaacttttagcagccacatgtattctggtagaactatagtttgagttgtcgtcgggttggacaatttaataccccatttgaatggtatcttcttaagccaaagtgcagtttccatggggaattggatggctagagaattaa

SEQ ID NO: 2636 - DNA, 394 bp, Glycine max
tagtaattctagggatggtactttttgcaaccacttccctagctgatcatcatttactttcaacagcagaatctcctatgtcagaagttgtccatcgttatagttacgatgatcatgattataattccaatcactattatgatcattatcataaccacaatcatcatcaccatcatcatcacaatcatcatcatgattttgatgatcacgatcataattgtggtgatgacaataaagatcataatgataatcatggttatgatcaccaaattcaaaacccacacgatggaaaacactggccttctaccacacaaaatgagccttcaaaagtagaaaacaagaagccacaagaggagcacagttaggtggaggatggccattataagcttcacca

SEQ ID NO: 2637 - DNA, 590 bp, Glycine max
actggtgtacaccctgaccaaaccgtaatttaggtttttctatatttcttaaaatctgtgatagttactcaacgactgattgatagtttacattatcaggttctgaatgcttacgagtttgagagacatgctggctgcaaaacaaaacatccaaacaatcacatttattttgagaatgggaagactatttatcaaatagtacaggaattgaggagtacccccgaaagtttgttgtttgatacaattcaaacagtttttggtgcaccaattaatcagaaagcatttcgcaactggaaaggtaatgaaatccttctgtccactgcacacatgaacacatttacgtttgtttggtatgtcacttatccaatttttttatctcctgtcaactttatccagaatcatttcaagcagcaacacgggagcttcaacgcatttatggaaaggaagaacttaacctataagtcccaaccctttgtgaaaacgtaacttgggatagattctagtgtgcatagtaagatatgtctatttttaccattttcctgtgtcttttatatggctccgcaaccttcagtaatgtgctcctttggatg

SEQ ID NO: 2638 - DNA, 374 bp, Glycine max
aaggaggctatgaaatgtttagcaactcgagatgtaaattcatatgaagaagctggaactcctgttattaaggagaaggatgaggaaaattgtggaaatattgtcaatgatgaagaacaggtgatgcaaattccaagcccatgctctatgtcatcatcacctgatatgatcttaatggagttgaaaaaagccaaattgaatctaggcaaaactataaatgaacttggggtgatacaatcctctattgaatctttgaataagaagatgaagaaggagaaaaattttctggagaggacacgtgaaaagctagcatcaaagtttgcagcagaatctgctcaagagagggtccaagagcaaacaagattgaatccacc

SEQ ID NO: 2639 - DNA, 543 bp, Glycine max
ttgtgccgtcccagtaaatgttaataaccatgactcatgaatgaatcatgtcacaatccaacagaacagaactagtaccatgttgctgtcacaagccaaactgcacaacaacaacaacatctccaatgccattaacatgattatgaagaagaagggtaataacaataacaacaatcattgttcacctgctatactttatcactacccttgccctgatggtgcttttgctgcccttgctgcacacctttactttaaggccacttcatcattctctcctcttttctttcccaacactgtcttcaaccccctcaggtttttgcttcattcagcatcttctttttgtacccttcattctggttgcaatcattgctatgctatatgttctattgctatggtttttgattcatatatgtattttttcttcttcttttgggttgcaattttcagtgctgaagatcttcctctgaatgaaattggtgatctttatctcttagattttgtggggcccgatggttttgttcaggaaatctccaccaaagttaa

SEQ ID NO: 2640 - DNA, 224 bp, Glycine max
tattgattctgtcgtataacatatagggtgttataattggttaactagccaatactaatagtaatagggttctttaaagaaaataacatatatgatacaacatagggcaaaaacaatgataaagagatcaatggtgatggccgaaactgcctgatcactaagcttcatattccttccaccaaggcggtcaaccatgtctggaacaggttcccagttcttgagat

SEQ ID NO: 2641 - DNA, 509 bp, Glycine max
ctgttaggtaaggtatcatatcatatttcttcagtgcaacgtttcgttttacaactctttcaattgtcttgtgttgccctcattctgtttgttgaaatgctcccctctctctctcaattgagacttattcatttcgtgttctctgcgaattagcatgttccgttcatcgttccgccgcgcgttttcggcgagggcgtcgaagcactgcgagaaccacgagttcctctctcggaactcgttcctggggagctgggaggcgccacgggacccgaaggaggcggaggcgaagctggcgcggctgcgaagggaatacgcgaagcaagtgaaggaggttcggaaggaatacataagagagatggaagcgatgaagattgagaaggagcgcaaagacgaggctcacagggaagccctcagagtcgccaacgaagagcgcaagaagctcaaggctcaagccgcgcagcttagagcacaggaacgcgacatcgaacgacaacagtttcgagaaacca

SEQ ID NO: 2642 - DNA, 483 bp, Glycine max
  misc_feature (445)..(447): n is a, c, g, or t
  misc_feature (450)..(450): n is a, c, g, or t
  misc_feature (452)..(454): n is a, c, g, or t
  misc_feature (456)..(458): n is a, c, g, or t
  misc_feature (464)..(467): n is a, c, g, or t
  misc_feature (471)..(475): n is a, c, g, or t
tactgagttgaggcttggacttcctggatcccagtcacctgaaagggatccggatcttttctcgttgagctcaacgaaactcgatgagaagccactgttctctttgcttcctacaaaggatggaatctgctcactgtcccaaaaaactgtggtctcaggcaacaaaagaggttttgctgacacaattgacccagaggtgaaaagttttttcttttaacgaggttgaatgaatgtttcatactggtgcttgagtctgattcttcacaatctgtgttgttgtgggaagtttcctggcaatgcagggataaacatgatgctatcacctaaaccttctggagttaagcctaccacagtgaaagaaataccaagcaaggtattacaagaacatccttctgcagcaaatggaactggtcataaccatacgggagcttctatcagtagcagnnnctngnnncnnntccctnnnntctnnnnncccccttt

SEQ ID NO: 2643 - DNA, 1456 bp, Glycine max
  misc_feature (1389)..(1390): n is a, c, g, or t
  misc_feature (1420)..(1422): n is a, c, g, or t
  misc_feature (1426)..(1428): n is a, c, g, or t
  misc_feature (1432)..(1434): n is a, c, g, or t
  misc_feature (1439)..(1443): n is a, c, g, or t
  misc_feature (1445)..(1452): n is a, c, g, or t
cagagactgataaaaacatatggacaggggaaaactgacttcaatgcagtgaagcataaacagcaatctatgatcttagtggatgtccagactcctggcgttcacataaagagaccattgacagtgtttggctttgatgatgcaccgcatgggcatgcagaagtaacatttgaaaatgtttgtgtgcccgcaaaaaacatcatacttggcgaaggacgtggatttgagattgcccaagtaagttgaaaaatattgtgatgttggtttgaaccctgttatcaccaacttaagcatcttttaattttagttctgttcgaaagcttgcagagcttcaacttccatgctttattgcctcctatggcttaaagagtagtgcttcctaaagtatcaatgttacttatttttttccagtgactaataatgttgacaccatgataaattggcagtcccaaaatgttgacaccatacgaagcattcaacagtcccaaaatgagtaaattgagatagcgccaaggtttgaactttgaaagatggtcatgtttcccacatgaggcacccttttaggggggaaaccatgaggctcattccaatagtccatagaggactattccttctgtgaacccatgattatagatgaacaacatcaactttgatactgtttttggcaaacatctagataacagcccaataagtttatatgaggcttttcataagtactactataaattatcatttaaaagtggcttaaatatatctttagtcctcacaatttagagtttttttgcttttagtcaaaattatttttttgtttttagtccttgcaaattatgttattttgttttttgtccttattatgttttagatgatacttttttcactattcaaagcactatctaaagttctttaaggtctaaaacaaaacaaacataatttgcaaggacgaaaagtgaaaaaacattaaattgcaaggaccaaaaatatatttaaacctttaaaggtggacacgccaataatagttttaatatattctactatagaaggaattacgggtttgtgcatgggagctattttggctttctaacggcaaacactatatctgcctatattgtttgagatgtgtttgctttagtaccaaaaagcatatttttcatgtgctgataacttgcattctttcagggtaggcttggtcctggaaggctccaccattgtatgagactgataggtgttgccgagcgaggcatgcatatgatgattcaaagagctgttggcagaagaacatttgggaagttgattgctcaacatggttcatttatttcagatatggccaaggtattaggattcaaataggaatggttttaaaaaaaatctagaagtggcaggaataaaaanntctctgttttaacttcattcgagaatctcnnnctgnnntacnnnagctnnnnngnnnnnnnnagtg

SEQ ID NO: 2644 - DNA, 313 bp, Glycine max
gataaagatgctggaagtgaagaagatgaagacgaaggttctgatgctcgaccggaagaatcataaattttagatacacatttactgatttttggtcgtggtatgggattgagtggaaacctctacgagctagaagtatacctcatgtataaagaactatgatggatggatttttgcattcacaatatttttcactaaggtcgactttactatcctttaaaatgtgggtgaaaatttaagaaattttttttatgtaattcttataaatctcgtctctgaattttttcactcccatttctaagggtgcttaaga

SEQ ID NO: 2645 - DNA, 403 bp, Glycine max
atgcagactagttctgtctattggtttattaattgggaattcttaactcaccagcctttgcaacagctacaaaagaagctaacaaccttcggaattccgtatctgggtttgctcattggatcctgcaagaaacgacaggaggatggaaccaattctgttaaccttttactatgcttacgtcaaccgagtgattggtttggggtcttaagtggtttttgtaaagttttctattcattagctttaaagcattttattttgtaccttaaattgttttaccccttcgccccttcacccaaaagactaatttttaaaatgtaggggttaattctatctgaagtttcgtacgtaaatctgttcttctgcagattttctctaatggcaatctacagcttccgtcttactt

SEQ ID NO: 2646 - DNA, 400 bp, Glycine max
ctcgcacacttccacagcactaccaaacccaacagcaacaacagccacaaaacaaatccttcaggttattaatctaagtaccctctcaatttttttattattgaaatcccaaaccatttcccttcctttccacccgtcattttaccaaccctttttgatattttgtttatttttacaatttctctttgcaattgaatcttctttgcttttctttatatttaccccctttattgttttcttttgctttcagaaatctgcaaacaatcgatggtcagatgtcacagcaggtggcgttttacaaccctactgatttgcaagatcaatcccaacatccaccctacattcctccatgtatgtaaattcttcatctttaccctccctttgttcaattttggttctt

SEQ ID NO: 2647 - DNA, 393 bp, Glycine max
atcacaactacaaatgaaacaaagtgaaatatgaacaaaattaattcatcattaagcaatacgtgtatagtctactaatctagagtctagtttcactcttgaactaaaaacctctaatcaaagttttgtcttgtactggcactcttggttcccaacagttccattagaaagattaattgcaacatcacaagaagtggaggaaaccacatggactttgataaagcctaagatgctgactttcccagacatcctcacgaaagtgtttaggggcaatgtaccagatgtgacatcagataaaagctgagaattggagagcaaacggtcggccataatggtgagggtgagattgaatcctttggtctcaccggatgaaatctctccggcagagatcgg

SEQ ID NO: 2648 - DNA, 362 bp, Glycine max
caatatgcacccaaatagcttccatattctcaaagcccacccatccatacccggccccactagaccttttagtcaccgaactcacctccgttgcctctcaaaaaggcaacgtttttctatacggcgtgggccgcgagggcctcatgctcaaggccctctgcatgcgcctcttccacctgggcctctcggcccactttgtcttcgacatgaccacaccccccatagccgccggcgacctcctcatcgcctctgccggccccggcggattctccaccgtcgatgccctctgcgcggtggcgcgctccaacggcggaagggtgctgctcctcactgcccagcccgagacagggtcttgcgtgaaa

SEQ ID NO: 2649 - DNA, 410 bp, Glycine max
ggttggatggggtgaaccatcagaaatgcaagatgctggctcaagtatgaacccctttctggataatgacgagtctggtaggcctcaagtaggcagccctaatcttagttctccttcaaatggggaatccgtaccttcaaatgggttgccaactactagcgattctatcaatgggaacagtgactcaagtccaacatctgtagcggtaccctcgctatttgaagaggatgtggaatttgtaggtgtagaattagaaggtacagagaaggcaatggaccaggctctcaaagaagggatagttggggaagcaggaccattgaaaagaaacgtagtctcaaaagttccagataaggaaaactctgaagaaggcagtcctggtgtgaaggagttcaacgatgcaaattactgaa

SEQ ID NO: 2650 - DNA, 399 bp, Glycine max
caattttcaagtgacctgcatcattccttcacttgagtcatccacagaatcctgcaaagcctaccttaaaacccttccttcattcatagacttcatctttcttcctccagttagcatagagcaattatcccaaggaggatacattggacagctaattcaactcactatttctcattctctgccatcaatacatgaggtgctgaaatccttgttctctaaagtccctttaactgcgttggtggtagatgttcttgcacttcaagcattggaatttgctaaggaattcaatgccctgtcctatttttacttccctagttcagctatggtattgtcactgcttctacacatgtcaaaacttgatgaggaggtttcaagtgcgtacaaggatctaacagaacc

SEQ ID NO: 2651 - DNA, 359 bp, Glycine max
acaaaggccattcaagaggccgcatcagaaggcctcaaaggcatggagcacttgatccgaactctctcccaccaaccctctcacttaaacaccgaactcaccgatgttactgtttccaagtttaagaaactcatttcgctcctaaaccgaaccggccatgcccgattcagacgggccccggttcagtactcatctccacccgcacctgttcacaacgctaacacttccacctcatcaattcaactcccttctccgccgcaaaaccctaatattcccgcgccggcgcagtttccttctcctgcgccggtggccgttcaccacgcgccggtgacgctcgattcacgaagccgcacaacgcg

SEQ ID NO: 2652 - DNA, 1312 bp, Glycine max
aggtattcatgtagtttatcctgcaacataaagaaaatattactcatcaacaacagaaaatagttagggaatatatcaggaggttaacgcatctatcatcatgagagattccaccatagatttataaacaagcttaaaggttctatcataagtcataagaatatgtgtacttgccaaatgtttgattgtctgtgtattcagctctctatataacctgcttgctttaacagatgcagttgccacatttctcatgtcagcagctcgaactctctgagactcaaatatggcttcttctgtctcaaattttgtaagcttaacaaaagccagacctagttcacccatcgtttcacccatgtcttgctgaaacttgacaagggattcagcctgcaggtcaatgcggataaacaaaatcaagctcagcaatcaaaaagggaaaacaatattgttcttattcagttccacatgacaaaaatggacatggtaacacaattccaaaaaaggggcacattttaaacaaaattcaataaccaaagcaacacttgaagaggaatgcctttcaattcaaccaactaacaatatttttttcaaaatatctttcaagaagctactaaaaagtgctattatttcccccataataagctataataacatgcatccatagagtgtttggaagtgcttttacagaattatttagacatatcttataattaagtgctttagcaggtattaggataagctcaaaagcaacttaaagcttcttataaactcttaaacttctttcgataattattacttggttaagtacccaaatgcacttagttaagcttttaatgatcttattgaataagcacatagttaagctgattacccaaaagcaccatactaacaaaaatggaagcttataatgaacttatcaaataagcatttagtcaagctcattacccaactgcacttagttaagcttataatgccgccatagttaatctcatagtgaataagcatgtaattaagctgattacgcaaatgcaccatagtcaattaccaaacatggaagccaaaaccttatagtgaacttactgaataagcatttaattaagctcattacccaaatgcacttggttaagcttctaatgcaccatagttaatctcataatgaacttactgaataagaactttaagctgattaccaaatgccccatagttaatcttataatgaacttactgaataagcacatggttaagcttattacccaaagtgcaccatagtgaactaacaaacactaaaggcaaaatcagtgaaacacaaaacctg

SEQ ID NO: 2653 - DNA, 390 bp, Glycine max
ctgctgctgctggccacccacatattgcagcggattctctggctaagatatcagatatccaacacatgcctgctactgttgccacccttgtgtctttaaaagaacgagctggtgacattgatggcgcagctgctgtgcttgacgctgcaattaaatggtggtccaatgctatgactgaggacaataagctcaatactataacacaagaggctgcttctttcaaactcaggcatgggaaggaagaggatgctgctcaactctatgagcagctcgtcaaaagccagggaagcatagaagcactagttggtctggtaacaacagttgctcgcatggatgttgttaaggcagagctttatgaaaagcagctgaaggctctacctggtttaaagg

SEQ ID NO: 2654 - DNA, 544 bp, Glycine max
cccttcattcttcattctcctctccctttctctattgctcatctccctctccctcgctggttagttacctctctttttctaaccttcactgttactgttactgtcactgttactacctttttattttttctctcttgctttcaacaaaaagctatgttacttttctcggaaaaccgaaactataactgtttctctctctccttctcaatttctttttaatctttgattattaacttcttgggttcttgttcttgcagagtcgcaatctttcatcggagtaaactacggccaggtcgccgacaaccttccggcgccggaggacacggccaacctcctcaaatccacaaccatcggaaaagtccgtctctacggtgccgatcccgccatcatcaaggccctcgccaattccggcatcggaatcgtcatcggcgccgccaacggcgacattccgagtctcgccgccgatcccaacgcggccactcagtgggtgaacgcgaacgtcttgccctactacccggcgagcaacatcactctcatcaccgtc

SEQ ID NO: 2655 - DNA, 677 bp, Glycine max
  misc_feature (434)..(434): n is a, c, g, or t
  misc_feature (437)..(437): n is a, c, g, or t
  misc_feature (448)..(452): n is a, c, g, or t
  misc_feature (454)..(457): n is a, c, g, or t
  misc_feature (478)..(481): n is a, c, g, or t
  misc_feature (484)..(494): n is a, c, g, or t
  misc_feature (496)..(512): n is a, c, g, or t
  misc_feature (516)..(517): n is a, c, g, or t
  misc_feature (527)..(528): n is a, c, g, or t
  misc_feature (534)..(537): n is a, c, g, or t
  misc_feature (541)..(544): n is a, c, g, or t
  misc_feature (546)..(550): n is a, c, g, or t
  misc_feature (555)..(557): n is a, c, g, or t
  misc_feature (560)..(561): n is a, c, g, or t
  misc_feature (563)..(565): n is a, c, g, or t
  misc_feature (571)..(579): n is a, c, g, or t
  misc_feature (602)..(605): n is a, c, g, or t
  misc_feature (618)..(622): n is a, c, g, or t
  misc_feature (626)..(636): n is a, c, g, or t
  misc_feature (638)..(638): n is a, c, g, or t
  misc_feature (647)..(652): n is a, c, g, or t
  misc_feature (669)..(669): n is a, c, g, or t
  misc_feature (673)..(673): n is a, c, g, or t
gctcgcgtctcttccacttctccttccgagatgccctttggtcacaaccgttgtcagtctcttctctctgtcttgttttttcaaaactttaatcaaacacttagtgggtcaactaactaaccaaaaatttgaaccttcaacattatttttttccaacttcttctatgcccacttgagtttcatggtcaataatgccttttttgatggcgcttagcgtaaaaaatgttaacttcaccttctgtggtcaactccaaaccaaattgagttctacctctacatatgacacttgttgcttcagggtttcgcaggttgtcggtttttccacgtttgcaactatgtcaagggctgagaaagggtttctccaaaaacatggcttgcagtgtcagtgtggataattgtgatacggttcatccagcaacagatgcttatgctgnaanggcagttgaannnnngnnnnctgggaaagtcattgcagtannnnctnnnnnnnnnnntnnnnnnnnnnnnnnnnnttgnnatgctgctanntcaacnnnncctnnnnannnnnatttnnngannannnatgggnnnnnnnnnaaaaaaaaaaaaaaaaaaaattnnnntttcaaaaaatgnnnnntttnnnnnnnnnnnantttaaagannnnnnaaaaaaaaattgttttnttanaaat

SEQ ID NO: 2656 - DNA, 505 bp, Glycine max
aatggagagtaagctgaggaactcactagatcaggtacttcttgattatacaggattcaactgcgtgcttgttgtatttgagatcagcttctttactttttgttctttgatggggaagggtttgggtatttatcaaatttgatattcagttcgtttgtgtctatgacatttcaaactataaggcatgttaatgcatgttacaggtatactttggcaaaacaagagaaatggtttgcacactgagaccaccatctgaagtggcacagatgagaatgcctgatagcgcctgagagctgacgtgtcgttacttggcgtataagagagaaatttactttgttttcttcatatgtttttgcgtgttggctggtaacttgtgtcacagtatttgaaggtaggtagtttcacaatggttggtggttcgggtgaccattgttttacagaggtagttgtgtttgttgtttgagtgtcaattgttgttttctgtagtggataagcatcatgtttg

SEQ ID NO: 2657 - DNA, 520 bp, Glycine max
  misc_feature (505)..(507): n is a, c, g, or t
  misc_feature (509)..(509): n is a, c, g, or t
ttggagagcttttctacctgaaggagagaatagagaccaccctgcttgcaacccttttggaccaagggggagaagcattgaaggactcaaattccctaaaagtcttgtttgtgtggctggtttggatcttctgcaggattggcaattggcatatgcaaaaggtcttgaggattgtggacaacaggtcaagcttctttttctcaaggaagccactattggcttctacttcttgccaaacaatgaccatttctattgcctcatgaaagaaatcaacaactttgtcaattctgattctgactgttaatatactattagtactaagacgacagacgactactactactactgctactacttaaccttaccttacctacaggaggcaatagtagaaatggtcattgtttggcaagaagtagaagccaatagtggcttccttgagaaaaagaagcttgacctgttgtccacaatcctcaagaccttttgcatatgccaattgccaatcttnnnanaaaatccaaac

SEQ ID NO: 2658 - DNA, 400 bp, Glycine max
cattaatgatgctcccaagaatctccaggaactcagcaatcccattgtgcttctcagtctcaaaaataaaattaaagaacacattattgatggccttcctgatgaaagggcgatgtgccatgaatttcccatagatgcggtgcagcgtcatcttcaagtactcgcgctccctcggatcctcagagtcgaacaaatccagcagcctcaaaatgaatgactgatcaatgtatctcttggccaacttcgcatccagctcgggagacgccacaaacctcagaaaaagctcatacacaatctgcaaatgaggccaggcaggatccatagaaggctcctcctcgtccatgtcaacaccatcaacaatcttattctcgcgcggctgaggactgagtgtcctgaataa

SEQ ID NO: 2659 - DNA, 376 bp, Glycine max
caaaacaacccctacagatgagtttgctataagcactgtagctgctgtccttaaggagaaaccacctgcatggttcacctatgggcattactctactgtcatggctatcatgtatcatttaccgatctctgttagagattttgttttgaagaaagcaatgaaaggctgagctatagttaggtggtgcatctatctttccacatggacaccttataaagcatttactttacctttagcaacagaagagatattttctatttagttccattttatcatattttagtgaacaaagtttttgaataaaacttgaccaaactgaggacatagtttcttgagaatgtgtctgaaactttcccattctttgaacatagaccag

SEQ ID NO: 2660 - DNA, 798 bp, Glycine max
  misc_feature (53)..(53): n is a, c, g, or t
  misc_feature (303)..(304): n is a, c, g, or t
  misc_feature (308)..(308): n is a, c, g, or t
  misc_feature (332)..(332): n is a, c, g, or t
  misc_feature (334)..(335): n is a, c, g, or t
  misc_feature (351)..(351): n is a, c, g, or t
  misc_feature (353)..(355): n is a, c, g, or t
  misc_feature (372)..(376): n is a, c, g, or t
  misc_feature (381)..(386): n is a, c, g, or t
  misc_feature (392)..(394): n is a, c, g, or t
  misc_feature (397)..(403): n is a, c, g, or t
  misc_feature (412)..(425): n is a, c, g, or t
  misc_feature (430)..(439): n is a, c, g, or t
  misc_feature (441)..(443): n is a, c, g, or t
  misc_feature (449)..(457): n is a, c, g, or t
  misc_feature (459)..(459): n is a, c, g, or t
  misc_feature (461)..(469): n is a, c, g, or t
  misc_feature (471)..(474): n is a, c, g, or t
  misc_feature (484)..(491): n is a, c, g, or t
  misc_feature (493)..(503): n is a, c, g, or t
  misc_feature (505)..(518): n is a, c, g, or t
  misc_feature (522)..(522): n is a, c, g, or t
  misc_feature (524)..(532): n is a, c, g, or t
  misc_feature (534)..(534): n is a, c, g, or t
  misc_feature (536)..(536): n is a, c, g, or t
  misc_feature (538)..(538): n is a, c, g, or t
  misc_feature (544)..(547): n is a, c, g, or t
  misc_feature (550)..(550): n is a, c, g, or t
  misc_feature (554)..(557): n is a, c, g, or t
  misc_feature (561)..(576): n is a, c, g, or t
  misc_feature (578)..(579): n is a, c, g, or t
  misc_feature (581)..(581): n is a, c, g, or t
  misc_feature (586)..(586): n is a, c, g, or t
  misc_feature (588)..(619): n is a, c, g, or t
  misc_feature (621)..(624): n is a, c, g, or t
  misc_feature (626)..(629): n is a, c, g, or t
  misc_feature (631)..(631): n is a, c, g, or t
  misc_feature (635)..(643): n is a, c, g, or t
  misc_feature (645)..(656): n is a, c, g, or t
  misc_feature (665)..(667): n is a, c, g, or t
  misc_feature (669)..(683): n is a, c, g, or t
  misc_feature (686)..(691): n is a, c, g, or t
  misc_feature (693)..(695): n is a, c, g, or t
  misc_feature (699)..(701): n is a, c, g, or t
  misc_feature (706)..(720): n is a, c, g, or t
  misc_feature (724)..(729): n is a, c, g, or t
  misc_feature (733)..(737): n is a, c, g, or t
  misc_feature (741)..(743): n is a, c, g, or t
  misc_feature (745)..(748): n is a, c, g, or t
  misc_feature (750)..(753): n is a, c, g, or t
  misc_feature (764)..(781): n is a, c, g, or t
  misc_feature (783)..(790): n is a, c, g, or t
  misc_feature (792)..(792): n is a, c, g, or t
tctcttcagatccgccaggtcctcacccaggctgttagcctcggtcagttcantttttccattttcaacttctcctgtctaaccttcttctagggtttatctctaatttctatcatttaacagttacaaaagcataatggggcattgtctagaacataaattaatttcttcacttttcactctcactggtcatagattatcaggatcacaatatgattgatttatgttaaatagattatgcaaacaacatagggtgggtcttgtacagacggactctaccgtactttatttgcttatgctgcnnacantaatttaattaaattaatttttgncnnatcattttgtatactncnnngccgtgattatggtccnnnnngctcnnnnnntcggcnnncannnnnnncttcctctnnnnnnnnnnnnnnatagnnnnnnnnnngnnncataannnnnnnnntntnnnnnnnnntnnnnatgtttttannnnnnnnannnnnnnnnnnannnnnnnnnnnnnncatncnnnnnnnnntntnanttattnnnnttncttnnnntatnnnnnnnnnnnnnnnnanncncatcntnnnnnnnnnnnnnnnnnnnnnnnnnnnnnnnncnnnncnnnntncccnnnnnnnnntnnnnnnnnnnnncttctcccnnncnnnnnnnnnnnnnnncannnnnntnnnaccnnnctttnnnnnnnnnnnnnnngccnnnnnnctannnnncccnnncnnnnannnntcccccttttnnnnnnnnnnnnnnnnnntnnnnnnnncnactttt

SEQ ID NO: 2661 - DNA, 452 bp, Glycine max
tctttgtagttggttcaggttttggcaacttcaacccagcaactgatcccctcaagttcaaccttgtagacccacccgtgaggaacaccattggaacacctcctggaggatgggtggccattcgttttgtggctgacaatccaggtaacttattatactactgcataactttgtcttcttctgcagtttgtatcacgatcacatattaatctgttacatggttttctttcactgctgcgaatcaggaatttggtttgtccattgtcacatagactcacatctgaattggggtttgggaatggcacttctggtagaaaatggagttggcctttcacagtcagtattacctccaccaccagatctaccccaatgttaaggttaatgaagcatcattagttaataaatttattgttctgtattacaagttctacaagaatttgccaaacaaacag

SEQ ID NO: 2662 - DNA, 362 bp, Glycine max
agatcctctcttcgatctagggtttctggcttaattaacaatcaaatgtttaaggaagaatttctatgacgattcgcaaccccatgcgacgaatccgtctcctccactccttctccgtcgtcttcctctactggttctacgttttctcatgaactaactccctctcaatcccctaccctaattcctccaatttccccattttttttctctaattaatcagatttgcaaaatcctaatttctctatcctaacaaaacccccaaattcaaacaaatccaatggcttcgattccgcgtccggcgagttcgggatcttcggagggaggaggagatccggctgcgatggacgagagaaagaggaagc

SEQ ID NO: 2663 - DNA, 350 bp, Glycine max
ctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggttcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaag

SEQ ID NO: 2664 - DNA, 588 bp, Glycine max
tcacagcagaaagagaaatgacctcaagaaaatcttgacaaatgcaggtaaataagtaatttaagttcatgtttcacacacaaaaagttaggggaaacaaaataaaacgtgacgttgttttgaggttgcattatttattataattgctagagtttttggtatccccttgacagttaggaatgagttactatgttaatataatgttctttcttgaaattttcactcctaatttaaggaacattaatataatgatcctaaataaaggtgtctgattttaatatcattgttaggtattgttgcaagtggaaatccatatccaacacgtaggatactacaagctttcaggaaagctttaggtgtgaatgttgacatagtttgtgagccagatagaagtggaaatgtttatcttgcagaggtccatcaatgtgttgatgctgctggaacaacatctatagactgtgacaataaggcaagaggatgtgatgatgaccccatctttccctacatgggattccaaccagacaaagatcccaagtaataagatcatgctaccaaaatctcctatagttgtattacccctggaacaaa

SEQ ID NO: 2665 - DNA, 802 bp, Glycine max
cagataaggttgagtcatgccctttgaatcttgagtttgacgcagatgacttagtggcattctcagttgttggttcacgaagcatccacctttctggttattttgcggccgacgatggggatgatcttagggatgactatgaatagtatccttctgaataatttccatttgttgacttatttgcatttcaatttaagttttgttcatatagttgtgattaagacacagtgcatggtgtaacatttgattttacaattagcttctttatttcctactacattgtgaaagtgattcatggggggaggatattgaaggaactgagtcagaggagtcatctgaatatgatagtgaagatggatatgctgatgactttattgttgatagtgataccgacatgtacccatcttcgccagtcccaaatagtggaggtattttcactctattatcaacttttctcgaggccatgaaatgattatatgtattttctgcccttttcttatgtttctttttattattttaaagtggatttctaactgatgttctcatgtttttttatatatttaaagatacttgaatatttattaaaataaaatacaaaatattatcaaatactcaaattctttggctatgtttttcctgtataaattcaagaacgatccaagaaaaattgcatctgattgtagacatgcagatacattattatttaatgatagataatagatatgctataacatcctatcatacaattctcactttcattataataagttttatcattactctgtataacatgaatgacatg

SEQ ID NO: 2666 - DNA, 380 bp, Glycine max
gtatttcctgaaacttcacctgcacctgcacctacacctacaactggggaaggttctacttcacacaattttggtgcccctgctgcccctgcaagaagtttgcctgctccatggagaagttcttatgctcaacctcctaattgtcgatttgagcatagaaagagatctccccggaatagtcaaaaacatgctcatctaacacctgcagtttcccctactaatgctccacactatcctgttgcctcaccatgggttggacctccagcacatggctttcattcttcggttcctgctttgagtcctttaccaaatgtagcatttgcacatgctgagccccctcctaagaatgagccatctgctgaacgtcctaactcaaatta

SEQ ID NO: 2667 - DNA, 615 bp, Glycine max
  misc_feature (335)..(335): n is a, c, g, or t
  misc_feature (369)..(371): n is a, c, g, or t
  misc_feature (378)..(379): n is a, c, g, or t
  misc_feature (393)..(399): n is a, c, g, or t
  misc_feature (401)..(401): n is a, c, g, or t
  misc_feature (413)..(422): n is a, c, g, or t
  misc_feature (425)..(429): n is a, c, g, or t
  misc_feature (438)..(442): n is a, c, g, or t
  misc_feature (444)..(457): n is a, c, g, or t
  misc_feature (471)..(475): n is a, c, g, or t
  misc_feature (477)..(482): n is a, c, g, or t
  misc_feature (486)..(486): n is a, c, g, or t
  misc_feature (490)..(490): n is a, c, g, or t
  misc_feature (492)..(513): n is a, c, g, or t
  misc_feature (515)..(519): n is a, c, g, or t
  misc_feature (526)..(537): n is a, c, g, or t
  misc_feature (540)..(545): n is a, c, g, or t
  misc_feature (547)..(558): n is a, c, g, or t
  misc_feature (561)..(562): n is a, c, g, or t
  misc_feature (564)..(567): n is a, c, g, or t
  misc_feature (570)..(577): n is a, c, g, or t
  misc_feature (579)..(585): n is a, c, g, or t
  misc_feature (587)..(590): n is a, c, g, or t
  misc_feature (592)..(594): n is a, c, g, or t
  misc_feature (598)..(598): n is a, c, g, or t
  misc_feature (600)..(604): n is a, c, g, or t
tgatttttcttttatgtcaaaattttggaaaagcactttggctgtaatgtattaagctggtgataatacttgattattcatatgatcatcatatttaaagttggcaagggtgctttgcaaaaactttaacttagaatcttgcaaggaagtgcattatatagtttgctgatgttagtgacttcaagttgattgtgatgctcaataatattaatccatataatggttttgctctgttgatgacaaaaaaattgttttccactgtatcactatcaggttgaagggttcaagatgaacctaatttactatgatctctaccagtccacacgactagaaanagtttatcacaggcatggtcctaccaagtcctannnataaaannaattactgtgaagnnnnnnntnatggttcttttnnnnnnnnnngcnnnnnatgctacannnnngnnnnnnnnnnnnnnacccccgtgacttnnnnnannnnnncaanctgnannnnnnnnnnnnnnnnnnnnnnannnnnaaaattnnnnnnnnnnnnatnnnnnnannnnnnnnnnnnctnntnnnnttnnnnnnnncnnnnnnnannnntnnncctngnnnnnttcaaaaaata

SEQ ID NO: 2668 - DNA, 407 bp, Glycine max
  misc_feature (329)..(329): n is a, c, g, or t
aaacaaatcaatcatcatgtttcatttttgaggggtaaaatcatcattttttttttattctttttttctccccgcacttcagcaatagaaatacatctcagatggcacaaattaacgcataatggcattattaggtcattgacaaatctgtatcaatgaataagatattcatcccaaactgcatgcaaagtcaggtcaagctggctcttctaagagaatctccgaacagctcattcccaggcaaagacgggagaaactgtcaatttagaatagatgaacgtatctggaaaccttcatcaccttcaaaaagcagcgggaatcttgtcaanaaattgccacaggtttgttcccaggggggagtttacttagggtatcagggtcaaatactttggatggaggccagaaaa

SEQ ID NO: 2669 - DNA, 674 bp, Glycine max
aaaggttcaaatctaatgatgatgagaggaatgacagccaaggactttgaccctgtaagatattcaggaagatggttcgaagttgcttcacttaaacgtggatttgcaggacaaggccaagaagactgtcattgcactcaggtaaatgctaaaataaatatagccgtaaatatacaggacaacatttggtatagaaaagagcccattatatttatgctcttccaacatctttccccaattaacttcatattctttataataaattgttgaatttggaggcacagacagaatcctaaggttgttcatttattaggcatgtgcggaaaattctaccattcagtagtataacagttagtacatcttggagataagatttatcatttaccttatttggcatggacaagcttcttgatattgatttgggtatactaatgatatttcagggtgtatatacatttgatagggaagcaccatctatccaagttgataccttttgtgttcatggaggccctaatggatttataactggaattagaggaagggttcaatgtctttcagaagaagatttggggaaaactgagacacagctagagaagcaggaaatgatcaaagaaaaatgctatctccgctttcctacactgccattcattcccaaggaaccttatgatgtgatt

SEQ ID NO: 2670 - DNA, 834 bp, Glycine max
gtctggttcaaaaatagaactgttaaaaatgcataagcatttgggaacaaaccaatgaattacttaacagcaatatcacgcctatatcacaaaatgtacctcgcaaacccagtatacactgtacacttatgaacacaaacaacaagtacacaagtattgtaattaattttccagcctatatagtttatcacaaagattctgcttcgtacctttttaccaacatcagatccttccaccacgcaaaccgattgaacaggactcaccttgaatagctgttaagttaaaccacaaataaacaataataactaagagatcctaatgaagattttcgtctaatctaattcagtgaatgcttagccattaagtgaataaagaaagcaaaacgcagcattagaattggtcgaaaaataacaacgaaacgacaagaaaaaaacaaaatttcaaaattaagcctgccgccgaataataagataaaacgcacagcatagtatcatagctaaaaagattcattttttattattgcaaatagctaaggagagaagcatggggtgaaatggacctgaacagttcgaggatcgacattgaatggaatctggtgagattgatgatgaatttggagaccgtcagagtcgaagcgagcaattcccggcgaagccgaagaaggagccgaagagaggtcggaaactgatgccaaagcgaactctcgctgcttccatttctgccctaacgattcctccattactttactactttctccaccgagccacaacccactactctctctttacttaacttctttcaaacaatacgttcatgaatgataacactacgcgt

SEQ ID NO: 2671 - DNA, 378 bp, Glycine max
  misc_feature (25)..(25): n is a, c, g, or t
  misc_feature (43)..(43): n is a, c, g, or t
ttttggagctagaccagttaaaagngtgatacagcaattgggnttgaaaatgaaattgctatgggagttctaaggggagatttcaaagaagaggactcaatcattgttgatgctgatgtgactctatcaggcaaagaacgttctcctctaaataaactgcttattaagaagttggacagccctgatgcggatgccatggtcgtcaatgattaattttgcctactagcttcagttagataaaagcagagtttaaaaaaaaaaattggtaaaactccatagggtacgaacgtagtacttttttttttggggggaaattttggtttgggggatttggggttaaaaaaaattggtgattccgggtttttttcaaaacccggg

SEQ ID NO: 2672 - DNA, 350 bp, Glycine max
tctgggcaatcctaaagccttcaaaaccaaccttcatcctccaagacgtcaccgtttacggcttcaatgccaccatccccaacttcctcacctcaagttttcaggtcacgctttcctcgcgcaaccccaacgacaaaatcggaatctactacgaccgtctcaacacctacgtaacttaccggaaccagcaggtcacgtaccgaacctcaatcccaccctcgtaccaaggtcacaaggaagaggatgtgtggtccccgtttgtctacggcactaatgtccccgtcgcaccctacaacttcgttggcctcagtcaagaccagaccaacggcaacgtcctcgtcctcgttaag

SEQ ID NO: 2673 - DNA, 399 bp, Glycine max
cggtggagaagcccgcaccggattccgaagcgcgtgtttcaaattcggatagtcgcgatggaatgcgcgtggtggtggagccgagcgacaagcacgacattcaggcgttaaggagaatggaggcgaaaaagaagacagagcagaagagggagcgcgtgagggaaccgtccgagcccgaattgaaacgggatttcaagagggagaaaacagaatacgggaacggcgttagtggcgcgtggaatgcgacgacgacgccgtttgacctgcaccaattcccgacggtgcagtacttgccgttgaataacgggtctccgttaccgtgctgggtcggaggggaaaagattgtgggtgctggagttgacggcgttaacggcggaagaggaggaaatatcaaagcca

SEQ ID NO: 2674 - DNA, 388 bp, Glycine max
gttctgtgcatggcattgattgttgaggaatatcttgatagtgacatatgctacaaggtgatccgtgcaagatgtgaatgcaaacttaaggaacgcaacactgtctcaattgagacttattcatcaaaaactagacaatggaagcaatccactctgatgtgctccacaacttttgcattgtgcccaaggacggcagctatggtggttggaggggttgtacactggtttgcaatgtggggaaaacttgccatttatgatcctcgtcttggagacaggtatatagccttgattaaactaccaacaggtgtgttaacacatgagcatgaggaatctgttcttggggagtcatctgatgggcttttgcagtatggccagagcaataatttga

SEQ ID NO: 2675 - DNA, 593 bp, Glycine max
gctatgctgcagcactttggatgataaggaaggtttggaaaattattttttaaactgccaacattgatttctgtcataaacttattacacttaaaatgatttacactgcgtactatttcttaacttatctgcatccttattcaatatgtgtaatgctcttgtagtgtagactaatgtagatttttgttaattgttgaattgcatatgcatggaaaatgtcatgcagattataggagaatggttcacaaacagtatttttctggagaggctcttgaaagctgattggacacaaattccaaagcaattagtttccacgtcatatttgcctgaagaaaaagtctgcaccctataaatgtctttttttgtgtgtgtgtgatttgatattgtaacctgaaactacgagaactcggaagtcctctaaaagtcttttaattactttgtgtatagaagtaaaagttttcattgcaaaaatgccaaatgacgcaatgacatctttgtgatattttttgcttcggatgcacgatgcttacaattgtatattcatgttacgtaatatttgtcactttgaagccgatgcttggattctttactac

SEQ ID NO: 2676 - DNA, 981 bp, Glycine max
  misc_feature (36)..(36): n is a, c, g, or t
  misc_feature (909)..(910): n is a, c, g, or t
cttaccatagccaactttatgtgagctgagttttanattactatttcacatgttttaactgctgttatttgctttgcctatcacaagcagatcaacttgctgctaaaagcttctttcaatgttgtgttacaaaaatgcttttttttcttcttctcttgtctcttgtttactaaattttaggatatttcaatagccaaattctatatcactgatctgtaactctgttatctgggagtgtgcagaactctctctctttcttagcattgagttgaataaattgtatgccattgtatttggagtttggacagtaaaccatatgactaatcctgttggacaccaatttttctgtttgccaacaacctaggactgaaaataatggtttggtgaataatgatagtgactaaggttctttatccaagttcagaaactacacaaataatgcattgattttaaaaccttgtgcgactggtactcacgtaaattgtgaaaagcatgttcatattaagaaacccttaaaaatagtcacgagtaatctgtggctgattcctgaaaatattcatggtcaacttgagcagtcctatccattttgttggtggcatctatgctttctttttggttccataaaggttctattttaaacattacctggtatgttcacagattgttccttcagctgcaatcagtttcaccacatacgacatggtgaagtcttggcttggcataccacctcaacaaaagtctcaatcagtttcggcagcatgattgctcagtgctcacccgtgatggcaataagttacaatgtcaccttctaattggctctaatttttacaggaatgtctcttactgagtattactgcatatgatttccacaggctactattagaggaaaccctttttggttaaattaannaatgctagaagtttgtttgttattatatctggagagttccttcacagtgcttctttaaacttaaaacgtaa

SEQ ID NO: 2677 - DNA, 380 bp, Glycine max
cagtggtctttccatggggaatggaaaccagagcaccgactctgctgctttcagttccaatgattctgccatggacatgcatgcagactagtcctgtccaaggttttatctacttaatatttgtttgatcatccctctacattacctgcaaaagaagtgaataaccaatggaagggcatatctggttttgctcgttgcatcctacaacaaatagagcagtgtggaaccagttttattatcttattaaattagttaaaatgcgtatgtcatccaagtgaccgcttggatgttaaatgttctttgtaaagttttttcaaatagtttaaaggcatttaaatttgtaccttgattgtctcctcactcctctttctcaaagacaa

SEQ ID NO: 2678 - DNA, 384 bp, Glycine max
tccctcatccactcacaaaatgtgccaggccctctccgccccatcgcctccgtgtacggctcttctctccttccttttcttcctcctcacggtggtgggcccggtctcggtctcggcatggcggccgtggccccagaaaaacaatatgaacaccaccgattacgccttcggggactccaagaaatacgaggggtcctcggagttcgtgaagctgaggtaccacatgggaccggtcctcacgaccaacatcactgtccacaccatctggtacggcaagtgggagcggaaccagaagaagatcatccgcgagttcataaactcaatatccgcggcgaactcggcgcacccctccgtggccgggtggtggcgcaccgtacagctcta

SEQ ID NO: 2679 - DNA, 858 bp, Glycine max
ctaatcaacaaaatccttgatcccaatcctgccactgtatgaccttgtgttttctttgtttaattttattatactctagtactaatctagtgtttaacaaatactcttacttttccctccatttcaccaaatatattattattaacaacctgtatctgtttttcttttaataatatgaaacagcggattacatttgctgaggtcattgagaatgactggttcaagaagggatataagccacccgtatttgaacaggctaatattagtcttgatgatgtagattctattttcagtaattctacggtaagtatttgatttatctgttaatattggctaaattttgttcatcaaagctttggattctaacctctatctcaatgtcactgtggtacacaggattcacaaaatcttgttatagagaggcgcgaagaggggcccatggcacctgtggcacctgtgactatgaacgcctttgagcttatctctaaatctcagggcctcaatcttagtagtctttttgagaagcaaatggtatgtctctttataagaaaatgagttgtatacttttctcctattagagcttgtcatcctagaaatttaacatggaatgggttgaggaaatgaaataaaaaaatgtcttatgagaacttatcaaattacattgtgatcggatcacaagtactattttcctttcatttcttttttcattttcccttttcacaccatcatgttttgctatttgttgattacaattacaagttgcatgaatcaagaatgcagtttttgaatataatgctcaaggttagttgtattttttgacaactagggactagttaaaagggaaacacggttcacatc

SEQ ID NO: 2680 - DNA, 826 bp, Glycine max
gagttgtagttgctcagctgcagatagatacattaatttatcagcaaacttcattttatgacaattgcactgtgccaacaagccttgatacaccaaaagggaaaagaggttcctatatcatttatcagtcttctaaaattcattatcatgaaatcatggcaagttttgagacagaaataatatattcttgagaggaaagtgcttaattatatatgtaaagaaaaagaactatgaattactacttaaaggaaatgctaaagattgatgccgctcatccctgtgtgtttggaaacacggtgcaaacgtgataaaccatgttcatcagaagtaactcaaagtagtttccacgtattttgatccttagacatggagagagggtggcgatctgctttccaattcactccaaacacgctatccggaacatccacacgccttctaataaccaaattacagacaccagatccaaagctagaagtctgaactaaagactatataatcaacaagaattgtaagagagggagagtgaccttgagggttcctttgcagtgatggcatctgaagcaagctttgtggaaaactcggttatccgcggtcaacttatcaaccagataaacggttttgtcacaggccatacacttctgtgttgttcctgcaaatgccattctttctttatcttctcacctcaccaacacaagctatgttctgtgtgtgttagtcttggtttgtcaccaagggaaagaacaggacaatgaagattgaggaggagacagaggaaaaaaaaaagtgaagaagcaagcagaaaattgcggagactaaagcaaccttc

SEQ ID NO: 2681 - DNA, 380 bp, Glycine max
atttgaaaggggcttcacttaaaataaaaataaaaaaaactatatcaattaaagcttattttcaatcttacactcattttcccccgaaattgaaaaaaagcaaaaactaatagctagtgaagccacattccacggaactattaattgatggaaatgagcttattcaatatgaattgaagacacagctgatgtgattccattggttcgtggatcagccttttctaaacaaacgccacaaggatcttctttaaccaacaaggcaaggacattgagtgaactccatacttttgtcacattgctgctcgaatctcccaaagtaacagcaaagactgcatcaaatcctcctgcccctggaactccagccaacaatactccttcaa

SEQ ID NO: 2682 - DNA, 398 bp, Glycine max
cccttggactcgaggttgatgtaaggatcgtggggcccgatgccatggtgagggtacaatcagaaaatgtgaaccaccctggggctaggctaatgggtgctttaagagacctagagtttcaggttcaccacgctagcatgtcttgtgttaatgatctcatgcttcaagatgtggtcgttaagcttcccaatggaatgaggagtgaagagagtcttaaatctgctattatcatgaggttggatcagtgacactggtgaggctattagctgtaatgtaagtgtaagatgttgttgcagttcatagtagtaggtttatggtgtacgttataataatgattaatgctttagataatttttatttttcttttcttttcgggggaaggtcttgcgtggtgagaa

SEQ ID NO: 2683 - DNA, 374 bp, Glycine max
ctcttgtggctgctctaacccgccaaaagcgtttcaagtctattcctgcacttctttctaaagttgcagacaatgggatgaagcctgattcaatacttctcaatgctatgatcaatgccttttctgattctggcaaggtagatgaggccatgaaaatctttcagaaaatgaaggagtatggatgtaaaccaacgactagtacttataatactctcatcaaaggatttgggattgctggaaggccttatgaatctatgaaattgctagagatgatgggtcaagatgaaaatgtgaaacccaatgatagaacatataatattctcatccaagcctggtgtaccaagaagaaactggaagaagcatggaatgtctaa

SEQ ID NO: 2684 - DNA, 244 bp, Glycine max
tgctcatatctggatggggtgtactattcacgcaaccgtactctccgtgtaagctgcttcaatagccgaaaactgagtccagtattcactggggggccaggcgtggatgaagtgcctccaatatgggttgatcgtactggtgttaaagctaatattacagaggtaatttcattggttctttttaagttaaatatatgaaccttgagttggccatttgggctagtggtattttttcaattaattt

SEQ ID NO: 2685 - DNA, 365 bp, Glycine max
acttcaccaaataatattcagctcccactttcctagttcctttccccttgtactcaatcaatcacacccctttcctctttctttgtccttattatttaaggccaatcacttatccctctaccgcaaaaactattctctaattactatgaccttcataagggaggatgatgatgatcaagttgatgatgatgatgatcatgatcatgtggatggtggtggatcacaaaacagtgccagcaacatcactgaaattgtgaccaccccagaaggggaaaacttaggagaatggctgagtctaggcctcaaaggagacatcaacatgccagcagaagaacaaaactcatcatcaaggcctctccacagca

SEQ ID NO: 2686 - DNA, 776 bp, Glycine max
  misc_feature (57)..(58): n is a, c, g, or t
atctactgagcaatagaaagcaccaaggagtaacacaatagcaccattcttttggannggctgggagttgtcaactacaccctgcaccacatcagtaatcatacacctattattaaattgtcacatcaacattcaccgcaataacattaagacacaaaaacaccattctaatacaatatttataagattctagctgaaaatagatgaactaatgaagttaaaaactatgacataattgttgtgaaagaacacatcaattatagtacctgttattaggtgcacattatggcatttgagtaattacttagtttataaataccaagcaacaactgattcatctttcttataattaatgaaatggagcaagtggacaaaattgaaggataggtaaaccatttactggattagcatgtgattaaaaagagaaaaattgaacacaatataatgcaaatcatctgaagaagccttttgctcaacaatctacttaaaagaatctaaccttggcagaactttttgcagagttagttccttttgtagatccactttgaacagcttggcttttggccctcactacccgagtcaaattcttcacagtggcagaaaccgcaatagcactaatgaggcacacagcaggggtagcaacaagaatcaaccgaaccataaccccagcaaaatacatgcttgtaagaccatacataactaaaaagattgtggcatcagacaaacgcttgaagcaaaaatagaggccagcagggaaaaggaatagcaagatatga

SEQ ID NO: 2687 - DNA, 654 bp, Glycine max
  misc_feature (622)..(623): n is a, c, g, or t
  misc_feature (625)..(625): n is a, c, g, or t
gagtgctgaggttgtcacatagtcacacaagagcttggagggaagattactcggcaaccaggaccaattcctggccttaacacaaagatcactgctttcttagatcctgatggatggaaaactgtaagaaatttctttgtttaaatttttatgttgtgagggtgtgggcttgtggtttgttttctatttcttttattgataatcatgagatgaaataataggtgaattatcacatgtagaacacatgcatatgtgcatacttgggcaactacaactgtaatttgatgatagtatactgtttctagtgccatcaactatgaaattgaatatgcataattatgaatatgagcaaaacaaattgtttctactgagcaaaacattatgaatagtgccttctcttcatcaatgataatacggttttttttttctcaacctgttggctcggaaatgaagtgcatttctttgagcatgtccatatttctactcttgcttgtgttaaatttctgccatcatcaatggtaagtatgtggtacgattcattttgtatggattttgtaggttttggttgacaatcaagattttctgaaggagctggagtaaagagttatggctttttaataannantactagtgctattgtatgaataagtgatc

SEQ ID NO: 2688 - DNA, 424 bp, Glycine max
tgcagttgggatatagcgttcttctatcagatgttgatattgtacatttgcagaatccttttgatcatctataccgtgattcagacgtggagtccatgagtgatggtcatgataacatgacagcttatggctataatgatgtgtttgatgagcctacaatgggttgggctcgatatgctcatacaatgaggatatgggtttataactctggattcttctatatcagaccaacaatcccttcaattgagcttttggaccgcgtggcaacacgactttcaaaggagaaagcatgggaccaggcggttttcaatgaggaactgttttacccctcatttcctggttatgatgggcttcatgctgccagaagaactatggatatgtatctcttcatgaatagcaaggttctgttcaagacagtgaggaa

SEQ ID NO: 2689 - DNA, 750 bp, Glycine max
caggtaatatgttctggatcctcatgaaaaaacaatttgctatatatttgtgaatatatttttgttgcaatttcctgtatcaaattactcttaatttgcataaaatgtacaatacttgctgatgttgtactttactgtttcttgttcttgcattggttttgaatggaactgattctgtgtataagcatgctcgcaatatggtttgcttagtagctttaagcatgtaacacgagttttcagccaagaaacaggaaaattactgcataaaataaattaggatttacaaattgcaacacttgattcaaacaaacttctgtatcttacagtatgtttgtataggtatttttgtggatgcaaattttgatttgtcattgcaattgcgattatgtcctcatccttttcgttattttatccacagctgctagattgaggttggctgcaaatgagaaggctgaagctgagaaaatactgcagatcaagaaagcggagggagaagcagaatccaaatatctgtcaggactcggtatcgctcgccaacgtcaggccattgtggatggactgagggacagcgtgcttgctttctctgagaacgtgcccgggacatcagctaaagatgtcatggacatggtgctggtgactcaatactttgacaccatgaaagagataggagcatcgtcaaggtcctcgtctgtgttcatacctcacggtcctggggcagttaaagacattgccgtgcaaattcgggatggt

SEQ ID NO: 2690 - DNA, 359 bp, Glycine max
  misc_feature (240)..(240): n is a, c, g, or t
  misc_feature (256)..(256): n is a, c, g, or t
  misc_feature (303)..(303): n is a, c, g, or t
caaattttcgggtggatttatctgggctagtgagaaaacaggatttagacatctttatcttcatgatgcaaatgggacttgtttaggacccatcactgaaggtgaatggatggttgagcaaattgccggagtgaatgaggctacaggtctaatatattttactgggaccttagatggtcctctggaatccaatttgtattgtgccaaactttttgttgatggaagtcaaccacttcaggnccctgtcagacttacncacagcaaggggaagcacattgtggtccttgatcatcatatgcaaanttttgttgatattcatgattcccttggttgtcctcctagggtgttactgtgctaaa

SEQ ID NO: 2691 - DNA, 391 bp, Glycine max
catcatgtctcaattgagaagtccttcagaataaaagaggatgataggttcttctcaaggctaatgtccaaggaaatctccatggctaactcttcttcaagggtcttctattatggagaaacatcaattgcagtccctttcatgtgggaggcacaacctggcacccccaaacacccttcttctgagacttctctgccaccccttacacccccaccttcatattattccaattccaagtccaaaaacaagagaagaaactcaaaggccaatatattttcatgttttatgccaaagtttatagggtcaagaaaggctcatgtgtcaccaacatcatctcgctcatcttcctcatcctcctcctcatcatggtcattggtttatccagcataca

SEQ ID NO: 2692 - DNA, 365 bp, Glycine max
agttcttctattgctaattattgtttgtgctgaagtgtctgtggtcctcacttatatgcatctctgtgtggaagactggcggtggtggtggaaggcattcttcgcatcaggttctgtggctctttacgtcttcttgtactccattaactacttggtgttcgacctgcagagtttgagtggacctgtctcagctaccctttaccttggttattcactactcatggccattgcaatcatgttgtctaccggcaccattggcttccttatgtcattctactttgtgcattacttgttctcatcagtaaagatagattgaggttcttgctgtcattgcatattaactatgaaaaaggttgattgatata

SEQ ID NO: 2693 - DNA, 273 bp, Glycine max
actcgtgaaatgaatggattccgtggcctttcatttgggtctgtctgtttgtctctgtacaatatataatgcaattcaataaaataaaactatatgtacatagttgagaaggtagagaccgttttgctctctgtgttttgttttttaccttagttcctggctgcccaaaattgggtagcatttgattgtatcaattgttaattttggacttcattcaagaatcatgtttttcttattatttttttttcgctgaacaacgatgtgacgtaagtg

SEQ ID NO: 2694 - DNA, 384 bp, Glycine max
cagagaattctgatgcagcagagggcttaccccttttcttcaccccttttgcagaagaagatgatgttgtgaaggtgaatagggacttcaaggtgacattctcagctgcctcaatatgtgtgcagggcacaaattggaatttggctgagaaggatagtgagagtggaaggaggctcattgctgcatcaggcagggatgattactttagaattactgagacaccaatcaaaggttcatattatataggttggtgtcctacagatgtatgccccttttgtaggtttgactgtggcattgttggtggtttgcgtgagaatgggaagattttgttggccttggatggtaatgtgctcccagttgtgtttgagaaagcataaaaaaaaa

SEQ ID NO: 2695 - DNA, 559 bp, Glycine max
atgaggctggatatgatcaacaaattggtagagccgaaggggagagaaactcagtgagttacaatgaaaatgctttccttgtcacctgcaaatccattttgtatctattaagaaagcctcccaaggtaaaatgaccacttctctctactttagtttgcctctatattattatgacaatgactaaatacctatagttaatagttgaaaagaaaatagtgccatcttaatctttgaatatagttatatagatggaaatgtgactaaaaacgactcttattgcagcattttgaggcattggtggaagagcactttagacaatgctccaaacatatacttttggcttgtaaggcatatcttgaaggagctcctattggatgtggttttggtggtggaaaagctgagcatgaaaaccaaaagggaacttctactggatttaaaataatgcttgctaagctcttcccaaagctagtagaggcattttctgacaagggaatcgattgcagccagtttgctgagatgcaaaagtaattgtctgttctaccttgttgtgaataagccg

SEQ ID NO: 2696 - DNA, 385 bp, Glycine max
cccttacgcgttgtttgtgtttgcgtcggaaggaagagaagatgagtgagaatttgatggagaaagtgagcgcactgggagagcgcctgaaaatcggaggcgtggaagtggggagaaagatgagcgaggggatgagctccatgagtttcaagctcaaggagttcttccagcctgggcccaatcaggccgacaagcttgtggaggacgctacttccgaggccctggacgagcccgaatgggccctcaatctcgatctctgcgacctcgtcaacaccgacaagctcaactgcgtcgaactcgtccgcggaatcaagaagcggatcattctcaagagccctagggttcagtacctcgcccttgtcctcctcgaaaccctagtcaagaa

SEQ ID NO: 2697 - DNA, 881 bp, Glycine max
  misc_feature (54)..(55): n is a, c, g, or t
  misc_feature (836)..(837): n is a, c, g, or t
ctccgctttcgtcttcctctttcaagagaaagtgcagctctgagaatttaggtnntggaaagtgcggtagctcctctagccgctgtcattgttccaaaaagaggtatctcgatttcgggtttttttccataactaaatttagagtcgtaaaaatctaaatatcgaatttttaaagattacatgtaattaattttgattttgcttgtaacatgttctttttaaaaataaataaaggtgatttattttagcaattttgttctcatgatatctatatatattttcgcgtgactctgtaggaaaatgaggttgaagagggtagtgagggtaccagctataagcttgaagatggctgatattccaccagatgattattcttggaggaaatatggacagaaaccaattaaaggatcgcctcatccaaggtacatcaaatactatgttactactatataactaatttaatttaaattatttttctttttgcaaagtttattcgtcttggactatcgttagtttatttggtataattggtaattgctagtttgtttatatagataaatattaaatttattagtagagtggatcgaatcccgtaacattttttttctttaaaatcatccaatttaccttatatgtctctcacttgatttcaaaatttaaagtggacccaattaatttgtttcttttatgctgtttctgagtacctattgaatctgaggagtggtcatgggtgttaattttttggttttgggaatgataattgcaggggttactacaagtgcagtagtgtgagagggtgtccagcgcgaaaacatgtggaaagagctttggatganncagctatgctggtggtaacatacgagggagagcacaatcacact

SEQ ID NO: 2698 - DNA, 404 bp, Glycine max
ttctcatccccgggtttaatattaatggaattgaagcaagcgaaattcaatctgaacagaactacaagtgatattgctgatgttcgtgcttctgttgaatcgctcaataagaagttagagaaggaaagactatcacttgagaaaacgcgcaagaggttaactcagaattcttcaaagatatgttctcttgaggaagagctaaaccagacaaaactaaaactgctagtggcaaaggatgccggtttggataacccttcggatattactagagagctccagcggctgagttctgaggccgaacatttcaagaaaatgggagaagctgctaaatcagaagtcatgaaagcaatgtctgagattgaacaaacaaaagctatgataaaaactgctgaaatcaggttggt

SEQ ID NO: 2699 - DNA, 397 bp, Glycine max
ccatgactcagttcagaaaatcgatttaactccctgggatcttcagttcctcccaattgaaaccattcagaaaggccttctttttcgcaacaaaaaacacacagaaaaccaaatcgagcacctccaacactccctttcatccactctcgccttctttccacccctcgcaggtcgtcttgtcattctccaacaccacgacaacactgtctcgtcccacatcgtatgcaacaacgcaggagcactctttgtccacgccgttgcagacaacaccactgtcgttgatattcttcaacccaaatacgttcctcccattgtttactccttctttccgctcaacggagttaaaaaccacgaaggcacgtcacagccagtgttggcagtgcaagtgacggagcta

SEQ ID NO: 2700 - DNA, 415 bp, Glycine max
ctgatgttgctgtcgaagttgtttgtgcattcttgtttgttgttaaaaagacctgccattgccctttgatccaatttgaagtttttgtttgttttgtttccttaggcaatatgatagagattcatttggtgaggatccagaaagtgaatcatcaaacgaagatccaagcggggcatctctagttactgagttgacttctcaaatggcaaggtcccagttcttgcaagaactaagcacaaagccacctggccttactcaagaggccttggactgtttgcatcaggaagtttttagcagcaatgccagtgagatagggttggattccagggtactgcaggactgcagtatatgtttggagtctttcacagacggagatgagctgatacgtttgccatgtggacataagtttcactca

SEQ ID NO: 2701 - DNA, 648 bp, Glycine max
  misc_feature (605)..(610): n is a, c, g, or t
aaggcctggtccatacatggtaaagctcattttgtgattccaagatgatggattacctgtttatgtttgaccactgttttacattttactttcatagtattttaaatagatgtctggcacagtgcataaactctttatccaaaaccacgtgcatggtggtactactacttttgttcatctttactttcgatgcatttattatttatattgtccatacaatcttttacagcaacctcctccttctccgtggacgaaccagaaccagaaccagaaccaaagggctccacttgacgtcaatgttggtaagtcccattttgaatttaatttggaacatgcttttaagcaatacgtggctttacagtaatgacgtgcatattactgtagcttacgtggaagggcgggatgaggcggaaagaggagcttcaaatcaacctctgacacaggtaagcatcttggtgaggtctttcagaaaaatgatctgttttcaaatttgaagacctcctggcggagtttctttcatgaagtcagagaatgttacttctttctccctgtaacatttttatcagtatttcttgtcttgaattgacctgaaaagagagaacgtnnnnnncatgtaacatttacatattattggtgtttgggaaacat

SEQ ID NO: 2702 - DNA, 379 bp, Glycine max
gaatagagagagccaccagttttttctctgaaaaacataggctgggaactggggcttttggcacagtttatgctggacaccttcacaatgatgagtgtgttgctataaaaaagattaagtatagagacaccaacagtgttgaccaagttatgaatgagatcaagctcctttcttcggtgagtcacccgaatttagtgcgcctcttaggttgctgcatagaagggggagagcagatacttgtttatgagtacatgccaaatggaacactatctcaacatttgcaaagagagaggggtggagtacttccatggacaataagactcaccattgctactgaaaccgctaatgctatagcatatctccattccgcaaatgatca

SEQ ID NO: 2703 - DNA, 778 bp, Glycine max
catcttaactgcaatagaggttaagatcaggtacttggaaatgtgaccccttattctccatcatgtttgtgtcaaaacgcgttctctttacgcatggagactcatcaatcacagagttcaccccacaatacattgaaggacactcgaatcctttagccatttccattaacatgccctgcaactcttccaaaccgtaatgctttccctgcagcaattgatagttgtaaacgattagtgttgttactcattcttgcatccgttttatatccaactttttcatcatattttaaatttttttttatttaacaaaaggtatcttaaacttcttacttagaagtaaactaatcatatcccactttatcaacctattttgaagtaaaataatatctctagtttagcaatcctatgtccaaatcggaatggaaccccaaaccttagttaaagggtcaagtcatattcaaacaactaaagttttttttcaaaaacaaatgttagtatgtaattattaatttgctagaaagttatttttttttagcaaagggggaaccgtcaacctttttcctcctaccttaaccatattaaaagcataaataatttttcattcaattctataagaagcattacctctcgcctcacttgagccatatgggacaacatttcttccacaaaatcaaaaaagccctggaagcagagaaacacacataaatctttcaagaccataacacaacaaggaaaaaataaataaattaaaaacaaccaaatttgaatccacataaaa

SEQ ID NO: 2704 - DNA, 357 bp, Glycine max
tcggcgtccagttcgaattccgcggcttcgtttgcaacagcctcgcggatctcgacccgaaaatgctcgagatccgacccggagaagccgtcgctgtcaactcggttttcgagctccatcgtatgctggcccgccccggatccgtcgacaaggtcttggacactgttaagaaaatcaagccgaagattgtcaccatcgtggaacaagaagcgaaccacaacggaccgggttttcttgaccggttcactgaggccttgcattactactccagcctattcgactcgctggagggttcgtcctcttcgaccgggttgggctcaccaaatcaggatctgttaatgtccgagttgtacctgg

SEQ ID NO: 2705 - DNA, 179 bp, Glycine max
tggggtatattgattgagtcgttaacctacctcttttgtgtagtattttgagtagttttgggtaacagccttggtgatctctactccctggattctgatttctcaacagccttggtgatctctactccctggattctgatttctcagattttgcctatagtttctacttttcattggcc

SEQ ID NO: 2706 - DNA, 368 bp, Glycine max
gctttcccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaaaaattaaacaaatttttgtaaggagggaaatttcggggtgggg

SEQ ID NO: 2707 - DNA, 381 bp, Glycine max
ggattctcatgaatcccataaattatctggaattacttctggaaattgtcagtatggtggctcaaatcagaacctggagaatatgatcggtacagtcatttgtcagtatggacaagttacaccaaaattatcaaacagtcaatgtggactcttacctgtttctggggttatctccaaccttaagtctgagggacatggtaatgttttcacttctttgttctatgcacaatctggtattcaccctatgtcgagtccaaaacctgtctgccagaatgagagttctccctttcccacaagtacctccacccagtcctatcctgaaagccacaactcagatcaactacatgactgctccaatgatgctacttgtctaaaatacag

SEQ ID NO: 2708 - DNA, 370 bp, Glycine max
ggggatgtcagttacttcatatgtaccagacctggaaggggacctgttttgctttctgatagcattcaagcacttctgaacgatgaaactgggcttcccaagtaagttcatgggaaacattctggtggttgatctattcttcgttgggcttcactagcaggctttttgagcccaaaatattttgactagaggaccctttcaaggaagcacatgctactcgtggcatgatgattcgttactcctagttcgcagtatgtgtttgtttaggtatctgtaatttttgtttcagatctagttgggctattttgttggagaaaaataagtctcgctcctttttttgaattgagcaaaataccttcaattcatttga

SEQ ID NO: 2709 - DNA, 850 bp, Glycine max
  misc_feature (800)..(804): n is a, c, g, or t
ttctgccagcaccacctttgacaaacaaaccgtgtgcaaatgtcttcagcaagctgctaataactatggcatcaacgacgaatacgctcaggcactccccgcccgctgcaatgtcagcgtcccttacaagatcagccgatccaccaactgcgactcgtacgttatttttttcttataaaacattaaaattactgacgaaataatttatatgtaattttaaaaaacatatcactaaaattcagtgacaccagaattagtgaaagaaaaacaatttttttctcaccaaatcaacattcttgaatttttcacttcataatgcatgtagtaaccagcaaagctatattggtacctataactaccttttaccaaaagtgttacgtatgaatgattttaacttttaattgagatgtctttggattacaattacatctaacttaatccacgttaaaatcaatttaccattctcatgagttttcggtttgtcagattgaaatttgtaatattacattttaatgtattttcagtgcctatccaaacacaatctaagcaatcgggtataagtacacaaagagaagaggctaaaataaccatatataatcttcgtataattcaaattatttatatttttcgctcttgtgatagaattattatctgtatataaacgtttattagctgtgttaagagagaaaaacaatagtgacagatcgaaaatggtgattatatgttgaacttcgcgtgcttgttttttgtaatgttgcagcatcaagttctaaaggagcgggtagctttgccaatttctnnnnngggataatgaggcaacgtatgctgtaacacttgttatcgttatcat

SEQ ID NO: 2710 - DNA, 386 bp, Glycine max
ttcacctctggacttaattttcctttcttcttcccttcattccaatctgttacccatagtgttttctagaaccacaaaatgcttcaacaccaaattgttcagtcccctgctatgctaggccttgcaaatcctaactccccatcaattccgaaccctacccctccaaagctccctccaacacagacccatcacccccaagaccgcaactcttcaaccccttcttcagctctcttgtctctcctcccacctcacctcagagcccaagcacttcttgcccaaatggcttccttagcctccaagctctttgaagtttcccccaatcggtccctttgggtcactgcctttcgtggatcccttccaactttcctctcttcccattcgtctac

SEQ ID NO: 2711 - DNA, 661 bp, Glycine max
  misc_feature (627)..(630): n is a, c, g, or t
aagatttgaaggtgaggtttcaagttacattcatataagagaatgttctgttttcacttttaattattaaaatgttacctattattcattttgttttatgttttcaaaaattctataggaaacagggaaaacaatttattttcattgtttcctatacaaactattgaaaatagggaaaatgctgaaagcaaggtaactgaaaaataaaaatagaaaacatttttttcaaaccaaacagctcattttctgccttaaaagtagttccttttcctaatggtgactgaaaatctcaatattatctgaattaaatatcaaatttcttatctgtttgtataggctgagaagaatgaacttcgcgatcagaaacagaggctcaaggcagagaaggagaagctggagcagcagctgaaatcattgaatggacagcctagtttcatgcctccccctgctgcaatccctgctgcatttgcggtgcaaggccaagcccacggcaacaagttggtaccttttattagctatccaggagttgcaatgtggcaattcatgccacctgctgcagtggatacctcacaggatcatgttctccgaccaccagttgcctaagctggcactgtacaattctctggnnnngcattttggtccaaggttgtatccattttac

SEQ ID NO: 2712 - DNA, 759 bp, Glycine max
gaaggcagccaatatccatagccaacttgaaacctcaagagaattgcaccactgggtgggttagcatagtcaaacactgccccatacaccctgcgtagtggctcccaacgtttctgccctctctgcacaacatttcaataaccaaattcagttcaactacacagagggacaagtattttgaacgtatggaagcactctcaagtaatactaaactaactaaatcaaccattaaagcaaatacacatgcctatatatagtaaagttgcagtttctatctactaattgatttaaaaatcattgtacattaagaattgaatgtatgataaatttatcggttgaatagtcatatattgtcaatcaatcataaattctgttgttattagtagaacttttaaggtagttattataaaaattaacaaatctatcatatatgatgatttgtaactcaatgataatgtacaattattttacattgtcaatgcataacctatgttttctacatgcgtgtgggagcacgtgcatgtatatatacctgccacatctcaacagccgtgatgtcgcgtactccatttacgttgagaagcaggacagctaagtagccagggtttttgctgctcttgtggacacggagcttaatgttagaagggtagttacagggaacccttgtgaatgcaatatccaccaccccgcgtttgaacagctccttagaagcagctacgttgcgtgccaatcctgagaatccacgtttgctcattatga

SEQ ID NO: 2713 - DNA, 1121 bp, Glycine max
  misc_feature (1089)..(1089): n is a, c, g, or t
gcagcgattattaaataaagaacaacaacaatcaagcatgtcaataaggccctgtcaaagaccaaaagacatagagtcaaggcaaggatagaagaaaagggcaaacatctcagtcctatgacctttaaatccaaacactgtttggtatatatcccagatctaaaatgtatactttccaaaatgtattttctttatattaagcatatgaacgaaattttactcacaggagtttaaaatttttcatccaaagagctcttcgaaggcgctttgactgtttcctaaagtgaaatgcactgtcttgcattgttgctgttttatcaacaagaagctcaatccggtcacctctctccaatattttctcaatattgtccaccatgatagtgcgtatctgtatgatagaaatgaaagttccaatatcatcgtgtgaatttaagtgaagggacttaaatagacaaagacacatgatgtgaaacatcaatagatagagtaaataacattacagcatctatacaacccgaaatccaatagaatgctcttcagaaacatgtttgcaaagcattcttgcctatcactccttgggatgagccaagcaccttataaagccactagaacagtccaagtcaagaggtataccacctctgcttagcttaccaactttctatatagataaatcccatatataattataactcataatggaattcatttttgttgaaggtataaactgggaaaaaaaacaaatatatatcatatttgtgtttttctttggtcccataaccagattggttgttgtattaacttattacataaccagattacatgtaaaataaaattatgtcacttacattccatatctaggaaaaagggaaatttatcgacaaaaaaatatggttgcataaaaaccagagcacaacttcacctatcatattctaaaactcgatatctcacttctcagtttgggctagataaatgaaatggagaggataaaagagaaatacaaaaatagggagagataaagttttctttgaaatgtacttgcctcaccaacttctcccctcacacgattgagggtatcggcactcgtattantagaaaaaaattccatctgctgatgcaaaacc

SEQ ID NO: 2714 - DNA, 401 bp, Glycine max
tagattgcagacttcggagttagcaaactcatgtgccgcacgcttgaagcgtgcaactcttatgtcggcacgtgcgcgtacatgagtcccgaccggttcgacccggaagcatatggcgggaactataacggttttgctgcagatatttggagtttgggtttaaccctatttgagctctatgtgggtcattttccatttcttcaagcgggtcaaagacccgattgggctacccttatgtgtgccatttgcttcagcgacccaccgagcctccccgagaccgcatcgccggagtttcacgattttgtcgagtgctgcctcaagaaggagtccggggagaggtggacggcggctcagctcttgacccacccgtttgtgtgcaaagacccggaaacctgttaagt

SEQ ID NO: 2715 - DNA, 376 bp, Glycine max
ttcgcctgcgagtggggttgattgtgctctgtcatgtgggttatggctcaatctggctgaccttgatgctccaacacaagctctcaagccagggcagaggaatttgcgatatgtagatgcagttctgactgttccttcgagagccatggtgcccgtgagtggaatcaacattgcctttaaccgtgaagctgttggtccagcattggtcccggctttgaggctggcaggggaagggaaattgaggtgggaaactatggaagatatatggtgtggaatgtgtgtgaaagttatatgtgatcacctaggccttggtgtgaaaagtgggttaccttatgtttggagaacagaaaggggtgatgcaatacagagcttgaag

SEQ ID NO: 2716 - DNA, 432 bp, Glycine max
aacacgttcaactcgtgcaagtgaggaaaaagatttcaagattgatgaaaccatggcatctgacaccaaagaagatgagaactttgcagcaacattaacctcctcacctgatgtaaattccaaggataaatccaagtcactgtctgaagcccagccaaaaaaggaaaatgcagtagatgcaggaaagggacctacagttcctgtatccaaaaaccttgttcaaagtgctgcgcctgaaacctctcctgttacttcccacgagatcaattctgcaacttcttcgcaatcaaaacaagatgaagagaaatcttctgtccctctgtcatcagttaggccatccttggaagagaacattctactcggggttgccatagaaggctcaaaacgtactcttccaattgaggaagaaatgactccatctcctatgccatt

SEQ ID NO: 2717 - DNA, 547 bp, Glycine max
cagcacacaaattttttgttcatttcatactaattgtcattaattttgagacccaaaaacatggacagccaacgaagtcctcttcttagttgggctttctactgccacggcaaggtaactaactaactacccaagcttttcttttttaccttaaaatctgtttccattgattgaagctgcttagttgaacattttagttataaaaagtgtgtgatgtaatgacccttatggactaattgttgattaatcacataactttgatgtgggcacagtcgatggaggagctgaagcagtctctgatgtacactacccttgagctggaacaaacaagagcaactgtccaagaagagctaagaaaaagagacgatcagcttctcaccctaaaggagcttctcaacaaagtcataagagaaagagatgaagctcaagagaaatgccagagactagtgttggagaaaatggtttttcagcaccaaaccgcacctgcttctggagtttccagcattgaggacgagccaagaaggggaattaatgactcctccaacaa

SEQ ID NO: 2718 - DNA, 447 bp, Glycine max
  misc_feature (371)..(427): n is a, c, g, or t
  misc_feature (429)..(441): n is a, c, g, or t
ttgctgctggcaagctcgttaaggtcaaaaactctttcaagctcgcaccgactaagtctgctcctgttaaagccgctgctgctcccaagaagcccaccaaagctgcggctaagcccgccgccaagcccgcttccaagcccaaagctgctgcacctaagaagaaggctgttgccaagcccaaggccaaagctgcggccaccaagcccaaggccaagcccgctaaggccgcgccgaagaaggtcgccgctaagcctgcgaagaagactcccgtaaaggccgtgaagaagcccaagagcgtcgtgaagaaacctaaaagcgtgaaatctccagcgaaaaaggccaaggctaagaagtgagggattggagtgggnnnnnnnnnnnnnnnnnnnnnnnnnnnnnnnnnnnnnnnnnnnnnnnnnnnnnnnnncnnnnnnnnnnnnngggggg

SEQ ID NO: 2719 - DNA, 443 bp, Glycine max
ttcaccaattacgagttctgaagaaattgagtatatatctatccatttgttttgaaaatggcttccaagagtattgcatgcattgttcttctctccctcaacctccttttctttaccatggttagccccaacaccattgccccttcccctgcgatacaaccaccaccaccgccaccatcaccgccacgtgagtgtcccgagttgggtctttgcctcgatattttgggtttgggtcaagggtctccatcaaaagattgctgccccatcctcggtggacttattgaggttggtgccattgtatgcatttgcgacaaactcaggtccgctacattaggaatcaacatagatgttaatcttgccctggtgctaatgttaaaattttgtggacacaacgagaccaacctcatttgcaattaagagcagaatacccatgatggtttgta

SEQ ID NO: 2720 - DNA, 875 bp, Glycine max
  misc_feature (866)..(867): n is a, c, g, or t
  misc_feature (870)..(870): n is a, c, g, or t
tagcagtaggtagcttgaaaggacaagaaaactctttagtatccaatgcagcacaagaacttctgtaaatgttgtgctaatagttgtatcatggagttcaatgtctgctacgaagcggcacattatgtaaaggcagcacatgccaatcattccaaaaggcatttgaatcatatgctgagctgcaatggatatcatgtcaagataattgacttgatgtgtttatttagtttgtttctctgtttgcatatctcattttaacttcaatactcccaacattggcaacacatatgtaatctttgagataagttgcttactagttattagtaagcaagaatagttaactctgatgataccttttgacgtatttctagtgtcttgtacgagtaagagcttgcaaagggcatcaaaatgctcagacttgttaacattctgatgatttcatcccatgctcatctatccaggcaccacaatatggtgtagatggctttctaagacctatgagaactaaccaattgtgtttcttgttttttttttaccaggacacttgacagctaaaagtgatgtttatagctttggagttgtgttacttgagatattaacaggaagaagatcaatggacaagaagcgcccgagtggggaacaaaatcttgttacatgggctaggccatacttagctgacaagcgaaaactgttccaactcgtggatcctcgccttgaactaaattattctctaaaaggagtgcagaagatttcccagttagcttataattgccttactagagaccccaaatcccgtcctaacgtggatgaagttgtgaaggctctgactccattgcaggatcttaatgaccttgcaatcttgtctnntcnctctc

SEQ ID NO: 2721 - DNA, 306 bp, Glycine max
cagcttaattctgcagcaggacgtgtagaaacacatttaatcgatggggtaggccacttccagatggaagggcctggttatgatgctgagatggtggatctcatcatcaagtttattgcatcactatgaagacaaataactgattgtgctgagtgtgatttgactctactattgggaattgggattagtttgtgtacaaaatcttgttgaatctgcgattgcaatgtttatttgtgccccctacgcctatgccaccttctaaaatgaaagaaatcagttacccacatagtaagcatttctgctgag

SEQ ID NO: 2722 - DNA, 1019 bp, Glycine max
  misc_feature (996)..(1000): n is a, c, g, or t
ctggtccttatggcaccctactgaaaggggatgttctttctgcaattaagtcaggaaaattatctccaaaacctgcttcatctaaagaaaaggtatcatcatttcaaagtcatcaacaagttgcagcttcccaagagtcaaaatctgacttaaagctgtcagatgcttatgaagattttcctaatagtcaaattcgcaaggtaggtccatcgagtatttcagtgcatgttacacggtaatgagaattatcttgccaaataaggatatatgaacagtatacaaaaagggtctctgagcagtcatggtctggtgtctctggctcagagttgattactcaaatatctgaagggaaatgcttgtaattagacctaatatggatcagaaaactctactgtttttgtggtctctgttaagtgtgtttggcacatcccccccccccaaaaaaaaaatgtcctcgactgttggtatacatgcagagatgcagatttcattttaatgtttttgatagtttttggatgtcctacacttgctatttacttctctcaactgcatgaatacttgggaaaaattcaactctgattccttccactcttccccttaatatatgatgactcttctctaattttttttactgttttgtaggtgatcgccaagagattattggactcaaaacaaaatacaccacacttgtatttatcatcaggttttgattcccaatgccttgcataatgcatattatcgcaaactaatttatgtttgcgctgactaattaatatatattttgattgccatgtatcagatgtcgtactggatcctcttctttcccttcgaaaggatcttaaaggtatggaccagtaataaattttccttggcatgagtcagatgttatcctcacctagtgggataaggcttattgttgttgttgatgtgttaaatgttatactcttagtcatgtgttttatggcaatgtgatatatttgttccttgattgcagannnnngtatgatgttaaagtttct

SEQ ID NO: 2723 - DNA, 484 bp, Glycine max
ggttcctgtaatcgaaagagagaccaaaaaagcagttggtaatataagtttgcgagacgttcaattcttgctaactgcaccagaaatctatcatgattataggtatgtcatcacattgaatctgacagaatgagctttttgtttcattacttacatactcattggatgttcacactataacagaggtattacagtaaaagacttcctaactgaggttagaagctacttggagaagaataaaaatgcatccccaatattaaatgaatatgtcacatgcaaaaaggactgtacaatcaaagagttgattcaactacttgatcaagagaagattcacagggtctatgtggtggacgatgatggggatttgcaaggactaatcacactaagagatatcatctcaaggctagtacacgaaccgcgtggctattttggtgatttctttgatggtgttctaccgctgcctgcaaacagcagagtttaacag

SEQ ID NO: 2724 - DNA, 320 bp, Glycine max
ccctgaatactaattttgcctctaaaaattttgagcatcctttattgcaggcctcgttgggaatgtctccacgaaatgtggaacctatttctccaatgggttctaggatttctatgctagctcagcgcgagaagcaacaatttcgcagcttaagcttccgagaactcggctccaactctgctgctgcctctgccgattcttggtcaaaatggggatcacctaatgttaaattggattggccagttggtgctggtgaagttggtaagctaagaaggtcatcatcatttgagcttgggaacaatggtgaggagcctgattta

SEQ ID NO: 2725 - DNA, 410 bp, Glycine max
  misc_feature (79)..(79): n is a, c, g, or t
ttgcaattgatccaaggaaccctaatctctttgcggttgctggctctgatgagtatgctcgactttatgatattcgcangtataaatgggacggatcaactgattttggtcaaccaaccaacttcttttgccctccacacttgattggcgatcagcaagttggaataacaggcttggccttttctgaactaagagagctgcttgtgtcatacaatgatgagcttatttacctttttacccaagatatgggtttgggaccaaacccccctgatcctgggtcccctaaatctatgaacagtgatgcaagtgaaattggatttagtcatggatctgtgtcatctcaatctaacatggatgctgatgacaaaatcaccccacaagtttttaagggacacaggaattgtgagaca

SEQ ID NO: 2726 - DNA, 976 bp, Glycine max
  misc_feature (510)..(515): n is a, c, g, or t
  misc_feature (520)..(523): n is a, c, g, or t
  misc_feature (548)..(551): n is a, c, g, or t
  misc_feature (574)..(574): n is a, c, g, or t
  misc_feature (576)..(584): n is a, c, g, or t
  misc_feature (591)..(596): n is a, c, g, or t
  misc_feature (602)..(604): n is a, c, g, or t
  misc_feature (613)..(614): n is a, c, g, or t
  misc_feature (616)..(622): n is a, c, g, or t
  misc_feature (625)..(625): n is a, c, g, or t
  misc_feature (630)..(633): n is a, c, g, or t
  misc_feature (635)..(641): n is a, c, g, or t
  misc_feature (645)..(664): n is a, c, g, or t
  misc_feature (666)..(672): n is a, c, g, or t
  misc_feature (675)..(686): n is a, c, g, or t
  misc_feature (690)..(691): n is a, c, g, or t
  misc_feature (695)..(709): n is a, c, g, or t
  misc_feature (712)..(714): n is a, c, g, or t
  misc_feature (721)..(724): n is a, c, g, or t
  misc_feature (726)..(730): n is a, c, g, or t
  misc_feature (734)..(740): n is a, c, g, or t
  misc_feature (746)..(749): n is a, c, g, or t
  misc_feature (751)..(757): n is a, c, g, or t
  misc_feature (760)..(767): n is a, c, g, or t
  misc_feature (776)..(781): n is a, c, g, or t
  misc_feature (784)..(784): n is a, c, g, or t
  misc_feature (788)..(788): n is a, c, g, or t
  misc_feature (790)..(790): n is a, c, g, or t
  misc_feature (795)..(803): n is a, c, g, or t
  misc_feature (805)..(805): n is a, c, g, or t
  misc_feature (807)..(807): n is a, c, g, or t
  misc_feature (810)..(818): n is a, c, g, or t
  misc_feature (820)..(825): n is a, c, g, or t
  misc_feature (827)..(831): n is a, c, g, or t
  misc_feature (833)..(844): n is a, c, g, or t
  misc_feature (847)..(866): n is a, c, g, or t
  misc_feature (872)..(875): n is a, c, g, or t
  misc_feature (877)..(881): n is a, c, g, or t
  misc_feature (884)..(904): n is a, c, g, or t
  misc_feature (906)..(911): n is a, c, g, or t
  misc_feature (913)..(915): n is a, c, g, or t
  misc_feature (919)..(924): n is a, c, g, or t
  misc_feature (926)..(942): n is a, c, g, or t
  misc_feature (946)..(952): n is a, c, g, or t
  misc_feature (954)..(954): n is a, c, g, or t
  misc_feature (960)..(960): n is a, c, g, or t
  misc_feature (964)..(966): n is a, c, g, or t
  misc_feature (968)..(969): n is a, c, g, or t
tcagaagaccaaggactatgcaagtgatgcaactgatgctgcaaagaagactaaagattatgctgctcagaagactaaggactatgcaagtgaagctagtgatgttgcacagaacacaaaagattatgctgctcagaagaccaaggactatgccagcggtggtgcgcagaagaccaaggattatgccagcggtggttctcagaagaccaaggactatgcaagtgatgctgcgcagaagaccaaggactatgcaagtgatggtgctcaaaagagcaaagaatatgcgggtgatgtagcactgaatgccaaagattatgctcaaaaaagcaaagattacgcaggtgatgctgcacagaatgtcaaagattatgcaagtgatgcagtgcagaagagaaaagagtattctggtgatgcttctcacaagagcaaagaggcttctgattatgcttctcacaagagcaaagaggcttctgattaatatgcaagtgaggtgccgagtgctctggtgannnnnncccgnnnncaaattagctgctgattatgccccnnnnaacattagagattactctgatgntnnnnnnnnnggctgcnnnnnngtcatnnngtgacgccnnannnnnnngantatannnntnnnnnnngcgnnnnnnnnnnnnnnnnnnnngnnnnnnngcnnnnnnnnnnnnatcnnaatnnnnnnnnnnnnnnnttnnncgggggnnnnannnnnactnnnnnnnttcccnnnncnnnnnnnatnnnnnnnnccccctctnnnnnnacntgtnancgtcnnnnnnnnngncnctnnnnnnnnncnnnnnntnnnnncnnnnnnnnnnnntcnnnnnnnnnnnnnnnnnnnngattcnnnngnnnnncgnnnnnnnnnnnnnnnnnnnnncnnnnnngnnncccnnnnnntnnnnnnnnnnnnnnnnnctcnnnnnnntnccgcgntaannntnntccctgg

SEQ ID NO: 2727 - DNA, 331 bp, Glycine max
gtcaatggattcaatttgggaatttgaatttggtccatcagcagatgcagtaggcataggagatgcaaacttctctttgatcatctcaggtggggattccttcaccagagattggacccaagagagatcaggctcttccccgttgttcttgagctcaaacgaggatgatcttcgcatctgacgaccaagtgtgtctccatttactgaccaatcagctttcccattaggagatccccactttgaccaagggtttgcaggggagccaacaagtgaggcaggactgttggcaccgaggtctctcgaactgagactgcgcagctgctgctgctgc

SEQ ID NO: 2728 - DNA, 734 bp, Glycine max
aagttgcttctgcttaactattgtcgtaactcaacattgttagattgccgtcctactgatattatttttaacttctcttatctgagataattttttttgaattgtttcagagatgtattcttgatattgacgttcaaggtgcaagatctgtgagggctagtacgcttgaagctatattcatctttatctgccccccatcaatggaggagctggagaagcgccttcgtgaccggtgagctgttgctgcttagcaatggtttttttttatttctcaatcagaccacgacttttgtgataacctcattgctttgaaatcagggggacagagactgaggaacagatcctgaagcgactacgaaatgctgatgctgagattgagcaagggaaatcttctcaaatatttgatttcatcctatacaatgacaatcttgaggagtgtcatgagagacttaaggtaaatgcttctgaagcaaagacctccagagtctttgggatgttttttgaccattaatcatcctgatgttaagtatcatttggtgcagaaactattgggacttgacggttttgtcactgctccacctatatcaggtaaggattttcctagtaaaacctgatatgtagcttcacaacaattttaaaaccatgaagataaattgatgtgtttaatccgtcaatccaacaggccctatagagattgatttaccaatggatcattcagtgtcaaaaattgataa

SEQ ID NO: 2729 - DNA, 452 bp, Glycine max
ttacacagcctagaaggaagcacaggaaaggaagatcaagctcaaacgctaagtatcaaaagcagactcaagatacaaaaacggtttctcaagttcctataacaagttctttcaaacccaaaaatggttgaggatatatatattttcccacaaattaaactgcataagttctattgattaattactttgccaagtttaattacttacgggtctaattctttagtctttaggcaataatgtgtggttatatagtttgaaggattgatgtataggtcaatatgcgttgactaatgaagtggacaaattaatgtacataattaagtgggggataacccctatcttgtgaaatagttttcggaattgccatatatacttgctagtctttatagcaaggtttagtcaaggtcttgtaacccttcaccgtgtgcacaagcacaagcgtgatttattga

SEQ ID NO: 2730 - DNA, 405 bp, Glycine max
aagggtgtctttctctgagtttttagttatgtttgacgatccagattggggttttggcatcatgcctactctggtgaagcttgaaaccggggatagaaacaggcatggtgacacggtatgctcggtttgccgctacccaattattggttctcggtttaaggagataaaatctcattttagtttgtgtaaccaatgctacagtgagggaaaggtgccttcttcatttaagcaggatgagtacagatttaaagagtatggaagtgagggtgaagccatgaaagataagtgtatgtgcttcagtttgcaattccataatgaaaagtagatagtggcattcgattttttgtcttttgatttttttgttctactatcttgtattatcccatcttgtttatcctagctaaa

SEQ ID NO: 2731 - DNA, 371 bp, Glycine max
aatctctgatgcgtttcaggtgcgtttccaagtcttggaattccctcatcttccatcccgcattcgtcaaattgcaccttcaacatcaaagggcttccaaaaacacccacctcctattaaggtgccgccgagatagcatgcttaatctgtctgacgaattcatcggaccctgttctattcgcggtttacttgagaacccatcgtccactgttgatgatgcttgccaccaattacaccccggatactttttcataggttcctgcaatggcttggtttccttgctttatcattctcgttctcttgttagaaatggatccatagaataccgggtccggttttggaacccggccacaaggatcatgtccctaaat

SEQ ID NO: 2732 - DNA, 463 bp, Glycine max
  misc_feature (454)..(456): n is a, c, g, or t
attttctgttctgttattttccctgtatataactcagtatctggaaacaaagagatgaatctacaagaggcccattgttcaccttctttagtatctgtgcataccgaaggaagcacatgggattctgagacttattcagtagcagcagaatgtttaatagatttatttgccaccttctttgatgtggtgaggtctcagctacctggcgtggtgtcagtactgacagggttcattagaagtcctgttcagggtccagctagtactggagttgctggattagtgcgtctcacaggtgaccttggtaacaggctttcagcagaagaatggaaagagatttttctatgtttgaaagaggcagctatgtcaacagtgagacgcactaatccagcaactccagtactagctggaccctgaacaggacttctaatgaaccctgtcagtactgatcccacgnnnggtagct

SEQ ID NO: 2733 - DNA, 1123 bp, Glycine max
  misc_feature (1076)..(1079): n is a, c, g, or t
tcatgttcacaaccaccaagaagtttcttcagccacctttgtcaaaccaaacctctctggtcacctaaagcaagctccaggtatggactttctcttcatagcttgctttgtgcttcattggagactgaaaactaaaaacttgatgtgttttttggacaaatttttatgttttgtgtgtttagtttgtgttttgtctgacttgctgaaatggggttgttggattttagaggttttggatagattcagtagatgcaactccactgtggagtatagtggccggaaaattgcttggctcggcgattctcggcattccggtcactggagtgcgaggccggagagttgtgatgttttttcaggcaaatgggtgtttgataatgtttcacatccactttacaatgagtcagattgcccttacatgtctgaccaattggcctgtcacaagcatgggaggtctgatttggggtaccagtattggagatggcagccacataactgcaatttgaagaggtggttctctctctgagctttgtttcttatccctgtgaacattgtcaggttatggttttagtggtggcataaattggaatgattcaattcaatggttttaaggttattattgttttgtgaagtttatgtacgatcaagattgagttttgtaaaggtccaagtagaatagatttgttcagttgttcctttgggagttagagttgaaaaaaatttaatcttttcttgtttctaaaagtagcatcagatatggattgtataagtggtagttaactaatggattaaataccttctaaaaaaactaatggattaaatatgtttttaatccctataaattagaaaatgtttgtgtttagtccctaaacaaatcatttccttttggatccccaatttatgaaaatatgtcaagtgcagtccctattactaatactattgactggagtggaaggaaaggacatgaaccgaaccacaccacactcaacacttcttcataaatggggaactgaaagatggtatttttagggtctacaagttaacatttctctatttatagggactaaaaaatatttaannnnttatttctgtgaaagagtaggttctttctgctaagcttcactga

SEQ ID NO: 2734 - DNA, 444 bp, Glycine max
tcacggacatgcaccgacggtggcgccgccgggtctccgagggagaacggcatcatgctgttcggcgtaagagtcatgacggaagctaactcctccttcaggaagagcgccagcatgaacaacctctcacagtacgacgcggagttcaacgccgccgacgccggctacgcctccgacgacgtcgttcacgcctccggccgcacgcgcgagcgcaagcgaggtaagtagttattaacaaattaaccatcgcagttccgataagtgctgtttggtttgagggatgattaattaattgatgaacgaaggtgttccttggacggaggaagagcatagattgttcctgttagggttacacaaagtcggaaaaggagattggagagggatttctagaaacttcgtgaaaactcgcacgcctactcaggtcgctagtcacgctcagaagta

SEQ ID NO: 2735 - DNA, 941 bp, Glycine max
tgataaaatcatttggtggtatcgtgaagatgtgtgctttcaaagagcctaaacattcactttattttcagggatgtctccaacaatgatttatgtggtacaattcctacatctgggcccttcgagcatattccattgaataagtaatttcttcttaactctaagcatgtagctttcttcttattctccatgtggtgctattcatgttggtttttgctcgagtcttttcttctcttctgcaccttcttttactattgttccttccttttctttttcttttgggggagggaagggggtaacaatgagaaatttagtaaccttctctgccaaatgctgctcccccttgcaatttttgttgcttaatggttaagatgttgttggtgtcctgttcacattctatttatggaggtcctgttaaattgtgatgataatatttgattgttatttgttgttgtgtgtgatgatgacacaaagtgtatgttataggcaatttccaattgtataatgggatcgtaggaatgacaaagattttgggaggctgccctgttacaatgtatttgtgatgacagggaatttgattgcattttattgtcctatacagttaattatatatggtcttcctgcatttttctggtgcactgattctgtaatcatttaaagtttgccttctagattctagctagaacatattttctgctatctggttatctttcttcttttcctttacttgttgaataaatgttgttttgtttcaatgctgtagctttgagaataatccccgcttggaaggtccagagttgttgggactagtaagttatgacacaaactgctcgtgaataacgtgatgtggtaggatctcaatctgcgttgaattatatatatgtattctaaaatttaagtgtattacctcatagtgtaatgggaagtggtaaatgtaatct

SEQ ID NO: 2736 - DNA, 333 bp, Glycine max
aaaaaacatcaaccaacgacatcctcgtcttcatcttcttcttcttcttcttctttgttcagcttccctaacgttaacgtcgtcgtcgtttatcccaaaacaaaacgatggacttcaccacttttgcaaattccatatcctcttctcatgcaattcctccaatacacacttatcgccttcaaccctctccttttcctttccacctcccattttcggtacgtaatttcttcttcttcttcttcttcttcttcttctctctctctctctctctctctctctctctctctctatatatatatatatatatatatatatatatatatatatatatat

SEQ ID NO: 2737 - DNA, 890 bp, Glycine max
  misc_feature (52)..(58): n is a, c, g, or t
  misc_feature (867)..(869): n is a, c, g, or t
  misc_feature (883)..(887): n is a, c, g, or t
ttaatgaatcttctaagagtatgggtcctttacataaaacttaaatgacatnnnnnnntacttaccttcttgccttgcttgtgtgctgcctgtcttccaatccttatgtatccttgttatattattcccgtctttattattttgccgtgaaagtgcatcagttcagtcaaaatatatagctcttcaccctgctgctattgttgcagtttgtttacgcatcaatattagaatactaaacactaattaatgctcaaattgagtttctgatgatagtatgtctaaatgagagaaaattaagaaattggaatgtgtttaaagtggcattttatgggtccagtgctgatttctttctgcaggagtcaagcaagagcatacagattgaagcatttcatgttttcaaggtactataacaattttatagcacacatttggaagtgactgctcttaatcaggcgtttattgatgatttattgtcataacagctatttgctgctaaccaacataagccagctgatatcgtcggtatatttgttgcgaacaaaagtaagatgctgagactgttggaagacttcaaaattgacaaaggtaagtgatgtcatctcttgatagtttagttgcttttatagtatcaattatcagtttctgatgatcagcttttaatgtgttgtgattgtgcagaggatgaacaatttgaagctgacaaagctcaagtgatgagggaaattgaagctctttaaacaaggaaacagcgacgcacctgaactgcaaattgtgttaagtggcaaagttgcaatgtgtggcatttcactttagcgaattgtgtattgtaatagttctgttagtcttttatcacgatgagacgatccnnntcatacagacttcnnnnnctt

SEQ ID NO: 2738 - DNA, 496 bp, Glycine max
gagatggtagcagcatgtatccaactaagggaaaattggcaatggtcagagcagttgtctgcttcaaatgaagagtttctcctatctagaaagaatctttatcaatattgtttagaaaatcatttaagcaggtgtttctctaaaatccatgtttgttaaatatgtaagatactactttggttgagggaagcaaatatgtagcagtggattagtgctgatttcttttgattctcctttcaggtttaagataccaaaaacgtttattgtatggaggaagccatttcaactcaccacgacagggaaaataagaagagaccaagtcagaaaagaagttatgtctcagctgcaatctttgcatagtaatctttgaatataccatacttccattggcccttaaacaaccaatgcatgcttcaacatatgtttcttaatgccaaagatgaagaatggcttgaatccataataccaatattgcaatgattcctcaggtatacgg

SEQ ID NO: 2739 - DNA, 385 bp, Glycine max
gtcgccgtggaacgccgaccatcctgtcgagtacatccagtgcgacgtctccgatcccgccgacgccgaagccaaactctccgccctaaccgacgtcactcacgtcttcttcgtgtcgtggaccaaccgctccaccgaagcagaaaactgcgaagttaacggcgctatgttacagaacgtgcttcgcgccgttatccccaacgcccccaatctccgccacgtgtcactccagacaggcggcaagcactacttcggacccttcgaattcatcggcaagatcgaatctcatgaacctcccttcgcggaggatatgccgcgtttggatgcgcccaatttttattacacccaagaggatattctttttgaagaaaccgctaagaaagag

SEQ ID NO: 2740 - DNA, 384 bp, Glycine max
aagtggagacaatttggctgcagttgtggtttgcttccagcagcaacctcctcctaacttggtggcaccacgctctagagtgcaacggagcttctctgctgaaggtttgaaggagttgcaaagcttcctggacagcttgagtaattgacttagtgcaactcctgcttcaattttctttttgagaattaagattcatttgtaattgtaggtgtaggctgagagaaaactttgactgtaacatatgcggcatctagtcgacatttaactttgcatatttagaattaccgtcattgctttatttgttagatttttgcataaacaaaaccaatcatacatagcttcagggcttgtgtggttctcatttctgactatgagccgtaaggg

SEQ ID NO: 2741 - DNA, 633 bp, Glycine max
tctaagcttaagcctgggattcctaaaaaggatgatggaaaggtggattatgggaaagatttctttgcacgtcaagcgtttttgacagtttcaggtcagcttcaagtcgagtcttatgcttgtgctctgagtagtgtgtatacctttggccccacatttcgcgcagagaattctcacacttccaggcatttggccgagttttggatggttgaacctgagattgcttttgcagagttgaaggtatatgaaacttgaactcactcgagcgtgatcgtgattatattcaaatgtgatatttgttgttggtagtggtatgcttatcagctgaatgttgatacaaatattttttttggttaggccaatgaacttgttaaatttttagtgcaatgttgagctgcctacttttcccctgcttataatgtttggtgcttttgctgtggtagaaatgaagttcatggttttgtattttttgtgtaggatgatatgaactgtgccgaggcatatgtgaaatttatgtgtcagtggctacttgacaactgccttgaggatatggagtttatggctgataagtttgataaaggttgcattgaccgtttgaaattggttgcttccactccctttattcgagttaca

SEQ ID NO: 2742 - DNA, 587 bp, Glycine max
ttatagttccgtgttattcatttggggcacataattaaattatttttcacgtatggtatttgattttttaacttaatattaattgtttttttattaatactttaattaaattttttaatctaatattgatattattttttcatttatttaataattattttggggggaagataggaatatcttgaccatatatgtgacaagttgatataatgaacttttaatttctcttgtgactaatctgatggtgtgaaaatagatgtgacggtgaagacagcagaggcgaaagattgcttgacaaggaggcacgggttccagggtagatgcttattcgacaggcaatgtgcacatgtgtgcaggagcgatggtttcatcggtggtcagtgccgaggccctcttcgcaaatgcttttgcagcaggccatgttgatcgaaattactactgccaaagaggccatgaaataaacaaacaaacaaacaaataaataaatagctctaaccgacacatatgtacttagtgtcggggttctagctagctagctaggtaggtacgtgtgtcttttgttatcgatcctagtttggtggagcaag

SEQ ID NO: 2743 - DNA, 385 bp, Glycine max
ggtgaaagttgcttcgttgcttttcctattggaattcactgcaacagttgttgatgctcgcttcgatccaagttcattcatcactcagtttctccccaatgctgaagccaacaattactatgttaaatccacaacaaaagcgtgctgtaacagctgtccttgcacaaaatcaatccctccacagtgtcgttgttcagatattggagaaacatgtcactctgcatgcaaaacttgtatttgcactcgctcaattcctccacagtgtcattgcagtgacataaccaacttctgttatgaaccttgcaactcctctgaaaccgaagctcactaggaatattgagcatgttccagtgactaacatgtttgacagagtcactaggctttg

SEQ ID NO: 2744 - DNA, 439 bp, Glycine max
  misc_feature (409)..(420): n is a, c, g, or t
  misc_feature (422)..(431): n is a, c, g, or t
  misc_feature (433)..(434): n is a, c, g, or t
  misc_feature (436)..(436): n is a, c, g, or t
cagccgtcacagaaaaagggctggttgcaatatcaatgggttgccctaagcttcactcattgctctatttctgccaccagatgacaaatgctgcactcataacggtggctaagaactgcccgaattttatccgattcaggctgtgtatccttgatgcaacaaaacccgaccctgatacaatgcagccactggatgaaggttttggcgcaattgttcagtcttgcaggcgactcaggcgcctatccctctcggggcaattgaccgaccaggttttcctttacataggaatgtacgctgagaagcttgaaatgctgtccattgcatttgctggggagagcgacaagggaatgctctatgtgttgaatggatgcaagaagcttaggaagcttgagattagagactgccacannnnnnnnnnnncnnnnnnnnnngnngnggg

SEQ ID NO: 2745 - DNA, 707 bp, Glycine max
  misc_feature (546)..(548): n is a, c, g, or t
  misc_feature (550)..(550): n is a, c, g, or t
  misc_feature (561)..(561): n is a, c, g, or t
  misc_feature (564)..(566): n is a, c, g, or t
  misc_feature (578)..(581): n is a, c, g, or t
  misc_feature (586)..(591): n is a, c, g, or t
  misc_feature (594)..(604): n is a, c, g, or t
  misc_feature (606)..(609): n is a, c, g, or t
  misc_feature (618)..(620): n is a, c, g, or t
  misc_feature (622)..(624): n is a, c, g, or t
  misc_feature (629)..(631): n is a, c, g, or t
  misc_feature (646)..(651): n is a, c, g, or t
  misc_feature (654)..(655): n is a, c, g, or t
  misc_feature (658)..(660): n is a, c, g, or t
  misc_feature (663)..(670): n is a, c, g, or t
  misc_feature (674)..(681): n is a, c, g, or t
  misc_feature (685)..(693): n is a, c, g, or t
  misc_feature (695)..(701): n is a, c, g, or t
gttgaatcatagccaatgaccaaggtaaccgtatcaccccttcttgggttgctttcaccgacagtgagagactcattggggaggctgccaagaatctggcagctgtcaacccagaaagggtcatctttgatgtcaagagacttattggaagaaagtaagacatcctcaagtttttgatttaggacaatttgatttgatgtgaataaaggtgtctgacatgtatccttttgcaggtttgaagataaggaagttcaacgagacatgaagcttgttccttataagattgtcaacaaggatggaaaaccttacatacaggtgaaaattaaggatggtgagaccaaggtgttcagccctgaggaaatcagtgccatgattctgaccaagatgaaggaaactgcggaagcattccttgggaagaaaattaatgatgctgtggtcactgtcccaggtaactggaagtctggaacaattcatgactttctgattttgcttttatgccaatttctcacattttcctttcaactgtcccagcttacttcaatgatnnncnactgtcccagnttnnntcaatgatgacnnnnctttnnnnnnttnnnnnnnnnnntnnnncttttcttnnnannnccttnnntaatcttacccctgnnnnnnccnncgnnngannnnnnnnatcnnnnnnnncaannnnnnnnncnnnnnnnctaaac

SEQ ID NO: 2746 - DNA, 385 bp, Glycine max
tcatgacacagagtcacaggtggatcatctggattcaacaagtggtcaagacatccagaatgcacagaacggttatgcatatgctcaagctgtagatggttataatcaattagttgtgcagtactatgaacttgaggagaaaaggttgaagattttggagcaacttaatcaatatggtggttggaattaccaaaatgtggccgctgattctaactctggtgtaccatattccaattctcaagattattcagcgactgcataccaagtttctgatccaaatgctgtctgtacatgttgcccgtgttacagtcaatgtctgccggctccatgcacgtcagttcctggttgttctttgggtggatcatctgttagcaagccgtgtaga

SEQ ID NO: 2747 - DNA, 836 bp, Glycine max
  misc_feature (777)..(777): n is a, c, g, or t
  misc_feature (780)..(782): n is a, c, g, or t
  misc_feature (784)..(784): n is a, c, g, or t
  misc_feature (831)..(831): n is a, c, g, or t
ttaatttacccctcaacatgtcaagtggtgcagggaaaagtctcctgcgttgactgcactcacaactatgacttatctggtttgtgccaactctcatgcaatatatatgtactagctttaattatatttaaataaatgttcattctatccattactctattttttagccaaatatagcatgtgtgcatgtgtgttttgttgtgtacaatgatgataatgaagtttgataaacctaggatctcatgtaaactatttaaatctctccctattaagccgactctgatagactaatctgtgtgtatgggacggatcgatctattttagagagattggggcagttgtgcacactatttttatttttcttttacatagtatatatgtgtgagagggcgagccctggtgcagcggtaaagttgtgctttggtgacttgttggtcatgggttcgaatccgaagtttttatagtatatatgtgtggttataaattattttgaagtacagttaaaaaaattaagttataatatcagttttgctcccactaatttatatatgtaagtattgctcccacaactaaatttttttggatggttctagggatcatgtatgaaacttgattctatatactttcaaattttcagatattaaggtttcggtgaggtgtgatggtgtgaaaaaactggctttggctactacagaaaatgatggctccttcaaggttgatcttcccctagaccacacaaaaccttcttcttctgtgaataattgcctagcaaaactnctnnngntccagttcagctatatgtctcaagggacaccccgtctcgtcatctgnatcga

SEQ ID NO: 2748 - DNA, 411 bp, Glycine max
aggtggggggcaagagatgccaagagagcaagggcttcaagtgaacaagattttgattatgaagatgatcctgacctgaccttgtgattgaaaatgccgctccaaccttctgttgtattataaggcacggcacgggtgacctgttgtattattgcaaggcagtcaggagatacggtaaatgttactttgcggctcggcacgggtgttgtattaaacttgtttttaaggcacggcacgggtgttgtattaaacttgttttttctagcatgatttgatagtgtagtggcaatgctgtacagaacaagaaaataaattcaactaatttttgttcctatgcttatagattgatgtttccttctgtcttgagtttttggcgctctagtggctcagtagagcagcagtcatttgaaa

SEQ ID NO: 2749 - DNA, 385 bp, Glycine max
attcctatttcctacacaacactacactgtctggtggaagaatctcttcactctccatgcaacaacgttggctatgtctccttattctctctctttgttagcctctgtctcccccaaaatgcacacccttctttctttctcctcatcacactctccacatcttccaaaccacaacataaccaaatccaataataaactctctcattccatcaatggactttcatcatgcccttcttctcctttgctccccagtgccacaaaatcttctccctttctcatttccacttcaaaaattgcatctttcagggtccttgctgcttcctctatacctgatgctagaagtgatgaaccagccaaaactagtgatttcttaaaaactcttcag

SEQ ID NO: 2750 - DNA, 399 bp, Glycine max
cagggaaaggtagataccccaagaagtactcagccaggtatatatgttctctggtggcagatctccacaggactttgttgtatggtggtgtggcaatgaatccaagggaccatcttcgtcttgtttatgaagcaaaccctcttagtttcattgtagagcaggctggtgggagagggtctgatggcaaaaataggattctttcccttcaaccagttaaacttcaccaaagacttcctctatttttgggaagcttggaagacatggaagagttagaaagttatggggatatccaacaaaaagttaatcctggttatgaggtttgatgctgctttgtatagcctcatgcatacaaattttgaatattcaaaccattatggtgcctgattaattgtttcagtg

SEQ ID NO: 2751 - DNA, 499 bp, Glycine max
  misc_feature (370)..(371): n is a, c, g, or t
  misc_feature (373)..(373): n is a, c, g, or t
  misc_feature (402)..(406): n is a, c, g, or t
  misc_feature (409)..(414): n is a, c, g, or t
  misc_feature (416)..(420): n is a, c, g, or t
  misc_feature (439)..(450): n is a, c, g, or t
  misc_feature (457)..(464): n is a, c, g, or t
  misc_feature (467)..(476): n is a, c, g, or t
  misc_feature (479)..(483): n is a, c, g, or t
  misc_feature (489)..(495): n is a, c, g, or t
cattcaatccataaaatcccaaaaacattgacagcaagaccaagtcaaccacctctcccagttgcagacttgagttccatatgatgggaaccgcatgtttcccaactaataacgttgttctcaaacctcaaaacttatctgggaatttctctaccctctgtgataacgttcggtgtctgaggttcctcactcccaaaccgccccacctgcgatcctctcactctaacttgggaaatagagcacagttgacatctttttcgatgtccaaggcaacccaattgaaggtttcgcaagatgcactctcatccacggaacaatcactgtcttcatctcctcgggtaataggagaacatgacttgctcattgtatnngnacgtctcaagggaaaaatatagaaaaacnnnnnaannnnnntnnnnnaaatgtatagctgtcaaannnnnnnnnnnntgtgagnnnnnnnnttnnnnnnnnnntgnnnnntgtctnnnnnnntgag

SEQ ID NO: 2752 - DNA, 390 bp, Glycine max
acacctggaccccacaaaaccctacaaccaccgcaacaacaatcgcaaccgccactccgaccactaccgcctcctcaagtccaacgtcgacgctctcaacctcatccaggtcggcctcactctcaccgacgccgccggcaaccttcccgatctcgccggaaaccgctccatctgggaattcaacttccgtgacttcgacgttgcgcgtgacgcctacgcgctggactccatcgatctcctccgccgtcaaggaatcgatttcgcgcgtaacgccaccgacggcgtagagtccacgcgcttcgctgaactcatgatgtcttcgggactcgtctgcaacgattccgtgagctgggtgacgtttcacagcgcgtacgatttcggttacttggt

SEQ ID NO: 2753 - DNA, 372 bp, Glycine max
ttactatttcctttcccaccactctcatcctatatctctttcttccttattcctctgtctagccactcgataatatgcagagtctttcaccacctacttccaacgcgctcaatttgaagcatgtttttcgcccgcgacttggcgcgtcaagccgaatctctgtcaaatgcgcttttgggtttgagccggtgagctacggagtcggctccagccgagccgattggcagagctcctgcgccatcttagccagcaaggtcgtttctcaggaacaaccctccgctgaccagaacagcggcaccaccgaccacatcgccgccgtcaacggtcacaaagccgccgtcagcgacttccaactcgttccaattggaaacc

SEQ ID NO: 2754 - DNA, 365 bp, Glycine max
ttcagatccactgcactgcactcgtccaatttcactcactctcacattcccaatttctccatgaaaccctaatttcagccatggttgttacatccaaaccttctccaatggcgctagatctcaaaacctccttcactctccccaaaaccctaaagctcaagacgaagcagcaagagcttctgatccgcgtcgccacgctctccctcatctacgtcctcgccttcatcacgcgcctcttcagcgtgctccgctacgagtccatgatccacgagttcgacccctacttcaactaccgcaccacgctcttcctcactcgcaacggcttcgccgagttctggaactggttcgactcggaatcatggtac

SEQ ID NO: 2755 - DNA, 1375 bp, Glycine max
gttggggctgagacccagcattttgtacctaaaaaaggaaaatccaggagattggttttctttgggacttatagaggagttaatgtcggaagaagcatcatccctcatatgcaagccaccaatgcttgctgatgcaaggtagcgcatgaggagaggcctcttcttccgtacagaccaagtggcagactgaatcatgaccaacagcagtcccagccacgaacttggatggttaggaaagcccttccaaaaacttggtccaccataaagggcgctccaaagtccaaactaaatgctagccccaaaaaagagggcaccacagcgtacgacattagctcctccccaggagcaaatatcgcacctacgacaaaaaagtaaagatggcagaaaaattatgagcctgaaacttataaattggagcttcaggaatcagagacttgcataaggaaaaattgggtcagatacctatgggaactttggtatcctcctaactgccactactgaagacagacaagaaaagaagaaaagagaatagaagctgatacctctctcagaagctcagatggaaagccagttgacccaaatgatgcaagcggtggaggcacattgtctccctaacaaaaatatgaaaaacctcaattaaattttaattggagcaaaacccaaaaataaagacagagtaatgtgatataattatttgctatggaattataatatatatactcacagtcacagatatttcatgccgatgtcgataagactcagcagatagtccagctccagcatctgaagccccatgacctctgacagaagaattaccattgccagcaacatttgttccatttgaaacatcatgagaagtataacttccccctttggaactctaatacaagatgaaatgcatgaaagataagtcccccaaacaaactatgatggacagaaatatacaattgattttgaaatactgcatttcttttccctctaccaataggatgctttcatttcctacacaactttaaagcatccattaaagggaaaacacaattaaattcaatacacactttgtctacttaatattttagttcaatacagctagcttcatcccatcccctaactgtagggatcctaataatatcataacaactgatttgaaattaatttcaaaagttgcttaaaaatcatcgtcaataaaccacaaccaattggtataatattacatacaaataactacatatcaaaaaattctgtagcataggtcatgtcagctaccaaatacaaacacattaaatacaatacaaacaaagtcaagcataaatacctgattgttccgggatccagcgtcgtttgacccaccagtgccatttcgatcatacctatc

SEQ ID NO: 2756 - DNA, 324 bp, Glycine max
  misc_feature (32)..(32): n is a, c, g, or t
  misc_feature (34)..(35): n is a, c, g, or t
  misc_feature (37)..(37): n is a, c, g, or t
  misc_feature (313)..(313): n is a, c, g, or t
  misc_feature (315)..(315): n is a, c, g, or t
ttcaattttggatctctctctctctctaatcntnncnttgttgcgatgcagattaggagcttggtagaggtggagccaccaagcccactgagatacttgatcggtgccgccgttatgatgatcggagtagtgttacccgtcggttacatgatgttccgtaacaagcgcgtcccctcctcttcctcctactccaaacagacgtaggtgtgcctgccctttcttttttccaattccccctttttttcatattcttatttcatgaaaaccactaaatcccttgtaatgtggataattgaaatgaaaaaaaaaaaananaaattgaat

SEQ ID NO: 2757 - DNA, 309 bp, Glycine max
ctatcatgccatggttctgttggcaaagaaaggtgtcaaaatagaagatgttttgcaggttcttcgtctgagattttcccaatctggtattgaggagaagaaaagtcgtgtatcccagaaatcagtggatgattgaatgttctgtcaactctatatctcaagcaatatatttagctttcggccacatagccagatgcaccattcgtgttcttatcggtgggactatgctgaatagggtaacattgttaaatagtgtagagaatgtcgagaacaccatgtaactgttatcctctcatttttgcagaattc

SEQ ID NO: 2758 - DNA, 391 bp, Glycine max
ctggacccttgctattgcctcgcgagtccatagaagatattactattaatggttaattgtcatataaagaagaagacaagaattttagtcaatgcatgggccattggacgagaccccctaaagtttggtcagataatgctgatatgttttatccagagaggtttgtgaataataatatagacattagaggacatgactttcaacttttaccatttggttctggtcgaagaggatgatgtcctgggattcaattgggtctgaccacatttggccttgttttggctcaattagtgcattgcttcaattgggagcttccatttggtatgtctcctgatgacttagatatgagtgagatatttggcctttcactaccaagaagactaccaagaag

SEQ ID NO: 2759 - DNA, 368 bp, Glycine max
aattcaacttccccatgtccttctccatgaccatgctgagctggagcgtgatcgagtacagcggcaagtaccaggctgcgggtgagttgggtcacgtgaaggacatcataaagtgggggaccgattaccttctcaagaacttcaacagcaccgccgacaccatcacccagctgggcatgcaggttggatcaggggacacctcccaaggtagcaccactcccaacgaccactactgctggatgcgtcccgaggacatcgactacgaccgccccacccagacctgcaccacatgctccgatctggccgccgagatggccgcggcgttggcggcggcatcgattgtgttcaaggacaacagggcctattaa

SEQ ID NO: 2760 - DNA, 490 bp, Glycine max
  misc_feature (38)..(41): n is a, c, g, or t
  misc_feature (352)..(356): n is a, c, g, or t
  misc_feature (364)..(366): n is a, c, g, or t
  misc_feature (377)..(378): n is a, c, g, or t
  misc_feature (383)..(383): n is a, c, g, or t
  misc_feature (385)..(390): n is a, c, g, or t
  misc_feature (392)..(394): n is a, c, g, or t
  misc_feature (400)..(402): n is a, c, g, or t
  misc_feature (422)..(426): n is a, c, g, or t
  misc_feature (430)..(432): n is a, c, g, or t
  misc_feature (445)..(447): n is a, c, g, or t
  misc_feature (449)..(449): n is a, c, g, or t
  misc_feature (451)..(453): n is a, c, g, or t
  misc_feature (455)..(457): n is a, c, g, or t
  misc_feature (459)..(464): n is a, c, g, or t
  misc_feature (477)..(482): n is a, c, g, or t
tctattaacaaaccgatttatgatttcacagacaactnnnnggttttttatgatacaggtgctaatttttgagactgatattctccaatatgaatattattgattacagaaaagagggatcaacatgctttttgtattgggtggaaatggcacacatgctggtgccaatgcaattcaccatgaggttgtcaatccttaaaccttttatcacttaattggttatttgtgatccaaagtcaattttcaaagtgacttcacttactggtcctttattggtttttgtatatttcagtgacgatattaagctgcacaataatattattatttgaaatgtgaattatgtgtgatattnnnnnctgtttannnattcttagatnntgttntnnnnnntnnncttctnnnttacagattttttttttccnnnnntgcnnngaaagaccccctnnngngnnngnnntnnnnnngcccaaaattatnnnnnnttgtattt

SEQ ID NO: 2761 - DNA, 663 bp, Glycine max
tatctgatggtggtctttcaatgggaaccgaaactgaaggttcaatcagcagtattgtggagtacactcttttccctgaacttgagaaggcagctgaaattacaccaatgaaggacaccacaaccgacaaccttccagctgagagcacagaaaagtgagttctctcccgccctccatctctattaaaagtttacaaggcacatattctaccctaatatagaatggtatagataatacaacagtgattgctggtacaatgatgatttttcatctcaaatccaagttacttgcatgggacctgttaccaagcttggaactgatctcaatttgtttgattgaatgcaggcctattatgccatccaaaattcccaaagcttctcaagtcccacaaaaagtgcagtcaaaacattctaggcattcaatgaacaaaacctcctcgaaggttctgtcaagtatgtatattcaattaacttggccattttattctgttattgtccaaaattaatatatctattttactctcacgccttttcctttttcaattaaccagtgactcaatctcccttggttattctgcttcttacgttcaggtgttagaaaacccgcagccagtagctcttcttcggtgaagccccctaaacgatggcaatagttaggatgcca

SEQ ID NO: 2762 - DNA, 449 bp, Glycine max
gagcgacttcacgaacaacttgaggtaattaatatagtagtacttgaggttttcttgaggaggagttttgtttgctttgcaagtttttggcatgttctgatatggcaactttgatacagatccaaagaaagttgcagattcaaattgaagaccaagggaaacgtcttcagatgatgtttgagaaacagagagagatgggtgacagcaaggttaacgtctccttggacgagccttctgctgctgcaccatcagaaacagtagaaaccacaaatgaggaacgccacaaatttgaaagcattccaaaagccatacccgaagagaaggagtcaagcacaacaaaacaaattgcaggtgaagctgaagaaatgatcaaggaagatgaagttgcaccacccacaaaacgggtgaaaagttcgtaacagcaggatcgttgttttatgccttctaga

SEQ ID NO: 2763 - DNA, 1030 bp, Glycine max
cgggatgggagacgacagtggcagcaaccggtcgaagccggagtggctgcagcagtatgatctaatagggaagattggagaaggcacctacggtctcgtcttcctcgctcgcatcaagtcttccaccaatcgcggaaaatccatcgccataaaaaaattcaagcaatccaaggatggcgatggtgtctctcccaccgccatacgtgaaatcatggtattcctttctctgcttgcttaattacacctagggaagttgtaatttctgaaattcggaagcgaattcgcttagattgtttttaatttcgagtttctgaagaaattgccattttttttttatttatctattttccttttcttttgttagttctctgtagtttctagtatttggaaaccttgaagaggcttgagccagaggaggctttttttaaaaaaaaataaaattatttaatggtttggcggtttggattggttttgagtgaatttcatttgatgctgcagttactcagggagataacgcacgagaatgttgtgaagcttgtgaatgttcacattaatcatatggacatgtctctctatctggcttttgattatgcagaacacgacctttttgtgagtatatataatcgtgaaactgttgacatggcactctacttaggcactagagttcaagttgaaattaaagttgtttgctttcgtagttcatcaaaatgtttcccgagataatgtgtactttctgatatctgaatttccaaggtgtttttagtttaatgttgccttttgacattcctagctagtgagataaggcttggttgttgcatcttgtattagacacattatggtctttgcaatggactttatgctattgtataagttttgcttccgtgtcttataaaatgttggtgaattttctctaggaagagatatacgtaggtagcaaggaattgcttgttctgattaattgagtgtaaagattgcaattttgaatggcaggaaataataagacatcatagggacaaagtcaatcaatcca

SEQ ID NO: 2764 - DNA, 408 bp, Glycine max
  misc_feature (372)..(373): n is a, c, g, or t
ctgtatctggggccgacatgggcaatctagctcacagtggacatgttgagtgcaagcatttgcttcgactggaaaatggtgctgagattgtgaggggcaggactgagtggaggcccaaacctgtgaacaactttggtgttgtgaaccaggttccagcagaaagcacctaagattttgaaatggttaacggttggagttgcatcagtctccttgctatgtttagacttattctggcccctggggagagttttgcttgtgtctgtccaatcaatctacatgtctttatatccttctaatttgtgttactttggagggtgagggggaaaaggtgaaagaaacctcattctctctttctgctgctccttatttcanntgtattctctctttctgctgctccatatttcaaaa

SEQ ID NO: 2765 - DNA, 390 bp, Glycine max
gattgactgttgaaagatcaagccgtgatggtaatcatgaaaatggttgattaaagtaattctggcaaatggggttcaaataggattgcctgttgaaaagtcgagccatgatggcaatcttgattgaaattttctggcaaatgaagtgcaaatatgattaactttttgcaagttcaaaccatgatggtaatgctgaagtttgttgattgatgcaccatctgaactaactgagcttgtttttgttgttcgtggctgtagctttggcatctaatatttgttgctattgctggatggcagttaaccagagcttaggagggacaaccctctccccaaggtattttaatggggatccttcatgttttctgggtgcttcaccaagaattgatacaa

SEQ ID NO: 2766 - DNA, 289 bp, Glycine max
aagagtgatagtggcggcggcggtggcggcacgggatcattgcccaaaggacagtgcttgtgctcaccaacgacacatgaagggtccttccggtgccgtttgcatcgtgggcctacagcttcaccaacaaattggatgaaacgctccaagtccatgcctgccaataagcctgtggtttctgactccacatgctgatgataacaaaaaaaaactattgtgagttatgtgttcatgtgtacctttatatgatatatgatatgaatccttgcttgcaactcttgaattttgg

SEQ ID NO: 2767 - DNA, 363 bp, Glycine max
cagagacgtgcacagacgcgtcggggtcgcttgtggtgtacgcgccggtggacattccggcaatgcacgtcgtgatgaacggcggcgactctgcttacgtggcgcttcttccgtcggggttcgccatcgtgcccgacgggtccgtcgaggagaacggtggcgcgtcgcagcagagggcggcgagtggcgggtgcctcctgacggtggcgtttcagattctggtgaacagcctccccacggcgaagctcacggtggagtcggtggagacggtgaacaacctcatctcctgcaccgtgcagaagatcaaatcagcgcttcactgcgaaagctgaaagtcacgtgactctggctttgtctattatt

SEQ ID NO: 2768 - DNA, 1132 bp, Glycine max
  misc_feature (52)..(52): n is a, c, g, or t
  misc_feature (54)..(55): n is a, c, g, or t
tggtgttctcagttccggtagtgattcttttcagttttacattttcgtttcntnnaagtattgaacttttgtagttttttattgggttaataatctagtccatttgtgtgttttttttgggttataggaatataaagcttcaatcatgtggttgaaaaatgggttcctagttgatttggttcatgacaaagaaagaggtagaattttgaaattggatagcattagttctggggaccagtggaaagaagtggatgttttgattttcaacacctaccattggtggactcacactggacagtctcaagggtaatgaagctttttgaatttttaaccactttttttggcgtttatgagaggtgctagccatgtggctaatgacatcattttaatgttttattgtaggtgggattactttcaagtgggcaatgaattaagaaaggaaatggatcacatggaagctttcaagattgggctgagtacttgggctaaatgggttgattctaacattgatccttcaaagactagagtcttgtttcagggaatcgctgcttcccatgttgagtaagttttatggctggttttggtttctctccaattgaattttggatttgtctaatttaaagtaagaaggtgaataaagtacatctatcattgtcaatcagatagtcaaggttaaaaattatgataaaatcaattacacatatgataaaatgaaaattaatcataatctaacctattgatttcttaattaatggttgattagaaaatcaatggtataaaatcaaataaaagtgctgataaaaaaatcaaataaacataaaatctaaaactaattacaaatacaatctaaatcatcgattccctaattaatggttgattaaaaaaattccatgcccgtctgctatgttttatgcttcaaagtttttacttgaatatggattgggtagggtgtggagattgcaacacattttgatacatttggtttttaaatgagtatgaaatagcaagacaaatgccccatatgttatgtgattttatttttttaaagaatggattgccccatatgttattatgattagtaattgttatataattgtagtgaagaagtcactcttttgtttcttgaatgaaa

SEQ ID NO: 2769 - DNA, 803 bp, Glycine max
ctacctaagctgactaaacttagctataaataacagaagatttgatggaagagcactagaatcccctgcaccaattgctaaccaagtaagatatatttgccttgagaagtcattcaattaaaataattttggcttcttcattcatcaatgtatcacttaatgtatcttattttgtggaacatggaaaagctacttgttgaaggtgctacaattgataaatgtctgcttttgtgtctaagtggtttaattttctgtttatttctctgctcatctaaattattcttctactgatatttgctcgagttgtccagggagtcatcactcaactttctgatcaaatttcaacattaaatgaaagaatggatgaattcacctcccgtattgaagagctgaattcaaagttcgctatcagaaaagattcagcaggcagtcaacaaaacttggctttacaggctgaggcctgcaatggctcaggccccacttccttctttgtaactggacgaggcaatggttcattgactggatcattgctacctaattcatcatcatcttctcagttggctaaagagtctcccctgatggaagaggtaggtgatatatccccttatttcgaattcacatgacagtaatagtgctgtaaattacatttatacatagtatttgttagagctatacgtttactagtcagtagaaaaatttggagtggttttctactttgaaattccacccaagacaataaaacatattcggcttttatttttatcattattattttgtcaaaataggtattagttattgcacga

SEQ ID NO: 2770 - DNA, 370 bp, Glycine max
aaacttgaggccaagattcatgacctggaggtaacttgtaaagctaacaggttttcagtgatggtattctggactttttcttttcaaactgatgccagtttgctaatcactctttctactacaatgattatgtgtggtttcattggtttctctgttttaaatatgcatttgtgtcattatttcaaatttctatgtctttctaggtgattagtaaatgcatataactattgaaacggtgtcatgggatgggtctcccatatgagtcagcttcacttctgaggtctaatatcctatagtttggcgtttagacattggaggcatgcgcaaaaaagcaaataatctctcctttgtataaaatctttagacatca

SEQ ID NO: 2771 - DNA, 355 bp, Glycine max
  misc_feature (321)..(324): n is a, c, g, or t
  misc_feature (344)..(348): n is a, c, g, or t
tagtcctaccaaaaggaataagagagcctagaggggaattttgttaaaaggctccacatattagggcactggttttgtgcgtgtgcaatatactactatcttgttttaataaaactttttaaacgtattgtctactttaggacgaaatctaagtttccaagtcaatcttccaaatatcagaggtaaaaaatgtacgctttggctttaataacaagtccttgatttttggctattagtatatatcattgctgtatgcctatcacttattaaaaagacaaataatataatgtaaaagatatgccattgtgtaacgtgaattannnntcttcgtatccaaccatgannnnnttccact

SEQ ID NO: 2772 - DNA, 307 bp, Glycine max
  misc_feature (296)..(296): n is a, c, g, or t
  misc_feature (299)..(299): n is a, c, g, or t
gaatacctctgtttgattaccagtgacgatcaccacaacagctaccagtgatgctgcaaacaatacaaaccttaggatgacatcaaatttaaagtaatcaacacccgcaggagctggagttgaagatgatctgcattcagggtcgccgccatgcttgtctgtagaagccatgtgtgatgctttgatagcaggtagctagtgatgattatactaataatcttattggtgagagagagagagagagagataagaatagttgaacaattgtgcaaatatatatagatggatatggactntgnggaaagcc

SEQ ID NO: 2773 - DNA, 1173 bp, Glycine max
  misc_feature (29)..(31): n is a, c, g, or t
  misc_feature (1159)..(1161): n is a, c, g, or t
gctgaagtaagtatatcactttaattcannnttggcatacatcttggttgatgggattttctcacctatggtcaggttgatctggtcatctttcagaatgagttttcttatggttttcactgatcctgtaggcaaagccaaaaaagatctgctcacaaattggattgtgtacctttgatgggactcatggtgttaggtaaacccgaagatattgtaccttctgtcattagcctataggctttaacatatttaatgttgagtgttctgtaatttcaattttattgaagagtttcaatttttcctttagcatgggtattgagagtgtggtggataagaatgaaagaaaatcatctggtagcattcgggatgctggttgttctgcatgtgagatggctgttatttggatgcagaaccagctgaggcagaatcagacagaggataggataatagactatgccaatgaggtgagttagtttttattttactatttgagtgctcaagttctgttttggattctagccttatgatattgatattgcagctttgtgataaattgcctaacccaatgggacaatcatcggttgactgtgaaaagctctcttcaatgcctattgtttccttcactattggtggaaaagtttttgatctttcccctcaggaggtacagtttcaaacctaattagttaattctggatgggctgatcactgactatttaattttgtgtaaaaagaatttataatgaggaaaagaaattcaattgttggagggaaaagagaaaaccattctctagcaaaaataggaataacaagaacggactagaagataaacttagtttgtgcaacggaattgagctttgccaagtcctcaatttgcaataacagtttgcaagtctatcattgaacaattactaatgaaattgtggggtgagtcgtaagagtttaaatcaaacaaattgaataaccttttcaatttgttggttgaataatattttctatttcttactttacaaattggttttaactaaaattagaataaaatagaagatggagcaggaaaaaccaagacagagaagcactttcaagtttcatctgctactagtgataattatatttaatagcagtagtgcaatttctatgaatgaatgattgctatgctccnnngtattttgtctc

SEQ ID NO: 2774 - DNA, 604 bp, Glycine max
tgccgtgcaatttctgtttctcgtgctcctctcactcctactggtactgtgatatcttttcttttttgtttgtttgtttttagtggtcaggagtgtatacacagttttactaattattttgtatcatgtaacaggatttcgatgggatagacaatggatggtggtgaattcccaagggaggatgtacactcaaagagttgaaccaaggcttgctttggttgaggttgaattgccatctgaggcatttcttgaaaactgggaacctacacaagactcctacatgggtatattgcattttcttaatccataacaacaacctcacacaatatgttaattactttttttttagttcattatatggattggcaccaatatctttttcaagaaaaaaaaaattgtgttagggagaaaagatatgtgttaattaggcattcttcatgatcatggactcatggttgttgttttttttccttgtttagtaaatgaatattaagtgctacttgatattacaggggtgaatgcacctgggatgcaacctctcaaaatatgtttgagccaacaagggaaggaggtacaaaatgctgtctcagtatggaaatggact

SEQ ID NO: 2775 - DNA, 548 bp, Glycine max
gagatacttttcacctttggttcaatgtactagacatatgtgcccagtccgtatccactggcatgttaagcttaactacaaggagtactggcgtgtgaaggttactattactaattttaattacaggatgaattattctgagtggaacatggttgttcaacatccaaactttgacaatctgactcagctgttcagtttcaactacaagtcattgactccttatggttcaataagtaagggtgatcctaacttgtttcgatttctggagttaaaaactttcttaaatactgtgaatattttcttaattcttcatcataaaacatcaaaacttttacttcttattttgataaactatagaaggtaattactgatttttaagttgcttttaacagatgatactgcaatgctatggggagttaagttctataatgattttctcaaccaagctggccctaatggcaatgttcaatcagagctactcttccgaaaggataaagcaacttttacttttgataagggttgggcttttcctcgaagggtctacttca

SEQ ID NO: 2776 - DNA, 621 bp, Glycine max
  misc_feature (528)..(530): n is a, c, g, or t
  misc_feature (579)..(582): n is a, c, g, or t
  misc_feature (593)..(595): n is a, c, g, or t
  misc_feature (597)..(598): n is a, c, g, or t
tagttgctctgggatggatgatgtgcatggtccaccagacgtcataaatggtattcccttgtatgtggccactcccttgtcatcagtgaaaagatgctgcatggaaaaagtatcatgagcttgtgaacatcatcacttctagtatgaacattatgaagtttaaaaatgcaaagttaacgagtgcaaagaaaataccggtgtaatcttctccagctgtttcttttttgggtttagtacatcttctggctttccatcaatcctatattagaacgacaaagcataggtataatgaatcatctcaagtaagttatatctatagcacaataagacaacaagtgctacaaactaaatttgaaccacatgcaagtttctagttaagtgctatacagttggaatgaggccactacatatctattgtttgatacttcagtttgactgatggctggcacagtgatgcttacattaaattcaatcttatcatgattattaaagtgatgtctccagacccaacgaaaggcatatagttannnaacaaagtgatgaggtatttggcaaactatgatatgaagatgatatatnnnnaaaactaaatnnntnncaaacataatttgtctcctgctt

SEQ ID NO: 2777 - DNA, 365 bp, Glycine max
atcctctgcatcaagttccctttcacaccctttgcagactcttacatcagaacagctttagcctcacaacccaaaatcaaactcattgatctccctctagtggagccaccaccacgggagctagctctcaactcccctgaacactacatatggaccttcatggaaagcctcaaaccccacgtcagagccatcatgcaaaacattttatcacacccagttgttggtttagtccttgatatctttgctatgtctatggttgatgtgggagatgaacttggcataccctcttacatgttcatgacttcaaatgttgcattcacagctttcatgcttttcctcctcagccgtcggatggaggatgtgtt

SEQ ID NO: 2778 - DNA, 389 bp, Glycine max
tctactggaggcatgtctgcttcagcctcaatgaaaaagaccaactctggtccattgaataagcatggggaaccagtcaagaagtcatctggccctcaatctggtggagttacacgccaaaactctggtccaattcctccagttcttcctacgactggtcttattacatctggcccattaaattcatctggagctccaaggaaagtgtctggtcaattagattctacaggatcaatgaaatcacatagttcctttgtagcccacaatcctgctgttaccactcttagccttgatgatgaatattccttcaggaagaacttcccgaagccaatattgtggtctgtgattctgatttttgtaatgggattcattgctggcggttttattct

SEQ ID NO: 2779 - DNA, 381 bp, Glycine max
gttcgagacactcaagcaccgcgcgcaggagtatgtcagccacgacaacgcagcagcgcttctggctgctggccttgctcgcacctttgacagaatgccttatctgctgtctctgtcttcctttgtggctgacgatgttgccgctgctgttcctgctgctcaagatctgggggagcagtggtcttattaatggatgtgcttcaattcaaatagtctcgcactagtcatcattccctttgtttctgttgcttgcttggttgttcttcttcttcttgttgatcgtcgtggtcgttgaggtcttcaattttttttttattattattccgttttcgctgtttttagtttagtcctggatgcaatgcaggataaagacagggtcag

SEQ ID NO: 2780 - DNA, 527 bp, Glycine max
tttttttcttctcatggttactgtgctcttgtatttattgttttatatacgtactgaaatttcgtacttaaacaggttacgacattgaggatcataacgatgccattccaacaagaccacactcacatgcagatgtgcctcctgctgtcgctgcagggcttggtaattaccctgccactgatccaaccagaaaatccaaatacaactctcagaggtcaattgcatcaccatcttcacattatagccatacttcacttccaactttcctcggatttcttgtattgtgttttgtttatattctataatcattcatttgtacgggccagtggtagtttatggtaaactttagctcattcttgatctacatgttgatataaggatatgttgatatagtgttgaagaatagatgtatgaattttactctcataaatcatgataatataacactgtaaatgccatttgcattgcatgtttatctcttgaatcatatgatatgacactgcaaatgccatttgcattgcatgttt

SEQ ID NO: 2781 - DNA, 715 bp, Glycine max
ccctcttcaacctcggtagccgccgcgagttctagcgccgcagaacccgcagcagaaaaatctctgaatgagggacatagaaagcagcgcaggtgctggtcacaggacttgcacaagcgcttcttgcatgcccttcagcagcttgggggtgcagatagtgagtatctctatatagtatgttctgattgttatgtgtttgagatgttactataattgcttattgattattttggtggtttctgcagctgccacaccaaagcaaattagagagataatgaatgttgatggcctcacaaatgatgaagtcaaaagccatttgcaggtatgttagttatataggatgatttgtataacccaattcccaaacttttgctatcaaatttggcttaagctagtaaagtcataattggagtctttttgctattagtctatccagttctttccatcatatggaatcgttaactgtttttcttgtttcttaaaagttaaaatcctcccctccagtcttaaatagtgataagattttgttgcacaattacagtaacttaatatttttgagttccaaatgttccatattctgaatccatagtctaaaattttcttttggggttttggacagaaataccgtttgcacactagaaggccaagtcccatggttcacaacagttccaatccacaagcagcaccttttgtccttgtaggaaacatttttgtc

SEQ ID NO: 2782 - DNA, 393 bp, Glycine max
ctgttattgcttcatgctattgaagaattttcttgcaagtctacttccaatgctttaaaggaggttgccctggttctaaagacattctacgatgctgatgtgttggaggaagagcacatagtgcagtggtatcaaaagggactgaagggcaataacaagaactctaagatttggaagaatgctcaacctttcattgattggcttcagagtgcagaatcagaaaccgaggaagaataattttcccatattctccgtttcttatgtttgcttgcttttgtcatgtcctttatttccaataaaagggtcttgttggccccatgcgttgtggaactactatacttgtctgaagggtgtatgcttgctggactagtatagcatgtatgcgtcagtgaa

SEQ ID NO: 2783 - DNA, 361 bp, Glycine max
ctcttctcctgcgccaaggaccacaacccaaccgtctggtttgccgacaatggcgaacgcttgggcacttatcgcggccacaacggcgccgtttggacctgcgacgtctcaagagattcggttcgtctgatcacgggtagtgccgatcagaccgccaagctatgggacgtgcaaagcggtctgcaattgtacaccttcaatttcgattcccctgccaggtccgtcgatttctccgtcggtgataggctggccgttatcaccaccgaccccttcatggagttatcctctgcaatccatgtcaaacgcattgctgacgatccaaccgagcagagtggggagtctctgcttctcattaagggtc

SEQ ID NO: 2784 - DNA, 356 bp, Glycine max
actgggtttgccctcttattggtggtggtttggctggtcttatctatacctatgccttcatccccaccaaccatgcacctctcgctactgaattttgatttcatggtccacattgttgccttgtgttaatttctgattcgtaataaagttggagtacgtcattgttttctagcttgtaagaattcatgaggttggtaatctagtttttctttttcttaaaaattatatttttcagatttatggctttccctagtatagtgttgcattgattaacatctatcaaatgaggagaagcttacagctgtttttagataatcattctcaacttttatctacatgtctggatattaccctga

SEQ ID NO: 2785 - DNA, 379 bp, Glycine max
ctctgcggaaactcctccgttctcaaaaccctaacccgacgccaccattcatccgatccaatgagttcgagaggagccagcgcgctgctatctcgagccagcaggattcgctcgaagcttcaaacggcgctggaagccaccgttttggaggtggacgacgtgtcgtaccagcacgcgggccacgccgccgtgaagggaagttccgacaaagaaacccacttcaacgtgaagatcgtatcgcccaagttcgagggccagagcctcgtcaaacgacaccgtctcgtctacgacctcctcgccgaggagctccagagcggcctccacgccctctctatcgtcgccaaaacgctccacgaaacaaaccctaataagtgacgcg

SEQ ID NO: 2786 - DNA, 413 bp, Glycine max
cctctaactcagtttcttctggaggagacaaaactgtgcaagagaaaccctctgccaaagactctgatgagagaaagtttgagtgccaatattgttacaaggaatttgcaaactcacaagccctaggaggccaccaaaatgctcacaagaaagagagaatgaagaagaagaggttgcagcttcaatccataaaccgctacctacaacaccctttccaatccaagcatggctttgcttacccttctgatactccttggttctatgacccctctacctataataactctgagttcacccttagtgaagaacctcagattagcttcaattcaaatgttttagatgccaacttttcttgtgaccagaaatctagttggtattctcttgcatctcacccttctaattcccaacaagag

SEQ ID NO: 2787 - DNA, 1362 bp, Glycine max
  misc_feature (406)..(409): n is a, c, g, or t
  misc_feature (417)..(421): n is a, c, g, or t
  misc_feature (424)..(439): n is a, c, g, or t
  misc_feature (444)..(449): n is a, c, g, or t
  misc_feature (452)..(455): n is a, c, g, or t
  misc_feature (457)..(469): n is a, c, g, or t
  misc_feature (472)..(477): n is a, c, g, or t
  misc_feature (488)..(490): n is a, c, g, or t
  misc_feature (498)..(502): n is a, c, g, or t
  misc_feature (508)..(526): n is a, c, g, or t
  misc_feature (532)..(538): n is a, c, g, or t
  misc_feature (544)..(544): n is a, c, g, or t
  misc_feature (546)..(546): n is a, c, g, or t
  misc_feature (549)..(551): n is a, c, g, or t
  misc_feature (556)..(556): n is a, c, g, or t
  misc_feature (558)..(566): n is a, c, g, or t
  misc_feature (570)..(570): n is a, c, g, or t
  misc_feature (575)..(595): n is a, c, g, or t
  misc_feature (597)..(603): n is a, c, g, or t
  misc_feature (605)..(607): n is a, c, g, or t
  misc_feature (609)..(614): n is a, c, g, or t
  misc_feature (616)..(629): n is a, c, g, or t
  misc_feature (631)..(632): n is a, c, g, or t
  misc_feature (636)..(644): n is a, c, g, or t
  misc_feature (648)..(657): n is a, c, g, or t
  misc_feature (659)..(662): n is a, c, g, or t
  misc_feature (667)..(673): n is a, c, g, or t
  misc_feature (675)..(678): n is a, c, g, or t
  misc_feature (680)..(698): n is a, c, g, or t
  misc_feature (700)..(703): n is a, c, g, or t
  misc_feature (706)..(711): n is a, c, g, or t
  misc_feature (715)..(726): n is a, c, g, or t
  misc_feature (731)..(735): n is a, c, g, or t
  misc_feature (738)..(739): n is a, c, g, or t
  misc_feature (741)..(744): n is a, c, g, or t
  misc_feature (747)..(748): n is a, c, g, or t
  misc_feature (754)..(755): n is a, c, g, or t
  misc_feature (761)..(767): n is a, c, g, or t
  misc_feature (772)..(780): n is a, c, g, or t
  misc_feature (785)..(789): n is a, c, g, or t
  misc_feature (794)..(812): n is a, c, g, or t
  misc_feature (815)..(825): n is a, c, g, or t
  misc_feature (827)..(839): n is a, c, g, or t
  misc_feature (841)..(842): n is a, c, g, or t
  misc_feature (851)..(852): n is a, c, g, or t
  misc_feature (865)..(869): n is a, c, g, or t
  misc_feature (871)..(874): n is a, c, g, or t
  misc_feature (881)..(882): n is a, c, g, or t
  misc_feature (885)..(888): n is a, c, g, or t
  misc_feature (891)..(893): n is a, c, g, or t
  misc_feature (895)..(923): n is a, c, g, or t
  misc_feature (927)..(932): n is a, c, g, or t
  misc_feature (936)..(948): n is a, c, g, or t
  misc_feature (951)..(952): n is a, c, g, or t
  misc_feature (958)..(968): n is a, c, g, or t
  misc_feature (971)..(974): n is a, c, g, or t
  misc_feature (980)..(994): n is a, c, g, or t
  misc_feature (996)..(1003): n is a, c, g, or t
  misc_feature (1009)..(1012): n is a, c, g, or t
  misc_feature (1014)..(1016): n is a, c, g, or t
  misc_feature (1021)..(1022): n is a, c, g, or t
  misc_feature (1025)..(1033): n is a, c, g, or t
  misc_feature (1035)..(1041): n is a, c, g, or t
  misc_feature (1043)..(1046): n is a, c, g, or t
  misc_feature (1048)..(1048): n is a, c, g, or t
  misc_feature (1050)..(1058): n is a, c, g, or t
  misc_feature (1063)..(1064): n is a, c, g, or t
  misc_feature (1066)..(1068): n is a, c, g, or t
  misc_feature (1073)..(1076): n is a, c, g, or t
  misc_feature (1078)..(1079): n is a, c, g, or t
  misc_feature (1081)..(1081): n is a, c, g, or t
  misc_feature (1085)..(1089): n is a, c, g, or t
  misc_feature (1091)..(1099): n is a, c, g, or t
  misc_feature (1101)..(1109): n is a, c, g, or t
  misc_feature (1111)..(1112): n is a, c, g, or t
  misc_feature (1118)..(1122): n is a, c, g, or t
  misc_feature (1124)..(1130): n is a, c, g, or t
  misc_feature (1132)..(1134): n is a, c, g, or t
  misc_feature (1136)..(1136): n is a, c, g, or t
  misc_feature (1138)..(1147): n is a, c, g, or t
  misc_feature (1150)..(1158): n is a, c, g, or t
  misc_feature (1161)..(1187): n is a, c, g, or t
  misc_feature (1190)..(1196): n is a, c, g, or t
  misc_feature (1200)..(1226): n is a, c, g, or t
  misc_feature (1228)..(1228): n is a, c, g, or t
  misc_feature (1234)..(1242): n is a, c, g, or t
  misc_feature (1244)..(1257): n is a, c, g, or t
  misc_feature (1262)..(1263): n is a, c, g, or t
  misc_feature (1266)..(1281): n is a, c, g, or t
  misc_feature (1283)..(1283): n is a, c, g, or t
  misc_feature (1286)..(1294): n is a, c, g, or t
  misc_feature (1296)..(1301): n is a, c, g, or t
  misc_feature (1305)..(1308): n is a, c, g, or t
  misc_feature (1310)..(1310): n is a, c, g, or t
  misc_feature (1314)..(1318): n is a, c, g, or t
  misc_feature (1322)..(1326): n is a, c, g, or t
  misc_feature (1329)..(1335): n is a, c, g, or t
  misc_feature (1338)..(1357): n is a, c, g, or t
gtttcttccaccgcatgtcccaaaaatatggaaacatcatatccctttggtttgggtcacgtcttgttgtggttgtttcatcacccacagcgtaccaagaatgtttcactaaacatgatgttaccttggccaacagggtacgctccctctcgggaaaatacatattctacgacaacaccaccgtagggtcttgctcccacggcgagcactggcgcaacctccgccgcataacctctctcgacgttctatcgacgcagcgcgtccactccttctccggaatccggagcgacgagacgaaaaggttgatacacaggctggccagggactccgggaaagattttgcgcgcgtggagatgacctccaagtttgctgacttgacgtacaacaacatcatgaggatgaaacnnnnttttttannnnnccnnnnnnnnnnnnnnnnctccnnnnnnttnnnnannnnnnnnnnnnnacnnnnnncccctccccannnaccctctnnnnncccctnnnnnnnnnnnnnnnnnnnaccccnnnnnnncacccncncannnctccncnnnnnnnnntatnttcannnnnnnnnnnnnnnnnnnnncnnnnnnncnnncnnnnnntnnnnnnnnnnnnnncnncccnnnnnnnnnctcnnnnnnnnnncnnnncaaannnnnnnannnnannnnnnnnnnnnnnnnnnnannnnccnnnnnntccnnnnnnnnnnnnccccnnnnnatnnannnncanncccccnnctcccnnnnnnntccannnnnnnnnctccnnnnncactnnnnnnnnnnnnnnnnnnnaannnnnnnnnnncnnnnnnnnnnnnncnnaccacaccnntcctcctcattcnnnnncnnnnccccccnnccnnnnccnnncnnnnnnnnnnnnnnnnnnnnnnnnnnnnntctnnnnnnccannnnnnnnnnnnncanncccacnnnnnnnnnnnccnnnncatctnnnnnnnnnnnnnnncnnnnnnnncccctnnnncnnnccccnnctnnnnnnnnncnnnnnnncnnnncntnnnnnnnnngtacnnannncatcnnnncnncncacnnnnnannnnnnnnnannnnnnnnncnncccccnnnnncnnnnnnnannnantnnnnnnnnnntcnnnnnnnnncannnnnnnnnnnnnnnnnnnnnnnnnnnccnnnnnnnccannnnnnnnnnnnnnnnnnnnnnnnnnngnatatcnnnnnnnnntnnnnnnnnnnnnnntatannccnnnnnnnnnnnnnnnnanacnnnnnnnnnannnnnnaacnnnncntacnnnnncatnnnnntannnnnnncannnnnnnnnnnnnnnnnnnntcccc

SEQ ID NO: 2788 - DNA, 200 bp, Glycine max
ctaagttatggtagtatttgtcattcatttcacaaaaccggttcacctttggacccatggcttctaaaacccctaccttattccactctcgtttcttcctcttcggcttctattgctgggactgggaatttctcaccgctctcctcctctttagttcttcttcctaattaattaaattacatacaccttttcttcttttt

SEQ ID NO: 2789 - DNA, 570 bp, Glycine max
ataatagattttgggagttgactttaagtttttctccgtcaaagtaacacaaacctgttatgagcattgagctcaaggtacagttgtaatgcgtctcagattttccaagttatcttttatattcaacttttgatccctcaaaataatatttatttgtgacctgcaatgaattcttgtagtttttgcactttatattgctaacctcataagagcttcttgattcctgacagacgtgcatacatcttggtgttagaaagttcaatgtcaacaccgaggtaagaaaagcatacatggactcccttgttacccccaagaacgatctagttcatgttatggcctctgcaaaggaagccatgaaagttgtggttgcagaaaagatgcatctctttggttcagcaggaagggcataattcctacaaatttactagctaggattattggtgactatcaacttcttattattttgctattatgttgtcttgtagtaaggaatatcactgcctcatgaattcattatttccttcagttcaatagatggtttctgaatttcttatttacttgccttgtcct

SEQ ID NO: 2790 - DNA, 377 bp, Glycine max
ttattcccgagaaccctaaattcaaaaagtttgtgacagattgcacatcgcatgttgctgaaagatgtagtagtggaagcgaagcattgcatggcgagggagggttggctctttgccttttcgattctatggaaaattgcttggtagagcatggagcggccaaagttaaccaacgatcattattcgtgctaccaaaaggatccacacccattgaaccaaaagattcattaccttcatttattccatcaccacccatacctcccaagtccaaatttgaatgttggtgtgatagtttaatatcttgtgtgtgtacttggacgtccatggtgccgagtacaaggttattaaataaccaacaattaggtcaaggtttcaaa

SEQ ID NO: 2791 - DNA, 403 bp, Glycine max
tgatctttgctgcaaagtttatgacatgagtgatcctgataagaacaccacagagcaagatctcaaacgaaaaacgttgttggagcttgttgattatgtttcttctggatctgttaagttcacagaaccagcaatcgccgcattgtgtaaaatgtgtgcaactaatttgttcagggctttcccaccaaagtttcgaacaagtactactggtggggaaacagaagatgaagaacctatatttgatcctgcctggtctcacctacaagttgtttatgatctactccttcagttcatcaattataactctcttgatgtgaagttggcaaaagcacatatagatcatgcttttattctaagattacttgacctttttgattcagaggaccctagagaaagagattgc

SEQ ID NO: 2792 - DNA, 387 bp, Glycine max
gagtggtagctttaaaaggaaggagcacgaaggtgatggctataaggatgatagatccaaagggaaagatgatacttggaatgacaggaggaaggatagggaaagttctaaagaaagttggaagaggaggcagccgagtaacactgacaaagattcaaaaaatgaggagggtgcttttgacgacaacagggattgggagttgcctagacatggttatgagaggatggataatgaaaggcctcatggacggtttggtggtagaaaagatgcgagcaggggggaagctgttaaaacatccacaaagtttgggatttcgaatgacaattatgatgtgatagagatccagaccaagttttatgactatgggaaatcagagtctgtgtccaa

SEQ ID NO: 2793 - DNA, 361 bp, Glycine max
  misc_feature (319)..(321): n is a, c, g, or t
caaaaactcacacgtgcgaggctctttctctttctctgccacaaccgtcatctcctcctccggagcccgtgaacatcctcttccgccgccgccaactcctcagcgccaccgcatccaccatttccttcaatttcactgtccctttcacaacctctctgtccatgtcagagccggtagccagtgccggcggcctcttccaaatgcccccaccacgcctcatcaaccggtaatcccgtaaaacaagacatacagtgataacaagctaacaaggaataaaaaaaaagcatgggttgttaattatcttgttgtttgcgtgagnnnggtattttctggtgagagcgggtgagtcggagttcgagag

SEQ ID NO: 2794 - DNA, 322 bp, Glycine max
acgaggagaacgaaaacgacgacgataacggcgacgaggagttcgaggaacacgaggaggcggaggatcgctccggcaacgaagatccgcacggaggagacgacgaggatctgagaagaaggaggcgcgagctacttcggcttcggattagggatttggcgactcgtacgaggagcatgcggaaccggatcttggattgggccgagattctgatgggcctcgaggacaattccatcgagttccgcctccagctgccagaatccgaccgctacgtcggaaatcccgaggattacgtcgacgcggcagagtacgaggcgctgct

SEQ ID NO: 2795 - DNA, 444 bp, Glycine max
atattcaataacgatgcaaaagcaaaaggatcttgagtctgaagcagaagagttgaggaaatctaatttaagattgcagatagaaaattctgacttagctcgaagattggattctacccagatccttgcaaatgcatttctggaagacccagcggtaggaagatcatagtcacctactcttttcctttagtttagccactgcttgttagacaataatttttacattttgcttttgggatgcaggcagatgcagtgaagcaagaaagcgagtgtcttaaacaagaaaatgtgcgcttgatgaaagaaatcgagcaactacagtctgatcgatgttcagatcttgaagaattagtatatatgcggtggataaatgcttgcctacgatatgaactaagaaattatcaagccccactaggtaaaacagttgcaaaggacttaagcaga

SEQ ID NO: 2796 - DNA, 654 bp, Glycine max
  misc_feature (11)..(11): n is a, c, g, or t
  misc_feature (55)..(55): n is a, c, g, or t
  misc_feature (637)..(640): n is a, c, g, or t
acaccctgaantcatccgcgaatcccagcgccgtcgtttcgccagcgtcgaagtnctctaagaggtcatcaatctcgacaaagaatggcgaaagcgtactctctctctctctctctctctctctaacaatgtcaccaatccaatctcgcaccaatgctatctattattatgcatgccttttcaggtcaattcgagttggagaatctccgcaaagaatttaacaagatcaacaaggaagtctccaaactcaagcgtgtgagtatcttcatttccgttattctatttttttttctcgtctaatacagatgctaattctgaatgaattcatttgaactttgttctgcgcgttaggctggcgaggatgcaactaagttcatcagtgaatcagaggaaaccaagaaatcgataggggagaaagaggttgaagttcgggaaactctgaatctcttgaattccaagttggaaactattggaaacctcgtccacgattccgttccaattagccaggatgaggtttgtttcgttttttctttttatgtgtgttgttttatttctgctaattctcaatgcttgtctggaaattcatggggtcttccatgctttaggccaacaatgttgtcgttagatcgtggggagnnnngagagtggagccta

SEQ ID NO: 2797 - DNA, 688 bp, Glycine max
caaggtgtaaattacagggctctaagtgatttgtttcttatagcagatcaaaggagggacactgtccactatgacgtttctgttcaaatgattgagatttacaatgagcaagtcagggatctgctggtcactgatggaacaaacaaaagatatccttttaccagttaattgattctctttggttttgtataacctcaaaaattactgctgcccttaataaatgaaaacaagttttaatcaggatgcactatcgactatttatacatattatagaacacacatagcattgattgtgctgcccttaactattgatacattagaaattcgaagtagttcacaaaaaggactcagcgtgccagatgcaagccttgtccctgtatcatctactattgatgttattgaactaatgaaccttggtcaaaggaaccgtgctgttggagcaacagcccttaatgaccgcagtagccgatctcataggtgtggtattttttatattcactttcttgctcttcactcttgtttttgtgatgatatttcttggacacaattaaccattgtcttcttccaaatatcaatttggcagttgcttgactgttcatgttcaaggaagagatttggcatctggagcaatccttcgtggatgcatgcatttggttgacttggcaggaagtgagagggtggataaata

SEQ ID NO: 2798 - DNA, 788 bp, Glycine max
  misc_feature (711)..(785): n is a, c, g, or t
tgacaaaggttagttgcaatctttcttcaacgttaagtaacaaaaccttttttttccttacaagaatgtgataattagtcttaaagcttttaagattatatcagagaaatataataattgaattgaatctgattgtcctgcttgctgtcttgatatttggggaagtgagatttgcaaaccatctgacaagcagtgggggttctttgtgtgcaatgcttccaagacaaccttataaaccggtgttaatcttttacgactagtttacaaagtataatatttgtggtggtgattaaaaactaaatggtgaaccaagatatgataaaccgtcagcctcgatactaggttaccatttgttaaacaatattttatgtcatagatttatgttgtctcagtgtctttgcagatgttcaagaatgctaaaattcaaactagatagattatgcagagttgggactcgtagatgattgaagagagatgacgaaagtattataactgaagagaccatagcgtctagcagcctactgcaagaattggattgctcttagactggtcaattttagtatatttaactgtttgggcaaatttcttttgtttaggatagtggagtgtcctgcctacctgatcaattttgtaatctaatttcatccttcgggaatatcttgttactgaagttttaaggttttatgagttgaaatgtagagcccaggagannnnnnnnnnnnnnnnnnnnnnnnnnnnnnnnnnnnnnnnnnnnnnnnnnnnnnnnnnnnnnnnnnnnnnnnnnnccc

SEQ ID NO: 2799 - DNA, 770 bp, Glycine max
  misc_feature (703)..(706): n is a, c, g, or t
  misc_feature (727)..(731): n is a, c, g, or t
  misc_feature (739)..(739): n is a, c, g, or t
  misc_feature (752)..(756): n is a, c, g, or t
  misc_feature (760)..(763): n is a, c, g, or t
agaaggtagtcatatggttttcctttggatagtaaaaatctttgatagtgtttttggttttagcatagcttaaattttgctttgtaaactctgcaattggtaattgattattttcaacaaatcttgttagtaaaagattcaagaatacaaaactcttactggattggaactttgaaattatggatactatttctttagattcatataaataatggaattttatgcttttcacatttcaattaccatagacaccttctcttctggctgtattctcctagtatagcatggacttctgtgatgatgcctgctcacctgtatcttgttattctttggctgtgaatctccagtggtcatggaagcaacatatttcacatgtcttcatcattcttgttttgtgcctgcaattacttgtaaattatgataacaagtacttataatagcacgattctgattatgcaggcaaggaattacaagatgcacgagtgctaactgatgttggtgatgttcctatccaggaaattcgagattgtggggtagatgatcacagattaatgaatgtaattggtgaatctgtaaagttagtgatggaggaggtaaattctcaatttgtgagcctgtgctttgaatgctatcaaattgtttgggattattaaattacagtttctacaacatgcaatatatgtcatttcttcttctttttagnnnnatttgtttcttattatttttnnnnnattgtganttatatttgatannnnntgcnnnnaaaaaaa

SEQ ID NO: 2800 - DNA, 1355 bp, Glycine max
  misc_feature (564)..(565): n is a, c, g, or t
  misc_feature (571)..(572): n is a, c, g, or t
  misc_feature (578)..(578): n is a, c, g, or t
  misc_feature (580)..(595): n is a, c, g, or t
  misc_feature (597)..(603): n is a, c, g, or t
  misc_feature (605)..(610): n is a, c, g, or t
  misc_feature (613)..(614): n is a, c, g, or t
  misc_feature (616)..(618): n is a, c, g, or t
  misc_feature (620)..(627): n is a, c, g, or t
  misc_feature (630)..(639): n is a, c, g, or t
  misc_feature (641)..(645): n is a, c, g, or t
  misc_feature (648)..(649): n is a, c, g, or t
  misc_feature (652)..(664): n is a, c, g, or t
  misc_feature (669)..(672): n is a, c, g, or t
  misc_feature (676)..(682): n is a, c, g, or t
  misc_feature (684)..(702): n is a, c, g, or t
  misc_feature (704)..(709): n is a, c, g, or t
  misc_feature (711)..(716): n is a, c, g, or t
  misc_feature (718)..(718): n is a, c, g, or t
  misc_feature (725)..(725): n is a, c, g, or t
  misc_feature (727)..(727): n is a, c, g, or t
  misc_feature (729)..(733): n is a, c, g, or t
  misc_feature (742)..(756): n is a, c, g, or t
  misc_feature (761)..(766): n is a, c, g, or t
  misc_feature (768)..(768): n is a, c, g, or t
  misc_feature (770)..(775): n is a, c, g, or t
  misc_feature (782)..(786): n is a, c, g, or t
  misc_feature (792)..(792): n is a, c, g, or t
  misc_feature (794)..(797): n is a, c, g, or t
  misc_feature (800)..(802): n is a, c, g, or t
  misc_feature (805)..(817): n is a, c, g, or t
  misc_feature (823)..(828): n is a, c, g, or t
  misc_feature (831)..(852): n is a, c, g, or t
  misc_feature (863)..(872): n is a, c, g, or t
  misc_feature (874)..(874): n is a, c, g, or t
  misc_feature (876)..(881): n is a, c, g, or t
  misc_feature (885)..(888): n is a, c, g, or t
  misc_feature (891)..(896): n is a, c, g, or t
  misc_feature (900)..(908): n is a, c, g, or t
  misc_feature (915)..(921): n is a, c, g, or t
  misc_feature (923)..(923): n is a, c, g, or t
  misc_feature (925)..(925): n is a, c, g, or t
  misc_feature (927)..(927): n is a, c, g, or t
  misc_feature (931)..(934): n is a, c, g, or t
  misc_feature (936)..(944): n is a, c, g, or t
  misc_feature (946)..(952): n is a, c, g, or t
  misc_feature (954)..(955): n is a, c, g, or t
  misc_feature (957)..(969): n is a, c, g, or t
  misc_feature (974)..(977): n is a, c, g, or t
  misc_feature (979)..(988): n is a, c, g, or t
  misc_feature (994)..(998): n is a, c, g, or t
  misc_feature (1000)..(1012): n is a, c, g, or t
  misc_feature (1019)..(1019): n is a, c, g, or t
  misc_feature (1021)..(1036): n is a, c, g, or t
  misc_feature (1039)..(1043): n is a, c, g, or t
  misc_feature (1049)..(1054): n is a, c, g, or t
  misc_feature (1056)..(1059): n is a, c, g, or t
  misc_feature (1068)..(1071): n is a, c, g, or t
  misc_feature (1082)..(1088): n is a, c, g, or t
  misc_feature (1091)..(1093): n is a, c, g, or t
  misc_feature (1095)..(1101): n is a, c, g, or t
  misc_feature (1104)..(1107): n is a, c, g, or t
  misc_feature (1113)..(1115): n is a, c, g, or t
  misc_feature (1124)..(1136): n is a, c, g, or t
  misc_feature (1144)..(1145): n is a, c, g, or t
  misc_feature (1147)..(1148): n is a, c, g, or t
  misc_feature (1155)..(1160): n is a, c, g, or t
  misc_feature (1172)..(1176): n is a, c, g, or t
  misc_feature (1178)..(1181): n is a, c, g, or t
  misc_feature (1184)..(1188): n is a, c, g, or t
  misc_feature (1191)..(1216): n is a, c, g, or t
  misc_feature (1219)..(1220): n is a, c, g, or t
  misc_feature (1222)..(1222): n is a, c, g, or t
  misc_feature (1231)..(1277): n is a, c, g, or t
  misc_feature (1282)..(1297): n is a, c, g, or t
  misc_feature (1300)..(1300): n is a, c, g, or t
  misc_feature (1302)..(1310): n is a, c, g, or t
  misc_feature (1315)..(1321): n is a, c, g, or t
  misc_feature (1323)..(1341): n is a, c, g, or t
  misc_feature (1344)..(1346): n is a, c, g, or t
  misc_feature (1349)..(1351): n is a, c, g, or t
tgcacgatctatttgtagttgatagtgacattattatggagctttgtactgtatacatagatataaatgtaaactaagaaaaagagaatataaagatttttctcttcccttcaggttttcagatcttactatcatttggataatttctcctatttgttggtcacttatagccctcttagttgattcaagatcataaccaggatgcaatttcaggtcatgtattatcagtttaacaaggaagagcagctggttgcactagaggcagaaaagaagatactagaagaaaggaagaaactgaaagaagctggaatgataggaagcacgatggatgcactagatggagcagtatcagtggtaggctctggtgttggactggttggtactggtgttgttgccggtgccggtcttgtgggaagtggtattggtgctggagccgggcttgttggaagcggcatcggtgctggagttggtattgttgggagtggtcttggagccgttggtagtggactgagcaaggcagggaagttcatgggaaggacaatcactggtcatagtggctccagnnagagtnnaaagcngnnnnnnnnnnnnnnnntnnnnnnnannnnnntcnntnnntnnnnnnnnctnnnnnnnnnncnnnnnacnnaannnnnnnnnnnnncccgnnnnatannnnnnngnnnnnnnnnnnnnnnnnnntnnnnnnannnnnntncctatangntnnnnnataatcaannnnnnnnnnnnnnnatgtnnnnnntnannnnnnactagannnnntttttncnnnnccnnnaannnnnnnnnnnnncccccnnnnnnacnnnnnnnnnnnnnnnnnnnnnntatccccttannnnnnnnnncncnnnnnncttnnnnatnnnnnncgtnnnnnnnnnattcacnnnnnnncntncntcannnncnnnnnnnnncnnnnnnncnncnnnnnnnnnnnnnccccnnnncnnnnnnnnnncctctnnnnncnnnnnnnnnnnnnctcctgncnnnnnnnnnnnnnnnnttnnnnntcccannnnnntnnnncttcccgannnntcttctctgcnnnnnnnccnnntnnnnnnntcnnnntcccannnccccatctnnnnnnnnnnnnnacttctcnntnncctcccnnnnnnccatctctttcnnnnntnnnnctnnnnnccnnnnnnnnnnnnnnnnnnnnnnnnnnccnngncacgctcannnnnnnnnnnnnnnnnnnnnnnnnnnnnnnnnnnnnnnnnnnnnnntcggnnnnnnnnnnnnnnnnccntnnnnnnnnncgcannnnnnntnnnnnnnnnnnnnnnnnnnccnnncgnnncccc

SEQ ID NO: 2801 - DNA, 391 bp, Glycine max
ctctttctaacgttgcttctcctctccgttatctccgccgtcaccccctgcccgccgtcagaacgggcagcactcttggccttcaaagctgccctgatcgaaccctacttgggcatcttcaacacatggtcgggcactgactgttgccggagctggtatggcgtcgcctgcgaccccaccactggccacgtcaccgacgtcagcctccgcggtgagtcccaagacccaatgttccagaagcttggccgctccggctacatgaccggaaaaatctcgccggagatttgtaaccttagcaacctcaccaccctagtcgtcgctgactggaaggccgtctccggcgagatccccgcctgcgtcgcctcgctttactctctccaaatcctggacc

SEQ ID NO: 2802 - DNA, 375 bp, Glycine max
aatgatgatgatatagcccctagacccagacgttctcagtctcggtcacgaggaggagaaagatgggatatgattcccaattatactccacaaagcaaatcagcgactgacacaaagtttttcagtctaaagtccttcaaagaaataggttgcagtgaatatatgattgaatccctccagaaactcttgttgagccggccttcccatgtacaggccatggcttttgcacctgttattagtggaaagacttgtgtcatagctgaccaaagtggttctggtaagacattagcttatctcgcaccaatcatccagctccttagactagaagagcttgaaggacgtagtagtaaatcctcttcacaagctcctagagtc

SEQ ID NO: 2803 - DNA, 369 bp, Glycine max
ggacctgctttttctaatgtgccagctcgagtgcaaccaccagtaccaccacgtaaagtgtgctgtgaaatttgtaaggttgagtgcaatagtccagaaatcttggagcaacacaaggttgggaggaaacatcagaagaatatgagggtgcatgaagaatcgcaaaggcgcaatgctataaatggacaacaaagtgggaaaattcctacctctcaattgaatttaacagaccaacctaaggaagttcaggagtccgagaaaaatgaatgccccacagaaaatatgggctcgggggttataatcaatagtcacaaggaggaaatgctgctgcagaataatgtaggaaacatttctgaggttccagctgaa

SEQ ID NO: 2804 - DNA, 595 bp, Glycine max
aatggtcagtatcctttgtttgtttttcctttctgtataatgatgttggatattgtaggtcatcatcatgatgttaaccatgcaacaactaaatatctagtccttgattttaatactttgttctgactaggcaaatgagagagtggtagagacttagtagttgacttatatgattttgttgtgaattaatcgattaaatactctctaacaggtttggatcctttgcaatgattgtggcaaaagttctcacgtgcagttccatcttgttgctcaaaagtgcttgaactgcaagtcctacaacacacgggaaacaagaggctgagcaagtggtaatggttatttataggaccacttttgctctcacttcattgctgtgtaggtgtagtggcaatccaagtgcatcctttattgaggaaaatgcatgtgggaattgtcatttaattgcaggcaggccgaaccacatccaagagaaaaacggtttatcacgttgatgtggtgtcgagggtagtgtagagtcagcaattgtcgtgttggttatttcgtgttggggaaacccttttagtgttccagtgttcactcctgtaatgtttgtttg

SEQ ID NO: 2805 - DNA, 350 bp, Glycine max
aggtgttccctgctttggaagcccttgaagatggtttgccaaatgagttgttgggacaggagggacccacaggacctaagctcaaaagaaattggcaaggtgatgaggtttgaaatggaagacttggagaatggtggcattattgacaccatgcaattaaaaaaggagactttaatttggttggtttgcactatctgttttgtatttttatagggttcacaacaaacatgtatttcttaataataactgacaaagttgtttcttgtttgtatttgcatgccagctttttcgggtgttcccacaacattaaaaagcatgtgatattgctcttcaaatagtaggtagatgga

SEQ ID NO: 2806 - DNA, 216 bp, Glycine max
taaaaataagcagtatgggcttagagttaccaaaaaagtctaattttactttcagtttttcaaccattttaggaactcagactaccattttacaaacttggtattgattcccacacggtttgatttctgtgaatccattgaaattcaagctaaggaatttaaatatcttgttgggtatcaacatacaagtggagtctctgttgaaaagaaaaaaaa

SEQ ID NO: 2807 - DNA, 877 bp, Glycine max
attcagcatcttcatcccatggtaaatgatttaacatcagttctaattttaagttcaatgtttttcataaaagagtgaaaggaaattctctgtaaatgtcgtttcccaggagatgttaggcttgccaatattagaaggaaccaatccagcgtcatattttccttctactgtcattggttatgaggcagcttgctacagtcgtatatggagtgaggtttgaataactcgctacttctttatgtgatacgtttgtcaaaaataataataatcagttttcattgcaagcttcttttaattttcaatcatccgtgggtagttttcttactttctgatcattgaatttgaaaaattaaaattgaagcctaaaatgtttcaggtttttgctgctgatatattcacctcaaagttctgcaacgatgtttcaaaccagcaagcgggcatgcaattcaggaacaaggtcagtgatgacaatgacattctgcttttcgcgcagaaatatattaaccgtctgtttatatgtccctttaaaaatgggagtggaaaattcagcattaaatttataaaaaaattgtaaaaaaagaaatccattcctaaattttccatttccagtcatacatacggtgttctaattgtttgttcttggtaataacgatcgcatgcagcaatatattggtttgttaaagaaaatttcagagattgcgattgtaaatttagtagtgcttatttgcatacttgatttaaaacaattgcaggtattggcctcggcaggagtgaaagaccccattgatgtgttatcagactttctaggaagagaaccatcaatccaagcttacattgagaacaaagtcaagtatgttttgtaaggcttttggccgga

SEQ ID NO: 2808 - DNA, 354 bp, Glycine max
cacagtttgagttagagttggatggacatggaatggtgcctataagaatcagagaaagagaaaggatccacaacattaggttgaagaggaaaaagttggaggacattccggaggaaaccgagcttcctattgatactaatccagcagagcttgaagaagcgagccttcacttggaaacagatttggaaatactgagccgagccatggatatgggactttgggcactctgcctcggtttcggctatatcctttccagagctcactttcgcccactttcttgacaaaaattcgttcaattattatgtacctcgcaaatagcaaatgtttttgcgaaacagtcgtaggccttaattg

SEQ ID NO: 2809 - DNA, 757 bp, Glycine max
  misc_feature (67)..(69): n is a, c, g, or t
  misc_feature (71)..(71): n is a, c, g, or t
aatgttaagatagagtacaaatattgatgtgcttatcagggattattcagcatcaactgatttagtnnntntggactggaagaaaatgaagattccggcagttcttccttcttcagagcatgcatggttgttcaagttgatgcaaccaatgaaggtgatttttccccctttgaaggattcataaagcagaggttgttcttaactgtggaaatttaatcatgagaatgagttgtcacagatctgcttcttgagcatacagtcatgaaagcttttgttgtcaaggaatccttaaatttaatagcttaagatgctgagagaaaatgtatgaatttctgatattaggccataattgttattgttcaggcactcctacaagcaaaagaagatttacagtcagtggggaaagaaattacagatggtgaactagctgatgcaacaaacatgagcattattcaagtaaggaaagctatagaggttggccgagctgcaagaaacaagctcataaaggtaacatggaatgttcaactcttattttagattggcttataagaagccttcgaagatcagtgatatatgacatctccgttcctttttcttctctctctttgtctctttggatatgaatggtttaattgttgcagtgtttgttgctattctttggaatgagtattagttatactgagattaagaaaccattgtgatgtcggttgcagcacaatctccggcttgtgttgttcgtgattagcaaatattttca

SEQ ID NO: 2810 - DNA, 1143 bp, Glycine max
  misc_feature (1090)..(1092): n is a, c, g, or t
  misc_feature (1134)..(1136): n is a, c, g, or t
  misc_feature (1139)..(1140): n is a, c, g, or t
gtctcttttaattgaatatctctgatctaattgaacatgtttttttcttttggtttacagcaaaggagcatgtagaggggtggtatagcactggtccaaagctgcgagaaaatgaccttgacattcatggcttatttaatgagtatgtttgttgctccaaatttctctgtataatgatttttaattgctgtgtgtactgtgtattcttcactttatttgagcattaatatttcacacttttgctgaaaaataatatagtggattggcttggcaaattctttatcctcgtcaatatagttgtcataaattgattgaaacttcatactaggtgttactcttattctctttgcctctttatgtctttaacattttcatctgtagttttgtgtacctgatcaatctttatccatattaatcaagcttaaaactgttgcagctatgttccaaatcctgtcttggttataattgatgttgaacctaaggaattgggaatcccaacaaaagcatattatgctgttgaagaggttaaagaggtacaaattaagtccttcatatctttgatagaattcttatatttctgttcttgctgttattttgcaaaagtaatcctgctgcatgtgatagtgggaggggagctagtgtttgctcaacactaaattagtattcaaagaaactgacatatagtttattctgtgtacagaatgccactcaaaaaagtcaaaaggtgtttgtgcatgtgccatcagagattgctgctcatgaagttgaggaaataggtatttcatgccattcaatgtaaaactgatgtttttcttcttatgttttgtttatattttgtttgattcaaaatttctatatgaaaattctgaattttatccatacaattgtgtaaccagcttctcctgttttttttaattcttcttacctttgtgcaggagtggaacacttgcttagagatgtgaaggatacaaccattagcacccttgccacagaggtttcatttgtcccttttaactcataacttatccttattaattcctttccctttgtactctttagtcttgttacttttatattttatgttttttcnnntgtaatacttttgtaattcttttaagcgaaatgaactgactnnntgnngaa

SEQ ID NO: 2811 - DNA, 372 bp, Glycine max
tggtgtgggcaaggtgttttgaagaattttacaagatcttcgggggatgttgcagagacaaagatagcagctgattggaaaggtggagaaaattgcccaaagggtacacgtcctgaggaaattgatgcatctggggatgtaaacatggaggcatcaataacacctgatgatgttattcgggctggaggatttggtgccagggatgatatcagtagctttcttcctgttgcaagtgattctaccgacttcgaagcttcaatccgagatgcacgagattatgaagaaccacagggtcaagtaagcaggcccggccttggttggactggtgctactaagggggaatgaatgttgttgctgttatgtgctccagta

SEQ ID NO: 2812 - DNA, 744 bp, Glycine max
actcctcttattctcaggttcatctccctctctcatgctctagtctccttgttatatcgtatgaatttgttgctttactctttagctgtttattcatatcattattgtgttcaatgaattttcgaatgttagtcagtattctcagtcaagtttcctttccatcgcagcaatatgaaccttgctatggtgtttgaatttttaaactaattggtctggttcacttcatgttaacaatatgtggtcctcttctgcgtatttgtgagcagaacagaaaagagaagaagaaatggtgtcaggcgtgagagagataagctgtagcggagagccagtccttgacagtgatagcggggaggagttgatgcaggtacaagccggcatagacattgtcctcggcgatcttcctcgtcagtcccccggcacgctctatatcactaacaagtatgctctcctctcattcacaatttctttctctttgtatttgttgtgtgctctatttacactttggtctaacttacaattacatacaggcaagtaatatggttgagtgatttagacaagactaaaggatatgccgttgattttttgtctatctctctccatgcagtctctagagaccctgaagcctatcctcttccttgtttatatacccaggtacctgtcctaattctattcttttcccatattttccctccattcatctttctcattcgttgctcttcttcctccagattgatacaggaaaaa

SEQ ID NO: 2813 - DNA, 706 bp, Glycine max
ctctgcagatgctgaactgaccctgatgcaaaactcgtgttgtcttgtaagaggtaatcattatgcttgcacagcttgttatttaatatacatgcatacttacaaatatataacacttctaggttgtgttgtgttattaatcattagttattctttttaattttaccagcatccagtatggggttgggatcttacatgctacccagaatgagtcaaaaagcctgaagaagtctcttaaggtgattgttatggagttttgctactttgattgtgggagatagtgacatgacatccagtagtttgttccgaacttactgcttggaagttattctgttgatagagtttaatcaatttttttcacgaatgctgtgttttgaattatccctcttatgttttttgaaatcaggatgttgtaacagaaaacgagtttgaaaagaggcttttggctgatgttattccacctaacgacattggtgttactttcgatgatattggagctcttgaaaatgtcaaggatacattgaaggaattggttatgcttcctttacaaaggccagagctattttgtaaagggcaattaaccaaggtttgctctacagattaaaacacattctattgtttaacacgcattcctttgtgactattgacaggagaagttagattccattgttgtttgtttccttccctgcttttcactagttttttt

SEQ ID NO: 2814 - DNA, 567 bp, Glycine max
ctctacttggtctttgagtacatggacaccgatctcaagaaattcattcgctctttccgtcaaactggacaaaccgttccaccccaaaccatcaaaagcttgatgtaccagctttgcaagggcgttgctttctgccacggtcatgggatcttgcacaggtactctagttccctttcatttctctcacacctccttcgaatatcaattgatgaatctttcaatctttattattaagggacttgaaacctcacaatctcttgatggacccaaaaaccatgatgcttaaaattgctgatcttggactcgctcgagcatttactgtgccgattaagaaatatacacatgagatactaaccctgtggtatagagctcctgaagtcctcttgggtgctacccattactcaatggcggtggacatttggtccgtaggctgcatatttggtaagcttgtatgtgaggtagagggtttactaattctatttacatcccaattgtatgtgagtttgagggtttactaatgttatttgcatctaaattacagccgaacttgtcaccaaacaagcactc

SEQ ID NO: 2815 - DNA, 695 bp, Glycine max
caagaagtaagtgcacaaattcgggagaagacatcacacctccccggtgtttcggtaatctccttatcctttcctctctaaatcatgctcctaccatccaattgcaaccatgtaaattgatttatctgcacaaaatgagaaaagccttttatttacaatgtttactttctcctgcatcagattgcaatcatgggatgcattgtaaatggaccaggggagatggctgatgcagactttgggtatgtgggaggcactcccgggaagattgacctctatgttgggaaggtaacatgttctttatacccaagtactaaatcttaacaaactgaaaaagaaaaccaaacttgttttcaattttctatatatgctgaatggattttgacaacaagttgaatggaattattaccattacagactgtggtgaagcgtggaattgcaatggagcatgcaaccaatgccttgatcgatctaataaaagaacatggacgatgggtggaccctcctgccgaggagtaaaagcaagagcttaattttgagattggcattcaaggccatagtaagatgagcattgtcatatccaattattgtacacatgtaatataagataacactcaatgcttaagtttgagcctagttttaagttccttttgagaaagatcccaattaaagcttgttgtgaggaaatcgacagctag

SEQ ID NO: 2816 - DNA, 387 bp, Glycine max
gtgcaatttgttttgttgctggcgcgattttcggttactcgctcaggggacgagttaagcgttgggcttccaagattctcaagaagctcagctgaaactaacataattcaatgattctcattacaggtattcatttggttggaattcaccttcgtagatcaaatgtaaaagtacaatactactatcaattttgtgaaattcttagaggctccgttattgtgcttcatacggattttggaatgagtttgatggtcacagattcaattacttatgtacacaacggcttgttaatttctgctcggtgttatggtttttaacttcatttaactcagtttgctattacttcatatgtgaattatgatcatcttcttgttctcaggcattcac

SEQ ID NO: 2817 - DNA, 403 bp, Glycine max
gattgggcaccacaattggatattttgaagcacccatctattggtggttttgtgtctcattgtgggtggaactcattaatagagagtgtttcatgtggggtgccaataattggattgcctctttttgcagagcaaatgatgaatgctacaatgctaatggaggaagttggcaatgcaattcgagtagaggtgtcaccatctaccaacatggttggaagggaggagttatcaaaagcaataaggaagataatggatactgatgacaaagaaggatgtgtaatgagggaaagggctaaagagcttaagcaattagcagaaagagcttggtttcatgatagtccttcttatttagcactttcaaaaatcactcactcaaatggggtgtgataactcatttgtggtg

SEQ ID NO: 2818 - DNA, 633 bp, Glycine max
  misc_feature (588)..(588): n is a, c, g, or t
  misc_feature (604)..(604): n is a, c, g, or t
ggttctgacgcttccagacaagagcgaacccatctgatttgacaaatctggagaatagtttgatgaatcattcattgaatacaacatcttcaaagtattcaaaaactgttgtctatgttggacgtgaaggagaaggcatcattggtgcgattgccatatctgacactgtgcgtgaagatgctgaatctactataacaaggtatgtttattttgctgtatgtgtgtcctcaggatactagctatacccactcattttaggcaaataatatcaaagctgcttctgaccaaatgtgaagttggttcacttcactctcttcagaaaaaggggcagtgctttttttttttggttcacgagctaggccttcatttcaagctcaaaactaacactgtggtgcatcgttttcctatgccatctgccaaattcaaatatgcttgtattctattgcttgatgtgtgcattttccggctgactttgttgcatctattgcaaggctcaagcagaaggggattaaaacagtcctcttgtcaggagacagggaagaggcagttgcaactgtagcagatacagttggaattgaaaatgatttntcaaaacatttttttncccccaaaaaaaatttggatttttttccc

SEQ ID NO: 2819 - DNA, 366 bp, Glycine max
aatttgctgctaagcatggagtgaagcctgatattgaggttattcccatagattatgtgaacactgcaatagagcgcctcgccaaagcagatgtgaaatatcgatttgtaattgacattggaaacacgttgaagccaagctcttgagtaaataaagaaatatgcatgcgtgattcagacttcagatactgaacgtacatggggcaagagataaagattgagaattgataataatttctttaagcattatatgtgttttccgtaatgagtttttgtttcaaggatttagctacgctattccttgataaataagcaattaagtgtggggtgtgcaattgcttaagcttggttataatccctttgggac

SEQ ID NO: 2820 - DNA, 523 bp, Glycine max
caaaagttgatattgtattgtttagtaccttcaggactaagatattagaaacatgtttataactcttttattgttgtctatcctccaaaggttcgagtttctgctgttcttacaaatgcaccattcatgttgaatctggattgtgatcactacgtcaataatagcaaggcagtcagagaggccatgtgctttttaatggaccccaaccttgggaagaagctgtgctatgtccaatttccacaaagatttgatggtattgatcgccacgatagatatgctaaccgaaacacggtgttctttgatgtaagtacaattcttctaatctccaacttcacaaatatgtgcaaatttcatttcactaagtgaccttgaaccgtttgtcttcaatgttgctttcatcatagatcaatatgaaagggcttgatgggattcaaggtccagtatatgttggtactggaactgtgttcaacaggcaggcattgtatggctatgatccaccagtatctgagaaaaggccaaagat

SEQ ID NO: 2821 - DNA, 540 bp, Glycine max
gcattgaggatgagcactaacactaacactcccaaacacgacgatatcgacgccattttcaaacaaaagcgctttcttcgaacgcaggtcagaaaaaccctcaagtccatcgatccctccctcaaatcccaccaaggtatcactcactatctatatctatgtctatttctattttttttatcgacaaatgttaattattagtattgttaattcttcttagcggattcaaattcgcacctattattctcttgtttcattattttcaagataacaccgttcaagacatagttttgggagctccgtggttcagatccagtcgcaggttgtgcgcgtacataagctgcgctgctcttcgcgaagtcgacacttcaaaaatcttgtcacagattttgcaacataatagtactactggtgcggcctcgcattttctgattctcaaattagatttttttttgcttttttttcatattatttgctttttcttagaaacctgttaaacatttttgaatatcatgcagatggaaaaaaactttatgtgcc

SEQ ID NO: 2822 - DNA, 319 bp, Glycine max
  misc_feature (306)..(306): n is a, c, g, or t
acattgagggcaagctgcagcctcctcttaacagtgtgcacattgtcaccgcgatccaaatccatacccagcacacaccctttctccgtctgcacgaacacgcgcctccgacccgctggttgcttcccatgatactctctcccaaggggactgctccttatcactgccacagccatctgagtctgcacagggctgtcgagtttccgagacatcaacagaacaacaaccacggcacacgacaacagcggaagaaagattcctcttcttccctcctcccaagtagttgtcaactacactgaaagcttngtaccaatgtctc

SEQ ID NO: 2823 - DNA, 555 bp, Glycine max
tgatttgatcccttgtatacctaggagacgaacagctagtagatataaccaccaagtaagaacaagtcccggcgttcttcatctgtttaagaaaaaaacaaaaaaataaagccttcaccatataaaaataacactaaagaaactgaaaaaagagaaagagagagaaataacaaaagggtttctgttttatattttggttcatgagaagaagtagttggctgtacctggatatagctgacattgaaggactcagcggcgtgaggcagaagagaaacagattcagtctctgagactgagagggtcaatccagaggccaagaagagcagaacaagaagaacctgtttgatcattttttttttcaattctgaaagctgaaactttagccaaaagaatttacaagaacataaagagtggagctgttggttggggaaaagaaaaaatgcgtaggtttggggtttggacgccttcgttgaaaattcaaccttttattgttgtgtgcgtaagtcataagacataggcaaaactcaataagggtaaatgtatctttaaggtccc

SEQ ID NO: 2824 - DNA, 376 bp, Glycine max
ctagtgagtgggaagccagaaggtatggagcaatggctgctagggttttgaaagatgtaaaaatatcttgattttgagagttggtcttggagatatattgtcatagtaaatacatcatgatatattagccacatgttttttttcgtattggttttaacaatctttaaagagagaattatgcgtaggttacactttagtgagcttttaatgagcgttaaacctttttcttaatacaaatttcttgagcatggatttcagaacccctgacagattaagagctagatgtaacactggaacgaagttagaatcatattatcggttacaataaatgtttctgcatcaaatggcacattgtaagtccgtttgcttgtggtag

SEQ ID NO: 2825 - DNA, 515 bp, Glycine max
  misc_feature (491)..(494): n is a, c, g, or t
cccgcccatccctccgccatgagttccggcgagctcctccacatacagccccaggagctgcagtttccctgtgagcctattcagattcaataaagattttcacttttctcttcaaaattcaatttttcggttttttttattcggtttctgtttctgggtcttgttctaatttcttgtttcttccttttttaatttttctgggttttgggtttgtgaaaatagttgaattgaggaagcagatctcgtgctctttgcagttgtctaacaagactgacaactatgtggctttcaaggtaccaattttactctttatgtttcttttctgattcacttctgagttttttttgttctgagtttttttttgttggtttaaaaattcatttttattccctttttttttgggggaagccgttttttcccccttcaatttttgggggtttgggaaacttgaaattttgatttgggggggcacttcatggttttgcaggtcnnnncaacaaatcctaaaaaatatt

SEQ ID NO: 2826 - DNA, 1060 bp, Glycine max
  misc_feature (995)..(997): n is a, c, g, or t
  misc_feature (1011)..(1015): n is a, c, g, or t
  misc_feature (1048)..(1053): n is a, c, g, or t
atgggtctgatgatgggatttatgctgattgttgtcttcctcatgcccaaattaatggagaacatgggtatgctttctaaaatttatctgcaaacttttctcatttcctgtgtcatgtctatatatgtatggctgtgcttgctttgtatgggtgaaatgtttacttatttacttcaggaaaagtttttgagattggtcctataccatagttgctatttgtgtttcttatcatatattaaaatatgaatatcaggttgaatcagaagcaccttcaagttgaattatctgaagcgacttctatctttctcagtttctccctccctctccattctcgaagaaaaaatttcttgcatgatgttttcttatgattgagtgatttgggtcataattgaatactttgcaatcctgcatgagctttgctattttatgttaatacatttacttgttaaaaaatcggccatgaattatgcatctttagcatgtttgaattaatttcatggtgagaagtaacgcaacaaatagttgcttttactttttcatggcatcaccatgatattgtgagttagcattgattcttgtgtgctatgttatccaaaaacactttttgggcttctactaattttttcatgcatggttatcaaacttgatgagtttatgaagaaaaacttgttaactaatcagtaactcccagttgatgaaaactcagataaactaggaaaaatgatgaaaatcttgttcaactttactcttttgcataaaatgtgctgatggcttcattgtattttcgtggacacagatccagaagaaatgaggcgtgcacaagaagaaatgagaaatcaaggagttccatctttagcaagcctgttacctggtgctgcaagaagcaactaggtgtatgagtaacggaaaaccagtgagcaagttggttacccccaagcaggagctgaaaaaatgacatacgatgattggagaattttcttgtgacaaattgatannngatggaaatctttnnnnntatttatgtagtgaattagtaaaaattgaattnnnnnnataggtt

SEQ ID NO: 2827 - DNA, 652 bp, Glycine max
  misc_feature (565)..(566): n is a, c, g, or t
  misc_feature (568)..(569): n is a, c, g, or t
  misc_feature (572)..(572): n is a, c, g, or t
  misc_feature (574)..(576): n is a, c, g, or t
  misc_feature (578)..(585): n is a, c, g, or t
  misc_feature (595)..(595): n is a, c, g, or t
  misc_feature (597)..(599): n is a, c, g, or t
  misc_feature (621)..(624): n is a, c, g, or t
  misc_feature (634)..(646): n is a, c, g, or t
ggagtgtagcatttttgtttgatttattcttttcacttatatgcttaattgtttttaactactgcctatctcaattttctgctaagaactaattgcctctgttttggtgacaaacctgtagcaaaacatgcaacgatttttcatcagcttgatgttctttttttgacatttgagtcttttataggccgatacagcagtttcagagagggaacagctgctgctgggcaaaatttcagaactccaatcccggttagttaatcagtttgtaaaatgctttcttggtaaaccctttctctctgactttaaaaagtttacctacatcttctgtcatgtgttaacaggatgattaatttgaccgacgaactgacttatgagaagttaagatatgtgcaggtaagtttctgtacaagcttttatatttcattatccgtgcaggattttgcttctgctattttattttcttgcttggattacatacatgttacgtccaacttggaatccatttaaattgaagttttaaaggtgtctgtaaaaactaaatatcaatctggttatcgcttttgannanntgnannnannnnnnnnctggtcctcntnnnccaggaaaaaaaatggggaaannnnaagaaatttnnnnnnnnnnnnnataatt

SEQ ID NO: 2828 - DNA, 270 bp, Glycine max
cactctctgctagacattcttggtgtcccagagccgatgagcatgtgaagtgaagaagtttctgtgttcataatcgtttccggatagattatatcttgtcacctctccttcatgaactagttaacgatttgtggagtcgattacattgtttggttggatattgtttctggtcaggttatccttgtgttatgtaccatgtttaacctttgtttcatcatatagctccaaagtaacatgtaaactttggtgaattggtgttgatacaaagca

SEQ ID NO: 2829 - DNA, 356 bp, Glycine max
attttgaatcaatgctgataagtgaaatgttgctgtggccatgacacttggttaccactccttacctgctcaagagcctcttcttgtccttttgttctggaaaaaaaggtcacacctttgtatagaaggcagaattggaaggatactcaagtaatgttttgttgccaactgctttttaagctgcttctaaaagtattattaaacaaataaatatgttgagttatttctgtacagaaaagaagtatatgtatctgactatatcggtgcttttaaaatgtacatttcttttctagtcttttttcctttatttgatgacttaaaactgtgagatgtacaatgatgatcctttccgttgg

SEQ ID NO: 2830 - DNA, 385 bp, Glycine max
  misc_feature (350)..(351): n is a, c, g, or t
ctccccaagccaaggcaatgaaatataccctcaaacaatgtgaatttgaatccatggaaggagagaccaagttctgtgccacttccctggagtccttgtttgattttgcacactatctgttcgggtccaatgcacaattcaaagttttgaccactgttcatctcacaaattcaacaaccctgctacagaactacacaatctcagaagtgaaagtgatttcagttccaaatgttatagggtgtcaccccatgccttacccttatgcagttttttactgccacagccagcatagtgacaccaatctctatgaggtgatggtagaaggtgagaatggagggagaagaagagtnngagaagcgttgattggtgcattggacccgaacag

SEQ ID NO: 2831 - DNA, 345 bp, Glycine max
aaccggggaggaaaatgagaaagtggtttttaatgcagactcagtattgtttgagtttgctgatggaagttggaaggaacgtggaaagggagaactgaaggttaatgttgccagtgaaaccaaaaaagccagacttcttatgaggtcaaagggaaattatagattgattttgaatgcacgactttaccctgatatgaagctcacaaatatggacaagaagggtgttacttttgcctgcctcaatagtgccagcgaagggaaaggtggtctttcaacatttgccttgaagttcaaggatggctccatagtggaggaatttaaagccgctgttatggaacacaaagg

SEQ ID NO: 2832 - DNA, 716 bp, Glycine max
  misc_feature (6)..(7): n is a, c, g, or t
gtgtcnnagtacgtgcataaattactatacaagttaatttgaggaatacaatatatttatattttatgtaaatgtgactttcttattattagatttcgatcttttaaaaaattgtgtctatagttacttgatgacgatgttatatgcttttcgttataccctgttacatgtacacatcaaaatgggtggtggtgtgacatgagtacttgcatgacatgctataaccaagtgactatgtaaagttttttttaaaaacaattatagagatgaaaaaaaagaatcaaaatcaaataagccatgtttagagtttaaaagcatgcccattcttaattagtgcagaggaatattatggtcattacttgtcatattaactaattttacataaatattcatttataacaggagctagttaaaatgtccgagggaaatgcagggaaaggaaagagaatcgccatcattggcgtctcaaccttattgttggtggctatggttgtggcggtcacaattggggtcaatctcaatgagaatggttccaacaatgatatagaggacaacaagaaaaatcatgttgcttcttccataaaagccgtccaaaccctttgtcatcccacaaattatgagaaagaatgcgaggaaagccttatagctggggctggaaataccacagatccaaaagaactcatcaaaattttcttcaacatcaccattacaaaaat

SEQ ID NO: 2833 - DNA, 342 bp, Glycine max
gttgagactaaaggattggaggctgaagttgctgagactaaaaatttggcagctgaatttgccgagctggaaatgctggaaatgccggatttgagtatgctgaatgtgccatccccatctgctgtcgctgctactgctgctgctccatctgagtttgaattggatttgttggcatttgttgattccgagtatggatttcatgatgagcatgactttgatgatgatcttgctgccctggaagactttcacatttgcggtttcgatgacaatgagcctagcgagcttcccgattacgattttgacgactttggtgctgatgagtttgctggttggattgaagaa

SEQ ID NO: 2834 - DNA, 381 bp, Glycine max
  misc_feature (376)..(376): n is a, c, g, or t
actgtattctagtgagtcacttgagcatgaccttcctggtcaccttctccgctaccccatcgggattgccagtgaaggagatgtcactgagctgccaggatttgaattcttccccgacaccaaggctcgcattcttggtggcaaagctgactacctcccccctatcctcactacttagtttgattttgtactttgttacaaacttgtgattgcttacatcctaatttgtgtttttattacactacttagtaataatcttaatatagtctgtgatgtcttgtggagatttttttttcttctatttttttgaagatgtcagtgacagattttagttatctgatggctttgactggtttctaaaatgagcaagagggcnagagg

SEQ ID NO: 2835 - DNA, 766 bp, Glycine max
gcagttgtagctaagaacataggccccaagcctgccactctaaccaatgctattctaagccattttagattcaagaaaagaggtgaaacagcaattcaaggcctcagaagctgctcatatattccacacgctcctccatcttctccctttcaaatcttgaccccatcagaagctaccatatctgagcctcctagatggttgtcctttggtaatgagcctgaagccaagcccggcacgtggggtcagcaagctttgtctattaccctccttgagaataagatgagtagagtttatgctgcgcctccaaaggaaagattaaaggcattctataacacccctccctccaagtatgaaaccattgatcaggttagaatgattaacaaagtgtaccctctaaccgaacatccaaattttgttgggtaaaatatgttttcggtaccaaaaaatattttgaaattcaagcttagttagttataaaaatttaatagtttagtcctaacatttgagggcaagcaaagttgtgcttgattactagttggtcatgcgtttgaatctagaaatacgtaaggataagactgttaaaaatattcgatttatgttaaaatgtaaggactaaaaacttactatatataggaactaaatataacattttgaaatattttgggggacaaacatattctatccaagaatttatttcatgcaccaaatttagtgaaagtttttattgaaaagattctgttggattttcagggacgtgggctttgct

SEQ ID NO: 2836 - DNA, 1008 bp, Glycine max
  misc_feature (599)..(600): n is a, c, g, or t
  misc_feature (606)..(607): n is a, c, g, or t
  misc_feature (676)..(676): n is a, c, g, or t
  misc_feature (696)..(696): n is a, c, g, or t
  misc_feature (702)..(702): n is a, c, g, or t
  misc_feature (747)..(747): n is a, c, g, or t
  misc_feature (765)..(765): n is a, c, g, or t
  misc_feature (798)..(798): n is a, c, g, or t
  misc_feature (934)..(935): n is a, c, g, or t
  misc_feature (985)..(990): n is a, c, g, or t
  misc_feature (992)..(994): n is a, c, g, or t
  misc_feature (997)..(1004): n is a, c, g, or t
ttactacttgtttggaggattagaaagagaatgaccaaatctttcattgtattgcaggtctctgcaactggaatgtcttttagtctcttagttgttgcaatcacattctacataaaggtaacaatatgttttattttgttgctctatacatatcatacactgttttattataatcatgtacgtgtctgctcatgtgtgtgggtaccacagcctctctgaacaatttaccacctttttttatgtttttttttcttctgaaatttgatcccaggctagtatatcaaaaacttcttccttgtatgggatattgagcaccttgtcgctggttggagtcgtggtatgtaaatccatgtaaatttattatgaaaataagatgtttttgactgcttgttccctaactattgcatcttaaacttccaattctttcaggccatggttattgcattctctcttggaatgggagctatgccatggattataatgtctgaggtaccatttttatggttttacattttaggcttttattcccaaagtataggaatatgcagcaacaatgatacatgtgacaatcttatgggtaaaacagtaatctcaagagnngatgtnntaccattttgaagatgaatcaatgctgcacaagtcactaacatctttttgcagatcatgtatttcatgnaaaaaaaattcttttgtatngttatnacagttgcatgtaacacaaattgtggaaatagaattagtagtgtncattattggttgcatttnaagtcgcagtcaaagttaatgtgttcaatatgncatatcacagattcttccaataatcattaaaggcctcgcgggaagtgtggcaacacttgccaactggttgttttcctggttggttacattgacagcaaatatgcttttggattggagctctggaggtttgtgtgcnntaatgcatgtatttacggtggatttttattttattttattttttagttannnnnnannnctnnnnnnnngttc

SEQ ID NO: 2837 - DNA, 518 bp, Glycine max
  misc_feature (409)..(410): n is a, c, g, or t
cgatccagctggcggaccaagtaaccaaagccgccgacgaagccagctccttcaagcaggaatgcggcgagctgaaggcgaagacggagaagctggcggcgctgctgcgtcaggcggctcgtgcgagttccgatctctacgagcgtcccacgcgccgcatcatcgacgaaacagaacacgtcctcgacaaggccctcgccttggccctcaagtgccgcggcaacgccctcatgaagcgcgtcttcaccctcaaccccggcgccgcgttccgcaaggtctccttgctcctcgagaactccatcggcgacgtctcctggctcctccgggtctccgccggagacggcggcggagactacatcggcgggctccctccgatagcgacgaacgagccgatcctctgcttcatctnnctcataaagacactcaccggatgacgaaatggacatttgggattcaagcaattgccactcaaccaataccgacagtccctaggattaacacgtgcatactcactatgg

SEQ ID NO: 2838 - DNA, 740 bp, Glycine max
acttttccttgctctctcaattccgttttctcttttaaatttgcatgtgtgcatatataatatttctctccatttgttcagttttgttctgatcaacttcactctaattaccgattactccgttcattctgcagtcgtgggttttgaaagtattgatccactgcgatggctgcaaaaggagagtcaagaaaattcttcagggaattgatggtatatatcactctctgcatttatacttcttttggcacatgacatagtatccattttatatagatatatctcaacttcaaattttgtaggtcttggtgatatctttatatatataatgattatcttaacatagaagtaactaatgatatgttaggaatataatagaaaaattaaaagaaaaaatactaatcatatgtttgtcaatggtataggggtttatacaacagaggttgattctctgcagcacaaggttactgtcactggtaacgtggacgctgagactctcatcaagaggctttcaagatcagggagggtagtggagctttggccagaaaaaccacctgagaagaaagataatcagaagtctgggaaatccaataaggggggtggtgatggtaataaagagaaggaagaccaaaagaatagtgaaccagatgctgatggtggtggttcaaatgagggttctaaagacgctcccggtgaagattctgacaaagaaggtcatagtgatgaatgtgaggaggggaatt

SEQ ID NO: 2839 - DNA, 667 bp, Glycine max
ctacaagaacagaaaacttccattaccaccaaacaactcccctgaacattaccatcataagaaggagtcagaccttgtcgttccaaccgataaactaaggtataatcaaattaccatgctatctttgagattaattggtatgagcttaaaattttttccattgtcaaacaatcagaaatcatctattgtgtgaattttaaaataattattattataaatttatgatacaggacgatttgtgattgaaagacattataaaaatctatacactatcaatatatgtattacttattctttatcttttgcatatcctgtggatgaaatgaaacacttaacttcagcttatgttttatcatctagtttcctgaatagagcctgtgttatcaaagatcgggaacaagaaatagcctcggatggttcagcatcaaatccatggaaactctgcacagtagatcaagtagaggaactaaaagccattattaaagtgattcccttgtggtctacagggatcatgatgtcagttaacattggaggctcatttggattgctgcaagctaagtccctggacagacacatcacctcacacttccaagtgccacctggctcttttagtgtagtcatggtacttacaatatttttatggatagctctctatgaccgagcccat

SEQ ID NO: 2840 - DNA, 714 bp, Glycine max
gattgagaggttggaagggatctacacgtttgggcaaccaagagttggagatgaagcatatgcacagtatatgagacaaaaattgagggaaaattctatcaggtattgcaggtttgtttattgcaatgacatagttccgaggttgccctatgatgataaggacttgctcttcaagcactttgggatctgccttttctttaacaggcgctatgaactcagggtacgtatgtttgtccattttaaaataaacttcatttgatttaagtgctgatcatcaaatcacgtatgtggctttgtgcatttgaatatctttaactagaggacaagatattgttttataagtatttttcaataaaatagaacaaatatttacaattaggtcaatgagaatataacacatgcagtatttgttacatgaacattgtgtatataggagtagaaataggtcgggataaacaagactttacttagtcgtaacttgtttaaaaaaattcaacgctttacttctctatattctgctaacttcattctttatattttccttaaacaatgaaattaatttattgcagattctcgaagaagagccgaataagaactatttctcgccatggtgtgtgatacccatgatgttcaatgctgttttggaactaataaggagctttaccatagcgtacaagaatggacctcactatagagaaggatgtttttatgaga

SEQ ID NO: 2841 - DNA, 394 bp, Glycine max
ataaaataaattaaaaatatctaaaaagaaaatttgcagtgcgagccctggcagcacacacatctttgtgtctcaaaaatggaacctattgacaaccatctcacctctttcttccaccaccaccagcagcaacaacaacaacaccagcaccagcaccagcatccgccgccgccgccgccgccgaccacggcgtcgccgaccaacggtctcttgccgaacgcggatgggtcccacatgctgtaccctcactcggtcgcgtccgcggtgtcgtcgcagcttgaaccggcgaagcggaagcgggggcggccgaggaagtacggcacgccggagcaagctctggccgcgaagaaagccgctacgacgtcgtctcagtcgttctctgcggacaagaaga

SEQ ID NO: 2842 - DNA, 327 bp, Glycine max
tgctcctcctttagctgcacaatcatgatttttatgaagaaacaaaatttacttttaatgaatgttttatctttttttgtcagtgtaaatcaaccatggtaagggaattgattgtcactttgtgaatatttctttgcaagacatcggtcatggtctcatggaagaaattgtattataatgtcacaatttttctgcttgttgactagctattctaaatgatggtaatcaaattatagttaggaacaggtactatcggcttattgacgtggaaaagaattgtgtggatttggaggggattttccttgcttatctctacaatgttttcat

SEQ ID NO: 2843 - DNA, 490 bp, Glycine max
tgatgagtattttttttctataatttttctccctgtcatccttgtactgtcccccatatacttttcaagtttcactaaaattgggcattgtgcacaacaggtcaatttttcatcccttgaaagcttggtagctaaaattcatgaagatcgaagagttgctgagagggctcttgatcttcccttatattcaagttttaagaatgattcgtatttgagaagctcttagtacaattttttttatcccttagcttcttgtcgaataaaaccctggtgttaattgttgtaagtgcaaaatccagttattcaactcgaaagcagtacgcatattataccctatgattcataatcatgccaatgcaatgtgatttggaacatgcataaagaaatactgaaaaaaaataagagtcattgtttgcattttactatctaagtgcctattggggattttgacctttaattgagttcctcacatatcttaaaggagatttgc

SEQ ID NO: 2844 - DNA, 388 bp, Glycine max
tggtcgcccgcatcgctcaccgcaccggcaagaaagcagagctctggccctacgtcccctacgacgtcgttgctcacccctacgcacccggagtctacgacaagaaagccccctccggttatgtccgcaacaccgatgatcctcactattcccatctcgcacgtgccagctccactgaggtccgctacaccactgctttcagcgacgaaaacccctccgcctgtgtcgttatgtgaaactattctctttatttgttatcttcgctttcattctatcttgtttttcagatcatgttgtattttttctctgttgaatgatactccttcgcctttacctacatctttctttcttccttcatagtctcactcacatctcgtttccagttaaa

SEQ ID NO: 2845 - DNA, 156 bp, Glycine max
ttagtctctaaactcatccaagctaaaaatcctgtgaaaaaggaaaaaaatcttggcattgaaaaacgtttacaaggatgcctatcatctaggcgaaggatcctgattatgaaactttatagaaatatgttgacatgtcccaccataaaaaaaaaa

SEQ ID NO: 2846 - DNA, 463 bp, Glycine max
gagatcgctctgcaacaatatttattctctcatgtcaaattatgcaaacgccaacggaaaaggaaacagcaacggcagttacaaaactaaaggcggcgccggtgtcgcgcacggaagtttagagtccggcatgacggcggtgaagctgctggatttgatgccggtgatgcgaagctccgatgaggacgcggcggagatggcgccggaggagatgaatccgaagctgtttggtgtggcgattggagcgaagcgagcgagagagggaggaggtggtggagattgtggaggtggaggagaggaagatacgctgctgcgcctgcatcacgcgggttctgcggacgtgaaatctgagccgttggatttccagaaccatcgcgagaatcagaaaacgccgtggttgagtccgtgttacaggacaaatcaaagagtgtgcaacaacaggacaaatcaaagagtgtgcaac

SEQ ID NO: 2847 - DNA, 644 bp, Glycine max
ttgcctccttcgtcttacctcctggtgcgcgcctctgtctctacgcagatcctacacgacgcgtcgttttctctctctgttttccccaatttcgggaaaccctaacttgattttgattcgctgtcgcaggttataggctgaaaagggaaggggggagagagagtgtttgcggcaatggaggaaccgagcaaactgaagcgtgccatgattgattccttggctggggcaatttctggtggaatatcacggactgttacatcgccccttgatgttattaagattcgattccaggtatgtattttgtttgtcacgttttttggttttaatccctctttaattatcagggttattcatgttgaaaacaacaggtccagctagagcccacatcttcatgggcattactacgcaaggatttggcttcagctacggctgcagcatcaaaatacactggtatgcttcaggcaaccaaggatattcttagagaagaaggcgtacaggtactggaaccaaccagattttccacccttttcagtttgtgattgtgtgtgtgtttttaaagctaatagtccttttttttctatcacttttttgcaggggttttggcggggaaatgtgccggcattgctcatggttatgccatatac

SEQ ID NO: 2848 - DNA, 546 bp, Glycine max
gtcggttggtttgggtttgggatgtgacccagtggtgggatccttggcttgttcgaagaagagagaatacagagtcaccaatcgccttcaagagggaaagcgccctctatacgccgtcattttcaacttcatcgactcccgctacttcaacgttttcgccactgttggcggcaatagggttactgtttatcaatgtctcgaaggaggagttattgctgttttgcaatcttatgtagacgaagatgtatgtcactcctctctctctctctctctctctttagttagctagggtttcatttctctagaaaactgcttctatttttacatgtttttatgtacacgccagaaggatgagtctttttacacagtgagttgggcatgcaatgttgatggcaccccatttgttgtggctggaggaatcaatggggtaatgcgagtcattgatgttggcagtgagaagatacacaaaggcaccccatttgttgtggctggaggaatcaatggggtcatgcgagtcattgatgttggcagcgagaagatacacaa

SEQ ID NO: 2849 - DNA, 693 bp, Glycine max
ataattggatctgctaatataaaccaaagatctatggctggtactaaagatactgagatagctatgggtgcatatcaaccccattacacgtggtcagcaaagaaaagacatccacatggccaggtttgtatttatccctaagcttttaattcttatagcaaattttctaattgtaaatctctttgtccagccgcaaatgacatgtgacaacctgagagcactctaatgagttcgaaatcacatgtcttatctaaattgattacataatgcatagtgattctaggtataagtagacctggaaaaatcacccttatcttttactgaatgtgaatgacttcctcccaaattattgaattacttaatgatctcatggataggtaaccaaataaaaatcattgttagtttaactttccacctatgtatctcttgtatggctgtacctctatgtactatgtctcttgggatattgatcaatgcctgaatggtgtgatgaacctcttagctgttgtgtgccaatataccatgtgatattatatatttattacattcgatggcttttgttcctgcagatttatggttacagaatgtcactttggggagagcatcttggcatgttagatgaaacttttgaagaaccagagagattggagtgtgtgcataaagtgaataaaattgcagacaacaattggaaat

SEQ ID NO: 2850 - DNA, 190 bp, Glycine max
tgataaagtaatgtaagaattagtaatgtgagtatatggctatgatgctcaagaaaccaaatggtttatatcactggtagtattctccattaagcaagaagtatacccatttccattgtttaagataccagttatttcgaatttacgttcctagggaagtatgttgccttgtactggatggcataacccg

SEQ ID NO: 2851 - DNA, 394 bp, Glycine max
gactgcctccgagtggtgctgtaggaccatcaaatgatgttgaagaaggagagattgattgatttgttccccttgattgttccattattttgaacggatatataaacggtatttctggggaacagttgctggacttagagatgctgcttttttgttgctacggggaacagttgctgaacaaataattacggtttgtatgtctgatgctggttcacacctaagtttgaagatgggatagcaaaaactagtggtaaacgagtgaagattggatttggttttggttctttctgattaattttggttttaacttgggaaatggtttctgaaaatgtggatagaaagctcgcagcccccatttattgaagaagggctttggtatcttggatggaaagta

SEQ ID NO: 2852 - DNA, 729 bp, Glycine max
tggtgatggagctcacaactgaccaaaacggtgctgcttaccaacactcacttcccgttcccgaggacaaagttcttgtccctggtacgctccctccctcacactctctctactctataaactctcatttctcaccttaatctttcttaagtcactctaatgttgcttctagtcgaggtaaccctaaaaccttcaagcacaactaaaatcgacgatgttggttccgccgttgaggggtaacccctttctcttcttcgccaaattggaaattaaatgtttttttgcctcaaattgtaattatctacgtcttctctgattctttaaatgtatttcttttgtagatgaagggatgcacaatgataatgttcttttgttctagcaagtcaagcctgttgtacatgcctttcaggtgatattgctgacttgattttattgcctttgtataggcctcagtctttattttccttggttaccatattctttttggcctaatatgttcattgaatatatgatctaatgagtatgtaaaaatatagatttagctcttctaaagtgaggagggttcactttagttagaaattaaagtacagttttaagttttaactattctttggaatgtgcagctctgatgttaatatttctttgtctgaattttgctttgttagcttagtgaggaagggccatgtgaggatataagctctgatgaccaatcttccagcttcaatgaat

SEQ ID NO: 2853 - DNA, 399 bp, Glycine max
aaggttttgaatatcaaaatacatgacaattcacaacaacaaaatgacttcaattgccaccaatagcactgttgtcgccactagaatgctagttgtgatcactttagtccttgcactagtatgttgtgtcacatccgcgcaatcaccggcagcagcaccagccccggagagcaacgggtgcttgatggcactaacaaacatgtcagattgcctgacatatgtggaggatgggagtaagttggcaaagcctgacaaagggtgttgccctgagttggcagggttgattgatagcaaccccatttgcttgtgtgagttgctaggaaaacctgactctattggcatcaagattgatttgaacaaagccctcaagcttccttctgtttgtggagtgaccactca

SEQ ID NO: 2854 - DNA, 1054 bp, Glycine max
  misc_feature (64)..(67): n is a, c, g, or t
  misc_feature (992)..(997): n is a, c, g, or t
cactttatgagcctctgatttctgtggtgaacccattgaagaagacaagggtagggaacccccnnnngtacaaattggttcccggtgccacagcagctagcctgctggatccagaagatccaccacagaaaagagcagcttttaccaacaaccaattatgggtcactccttacaacaaaagtgagcaatgggctggtggcttatttgtttaccagagcaaaggcgatgatactcttcaagtctggtccaacaggtcaacgattcttttcatgattctacctttcctttgccatggttcaattccaattgtataatcacggctgtcacatttgctaaaaaaaatcacttactgacaaaataacttcgaagggacgtctacaaagagtactaacaatacacatatatactttgaaatattttatgttcataatttttttaacgttttcttataatttttacattaaatatttatttttttagtttcttaaccaatacctttttctatcattgatttaaattcatgtaggaaataggtccacttaaaaggaaataagactcatatatttggtagaatctacataaaattttaactaattatagagtttattagaaagaatgtgagtatgtgatgaaagaagttattttgttaaatgaatctcacggatcacaatctcaagaaattagttgttgattctcaatcaataaatttcttgagttcatatcttgtctttgtcatgatcaattaaagggagaaaaaaaaatccgtgtactgaataaacttaggttccaactgatggaaaattaaattacttagatcaaatcaatcacttacatactgatagaaaattaggtataatatgactttgaatttggtgcctagcgaagacattgtattatattatcaatttattagattgttgtctgctgatattttaatatgcagggatcgtccaattgagaataaagacattgtgttgtggtacacaataggnnnnnntcatataccctgtcaagaggactaccctatcatgcctactgtatcatcaagtttgat

SEQ ID NO: 2855 - DNA, 381 bp, Glycine max
gttccaacttactgcatttgatatatactaatgagtatatgaatctgagagtgtctatgcttgattgaactagtgcaaaactaatgagtatatgagcatattttatttatactatatgtatgtgtagtggtgttccggcatgtatttctatagagcttagtcaaagtaagcatgagacgtttaagtaactgtaaatggcaatattatagagagcaatgcaaaatcattgtaaatggcattgtcattgagcaatgcaatgagtccatggcttaaatgcatattatattttctagcattacattcataaatacatatatggactgcattaaacaatatcacatatgacacctccaatagcttttattgaaagctgtcatgtgc

SEQ ID NO: 2856 - DNA, 730 bp, Glycine max
ccttcctcctgggtttttcttctctcctactgatgaagaacttgttcttcactttctctattgcaaggcttctctcattccatgccatcctaacatcatccccgatctccatccgtctcagcttgctccttgggaattaaatggtatgcttaatcaattaagtttcttctctcaattattacaatcattgtttaattttttaaaaattaatatacattgatcatacattatatgtctttgtttagtgacataactatacaagagaaaatagataatgcatataaaataattttatttagtgacataactatacattgatcattaattataataaataattatcttttataataactatgttaatagtcacaccgaattattttgtaattggttagagtaaaattaatgactttacattatgaagtgcataatcattaaccttactataaaatgagggggtatatatttaatatttacaggtaaggcgttgttaagtggaaatcagtactatttctttaccaaagtgaatgaaaacagagccagagaaaatgggtattggaaggacacaggtgtcacggaacctatattgtcaacctttgataagaaagtgggaatgaagaagtacttggtgttccacataggtgaagctccacaaggtactgaaaccagttgggtaatgcaagaatattatatatgttcctctgggtttgacactgcctcatatcgaagt

SEQ ID NO: 2857 - DNA, 446 bp, Glycine max
tgttgttaggataattgaccacggtagcaccgaagagctatctgaatcgttgtttgtcccgcaagaaacggatgttgaggagaatattcgtgcctctttggctgggatggagtccatatatgagttgaccaagattgttgttcagaaagctaaggatgtgcttgaggagaaggatcgtgagattaagagtttacatgagacgttggctcggttagttagggagaaggatcaaattggttcttttcttaggagtgctttgtctaagagggtggcagttgatccgtcttctagaaagagtgagctgtttcaagctgcagagaatgggttgagagaggctggaatagatttcaaattcagtaagcttcttggagatgggaaagttgcagcttcaaatgacaagtctgatacaacggaaaaagaagaggatgaaatatactccctggctg

SEQ ID NO: 2858 - DNA, 606 bp, Glycine max
  misc_feature (366)..(368): n is a, c, g, or t
  misc_feature (540)..(544): n is a, c, g, or t
  misc_feature (551)..(554): n is a, c, g, or t
  misc_feature (556)..(559): n is a, c, g, or t
  misc_feature (562)..(565): n is a, c, g, or t
  misc_feature (569)..(578): n is a, c, g, or t
attgaagaaattccaactgctgccaagtcttttgagaaggtaacaaaggaagctgcatcaagcacagaagagaaaagccataatggggtggagaatgcacctaaggctgttgatgctggcgctgagattcactaaaacctgaaatctgaatgagagccatgaacaatttgaaacattgtagagtttcagattgttctttggttcatcccaaccgaatcattgtgtgagatttcccaactgcattttcctcgtgttattttttttcatatatagtttgaagaaccaattttttgttcttgtcaagtcactttttttctatcctatcattgcttatctgtattggtaggtcaaattcaccaaaaatannnataagcaatgataggatagaaaaaaagtgacttgacaagaacaaaaaattggttcttcaaactatatatgaaaaaaaataacacgaggaaaatgcagttgggaaatctcacacaatgattcggttgggatgaaccaaagaacaatctgaaactctacaatgtttcaaattgnnnnnttctcannnngnnnnttnnnnaatnnnnnnnnnntcaacagccttaggtgcattctccaccc

SEQ ID NO: 2859 - DNA, 721 bp, Glycine max
tgaaatgagtgaaagaaaacttgagaccagctctttccgttgcaacagatgaaatgagtatcataagaacaaaaacgcctaaaagtttccccattcaaattagatattaattcaatcaagtaggcattagaaaaaaagaaaatcaaataggcattttttttcatacctaaaacattctagatagcgcccaactgtcttaagaatgatatccctaggaagactgtttattacaccgtgtaggaacaatattcccccatgaaaagcaatgactacatatttggatgcttcatatccaccaccatttttgccaccggtgcttagcagaatgataacctgatgaattagttgtgcaagtaaaaaatccacacttgttgtggctgcccactgcaaatgaaaaggagttaaaagttaatgtttcaaatagattattaattagaaatgtacatcttacacaagatgttaaaattctagaagatttgatttctcaagaatacctggcaatgatattgaacctgcaaaaaaagaaaaaccatgcaacacgcgtcagagaatggcagtgtattttgtgattagactttgattaagctatgaaaatgagcaattaatatatgttagtatatatgattttggaatatggatgcaatagctaccaaccagtgatccaggagacaaagggtgcccatctagggcaccctagtttggcactccaataataaagccc

SEQ ID NO: 2860 - DNA, 856 bp, Glycine max
  misc_feature (813)..(818): n is a, c, g, or t
gagaggatttctcgaaacttcgtgaaaactcgcacgcctactcaggtcgctagtcacgctcagaagtacttcctccgccgccacaaccagaaccgccgtcgccggagatctagcctcttcgacatcaccacggatacggtacttttaattaatttcattttcttctcctctcactaaaaaaaggggaaataaaaactaaaaactaatgagaaaataatttatagatactttttttaaaaaaataagttgttaaaaatgttgtggctctaaaatgaatatcaattttttttgtcattagattttatttactcatttactaatttattttaagctaaattagttaattgtttttcaaattatttaggaatttgtaagaaattttctaaattaaaaataataataattgaattcttgaatatgtaactatttttcaattgagtctcgataaatttttaaattatcataacttttaaaattgccataaattaatttcggaaacataccttttaatttataattacaaaaatttaatttacagatgtatttaattttttttcaaataatttagaaattaactgagtgatttaacatttattttatagtgcaaataataatatcaatatgattttagattgttgttaatagatctaattttaattgacttttattttggaatttcaggtgatggaatcttctactataatggaagaggaacaagttccgcaagaaacgatggcggcgcctatccccgccgcatatccgccttttcccggcgcgggttttccgatgagtctatctccggtggtgttgccnnnnnntggtgagagactgaccaagccgatcaggccgacgccga

SEQ ID NO: 2861 - DNA, 588 bp, Glycine max
tgctggaatctacaaaccaacagatgaacctccacatgttgaaggcgtatgttgaatattcttatattccccaattagcatttgtaaaactactatgccaatagcaattatataaaattgaagtgaaaatgcactgtggtgtaggatgttgttaaagcagatgctggtcatgttgaagtggagaaatacattgaagaaacctttggaagttgggcagtgttccggccacagtacatgattgggtctggcaacaataaagactgtgaggagtggttttttgacagtaaggggaactttctaaacaaactttattattagcttttaatactacatatgaatccttgtttcaataaataatcttttctagaaggatcaatactaaaaacaatgtgcaatgtcatatttgtagggattgttcgggacagacctgtgccaattcctggctcgggactgcaactcagtaacatagctcatgttagggacttgtcctcaatgcttactctagctgttgagaatccagaagctgcaaatcagaccattttcaactgcgtaagtgaccgtgcagtgactctagacggaatagccaaa

SEQ ID NO: 2862 - DNA, 597 bp, Glycine max
ctttcactgcattatcctttggtgctgttgctgcaactgtcaacaatttttggctccgaggttgtcttacagtcaaaggattgtggctctgattgggtggcgcattcatattctagtcatggtcaggatctgttctacataaacggcaatgtagtaaacaaagttgctttctgtgaggctctcaaattgtatattgcaaaggggtgtgatgtgaaggactactttggaagtgtcaaatgtgtgatggatgactcttttggtatggcaccttatgatattaatttgagtatggttatttgccaaagatagtttatgcacaattttttttgtagatttccacttttactattactatctttgagaatagcatttcttttaacctttgtatcggctcttattgtttgcagtgactttacctttaaaggcagggaggaaacttttgaaggatttgagcagtgaatccacaccacagagagattctaagcctatgtcatccaacgtagttgttattggtgcagggggagctttgttggtgtgttgtgctgttctttgtccttgtttctatgccaagagacgtaaagcaacttctcatgcagt

SEQ ID NO: 2863 - DNA, 384 bp, Glycine max
gcggttaggtcgttccctcctcaatcgcaaggactgacacgtgtcaaagtctacgacaccgacccagcagtgctccgggcactatccggatccggaatcagagtgacggttgatcttccaaaccagcaactcttcgcagcagccaaagctccctcctttgcatcctcatgggtcgaaaggaacgtcgccgcatactacccacacacccaaatcgaagccattgcggtcggcaacgaggttttcgtggacccacacaacaccaccaagttcctcgtacccgccatgaagaacatccaaaaagccctcaccaaacacaacctcgacaaagacattaaggtttcctcccccattgcactttccgcactagcaaactcttacccttcc

SEQ ID NO: 2864 - DNA, 517 bp, Glycine max
  misc_feature (406)..(408): n is a, c, g, or t
  misc_feature (410)..(414): n is a, c, g, or t
gcctccgcaaccgcaaccgccaccgcgcactgccaccatcctcggaaagtaccagctgacgcgcttcctcggccgtggcagcttcgccaaggtctaccaggggcgatccctcgtcgacggtgccgccgtggccatgaaaatcatcgacaaatcgaaaaccgttgacgccggcatggagccacgcataatccgcgagatcgacgccatgcgccgcctccaccaccaccctaacatcctcaaaatccacgaggtgctcgccaccaaaaccaagatccacctcgtcgtggagctcgccgccggcggcgagctcttcgccaaaatctcccgccgcggaaagcttccggagtccaccgcgcgccgctacttccagcagctcgtctcgatgattacctagcaggaaggtttnnnannnnntacaccaccaccatcatcataacctacatactctgatgtttcttctacacaacaagcaatctcttcactcaccaaaattattagcactctctcacctcttgca

SEQ ID NO: 2865 - DNA, 320 bp, Glycine max
gccttgctggactggctgttatgggccaaaatctagcactcaatattgctgagaaaggctttcccatttctgtttataaccgaaccacttccaaggttgatgagactgtagaacgagcaaaacaggaaggaaatcttccagtttatggctaccatgaccccgaagcttttgttcattccattcaaaagcctagggtgataataatgcttgttaaggctggggcacctgttgaccagaccattaagaccctatctgcatacatggaaaaaggtgactgcataattgatggtggtaacgaatggtacgagaacaccgaaaga

SEQ ID NO: 2866 - DNA, 413 bp, Glycine max
ggggggtgcacctacagtgttaaacatgataatcaattcatcacctaaagtccagaagccgcttccgggaaaggtccaagtgatgacaggtggtgcaccacctcctccggatgtgattttcaggatggaagaactaggatttaatgtgactcattcatatggtttgacagaaacttttggtccggcatcaatttgcacttggaaaccagaatgggacaatctgcctcaagatgcacaagcaaaactcaaggcacgtcaaggagtggcccatgttggaatggaaggcctagatgtgaaagatcctcacacaatgaagagtgtaccagctgatgcaaaaaccatgggtgaggtgatgttcaggggcaacactgtgatgaatggatatctgaaggacttgaaagcaacacaagaaa

SEQ ID NO: 2867 - DNA, 597 bp, Glycine max
attttataggtatttttattttctctcccttcttctccctctctcttcggatatcttaaataaattttccttgatgcaatattatatcttagaaaccacacattgtttattacacttagctattatcattttaattgtagccgaggcatatgggatgccaatgttgccagcctatttgaatctcaccaaaggacaagacattaagaaaggagtgaattttgcatacgctggttcaactgcacttgataaggattttttagtacaaaaaagaatcaatatagaggaagctactttttcattgagtgctcaatttgattggtttaaaggactcaaatcctccctttgtacaagcaaagaaggttttaccaaaacccctttaataatatttttgttgaatatttgaattttttttccaatatgactaacaattgttattcctttttatgatagagtgcgataattacttcaaaaactcattgtttctagtaggagagattggtgggaatgacatcaatgcactcatcccatataaaaatattacagaacttcgagaaatggttccatcaattgttgaaacaattgccaataccacctcta

SEQ ID NO: 2868 - DNA, 386 bp, Glycine max
aagtatctcttccgagtattcgtggcgtaagagtgtgtggcgtgtcccctaccctcctcatattagagccctttttgaagatgaataattaaggggcaccaaaattaatggatgaagaaccaaaaggacagaaaataccgaccaaataagaccatatctttttctagatccattgttctgtttcagtgattgttgactctccaaggacttatgatgcacaaattccgagagactatcaatcctatatacagagcagacattgaaattaatttctgttccatgtaaattatatccaagtattgattcttgtggtggcagttattctgttggtacagttaatttcaccattattgagaaatgaggggttgatgctactgatcatgttc

SEQ ID NO: 2869 - DNA, 404 bp, Glycine max
ttctcaataatgatctatttgcattgtttcgggcgttacccttttttttatatttattttgtaaagggaacaatttttgcaagtgaaacttgttttttcatttgaggattttgtttagtatacctgctgtgcttatggacggtcttgtactgattcgttatgtcatcagcacaaaacataaacctaagctacatctaatgttgccaccatgaattttttgtgtgttccaattcatatgggaataacacttctgcattgtggcaaaagttataattactttctaatatcacaatctaaataatctttttcgagtcccatttaaggagttttaaatttgaagcctttttttggtttcacagaataattatgtatttttatggctaagctgtcagttatatttgcac

SEQ ID NO: 2870 - DNA, 678 bp, Glycine max
  misc_feature (57)..(57): n is a, c, g, or t
  misc_feature (605)..(607): n is a, c, g, or t
  misc_feature (611)..(611): n is a, c, g, or t
  misc_feature (642)..(643): n is a, c, g, or t
  misc_feature (664)..(665): n is a, c, g, or t
  misc_feature (667)..(671): n is a, c, g, or t
gagctcttctgagcaggtttaatcttgaagaagctttattttttattctcttgttcncctgcctgtcttggggattgtgttcctcaaatttttttcagtcttcctagaatttaaatttcaaagtaaagcatgttgagtgtgagagctggctggatctttttatatttttctgcggtgtgatttatcctggttacgttattatgctttttaatgcaagtttcattctattaaggatttttttttgtaatcttggttacctttgcccgttttcttgctgaaccttgtttgcaggaggactttaattcatggaatttctggaaactaccccctcctgccatagatatttgaaagggtcccatggatttttaggctcaattatgcagcctagatatgaatgggcgcaggcggtgctgctccaaaaattatatgggtaaatttatcagctctacataatctatccagactctaggatttagttttagtaattagatacttgatctattttgcataggtttttaactcaagtgtttcctctaatttaatcagaaactttataggtaaatatctttacaattttctagtatatgttcaatatttctcctggnnntgangtattgaagatattattaatataactaattnnttatatacttgcatgtcatgnngnnnnntgttttg

SEQ ID NO: 2871 - DNA, 196 bp, Glycine max
taggttctggtggagcttctgggacttcagatcgaagctttcttccacaatcaactatatatagttggagttgtgggcacttttccaaaccacttttaactgctgcagatgatagcgaagaggtatcagccagaagagaagagagggaaaaatttgcattggagcacatagcaaaatgccagcactctggtttgaa

SEQ ID NO: 2872 - DNA, 647 bp, Glycine max
ataaggatgacaaccccattgtgtttggaaccattcagacttatttgaaagatgccaaggagaggttgttgctcacaacaaaggcagcagaaaaaatgggagttccattggggttcaaattggttagaggtgcctacatgtccacagagagtaaattggctgagtcatttgggtatgcatccccaattcacaataccattcaagaaacacacaattgcttcaatggctgctcatcatttcttcttgagaagattgctaatggacccggttcaatttcagttgttcttgcaactcacaatattgaatcaggtacttaaagatgtacaattttcaagctcttcaatttcttatgattcataatagagttctatatgtagatccccaactaaccgaaaaccatcattatacgaatttcaacaacttaccatacatatctatatgtaatgtaattgaatgacagtataattaattagtgcattgaatatttacttttactaataagaaaatgtcttggctagcatttcaatttcaaatgactgatatgatgtgacaatgtggtatagggaaattggctgcagcaaaagcatatgaattgggggttggaaaggtaaaccacaagctagaatttgcacaactgtatggaatgt

SEQ ID NO: 2873 - DNA, 305 bp, Glycine max
gctggatgtggagtcctttgtctctgaactatgtggaggtttcaagcttctatcggacccggaaactggtttgatcacgagcgagagtctaaggacaaattcagctcttctgggcatggaagggatgagcaaggaggatgcagaggctatggttagacaaggtgatcttgatggagatggaaagcttaatgaaactgaattttgcatcctcatggtgaggcttagccctggaatgatggaagatgctgagtcatggctggagaaggcaattgatgaagagcttagcaagtcctcatcttagagat

SEQ ID NO: 2874 - DNA, 382 bp, Glycine max
aaaaggtgacggaccattctgatgacctttcaaaaggcattgcaattctggtggttgtgatggtgtgcactttcgtgtcttcctttgcatggtcttggggtcctcttgggtggcttatccccagtgagactttcccattggagactcgttccgctggtcagagtgtcaccgtttgtgttaacctgctcttcaccttcgtcattgcacaagccttcctctctatgctctgccacttcaagtttggcatcttcttgttcttctctggctgggtcctcgtcatgtctgtcttcgtgcttttcctgttgcccgagactaagaatgtccccatcgaagagatgaccgagagagtgtggaagcagcattggttctggaagaggtttat

SEQ ID NO: 2875 - DNA, 566 bp, Glycine max
atggactaaagtttccaagggtaagcatatatagaggtcaccctgtagttagaagagaaaaaggttcggtggaagctgggaagctaataaggttgcctgattcattagaggaactcaaaactattgcaggtaacatttcaaatttccatcaagtcagcattgaaattatgaaaatctccactaatcaaatttctaaccccatctgttattaaatggttgtctatataaattcaccaaaatagtatagtttttttaagtgtacattgtttgagaaagaaaatttgcaggtcttagtacactaaaatgtttttgtttgtatattgtatcttcttcaacaggtgaaaaatttgggtttgatgcaaaagatgcaatggtgacaaatgaagaaggagcagaaatagattccattgatgtgatcagagataatgacaaacttttttttgttgaataagctgagatgcgaaaatgtcaagtgtaaatatataatctcgcacaacagaattacttacaagtttcttttgtgttagtaattttgtcttcttcctgtagccataaagaagtggctt

SEQ ID NO: 2876 - DNA, 573 bp, Glycine max
ccttcaaatgtcagctgtaaatcagtcttttagggatcagggcatgaagtctattcaaactgcacaaccagcaccagatccatttggtttgcttggcctgttaagtgtgatcaggatgagtgatcctgacctgacatctcttgctcttggaattgatcttactacactggggttaaatttgaattcatcagaaaatcttcacaagacctttgggtctccatggactgatgaatcagctaagggagatccagagtttacagtgccacaatgttattttgccaaacagccacctgctctacatgtgagatttttacattatgttttataatttcatttccctattttcaaaccttttctttgggctaactttttattattgcatgatgcagcaaggttatttttccaagttttcggtggaaacattgttttacatattttataggtggcttaaaaatctgaatatcacttactttttcattgaattgcttgttattttataattaaatataaaaataatcttttttgcagcatgcccaaagatgaagcccaattatatgccgccagtgagcttta

SEQ ID NO: 2877 - DNA, 596 bp, Glycine max
acatcctaactgatatatctgtattctctatttcatgtctacaaaaacattgttaaatgcttactaggctgagtttatttttacaggttgaacccaaaaatcctgctgcgggttgtactgatgatacaaattcaaatgtaagtcatatatgagatgtttatatgccctatgttgttttgtttgatattatattttctttaaatatatactgactcggttaagttgtttttacagggtgaagctactaattctactgattaatcatactgatgattaggatgttcttcaggaaagtgtagccaatgtgaatagcactttgttaatatggtttgttgggaggctcatgtacttgttgatgatgtggagacttgtgagttgtgatagggtttatatcttgtgtcctgtgaatttctctcatgcactagcggatagttttgtaaatccttcaattgcaagtcttgcgcacccaaaatttgatggctaacttgcaagtagttgattcacatttgtgttaccttttaaaattgtatgttttgtctacagaaatttcgttgaatatggagcattgcaatgaattgggtcgtgtgtctaaacta

SEQ ID NO: 2878 - DNA, 379 bp, Glycine max
tggagtgaagggtctcgctgatttgaacctcgcaagtgttcctcaccaatacattcaacccctccaagccagattagaccacaccaaaattgtccctcagaaatcaatacccatcattgatttcacaaaatgggaagacccagatgtccaagattccatctttgatgctgcaaccaagtggggtttcttccaaattgtgaaccatgggataccctctgaggttcttgacgatctcaaggatgctgtgcacaggttctttgaattgccagctgaggaaaagcagtgtcttaaagagaactcaccccctgaagttgtcaggttggcctctagttttagcccctatgctgagtcggtgttggagtggaaagattatctgcaa

SEQ ID NO: 2879 - DNA, 715 bp, Glycine max
  misc_feature (564)..(566): n is a, c, g, or t
tctcgatgacagaaatgaacaatcctcagtctcccatgaaatctagtgcccttaactacatgactgtaaccaatcccagcaacatacccctcagtgctgttatgaaaatcatcaggaacatttgaagctaagatttcgattaaaacttggaaggatcgtgacagaagactggggcatatatttttcggaagttcagcaattatcacagcagggatttagaagctagacagtcttacacgttattgaaaaatatatcaacccgaagtgttgaaataaatgataaattcacattcatttgcagttattatgtacataataacaaggctaggttagttgaacctattaccacatgacagattcacaacattagcaaggtaacaaggttgattaattaattaatagctagctaaaactattcatttggtgtgcgcatttataaaaattgaatcgggtaattgagagtagtgctgtataatcatgtaatttggcacctttctcttgttgtgtgtgtgtgtgaggcatatttgcctattttttgggtttgtaatcaataatgatgaatannngtggtggtgttgtagatggacaaggcttcgattatcaaggatgctattgagtacatccagcacttgcacgagcaagagaagattatccaagctgagataatggaacttgaatctgggatgccaagaaagagtccaagctatggttttga

SEQ ID NO: 2880 - DNA, 661 bp, Glycine max
  misc_feature (496)..(501): n is a, c, g, or t
  misc_feature (506)..(506): n is a, c, g, or t
  misc_feature (508)..(513): n is a, c, g, or t
  misc_feature (516)..(522): n is a, c, g, or t
  misc_feature (533)..(545): n is a, c, g, or t
  misc_feature (548)..(557): n is a, c, g, or t
  misc_feature (559)..(569): n is a, c, g, or t
  misc_feature (571)..(576): n is a, c, g, or t
  misc_feature (579)..(582): n is a, c, g, or t
  misc_feature (593)..(604): n is a, c, g, or t
  misc_feature (607)..(609): n is a, c, g, or t
  misc_feature (611)..(615): n is a, c, g, or t
  misc_feature (620)..(622): n is a, c, g, or t
  misc_feature (629)..(630): n is a, c, g, or t
  misc_feature (636)..(639): n is a, c, g, or t
  misc_feature (643)..(643): n is a, c, g, or t
  misc_feature (646)..(656): n is a, c, g, or t
ctaccccgccgtggaggccgccgcctcacggcctccgagctctggccaaactccttcgccaaagacgatgactttgacttggattactcccacatcgctacccaacaaccctccactctcaaaaggtcccaacctcccaaaggttagtcttgttcactaactcactcgctcattttcaccctgttaattttttaaacatgttaagatttttttctttttctactgtgattttgttcgaacagttagcgagcaggttgagaataagccggtgaagaggcagaggaagaatctctacagagggattcggcagcgtccgtggggcaaatgggccgcggagattcgcgatcctagaaaaggggttcgtgtctggttgggcacctttaacaccgcagaagaagccgcgagagcctacgatcgtgaagctcgaaaaatccgaggcaaaaaggctaaggtgaatttccccaacgaggacgacgaatattccattcaagaaaannnnnnaaacnannnnnntannnnnnnctaaattagannnnnnnnnnnnnacnnnnnnnnnntnnnnnnnnnnncnnnnnntcnnnnttctaacccannnnnnnnnnnncannncnnnnntatannnaaatatnncccctnnnntccnccnnnnnnnnnnncctcc

SEQ ID NO: 2881 - DNA, 401 bp, Glycine max
gctttccttgacaagtgatgccgagaatgatgtttctggcagtcaaccaattgcttgaagttcaaattgggtggttcaatctgtatatagacgtgttgtttcaacatgatttttgcgatacagactcaagtaccaatcacttctgctgaggagctatctttgcttactgaagaatattgcattcctgccatgtaccaattctcggtcttctagtgttagagcatatcggtaggatcgaagatggtattttgttttgactgggtgataacatattatagattatagaaaatggaaatgtcgtggcgaactatgcagtaccagttctctatttaaatactaaaacaatttagttaggtgatctagattttattttccatttatctcattcgatgtcttgatcc

SEQ ID NO: 2882 - DNA, 190 bp, Glycine max
ggactttaagttgcctgatcccatgtactacattagttgaggtctctagggctcttactagcatgttcctatgaataaaataagatgcatgttgtaataatggagagatcgacttaaaccaaggagcactcgttaattaattgctatgtatgtgactttgtgtgagacaaaaggtcacgtggtaagagac

SEQ ID NO: 2883 - DNA, 354 bp, Glycine max
  misc_feature (343)..(344): n is a, c, g, or t
gatttttatgtggacaagggtatagtacaaggactttacaactcatcacaggagataacagtagctgccctgaaacaaagaatggttcagcaagggatctaaactatgcttcatttgcactctttgtcccaccctacaactccaatagtgtaagtggcagttttaacaggactgttacaaatgttgggtcaccaaagtcaacatataaagctactgtgacttctcccaagggactgaaaattgaggtgaaccccagtgttctaccattcacttctcttaaccaaaagcaaacatttgtgctcacaattacgggaaaactaaaaggacctatagtttcaggctnntttggtttgg

SEQ ID NO: 2884 - DNA, 403 bp, Glycine max
  misc_feature (331)..(331): n is a, c, g, or t
  misc_feature (361)..(363): n is a, c, g, or t
  misc_feature (365)..(367): n is a, c, g, or t
  misc_feature (394)..(396): n is a, c, g, or t
  misc_feature (398)..(399): n is a, c, g, or t
cctctgacaccctgcatgtgtagagcctgattacagcaattttatcgataacaatgggactttactcaagatgcatttgggagaaatatgccatctaagttatgaattctatctatctacagggtaaacgacggaatctgggctcctgtcaatgcaagctttgaggtaggaggggcagtaaatagaaatttgaagcagtgatattggcttgaagggaatgagattggactgttggttatcactttaatgaacagatttcctattctgagtattctctttgccgagaccaggtggattttgtcttttcgtctaacttgtagcaattcccacnaaagtaaaaatacaaggccaaaaagaaggnnnannncaaaagggataaatatcagatggccannncnnccaa

SEQ ID NO: 2885 - DNA, 374 bp, Glycine max
atctcactgaatggacaactctatgcattaggttgcccggatggatgcaagctcactgtatatgatagagcaacagattcatggaaaaagcttattgatagcaagcttcacgtggataaatttccatctctagtagctgttgcacctgtttcccttaatggaaagctctgcattatccgccacaatatgagcatcagtttagttgatgtttcaagtcctaaccaacaactggaaagcaatcctcaggacctttgggaaaatattgctggaaaagctcagcacattcgcaggtctttagttagaaagttatggtcaactatagcaaggcgtgatttttccaagagttgcattgtttgctgtcaggtgctacaagc

SEQ ID NO: 2886 - DNA, 374 bp, Glycine max
agtgtggttggccatcgactatagcataaactgaggacattagcgcacctcgacgaaaaaaggtagtaatattgatcaaagcaccattaatataataataccatttagggatacatagatgatagatccaatggtctaataaagtagaacaagcatacaagatgaattatggatcaggggcgatgggggcagaaggtgaggaaatagttagctttggtgcaagtagcaatgctggtggggtcatcataggcataggagtaggccttggggcatgcggtcttgaagatcttggaatagacggtgggcttgcaggcctgtgggcttccataggagccggtgcagcagtacttgggggagttgaaagcggagcaaga

SEQ ID NO: 2887 - DNA, 215 bp, Glycine max
tttgagcagaagctttagatgattctcatgaagcaaggaacactgctgctgttgttaacgagctgtccaaggaaataacaaaaattttggtttctcatcctgtgaatgctaaacgtgctgcagaagggaagaacatagcaaatgtagtccttttaagaggctgtggcattcgaattgaggtctgttttttcagtttatttcttaattgatacatt

SEQ ID NO: 2888 - DNA, 1126 bp, Glycine max
  misc_feature (62)..(65): n is a, c, g, or t
  misc_feature (1057)..(1064): n is a, c, g, or t
ctgatcctcaaatcgctgtctgtactaagttcctgaatggtttatgttctactcccaactgnnnnttgacacataaggttttttatatatggggtcctacaaattgaatatggtctcctgcatttactgatctgtctaaagtctgaggttaattgatttttttatgcaggttattccagagagaatgccagattgttcttatttcttgcaaggtgcgtcttatatagacagcagtctttcatcaagtgaataatatgaaaatgtgattctaacatgtttcatggcaggcttatgctcaaatagaaattgtccatatagacatgtcaatgtgaaccccaaggcatctatttgtgaaggatttctcaaggggtattgtgctgatgggaatgaggtattaaccaaccatgtttaatttactattgagtgactggataatttgaatacttgaactttttaccgtttttcttttaccataatttaagtaaatcaatttatgtgcatatgaatgctcatcacattttcataattcaagaaaagggtgtacaatcgggtgtttcatcatacttgtggtgattgataattctgatgatgttctgtaatattgatcaatcttttatttgtcaaattataatcccatgtctgctatttctactaaaagttccttcctctttggaaaacattttgctttgtttataactcctcatccacttgcttgcgctgcctgtttccttgtgatctaaccctaaaaaaatactaacgtaccctagtgctcggaggctcctcgttatgtgaaatttaaaaggggagggtaattgtatgcagtcttacccttgcatatgatgcaattaggctgtttttcagatccccatgaccaaccggtcaccaaagaacaactttaccgctgtgccagggctctccctcgcattcttccttgtgatctaaccctaatgcttgccaatttatgttctttcagtgtcggaagaagcacagctatgtctgtcctacttttgaagcaacaggaacctgtactcaaggaaccggatgcaaacttcatcannnnnnnnaacaaagcaagggaaagaaaaggaagagaactgcagatcagaacaacagtagagggcgtatt

SEQ ID NO: 2889 - DNA, 724 bp, Glycine max
  misc_feature (350)..(353): n is a, c, g, or t
  misc_feature (459)..(464): n is a, c, g, or t
  misc_feature (528)..(532): n is a, c, g, or t
  misc_feature (544)..(547): n is a, c, g, or t
  misc_feature (646)..(647): n is a, c, g, or t
  misc_feature (696)..(696): n is a, c, g, or t
tatcgtgcttctacaaaagtgctgtcaaactgcaagaggttggacccaggatgactcttcaactagttaaaattgagaagggactgtgttcgggtgaagttctcttcagcgaatatggtacatcgtcctacacattgacctcaattaaatttacttatatttgttgaaaaatctatgaaacccacaattggtttttttttttttttaaaaaaaaaattttttttgactttttttgaaaaaaaaaaaaaaaaaaaaccagggggaaaaaaatttttttttggaaaaaaaaaaaaaaaaaaaaaatccccccccggatttttttttcctttttcaccaaaatttttttgggnnnngcataaaaaatttttaaaatttgaaaccaaaaacccaaaaccaaaaaaaacccctttcttttttttttgttctaaaaaaaaaaaattgttaaaaaatttttgcccnnnnnntggttaaaaaaaaaaaaacccttcaaacccaattgtattttcccggaaaaaatttttttttccnnnnnaacctccaaaannnnaataattttttttttttttttcccctttaaaattgggaaaaccccctgggcatttttcccccaaattaaaaattccccagggagagcccctttttcaannaattttttttttttgaaaaaaatttttttaaaaccctttttgtttggtnaaaaaggttaattcggccccccccaaaa

SEQ ID NO: 2890 - DNA, 401 bp, Glycine max
  misc_feature (396)..(396): n is a, c, g, or t
gaagaggaaaaaccacaagcagacgagacaagtgatgagaaaaaagtggaagaaaaacaagctgagactgctgctaaagaggaagagaaacctgctgaaccagcagaaccaccaaagccttgaaaatttcgttctgaacagaagctatatatatgtagctgcttcatgaagatgcagaagatcatatacgtgcattcttagtttgcatatagtccaaaattgtcacataccattcccttattcttttattcctgtgtaaaattggttttgtgctgcttagtttgatattgttgcagatttggtgattgatatgcatgtcaattaatgtttttatgatgaatcgttttgtaatattattcatttttcagtcaaggaattgtgacgtttagttgggtntcatc

SEQ ID NO: 2891 - DNA, 346 bp, Glycine max
ggacgacctcatcgccaagcagatgcgcgtcacgcgccaggagaatccacactgcgagctcgtctccttcgaccgcgactgcgccaacgcgttccagcactacgtcaacgacactctcgccttcgccgtcaagcgcggggggttcatgtacggcaccgtttcggaggtgggaaaggtcgaggtggacttcatctacgagcctccgcagcagggttcggaggacaatctcgtctttttcagggacccagaagaggagaagtttgttgaagctattgcggtggggttggggatgaggaaggttgggtttattttcacgcagacgattactcaggataagaaggattac

SEQ ID NO: 2892 - DNA, 637 bp, Glycine max
cattctccggtgttcaaaacttctctgttcttcgcgggcgatggcttcaccgtctacgattgcaaaggtcaacttgtgttcagagttgactcttatgggcccgacacccgcgacagagacgaactcgttctcatggatcctaacggacgttgtctcctcaccgttcgtcgaaaggtacgaaatctattctctaatttcccttcttttaattaaggttgttctaaaacatgttgtttagttgatactagtattagtttttcgaaagcactttttagtacgaaatatttgattgattttgcaaagatgaattcaagtgggatattgataatttgatatggccattgtgttgctagtttgtatattatgtatggttaggtgatagtgggtgattcattgacttgcagaggccgagtttgcatcaacggtgggaaggcttcaaaggggagagaatggacggtgataaacccatcttcagcgtgaggagagcgtcgatcataggacggtcgcgtgcgagtttgacggtggagatgtacgacaacccaggtgaggagtaccagatcgatgggtgcttctcgcagcgttgctgcacggttttcaatgtgacgaaggaatcggtggctgagattcgtcgtaaagt

SEQ ID NO: 2893 - DNA, 319 bp, Glycine max
gacatcatcgtcgagccccccggcatcggctccactcaggacccctacaccggcgccgtccgccccgtcgtcttcatgtccggccgcgtcaacggccagtacatcatcgagggcctctcctccggattcatgttcgtccttggtggcatcggcatcattctcctcgacctcgccctcgatcgcaaccgcgcgaaatccgtcaaggtttcctacgcctccgccggcgtttcctccgtcgtgctagcttacgtcatgagcatgctcttcatccgcatcaagatccccgcttatcttagatgaataatggatccacgagatt

SEQ ID NO: 2894 - DNA, 365 bp, Glycine max
tctggaggtaattgattgccaatttggacttttggagtctctatttatatttaaatcgttttggaatactgtgggagtggcttcaatttgttgtttcgtcaattcatttacaaacacagtcatatatataggtttaccgtatacttgctgcttatgctagtgatttttccatgggtttattgaaccattggaatcatccatacggtttttttttttagtagttttcttctgattgagcgtgtttttgtcgtaagttgcattatgcaattggtttttttagctttcagaggacatctacatttgtctgaacatgttggtttgattctggtgcttttgcatatttgaggataaagcaatgattatgt

SEQ ID NO: 2895 - DNA, 439 bp, Glycine max
tagtgttgattcttcttccttttcttcttgtaaaaatgattcattttcctctaactacagcattgatacttgcaagatgtacaaaggggtaaggaagagaaaatggggcaaatgggtgtccgaaattcggcttcccaacagccgtgagcgcatatggttggggtcctatgacacccaagtgaaggcggccagagcatttgatgtggcactttattgcctacgtggcaaaagtgcgagtttcaactttcctgacacacctcgacacttggaaattaatatggtgttaccatgtgacatacaacaacaacctctctcccatccggagattcaagagatagcctcgaagtttgcgaacaacgaccacgtccctttggaggaggagagtgcttttcaagaacaagaacaagacccctcgatggagtcacaaagtgacgagtca

SEQ ID NO: 2896 - DNA, 389 bp, Glycine max
ccttatatccaggattaaggttcaatggcattcaggacgcaatagctccggagagttaaatatcaaggaagctatccaggcagctctccaaacttcagtcatggatgttttactgccggatccattgacatttggcttcaggcttgatagagatggttctgaatcaggaaaaccttattctgataaagattctgaattagttgaatctcctgcttccaaaggttctgtgattgcacatgaaatgacaccaatggaagttctggttcgcaataacaccaaggatatgatcaaaatgagtcttaatattacatgcagagatgtagctggggaaaattgtgtagatggtaccaaagcaactgttctatggactggtgagaggtgtctgatga

SEQ ID NO: 2897 - DNA, 296 bp, Glycine max
agtggtgccgattttgtttctaattagtgaggatattgtactcatgtaatttctttgatctgtgtacacacgtaatacaaataaaactgtcaaaatcatgttgatgctttcatttggtttacattttattcggtgatattaggccactcactttcgttgcttatgtgtgtaaaattttgacattttctaggcattagtttattcaattgttcaatgtcccgtgttgtaagaaaatggacaggtctggtaaagtttcataaattattgcgggtctatgcttatgtaaagaactcagg

SEQ ID NO: 2898 - DNA, 446 bp, Glycine max
  misc_feature (424)..(424): n is a, c, g, or t
  misc_feature (429)..(431): n is a, c, g, or t
  misc_feature (438)..(439): n is a, c, g, or t
ttttgttgtttgtgtgtttgttttttctctcacctgaaaatgtcttgctgcggtggtaactgtggttgcggaagcgcctgcaagtgcggcaacggctgcggagggtaagatttttgttgtgtcactgttgcttcacacttcgaaaaattgagtttttccgggaaaattttcttcttgggttttttatgggcttttttgggtacccttttggttgaattgcatgaaaaaattatgctttgtttattcttgcatgaggacattctgatcacctgaacctttgttctgctttacagaagtcagaacatgtcgattttataggtttttggggtgttttgcttggctttttgggtacctttttggtaaattttataaaaaaaaataatgttttttgttttattcttgcatgggtttctacgagagagtngtatnnncaagttnntgggggg

SEQ ID NO: 2899 - DNA, 324 bp, Glycine max
cagcttccacgaccgcagaccaggatgcagtcagaacaaggataatcaagctcaatgacaagctcaagaaactcaattcctactcctcattcctcaatatcctcaatctcatgtctcttacttggcatctcgtttatttggctcaacgacttccccatatttgctaaaccaaatactacgttccttttgtcttttctactaatcacttgttttctgtgtttcttttctgtttctatcatgtttgttgatatttgcaaatacttcagtctctagatttttgtatcttttagctttgggaacaatacagtgtttaccactccctga

SEQ ID NO: 2900 - DNA, 384 bp, Glycine max
cattttttctccgatcccctattcctctccattctccgttgtgtcgatttttgttactcaaaagggaaattgatttgatagatagacagatagatcgtttctatgggttaaagtgaaatccgaatccgaatctgaatctgaatctgatccaatcattttcatgttagggcgtgcgatctccaatcaagcgcggttgtgtttaggtttcattttgttgggcgtgtgagtcgtagggggtttcgaagagcatagaataatgccttcggtgcccgttgatctccgtctagttccttctttgaccgttttccatggtggatcctcttttcatcgtctgaaaaatcttgaaaaaagtgatcggcgtggtaatcttagttaacaataaca

SEQ ID NO: 2901 - DNA, 522 bp, Glycine max
gagagctgcagctttaatgatgcgtgatcgaccaagttatgaacaaagggttaaaggtattgatcctttcctgtttttcattttctaaatatgaattagtttatgtgcactcctcctacgtctgcatcacagacttgctatgttttctttgcagtttttttattttgatcttcctttgtcagccacaatcaaattctaaaccaagagggacacttgaataaacatttttgacctctgggtagtagatgtagactgccatcactaaccaaattggatgtgaataactgcttgaatgtgtcagtgcgtgtgcatgcattcactcaaaacactcaaacaattataagaacttcaattttaataattcttaacctcatttgattatcttatttagattattaacacaaattgctgctcttcttctattaactgcattatgaactttaacatttaaggtcttatctgctgatggaatcgacttcgttgacatctgctaccaatatcatgttactgtcttttatgata

SEQ ID NO: 2902 - DNA, 337 bp, Glycine max
cgcaaatggatattgcctcgttaattcctcaagaagaaagagaaggaatttgtgtcatgtaatgatctattatctattattggttgcagaaacagtatgtacatgacactttcttcttttggggatatgaattaggtatgttgttttaaattacttgttgtgattctcgtaatgtgatattattatggtaagaaattcatatataattttgtttcaataataaattttttactattgtagaaacttacactttgaggctgaagatttactcatatcgatactgcaaatactcattcaatttgaaagaatttgaggctgaagatctacttgtaacaaa

SEQ ID NO: 2903 - DNA, 386 bp, Glycine max
gtttggagaaaacggattggtcgaaagcacccttcatagcagcgtacaaggggtttcacatcgacgggtgcgaggcttcggtgaacgccaagttctgcgacacgcagggcaagaggtggtgggaccagcctgagttccgtgaccttgacgccgcccagtggcgtaggctcagatgggtgcgccagaaatacaccatctacaactactgcactgacactaaacgctatcctcatatctctcctcctgagtgcaaaagagaccgtgacatttaaatttcgagtgaatagatattttagtccgtgatatttaaatttctcattcactttattattgttgcttctcttttcatttttatcaccctgccacacattcacatttccacttcc

SEQ ID NO: 2904 - DNA, 1188 bp, Glycine max
  misc_feature (1088)..(1092): n is a, c, g, or t
  misc_feature (1122)..(1135): n is a, c, g, or t
accgcttccttacaccgtctttctcgtctccgattcatcgccaaaccccaacctttcctatctcctcattcaatcccctcccatttctctctcacccccaaaaccaaggttccaatttcgtgctttctttcattctcattcttatattcttatgttgtcaacgttctctatttttcttcgcagaaagcgaatcgattccgattcctctcaatggctgcggaacccaaggaatcgccttccaacaaccccggtctccatacaactcctgacgaagccaccaagggttacatcatgcaacaaactgtaagctagctttttctaatttactattatatattattgttattgtgtatttcaggagtttgatttctgactatttaactgtgatttcaattacagatgtttagaatcaaagaccccaaagtgagcctcgatttttattctcgagtcttgggcatgtcgtaagtttttttatttttttttcttcttttagatacaatacaacatttttcttttgtgttggttatttatttatttatttgttagtgcttgaaaatggacttgatcacttgaccttctataaaagtaatggaatttaattagaatatgacactatcatcccatctaggattggcatgtatagttgtaagtttttaatttttataataattttataataactattttagaagtcatatttggatatgttaaaatatctacactggcagtctattaaaattaaatttgaactaatatatttatgtctagctacaaattcttttttatttttgaatttcttcctcgctgtggatgctatgaatgctgatggcagtttgttggttggtttagtttgcttaagagattggattttccggagatgaagttcagcctgtacttcatgggctatgaggtatgatcaataattttggtggtgaaaattgaattggattatatatatgctgtgatggcaatattaaatcttttctaaatagttcttaacctttgatctttttctgacattttttgttgttgtttagaatacggcagaagctccaagtaatccaattgataaagtggtttggaccttnnnnnagaaggctacaattgaactgacacagtaannnnnnnnnnnnnntatatttcttatccttgtgtctcttatctaccagtaagataagtacagtaatg

SEQ ID NO: 2905 - DNA, 415 bp, Glycine max
  misc_feature (331)..(334): n is a, c, g, or t
  misc_feature (345)..(347): n is a, c, g, or t
  misc_feature (349)..(349): n is a, c, g, or t
ggaggtcatgaccaattaattgaagttgatttgagcactaactcgatcacatggtcaggagctaagctggtggctgaagctgttgtgggaaaaccaggttttaagttgcttaacattaatgctaacttcatttctgatgaagggattgatgagttgaaaaatatattcaaaaactcacctgatatgctgggtcctttggatgagaataatcctgatggagaagaccctgatgaggaggctgaagaagatgctgatcatgatgaattggaatcaaaactaaagggccttgacatttaggaagattcacaggaacaaacatgcaacctttacnnnngagcttcatcnnngnctcacagaacaaggaaattctatgcacagctttatgaagagtctcaaacttaaaaagtgggagcaa

SEQ ID NO: 2906 - DNA, 367 bp, Glycine max
ctacataagttgaattataggtcagtgtgatttatttgcagaacatgaactgattctgattccacttgaggatccagagctggccagcacatgatggggttgaaggggttaacaaagacagaaactgaggtagaggcagaacctcgtgtggatgtagcatgcttgtcaatatttttatttagtcaaaatgatgatgaagttggggtataatttgtgaagcccaattaaagcttcagaatggttgcagtgtcaatgatcatcatcaactgcaaatacccttttcagcaagttgtttaattttctgttgtaaccataagcagatttgtccaagaaaatttccttttatttgttcaatttgtgccatgtg

SEQ ID NO: 2907 - DNA, 366 bp, Glycine max
  misc_feature (297)..(299): n is a, c, g, or t
  misc_feature (304)..(305): n is a, c, g, or t
  misc_feature (321)..(323): n is a, c, g, or t
  misc_feature (356)..(360): n is a, c, g, or t
atcaacgttggattggccctattcgtcgtttcgcttctcgtcgttcccctccttgatgccttttacataaagggtcgggtcgggttttatagcgggttctacgtcaccgccggcgccgttggactttccggcgtggccgatgcgttggtgcagggctccattgttggctccgcgggcgagctgcccgataggtatatgcaagctgtcatcgccggcactgctgcttctggtatctatcgtctttctatcttagtaattagttactattattgcttctatttttgcgtttgtatttannncttgnngtggggttatttagtnnnatagaccttgcattgtttgcgtttatgctatannnnntactta

SEQ ID NO: 2908 - DNA, 971 bp, Glycine max
  misc_feature (909)..(912): n is a, c, g, or t
gcgaggtccacctacactctgtacattgtacaagtcactactttaatacatataatcaaacaatcaatatcatgtcttaaaatgcatacatttcaaacaattaagattggaacaacgaacataggaagcaagttatctaaaatcattcagcctttctttggcattgctgcaagtctcgtgtacattcttgccatggattgataccctctaacatcgcctgaacgcagaagatttcctataacaacaaatgaaaataagtgccagaaaaaaggtctcctttcatactggtcagcaaaattacaagttttacatgaaggtttaattacttattatcccacctgcacaatctttatatttgagtccctatgcctagaaactgcttgttcgtccctacacatacattttttaactcgttttagtctcaacaattatggacaacagagactaaatggattaaagagtgtatgtataaagattaaagtagtttttatgtgtagggaccaaatgagtaatattaaacctttcactaaaaaaaataaaaaatgagggcatatatttggaatgagctgatgacgtaaggatttgaagttctctgttttcccaataatactaaaatgctattgtagatagttttataatcaacaacaaaaatctagaaatatacatgtaaattcaaacaacacacagttaaagacaacaaatgaaacatcagattctagagcaccacctccccatccattctctcaagcatgactgataagcatgtggatgtataaaaattggcatattttttgcattttctcaatcctcatatccagcttcaatttggtcatcaataatcaaggtaacatatatattacgaattatgaaagagtatcatatgaattcaagtttctttttcttgcagtnnnntcttttgattccacacaactagagacaaatgagaaaacaatataaaggaagagagtaaa

SEQ ID NO: 2909 - DNA, 1028 bp, Glycine max
  misc_feature (453)..(455): n is a, c, g, or t
  misc_feature (480)..(487): n is a, c, g, or t
  misc_feature (489)..(490): n is a, c, g, or t
  misc_feature (492)..(492): n is a, c, g, or t
  misc_feature (495)..(496): n is a, c, g, or t
  misc_feature (538)..(542): n is a, c, g, or t
  misc_feature (554)..(555): n is a, c, g, or t
  misc_feature (560)..(565): n is a, c, g, or t
  misc_feature (571)..(579): n is a, c, g, or t
  misc_feature (587)..(600): n is a, c, g, or t
  misc_feature (603)..(604): n is a, c, g, or t
  misc_feature (606)..(613): n is a, c, g, or t
  misc_feature (615)..(616): n is a, c, g, or t
  misc_feature (623)..(624): n is a, c, g, or t
  misc_feature (627)..(631): n is a, c, g, or t
  misc_feature (633)..(641): n is a, c, g, or t
  misc_feature (645)..(648): n is a, c, g, or t
  misc_feature (650)..(661): n is a, c, g, or t
  misc_feature (664)..(669): n is a, c, g, or t
  misc_feature (678)..(693): n is a, c, g, or t
  misc_feature (696)..(705): n is a, c, g, or t
  misc_feature (707)..(715): n is a, c, g, or t
  misc_feature (717)..(717): n is a, c, g, or t
  misc_feature (719)..(719): n is a, c, g, or t
  misc_feature (722)..(734): n is a, c, g, or t
  misc_feature (736)..(736): n is a, c, g, or t
  misc_feature (738)..(739): n is a, c, g, or t
  misc_feature (741)..(743): n is a, c, g, or t
  misc_feature (745)..(748): n is a, c, g, or t
  misc_feature (756)..(772): n is a, c, g, or t
  misc_feature (774)..(782): n is a, c, g, or t
  misc_feature (784)..(784): n is a, c, g, or t
  misc_feature (787)..(792): n is a, c, g, or t
  misc_feature (797)..(798): n is a, c, g, or t
  misc_feature (805)..(811): n is a, c, g, or t
  misc_feature (817)..(823): n is a, c, g, or t
  misc_feature (830)..(835): n is a, c, g, or t
  misc_feature (837)..(837): n is a, c, g, or t
  misc_feature (840)..(858): n is a, c, g, or t
  misc_feature (860)..(865): n is a, c, g, or t
  misc_feature (868)..(870): n is a, c, g, or t
  misc_feature (872)..(874): n is a, c, g, or t
  misc_feature (876)..(879): n is a, c, g, or t
  misc_feature (882)..(883): n is a, c, g, or t
  misc_feature (885)..(889): n is a, c, g, or t
  misc_feature (891)..(897): n is a, c, g, or t
  misc_feature (899)..(902): n is a, c, g, or t
  misc_feature (909)..(910): n is a, c, g, or t
  misc_feature (918)..(920): n is a, c, g, or t
  misc_feature (937)..(939): n is a, c, g, or t
  misc_feature (941)..(942): n is a, c, g, or t
  misc_feature (944)..(951): n is a, c, g, or t
  misc_feature (955)..(956): n is a, c, g, or t
  misc_feature (968)..(970): n is a, c, g, or t
  misc_feature (975)..(980): n is a, c, g, or t
  misc_feature (990)..(1006): n is a, c, g, or t
  misc_feature (1018)..(1023): n is a, c, g, or t
aaggagagggcttggttagaaaccaattcagctggaacagaggtaactacctatctatctttttgaacaattttttgtttatacatatctattgttttcagtaatggtggtggtttcacttttagcataactttgagaatatgacacgctgattagcattgtgcacatatatatgagttgcagaagcgaatatgctctatttggaaacgccaattggagttggattctcttactcaactgatacttcctcttatgagggtgtgaatgacaaaattacgggcaagtttttaatgttcacccgtctctacttgacatcaccaactttctacttttttagtcgtcccttgaaataattctcaatttcattggtttgaatggtgattggtaaataaccattagatgcaagcattttcacatggctaaagaaagagtttctaaaggaagatccgggtnnnctttctttcttcttcattttccccnnnnnnnntnntnctnnctatctcccttttgcttttcttggttgttatctttacctttnnnnnaattctctcccnngttcnnnnnnttttgnnnnnnnnnttgcttannnnnnnnnnnnnnttnncnnnnnnnnanntttcttnncannnnngnnnnnnnnncctnnnnannnnnnnnnnnnttnnnnnncaaaaaaannnnnnnnnnnnnnnnttnnnnnnnnnncnnnnnnnnngnanaannnnnnnnnnnnncntnntnnncnnnngaaaaatnnnnnnnnnnnnnnnnntnnnnnnnnnanttnnnnnnaaaannaaaaccnnnnnnntttttnnnnnnnaaaaaannnnnncngannnnnnnnnnnnnnnnnnntnnnnnnttnnnannnannnnttnngnnnnnannnnnnnannnnggatttnntaaatttnnntttagggattttttttnnncnncnnnnnnnnaaannttctccccctannnaaaannnnnnaaaatatttnnnnnnnnnnnnnnnnngttggggggtannnnnnaaaaa

SEQ ID NO: 2910 - DNA, 538 bp, Glycine max
caactgatcataggtgcattggggattccagcgttccagcagctaactggcaataactccatcctcttctatgcccctgtcatttttcagagcttgggctttggtgccaatgcttcactgttttcatcttttattaccaatggggctcttcttgttgccactgtcatctcaatgtttttggttgacaagtatggtagaagaaaattctttctggaagctggctttgaaatgatatgctgcatggtaactacatgtttatattcctcgagtttgatagagctaatggaattgctaattggactttttgatttattctttgctttgcagattattacaggtgcagtcttggctgtgaactttgggcacggcaaagaaattgggaaaggagtgagtgcctttctggttgttgtgatcttcttgttcgttttggcatatgggagatcttggggtccccttgggtggttggttcccagtgagctcttcccattagagataagatcatctgcacagagtattgtggtctgtgtcaacatgatct

SEQ ID NO: 2911 - DNA, 442 bp, Glycine max
  misc_feature (372)..(372): n is a, c, g, or t
  misc_feature (374)..(374): n is a, c, g, or t
  misc_feature (412)..(412): n is a, c, g, or t
  misc_feature (414)..(416): n is a, c, g, or t
  misc_feature (419)..(422): n is a, c, g, or t
  misc_feature (430)..(432): n is a, c, g, or t
caagacctgctcagtccagtgcaccagcagaagagcaatcctcttcttcaaacggacaagctgaacctgaaacaaaactagagagaagtgaaagttagtattattcctcagtgacagttcaaatattgatcatatgtatgtagtgtgcaacagtgattagaatgcgtccgcatggtcattttcctttcatcccacattatacaccactgctatattccaattaccataaagaataccagtttttctcccgtttcttctctctcgtgtctacttttgactcttaaaaagtctgttctgcatattcaacatgcggctccaaatatcagtaattgtagttataatcaaccatctgcaagaatgctacaaaaaccnanataaggagccgaatgttgaatatgcagaacagactttntnnnagnnnncagttgannngagagagaag

SEQ ID NO: 2912 - DNA, 1493 bp, Glycine max
  misc_feature (724)..(724): n is a, c, g, or t
  misc_feature (726)..(733): n is a, c, g, or t
  misc_feature (736)..(746): n is a, c, g, or t
  misc_feature (748)..(750): n is a, c, g, or t
  misc_feature (753)..(753): n is a, c, g, or t
  misc_feature (756)..(763): n is a, c, g, or t
  misc_feature (767)..(771): n is a, c, g, or t
  misc_feature (774)..(781): n is a, c, g, or t
  misc_feature (783)..(784): n is a, c, g, or t
  misc_feature (786)..(794): n is a, c, g, or t
  misc_feature (801)..(817): n is a, c, g, or t
  misc_feature (822)..(822): n is a, c, g, or t
  misc_feature (826)..(828): n is a, c, g, or t
  misc_feature (831)..(838): n is a, c, g, or t
  misc_feature (840)..(840): n is a, c, g, or t
  misc_feature (843)..(861): n is a, c, g, or t
  misc_feature (863)..(875): n is a, c, g, or t
  misc_feature (880)..(886): n is a, c, g, or t
  misc_feature (889)..(897): n is a, c, g, or t
  misc_feature (900)..(906): n is a, c, g, or t
  misc_feature (908)..(918): n is a, c, g, or t
  misc_feature (922)..(924): n is a, c, g, or t
  misc_feature (927)..(927): n is a, c, g, or t
  misc_feature (929)..(942): n is a, c, g, or t
  misc_feature (945)..(964): n is a, c, g, or t
  misc_feature (966)..(970): n is a, c, g, or t
  misc_feature (972)..(972): n is a, c, g, or t
  misc_feature (974)..(976): n is a, c, g, or t
  misc_feature (980)..(983): n is a, c, g, or t
  misc_feature (988)..(993): n is a, c, g, or t
  misc_feature (999)..(1005): n is a, c, g, or t
  misc_feature (1008)..(1013): n is a, c, g, or t
  misc_feature (1015)..(1026): n is a, c, g, or t
  misc_feature (1031)..(1048): n is a, c, g, or t
  misc_feature (1050)..(1050): n is a, c, g, or t
  misc_feature (1052)..(1057): n is a, c, g, or t
  misc_feature (1059)..(1066): n is a, c, g, or t
  misc_feature (1071)..(1080): n is a, c, g, or t
  misc_feature (1087)..(1087): n is a, c, g, or t
  misc_feature (1094)..(1094): n is a, c, g, or t
  misc_feature (1096)..(1128): n is a, c, g, or t
  misc_feature (1131)..(1137): n is a, c, g, or t
  misc_feature (1145)..(1156): n is a, c, g, or t
  misc_feature (1159)..(1161): n is a, c, g, or t
  misc_feature (1163)..(1166): n is a, c, g, or t
  misc_feature (1170)..(1172): n is a, c, g, or t
  misc_feature (1174)..(1178): n is a, c, g, or t
  misc_feature (1180)..(1187): n is a, c, g, or t
  misc_feature (1191)..(1195): n is a, c, g, or t
  misc_feature (1197)..(1198): n is a, c, g, or t
  misc_feature (1200)..(1209): n is a, c, g, or t
  misc_feature (1217)..(1221): n is a, c, g, or t
  misc_feature (1226)..(1231): n is a, c, g, or t
  misc_feature (1233)..(1233): n is a, c, g, or t
  misc_feature (1235)..(1258): n is a, c, g, or t
  misc_feature (1264)..(1265): n is a, c, g, or t
  misc_feature (1267)..(1287): n is a, c, g, or t
  misc_feature (1289)..(1291): n is a, c, g, or t
  misc_feature (1294)..(1295): n is a, c, g, or t
  misc_feature (1299)..(1306): n is a, c, g, or t
  misc_feature (1309)..(1316): n is a, c, g, or t
  misc_feature (1322)..(1333): n is a, c, g, or t
  misc_feature (1335)..(1347): n is a, c, g, or t
  misc_feature (1350)..(1353): n is a, c, g, or t
  misc_feature (1355)..(1356): n is a, c, g, or t
  misc_feature (1358)..(1377): n is a, c, g, or t
  misc_feature (1380)..(1387): n is a, c, g, or t
  misc_feature (1389)..(1394): n is a, c, g, or t
  misc_feature (1396)..(1401): n is a, c, g, or t
  misc_feature (1403)..(1403): n is a, c, g, or t
  misc_feature (1406)..(1409): n is a, c, g, or t
  misc_feature (1411)..(1413): n is a, c, g, or t
  misc_feature (1419)..(1431): n is a, c, g, or t
  misc_feature (1433)..(1436): n is a, c, g, or t
  misc_feature (1440)..(1450): n is a, c, g, or t
  misc_feature (1453)..(1456): n is a, c, g, or t
  misc_feature (1458)..(1490): n is a, c, g, or t
agacttcggtttgcgcacgctgaaactgtagttccattctcatgcctgcttggtttatttcttgaaggatctggtgagttttttatactctttgcttgaataaatgtgcacagaattacatatttttgttttgttttttctactaacaagtagtgactagtgagagagagtgcttatagatgttctcttttgacaatgtacagagttaaaaaaaattcagaaggagcaacctttgcagcaccctccgaagcctccacagaaaagaaaatggcggggtagcactgtggccccttttgctggtaacaacatgttgatcttgtatagttgtcctgctccagacaaatctaccagcaagcactttgtacaagtgttacacaacgaacaccctgttccattgccagtaagcctttgtaccttaattttaccaatggtcatggtctggggggtcgtagggtttcacttattgtttaaaatcatattgtgatgttgttcatcaataactcagtttttgtgtcatcgtgtacagggttgtgatggctccgatttctgtccatttgaagtattcaaggtacttgtataatcccactataatgctcaatatgatcaaatgggtattgggtaacattaatttcggaatgttgttttatattctactatttttaattctgagttttctcttacacaggaaaaaatagttgcacctcatcagaagcatgattaccanannnnnnnnatnnnnnnnnnnngnnnccnccnnnnnnnnatgnnnnnctnnnnnnnncnncnnnnnnnnnttccctnnnnnnnnnnnnnnnnntcttncctnnnttnnnnnnnnancannnnnnnnnnnnnnnnnnncnnnnnnnnnnnnntcccnnnnnnnccnnnnnnnnnacnnnnnnntnnnnnnnnnnncccnnnccnannnnnnnnnnnnnnttnnnnnnnnnnnnnnnnnnnncnnnnncncnnncccnnnnctccnnnnnncttcannnnnnnctnnnnnncnnnnnnnnnnnntctcnnnnnnnnnnnnnnnnnncntnnnnnntnnnnnnnncatcnnnnnnnnnnccccagngcacggncnnnnnnnnnnnnnnnnnnnnnnnnnnnnnnnnntcnnnnnnntttcccannnnnnnnnnnnttnnncnnnntatnnntnnnnncnnnnnnnncaannnnncnncnnnnnnnnnntccacccnnnnntcctnnnnnntncnnnnnnnnnnnnnnnnnnnnnnnnctcgtnncnnnnnnnnnnnnnnnnnnnnncnnnccnnctcnnnnnnnnatnnnnnnnncccgannnnnnnnnnnncnnnnnnnnnnnnnccnnnntnncnnnnnnnnnnnnnnnnnnnnacnnnnnnnncnnnnnncnnnnnntngtnnnncnnntacgannnnnnnnnnnnncnnnnctannnnnnnnnnnacnnnngnnnnnnnnnnnnnnnnnnnnnnnnnnnnnnnnngct

SEQ ID NO: 2913 - DNA, 733 bp, Glycine max
ggtctttcactttctttgtttcaattctcagtttacttgatgatggttttgtaaatccgatccatattccttgcatgcaaaccatcatagtggcttataaggttgcacattttgactccttctactgtggcctattcccactttcaaatgtttcaggaaggcaaaaactcagtagcccgtcatggaatatggcaccaattccattgcaaggcacttccacttattataaccagcacataccccactatccatttccgtatccagcctacaggtatgcaattcaaacatgtcacaataagctgtttttatatttgacatattcatcatcatattctaaatgaatttcagtccaacattcaggtatcctggttatcctcacccacaagacttgtatgaaatggttagtttgctcaagaaagtagctctctcttttcataccagcttttgagttgctaaatggatatctatctgctagaaagctatatgtgaccaaatttgtataaaatcattgcaattcatatagggaaacaatttagtgtacattatatacaaggaaagattaaactacatccaccatccaaacaacttttatttgaattttgttgttctctacagaactacaataatgcatatggtggacagcagcttccactccgttggttgccagcatattgccaacccttttatggccttggtagacagtttattccaacagcatatgtgaaaaaggcac

SEQ ID NO: 2914 - DNA, 1372 bp, Glycine max
  misc_feature (1315)..(1315): n is a, c, g, or t
ttcttcaggccacaacaactccttctactgcctctctctagctagttccttcttcttcttcaaaggtcttgcatccatccactccatttctctgttttgttttaattcttcttcaaaggcttttgttatcttatgttatcttaacaccatttcagatcccatataagaaaatggggcttcataattggatcaggaacttaaccaactgttttttccttttattttctttgatgtttctgttctggctttgaagattggggtggaatggggggtcacaaggtcctgaactttttctttcttcccttttgttttcatccaattctataaaattttgaaaagggactaagatggtagttaaaatagttgctactactatagcctataggctttgtttagatatattcctcttgaaaagttttagttttcctcaggtcctatatgcacaatctcgtaatttattctgcaaataccaataaaataggtttcttttacatgagatgaaacatccaatccaatctgaggaaaaagcaaggtaaaaaaatgattttttttgggtcccaattcagttagcaataagaaaatgaccttgagttgctgaatccttttatccagacttttctatgctcaaattttttctcctacttttggtatgcttactggaagaagaaactatggcccacccttttgattttctgagccaagggaggaaaatgacaggatagtaacaaaggcgtatctaatttcgtttcttttagcttcaataagttttcattgtccttgctttctccacatatcctcttcatagagaattccagaagcaatgttggatttcagaattcagaataggaaactattttttgtcattaagctctttcaggatttagccttttttctgaatgaatcctgaatccttttccttctgagtcagaaagtgtcttttgttccatcacattatctcccaggattcctcaccacacacagtacattcaattgtttccctcttgtttttatcactaagaaaagactaaaacacaaataaaaaaagaaaatgaaattgttcttcctatgactaacgtttaactgttatgaattttcactgtccagattctgtactatataaaatcaaaggaagaaaagaggcctaattaagtagctttcagttgtggaatcatcatattgcagcgttgatggggcatttttcatctgcgttcaataggttggcaaagtcttttgcaacgaagaaagggaggagttctgatgaatgtaatggaagagaagcggcggtagcaatggcaaaggaagccaaaagaaatcncttcatgttgcatagctccggcacagttaatgttgatggttctaacaacttgcctca

SEQ ID NO: 2915 - DNA, 373 bp, Glycine max
tgatcaattcaagttggtataatgaagttccttaaaagagcagaggtcccagttgctgctgcatctagagagagtggcattgaagaccctacttcccagactccgggtaaaaataactcctgctgcaaagataagcaaacattttcctcaattcctgataatgacaactcagagacgaaggaagtagaaaaccaagcagttggctctgttgattcccatgccaatcaagtttctctggatgatattcccactctggcatttccatctatttcaacatctgattttcaattcaaccatgagaaggcagctgatattattgttgagaaggttgcagagttctcaaataagtttaggaatgccagacttgttcttg

SEQ ID NO: 2916 - DNA, 389 bp, Glycine max
ccctccacttagctgaacataattcaccacttcaccatcaatttcccctccaatttcccatttatgatccatttggcatttcatcatatttcaccacttgtcctactccacttggatgatttcctaacgtattgttttcacaaatccttgttcttcatcagctaatagtttgagtccaacgaattcagcaacactatagatatatgctatatcttcctttccctatacattttccttccaaagtatctctagttctctacaaatcaacgtggcacattttttagcctaagaaaagctttagctgcaactcaaattcaaagtgtaagcctttcttgtttttattagtttatcttcaccaatggaagagaactttaagtgtgaacaagttg

SEQ ID NO: 2917 - DNA, 391 bp, Glycine max
gtttggttcgtgaaatcgctcaggatttcaaaacggatctgaggtttcagagcagtgctgtttcggcgctccaggaagctgctgaggcttacttggtgggactctttgaagacaccaatctctgtgccattcacgctaagagggttactattatgcctaaggatattcaactcgccagaagaattagaggggaaagggcttaattttgtgatcccttttggttttagggtttacgtgtttttatttagccctttctggtttccgtctctgaatctttcaaggtttagatttattgtaatgatgccattctgattgaagtattgaaattatgcgtattctcttcaagtgaatgtaaacgatttgtatggtctttgtggttgacttgttgaca

SEQ ID NO: 2918 - DNA, 393 bp, Glycine max
cgccaaaaaccaaaccaagccaatcaagcccactaatagtatttcctcaacgaaccacaccaaaaccacaaaatcaccccacaacatttcctccaaaaaccaaaccaagccactcaagcctagctccaccaattcagcttccaccgacactgccctcgccaagaagctcaatagtaagatcaagaagctcaacgtcacatccaaaacctcaccctcaaaacccggtaccagcgtttccatttccagcaacaagaaaacattggatctcgccaaaccaactaacaaaacagcaaaagacaacaagcaacccagaacagcaaaagtagatcaaactcacgacgcaacaacaaacaagaaacaaaagactcccccgaaccaactacttacaacaaa

SEQ ID NO: 2919 - DNA, 337 bp, Glycine max
gttcgatttcgtgtatcaggtgctgtcgtggattatgctctcgaattgcttgcatttttcgttcaagaggattgttcgaattgttgcagcggggtcgattgtggattccgatagggaaaaggttcccgccagattggttccaatttgctgatttggtacccttttaagccggttcatggatcaaatcatccataattacgcattgcatccctgtttaaattgtgcatttgctgtaaataatgttgtatataataatttatcatttaattgactaattccaaggtaattattttgctgtacttatggtttgtcttagtgaattgtttataatttgata

SEQ ID NO: 2920 - DNA, 389 bp, Glycine max
tttttatttttcaataataaaaatatatatctaatgttgaggtcgttttcttactgcaacagtagctgctgatcggcacgagaatcctaccgaggaccttaaacaaactgatgaatttctaagggagaccattcccctgcggattggagtcattggatacgttgttttcacaatgatttccataattataattccacgcatgtttcctcagctgaaatggtactacgtggtggtagcttatatatttgctccatctctggcattctgcaatgctttcggagcaggtctcactgacataaacatggcatataattatgggaaggttgcactctttacgctggcagctgttacaggaaaagaaaatggtgtggtggctggacttgtgggtt

SEQ ID NO: 2921 - DNA, 721 bp, Glycine max
  misc_feature (542)..(544): n is a, c, g, or t
  misc_feature (547)..(548): n is a, c, g, or t
  misc_feature (550)..(563): n is a, c, g, or t
  misc_feature (572)..(576): n is a, c, g, or t
  misc_feature (578)..(578): n is a, c, g, or t
  misc_feature (584)..(587): n is a, c, g, or t
  misc_feature (592)..(593): n is a, c, g, or t
  misc_feature (604)..(606): n is a, c, g, or t
  misc_feature (628)..(630): n is a, c, g, or t
  misc_feature (634)..(634): n is a, c, g, or t
  misc_feature (642)..(651): n is a, c, g, or t
  misc_feature (656)..(656): n is a, c, g, or t
  misc_feature (664)..(670): n is a, c, g, or t
  misc_feature (676)..(680): n is a, c, g, or t
  misc_feature (682)..(683): n is a, c, g, or t
  misc_feature (686)..(692): n is a, c, g, or t
  misc_feature (699)..(705): n is a, c, g, or t
tacaagaactttcagcccttgcaagcttacacaatggagttctaaaagtagttctcttacaattggataagcaattaaagggctttaaatttgctctatatgatttcagtgctgatctcactctaatggtgaaccatcccttgaaatatggtaatatgtctttagtgttggaataaaaaaagatcaaattacacttttgattctcaatttaattagtgtccatactctacgttgtgatgttgcgaattaataattgaaaattgtggtggtttatttgatgcaggtttgaaggagggaaaatcagcatgttgtggaagtggaccatttagaggagtgtatagctgcggagggaaaagaggggagaagcaatttgaattatgtgacaaacccaatgaatatttattttgggattcttatcatcttacagaaagtgcttacaaaaaattcgcagatcttatgtggggcttcaccaacaactcttcaaatatagggccttacactattggagatctcttccaactcccatgacttgtttacttggnnnatnnannnnnnnnnnnnnnttccctccnnnnntncctccnnnncttcnntttcccccccnnnttctttccccccccccccctcnnntccncctttctnnnnnnnnnnccccncccttacnnnnnnncccccnnnnncnnccnnnnnnnttttttnnnnnnnctttccctccctcctt

SEQ ID NO: 2922 - DNA, 397 bp, Glycine max
tttgtaaagtattttgacttatttataagcagtagacactttattctttctttttactgatagaggtaggcaatgatctagagtttctatacaccgataatggcgccgtgttgttggcgtgaaaagaattgaggataaaaaaatatacgatattgggttgtaatttaattcagcctttcgttggcaaagacctctgaaagaacttgctagagacattgcatgccgatagtttctcacctctgtatcatctggcgtgatgacgatggagattggaaaatacgttatttttttggaccatagaaaaacaaatctatattggagtactgcctatggtttgaaccaatcaaagacgcaatacactccactaacggtgcttgtgaatggactagagtggaaa

SEQ ID NO: 2923 - DNA, 369 bp, Glycine max
atgatgagggacactctgcctgcaattttaactaatccagacgaaaatcaaaacaatatccttgtggctggaagtcgtggtctttacactggaaccagagatattaatgctattgcaaacagcattgctgctatgggattagtatcactgtctggggtatccaaggtagacagtggagtctattcggagctatgtgaaaactatgggaatttggaagcagtgaaaaattccaacgattcaggtggtggtgcctttttggatgatgagggcggatcttctttggattcgaagcagtagtgtagtgatgaatgcaattgtttttctttttttatttatgtagatctcttttgtttagcaaatgtagatatg

SEQ ID NO: 2924 - DNA, 387 bp, Glycine max
tacgaagagaaaaaaatacgtctctggagactagagtgtatataatgatcttttacattagtttggtactgctcttcaagtttgaccctgtcacagagatgctacctatagtatgaatctagacacgctttgtgaaggacatgtggtgcagggtatgtataacataggagtggtcataactcaggaataccgatgtactttaatgtcctgatgttttacttttgtcatctgaaaggcaaccatgtggtttgctcaccagttttatgccatttggtttttgctatggttttggtgtttttagtgtactccagttccagttagagattccttactctgatagtatatatattgtgactatcagaagttatacgcatcagaatggctttg

SEQ ID NO: 2925 - DNA, 731 bp, Glycine max
ctctcttgtactttcttcacaaattcttcctctttcaactttcccctttgctacagtattattgtcactccataaaaaaatgttactctccaaactccaaagtcaatgaaaaattaaaaacaaaaaactacttaaaaaaccaatcatttctcataaactacctctgttcttaacttaaatggtttttgcctagtgacttttagcttctccttctgcttccacctcctccctccaaaagtcccagatgactccgagctctgaagaatccaatcatcaaaactcaaaatcccattagtgaatcattaaccattcttcattagcacttaaatcatataataaaaacagcatctaaagccttacatttctcctgctccttctacccccagaagtcctactagatacactgcagccccaacaaacacaacaacacacaaatcaacaaaaaccaacataataacaaatgacagacaaataaagaaaagtgagtgcagacattaatccaagacaaaacttagatacagttccataggcgtgtttagtgctaccctacgatcagaattgaagttttacctcaagaatctatatatgctgacctttaatgcaaacttttattatgaggattactaaaatgaaactataattttgattggagaagttttatccttaaaaatctaatcataatactgtgcatcaaaagtatcctaaggaaccacatctaagttttgtcctta

SEQ ID NO: 2926 - DNA, 677 bp, Glycine max
  misc_feature (598)..(600): n is a, c, g, or t
  misc_feature (615)..(615): n is a, c, g, or t
  misc_feature (632)..(634): n is a, c, g, or t
  misc_feature (651)..(651): n is a, c, g, or t
  misc_feature (653)..(655): n is a, c, g, or t
  misc_feature (658)..(658): n is a, c, g, or t
  misc_feature (660)..(666): n is a, c, g, or t
  misc_feature (669)..(669): n is a, c, g, or t
cttcccacctgttttgcttatcctcaactgcctttgtacttttgctctaaacttatcagttttccttgtgattacacatacaagtgctttaaccattcgtgttgccggagttgtcaaggattgggtggttgtcttactgtctgctgttctgtttgctgatacaaagttaacactcatcaatttgtttggttatgcaattggtaagtaattgattctgtttgaccttctaaattttcctgtctcactagatatatagcctttgaggatttttcataacatttcctgcaaatgccagagtatttgtacatatccaatcgtccaggaaaattgatagcccagtattgggtgctacccagaagcctatgtgccattagcattatacaaattttaaaaactcagaatcaaagatagtccttcattttgaaaattaatgtgagaatatctaagatcagctaattgtcaggtttctaatatggtcggagtctaactaacactctagcagtgtgttattgatgagacaaaactaaagggagattgtaataatggaaatggagtatacaaaacgcagtaagtataaaaacagaggctccctggcttnnnaatggattcctgggnccaaagctataagctgnnnactattactaactaatntnnngcntnnnnnnnagncatatgca

SEQ ID NO: 2927 - DNA, 684 bp, Glycine max
ccaacagctagataaatttatccatcagtcagcaaatgagtaagaaagtcctcctagtctagtatatgcactactatctattacaattattaagcatctgtaagtatagaagacattacaaattttaagaaatgcattttgcatttaattttcatgtatgttagcaattaattttgattaatttatatcttgaattaattaattaatgttcactcattctggtcaatacagttagttaggtaattgtaaaacaatcatagaacatatcttttccatttttatctcatgaaaaatgagttaaaaataagattatatgaaatggaacatgtgcaaggttatgtttgtctaaaatgtctgaggatagaacaacattaactcaactggttgaatttctggtggtctcttcatttgtaagtagtgttatcttgtggcaacttgcctcttctgacgataaagttttatagtcttgagggttatagatgtcacaaatagctttcaataacctaaagtaaacatatgccatgtatgcagaattccaaaaacaattggtgtctcaattccaatgaaggcaactttcttcataacttacataatggtggatgggtgggctggatgtgctggtgagattttaaggttgaagccattgatattttatcacttgaaaaacttcttcttagtgaagac

SEQ ID NO: 2928 - DNA, 651 bp, Glycine max
  misc_feature (44)..(45): n is a, c, g, or t
  misc_feature (54)..(55): n is a, c, g, or t
gatgcacataatacattatctttcatctatcattatacagcagnntatgctttnntatccaatatcaagtactcatggcaggatctgcagcaatgcgaagcttgtgagatttgagacagtaagcatgcaaaatgcaatattcagtatagctagtcaaaggatcaactcaagccatacctcacccaatcgtgcatttattttcaggggcacaaaatcatcagcacgcgtcacacctatgttcacaattgcagtagcagcaccagcctcatgagctgctctgttcaagtaaattttacaaatccaatcatgtcagatatgcaaaacaggcaaatgaaatttcagtgcttgcaaatgggaaatacaaacctttatctaaattagagttttgaagttaattacaaacaaaactttttctttgaaatgataatttgatatatatctcattctcaataatatcattgcatatcaaattttataggagggcatcaacaatcattttataaaatagcagaatttgtctagaaaactatattgtattttaatctcaggtgtcatttatgggaagatcctacaatagataagaataaatcactgacaagacaaaatgatgaagggttctactccaacaccagattttatcaaatagttatt

SEQ ID NO: 2929 - DNA, 359 bp, Glycine max
agccaagaaagaagataagattgtagatataaacactttccgcaaccgggatatatctgctagtgaaaagtcttctaaggatgtcatttctgttaacaaggatacagattatgtgatagaaataaaagcagatgctgtttctagaagtaatgatgatgtagtttctcaaacagatcgaacaactagtacaaggaaaacatggagtccacctaattatggtgctttaaaaattgtaattgctgatgaagatgagcagagagataaacctacacggactgttgatgccacccctaaagaaaaaggattcagaaatctattttggaaactaaagtttgaagagtatcctcaggccatgcgag

SEQ ID NO: 2930 - DNA, 249 bp, Glycine max
  misc_feature (221)..(221): n is a, c, g, or t
cgcgtgctgagcataaaatacttgataccaaatcttgaactgaaagaaggatctcttgtatcagagatacatcacgaggtgcgtcttgctggccttactgttatccaaattgagttatataaagaatacttatatttttcataatattttgcaccatgctttctcaacttttgtttgcattaaaatcaaataaatttagcactggtcttgtagtaactacnatgttcttttactatgaagcatgaacaa

SEQ ID NO: 2931 - DNA, 266 bp, Glycine max
ttaaaaatttgaatacaagaaccaatcgtgcaataattgatacatatgtatgtgaaaaatagcaaaacaatctttatctttatatacacacactaactccgcgttgttcctcctcctagtaagtgcaacatggccatctcgctccaagaaaaatgtatataatttcgaccgtaacatcataatggttctaaatccatggcacttcctcagggctttttactaacccttgtggctgctgtagttattgggacagataagcaaactgc

SEQ ID NO: 2932 - DNA, 176 bp, Glycine max
acttggctgattacaatatccagaaggaatctaccctccacttggtgctccgtcttcgtggtgggatgcaaatctttgtcaagaccttgactggaaagacaattacccttgaggtggagagttctgacaccattgacaatgtcaaggctaagattcaagacaaagaaggtatccca

SEQ ID NO: 2933 - DNA, 388 bp, Glycine max
aggactcgaccaacacacttgatggcgtctcaagccagctccagttgaagtcctcattgtcatccaaagcctcggcgcaaaccctgaacaaacaacaagttctcaatcgcattcgacaccgtaagtccttaaacagaatcaaaggcgcttttgagggtcttttgggcaactccaaaggtaatacaacttcagcacaagaccagatttggctccaacaagatgacgctttctcttctccttaaatatatgtaacccatcaactaagattattcccatatgactatcaacttatcgctttatctctgttactgttactttctttttgtatattgaatatcttagtactaaactactcaagttataatttatcgtcactcctcaaattgac

SEQ ID NO: 2934 - DNA, 364 bp, Glycine max
tggagctgctggtattgttggtatcttgaagaagattggtagggacgggagtggtggtatcacaggtggacggagtagaagtgatatgaaaatgagaagaacagttgtggcaattgaagggggattgtattctaaatatacattgtttagggagtacttgcgtgaagctctaaatgaaatattgggacaagatattgccaagcacgtaattctaaaggtcaccgaagatggatccggcattggggctgcactgcttgctgcctcttattcatcctaaactgtggatagagggtacacctgctataaaatatatatataaattgtttgatatttatatatatatgtgtgtatatatataatatat

SEQ ID NO: 2935 - DNA, 379 bp, Glycine max
tgcttggggttcttggatggaggtgtgaaccccagaaactccattgtgattggagggtatcaattggaggatgtcatagtgcagtttgatttagccacttccatggtgggatttagttcctcccttgtcgccaaaaataccaagtgttccgattttaaatatgccagttccataactgcagactcgatttgaatattttaacccaccgctttgaggatgggctttctagtactaagtactaagttttcttgcttgattttatgtttttgaagcttctcagatctcaattactaagttttcttgtttaattatgtttctgaagcttctcaattttgtaacaacttgattttgggtagtttttttttttctttttcctgca

SEQ ID NO: 2936 - DNA, 389 bp, Glycine max
gatgagaatataataaagatgcttatggatttgggtttgcctgtttaccaacaggactttgagaagcattttcttgatgtttcagcaaatttttactgtcgtgagtcccagaaattcattgaatcatgtgattgtggtgattatttgaagaaagctgagagacggttaaatgaagaaatggagagagtatctcactacttggatcctagaagcgagtcaaagataactaatgtggtggagaaggaaatgattgagagtcatatgcacactctagttcacatggagaactcaggcctggttagtatgcttgtggatgacaaatatgaagacttgcaaagaatgtataacttatttcgccgggtgtctgatgggctcacaattgttaaaga

SEQ ID NO: 2937 - DNA, 390 bp, Glycine max
cgaaccggttctcgggcccaccgaggcccaattccgcttcctcaacgggcctgtccatgataaccgtcgaggacgatatcgagtctcttttctccgagacgaactcggaggaggagcggcgcgtgaggaagcaacctagcattggggcgtcggggatttcctccggggtgaagctcgaaaacgtggggaaagcctacaagggcgtgacggtgctgaaggacgtgagctgggaggtgaagaagggggagaaggtgggcctggtcggcgtgaacggcgccgggaagacgacgcagatgaggataatcgcgggccttgaggagccggatttcgggaacgtggtgaaggcgaaggcgaacatgaaaatcgcgtttctgaaccaggagttcgagg

SEQ ID NO: 2938 - DNA, 1072 bp, Glycine max
  misc_feature (1012)..(1015): n is a, c, g, or t
ctcttccttttgatgatgaaaacattccaaatctcttcaagaaaataaaggtattgttaatgttaattttatttatttaattaactgagtgatcacctgttgtctacatatatattaaaactgcccaggccttggacatatggctaattttccagctttcttttcctgcttctttatatttttatttttgcttcgtgcattttcttttttgctttggccatttttaattattttaatcttctgaaattgtgcaaatgcacaggttgcattattgagttctatattaatacaataggagtgctataatatcttgacagttttgaattaaacattggatgttgttctatattaatataatttatgtagtaatagatcttttttgaaaatcagataatccaaattggatttattcgtcaaatgatgttatcatcaaagagattttttcccatgtttttcatgtagggcggtatttacactcttcccagtcatctatctcccaatgctagagatttgataccagggatgcttgtggttgaccctatgaggagaatgaccatacctgagatccgtcaacacccatggttccaagctcgacttccgcgttatttagctgtgccaccaccagatacaatgcaacaggccaaaaaggtttatttttatatctttttgtgttattcccttcttccctccatttttcgctcttctgtaaattatctatggttcatgagaaatgtagttgaaaaatactgatttgatgtgtaaatgctcggtttcaaaccttgcactttacattcattcacattggggattatgaagtgtatgttacttgatatattataatcagtttaaatgataaaccaaatcatatcatggttttgtagattgacgaggagatccttcaggaagtggtgaaaatgggatttgacaggaatcaattggttgaatcttttgggaacaggatacaaaatgaggtttgtgcctttgattttctccttttatatctgtcagaaannnnccttacttccatccatgtatttcagggtactgtggcatactattgttatgacaaccg

SEQ ID NO: 2939 - DNA, 396 bp, Glycine max
tcatgaggaagtcaacatccttcagcaaaatcagttggaactcagggataggctgtgcaaactgcttatgctcacaagtgataggatccttccactacaaaccattgaccagttaaaatgggacttgggtttaccatacgattaccagcattcttttgttccaaatcatcctgaaagtttcttatatgttcgccttcctgatgatcgtattggcctgaaattgttattttgggatgacaagcttgccatccctgagttacagaagaatacttctctacaacaaaaggcagaagacataaaaaatggatccttagaatttccaattagtttcaccaggggttttggtttgaaaagaaaatgcatggagtggttgaaagagtggcagaaactccctta

SEQ ID NO: 2940 - DNA, 439 bp, Glycine max
tttgatatccctcctaccaaaggtaaaaatggcaagggtggcagtaatggtaaaaacaataatgacaagggtcatggtagcaataatggtaatgtgggtcaccacatgggtcagatgggcccaatgggtcagagaggtccaatgaatcagatgggcccaatggaccatatgaggaatatgaacatcaatatgccggcggtgcaaggattaccggcagccacggccgccgcgatgaacggtggttactaccaaggcatgcagatgcaaatgcaacaacccaacccttacaacatgcagcagcagcaacaacagcaactaatggccatgatgatgaaacaacaacaacaacaacaaatgcaagcaaacatgaacgtgtacccaccacacatgatgtatggaaggccacacccacaccaagacccatctatgaactaaaaaa

SEQ ID NO: 2941 - DNA, 679 bp, Glycine max
  misc_feature (624)..(627): n is a, c, g, or t
cacctccggttccttgcagtcgcaggacagagccgaagacgacaacaattctaattccaccgctggaggcggcggccacgactatgttttcgccggcgagttgtcagttccggtgagttttcaattctttcataaaaaaatactgcaattaattttacgcttaaatacattttttccatataatttagtattttttttatttttctccttatattcctaactgttttctttttcatccgtgttttagatgaaaaaaagacatttttcaaaatattgttctactgttatctaaaaatatttcatgaaaaaaaacaaaacacacattttataatgattaaaaaaattagaagaatgaaaatgataaaaatactaaattatagatactaaaaatatatttaaacattaattttaattcatggttttgtgaagaaaaaacaacaaaataattaatttttgcaggcagatgatgtggcagacttggaatgggtttctcactttgtggatgattctctcccggagttatctatattgtaccccattcattgttccaagaaaacaagagtatgggccgaaccggaatccagattgagcccggcccaaaccgtttcaaaagtcccgagaaannnnagaactgaaaagcctagaaagcccaacactcgtgtctggtcctcttttacgg

SEQ ID NO: 2942 - DNA, 439 bp, Glycine max
gtcatatcacatatttatataaccatcttcatactcattgccaccttgtgatcacaatattttatttatgttcactacactcttatcatcataactagaaaattaaacagaaaagcagaagcacttttttcatcatggaagcctattctggttcttattcctcatcatccaactcttcatacttgacccaaaacaaccgtgaggactcaaaagggtatcacatgaaacaacaaatttaccctcttcaaaatcacagttcttcgtggctccgttccgtgagaaagacaccagcaaagccgtggaagaagcaccatgtggcaccgatgccaccaacaccagtgaaagtgtacaaagtggatgctataaactttcgtgaagttgttcagcaactcacaggtgcacccaagcacaagcctcagcagcttctccaaatcaacaa

SEQ ID NO: 2943 - DNA, 488 bp, Glycine max
  misc_feature (352)..(354): n is a, c, g, or t
  misc_feature (356)..(364): n is a, c, g, or t
  misc_feature (368)..(376): n is a, c, g, or t
  misc_feature (379)..(381): n is a, c, g, or t
  misc_feature (386)..(387): n is a, c, g, or t
  misc_feature (389)..(390): n is a, c, g, or t
  misc_feature (392)..(423): n is a, c, g, or t
  misc_feature (425)..(432): n is a, c, g, or t
  misc_feature (442)..(450): n is a, c, g, or t
  misc_feature (453)..(454): n is a, c, g, or t
  misc_feature (457)..(462): n is a, c, g, or t
  misc_feature (465)..(470): n is a, c, g, or t
  misc_feature (472)..(472): n is a, c, g, or t
  misc_feature (474)..(477): n is a, c, g, or t
  misc_feature (480)..(481): n is a, c, g, or t
agcacctagctgtggttagttaaaaagggctagctctgattagtgtgtgagctattggtacgcacgctaatgttgggagttatacgagctcgaacgtggttgcgatattcagagccccttcttcaaccatggaaggtagggttctcctctttgtccgccattgacggccgtaaacaccaccttctgaatctgcaggagatcgagacagttctgaccgacgttaaagctgacgacgttaaggtgataccagttcccaagcactgcgattgggctgatttcatggtactcgccactggcaggtccacctggcacgtcaagaacatcgctcaagccctaatttaaaaaaaagaannngnnnnnnnnngttnnnnnnnnngannnttaannanntnnnnnnnnnnnnnnnnnnnnnnnnnnnnnnnnannnnnnnnaggagggagnnnnnnnnnaannatnnnnnntannnnnntnannnntannatattaa

SEQ ID NO: 2944 - DNA, 506 bp, Glycine max
agtgttaaacagctacctgaataccatgaatgctcgggtgtgtatattccaaatcctcttgttctttgtttattccaaatcaacatgtattctgaatgatgcatactgattttccatcttgctaatttatgcaacctttttgtgtcgtcttttttggggactgttttgcagaagatgaatttgttgaatctctttcacctgccacaccccgtgagtcaacagaaatagatgaggagcaagaaaagcaccttcttttgccatcagatagaactgaggatgttcatttcgttaaagagacgcaagtgaaataagcggtgtctttgaggtgagaaataacacaggctgtcttcgctttgaatatttatccatttgatttgcagtgattcttttttctcaaagttttctcattcttccatggctttctacattctcttgggtttgggttcattcatggaaactgaagaatccattgttttgttgtgtataaaaggttctcaaatgaggct

SEQ ID NO: 2945 - DNA, 378 bp, Glycine max
agagtgaagtttttggatgatcaaaaccgacacatcatgaggaacgtgaagggacccgtgagagaaggagacattctcaccctacttgagtctgaaagagaagcaagaaggttgcgctagaggatctcttcatggtttggctcaggacttaaacaaaacatcgttgtttttgttgtagttaaaggatgtcaaatgttaattgtcatggacctgaattatgcacctactatgtttgacattatgccattatgtttgtggctgagttatgactaaatttatgctttgactatatgaagtgttttctattctatgggctatattgagatgtggttagtagttagttatgtataattatggaaatgtttatgatctaagaat

SEQ ID NO: 2946 - DNA, 340 bp, Glycine max
  misc_feature (303)..(311): n is a, c, g, or t
  misc_feature (313)..(315): n is a, c, g, or t
  misc_feature (333)..(335): n is a, c, g, or t
attcgattgattatgtgtttgccatggcttacaatgttgtggctataccagttgctgctggtgtgttttatccttcactggggatcaagctgccgccatgggttgctggtgcatgcatggctctctcttctgtaagtgttgtatgctcttctttgcttcttaaaagatataaaagacccagacttactacaatacttgaaataattgtagaataataagaaaggaatgaaacctactagggtcggcctagtagtggggagatttgtgtagtttggacgagattataggtttaaatctcgtcannnnnnnnnannnaaaaaagagagaaataannnagaat

SEQ ID NO: 2947 - DNA, 560 bp, Glycine max
  misc_feature (411)..(413): n is a, c, g, or t
  misc_feature (557)..(557): n is a, c, g, or t
tatcttgttctccgtggcaccatgcgcgcccacaccgacgttgtgacggcgattgccactcccatcgacaactccgacatgatcgtcaccgcctcacgcgacaaatccatcatcctctggcaccttaccaaggaggacaagacttacggtgtcccccgccgccgcctcaccggccactctcattttgtccaggacgtcgtcctctcttctgacggccagtttgccctatccggctcctgggacggcgagctccgcctctgggaccttgctgctggcacctccgctcgccgctttgtgggccacaccaaggacgtgctctccgtggccttttccattgacaaccgtcagatcgtgtctgcctctcgtgaccgcacgatcaagctgtggaacaccctgggagagtgtaagtannngtaagaacacgctggagttgaactcctgattttgggcgttgattagaattatgatgtttacaattcccggctcaaccatttaactgtacctgggatattgcactttgtcagaaatgaaatttggatagctcctgaccaaaagantta

SEQ ID NO: 2948 - DNA, 284 bp, Glycine max
acccactacaaatgtccgtgattgtatcagatgctttcaaacttgtcaggcctaacacctagatcaagcaaacaaataaagagggtgttaatacttgtataaacatgtgtagcaggatcatacactacgtaatttcaaccttgtgcattgcccgtgacagcagtgactggcacccaatgggatcatcaacatatgaacaagctccaacctttcttttgatgaaaagaataccagaattaaatggattattcttgtctccaaaattccaccaaagtttatctgtt

SEQ ID NO: 2949 - DNA, 479 bp, Glycine max
tatctgggccttcatctcccatttgttctgcttcttgcaacatgttcataagcatgttcacttgttcttgcagcattgcattttctctttccactcgagcgcgtttgcttttttcatccacaagctggagttgcaagtgctctagacaccgtgaatcctcctccagctgttcattcagcccatcaatttccctgtcctgcaagcaacaataacagcaacaacaaaatgagcaagtggctcagtataattttgtcttagtttggaagtgaaggtgttgaggaaacttgtaagttgtaacctttctgttcatttcttggatggcaatccttctcatgctttcaacaacatcgacattaacgagttttctcttcttgccaatcagccagcccttcggatagtttgcagactcaaagtcaggaggaggaagtaaagactcggccgagggtcgtcggccattaatattcattataggttctaaa

SEQ ID NO: 2950 - DNA, 398 bp, Glycine max
atgatgggatcttgcatatgcccgttggagactccggcgaggttgctttggaccacaagcttcttccgtcataagcttatgatcttctaataattaataattcacgcacacaaacaaacaaacaaacaaacaaaaaacacttcataacaacaacaacaacccttctgaaattctcaacacaagtttcaaaaaacagagtaaaagaaacagagcaaaaacacacacacaaaaacacaaacacagacaccttttaagtattaaggtgtctctttctctcgccggaaagtttctccgtcggcggtggtgattgaccggagtgccatggagtctggacggattttctttggtgcctctgcttcaagcggcaacaacatgctctttctcggcacaactgaact

SEQ ID NO: 2951 - DNA, 357 bp, Glycine max
agttgaaaaatttagcactggcactcgaggcttcagggaggcctttcatttgggtattgaggtccacttggcgtcatggcttaccacttgggtttatggaaagggttgtgaagcaaggcagaggcatgatggtttcttgggcaccacagaatcagattttgcagcataactctgtggcttgttatatcacacactgcggctggaattccatattggaggctttacagttccaaaagaaattgctttgctacccggtggcaggggaccagtctgtcaactgtgcctatgttgttcaggtttggagggtaggtttaaaactcaatggccttgaaccaaaggatgttgaagaaggactta

SEQ ID NO: 2952 - DNA, 318 bp, Glycine max
ggtggccctgtcagctatcacaatttggttgttgagcttggccccatggaaatacgaactttccttttgaaattttaaaatagctcaaataatcattgatgattttatttgaaggaataaacatgtttgatcacatgacttttacccttgtaaaaattggtagagggagaccaagaacgattttgaaggaaaacatgaaaagaaatgagtaaagatcctatccaatgactagaaataatatatttaagactttggttcttaaccaaatctaacgacatcaggtaacagtgtaaccgactccatctaagattgttgttg

SEQ ID NO: 2953 - DNA, 553 bp, Glycine max
aacctttttattacgctaatcaccaaagtgaaactccaattctgattgaaaaacaataccaaaaacacttgaaagaataaattttatgttttgtctttatttaaaaggtgaagagatatgaatagttgaataccttacacggtgccttgttgtcgtaaaggttgagtttcagcatgaactacattattttgctggtccaatggcatgtattgtgacatgatagccatgatctcagagtccatgtatgactacaaaaacacagacaaaggtaatttaatatggtaatctccaatttaatatgaacgatgtataacattatctgtagctgagaatgaattaggcttacccggagcctatatttgtagaacacgtaaccagctagaccagcaccaacaacaactgctatgaccacaaaggcaaggaaccgtccaaattttgattcacttctttctgcatgataaaaaagcaaaattttaatcatgaacaagctaaattgtctagaaaaaatgcagtgacacaagaagactagtttaaaatctcttattatcaatct

SEQ ID NO: 2954 - DNA, 299 bp, Glycine max
gtgcagctgggccgaacagcttgagcatgacgagtcttcttgaagaagcaaatctcccgctggagacctacctgaagcaaaatggccttactagcttgataacagagcagcaaacaaattcagcttcaaatgtgcaggcacagacaaccaatgatagtgaggtgaaacacaatgaggattgcggaaccgctacggttattcatgcgcaggaaagcagccctgaagagaacagtgggcaagataaagagcaaaacaattaactcatgaaatcttgccagttacattttcttttttccttt

SEQ ID NO: 2955 - DNA, 465 bp, Glycine max
ctggatgcatacgttgtaggccaaaccctgcagatttggatggagatatggtcactgcttcagtctttagtgattgctctgctgacagtgatgagccggcagactcacacaatcgtagtcctctagcaattgactgtgagactgggactagaactgctgctggcagtccttccaggtagcttcctcaaactataacgtgcttccagattgtgattgaatatattagaaatatatatattttctcctttactaaagagttgccttctttctgaagcttaatgctcaaggatcaaccacctgctgtttcccaactgaattcaacgggagtaaagaaaccaggaaatattctaagtaatcatatgtcttctacttccccaaaacgtaggcctttacgcaaccatgttccaaatcttcaggttcctcctcatggtgccttctatagtgctcctgatagttccttgtcaa

SEQ ID NO: 2956 - DNA, 411 bp, Glycine max
ctggtcaagtttatgcggtggccatatccaatggttttgggtatggtgcccactggtcaattgctttagcagcagcttcagagctatttggcctaaaaaactttggaactctctacaattttctcaccatggctagcccagcaggctctctctttctatctggatttgtagcaagcacaatatacgactattacgcggagcagcaagtgaaacaccgaatgctcactggaaataacaatgacttgcttctttgtgagggaaacatttgcttctccatcacatttggaattttagcagtagtttgcttatgtgcagcatctttgagcttgatcgttgctcacagaacaaggaaattctatgcacagctttatgaagagtctcaaacttaaaaagtgggagcaagcataggaa

SEQ ID NO: 2957 - DNA, 343 bp, Glycine max
agactctgctcttccaaattgatagaaattatatataacaagcaaaaataaaaacccctaagccaatcaaaattgtatcacagtaatttgaactttttataaagttacagcttggcctagttcacagaaatctctctgcatttccacaaataaactcttctaagaatacataatccaaaaaacgctacacagtctatagcactgaagatgtaaattacatatgcgtcagtcatatcttgtgtaatcttttttctttggaggatggggctccagaatcttctacgttttaaaagaggtcctacgagcattcgatatctgattcatctggtccatcgatgtaaag

SEQ ID NO: 2958 - DNA, 375 bp, Glycine max
cgttccttcaggcagtgttcatttctctgcccctcacttacttattcactcccaactccaaaaccatcatcgtcaatatggcacaagcacacgctctattttctcctttcaatcctcgccttcttccttcttcctcccccattctccgacgccgtttcttttcccttccaatttctccgttaactcaccggaccgtgattgcctccgaaaacgtcgccgtttcgcctgatgccgcctcgtctactcactctctcccccaggtcttcaattccttattcttttttatttccattcattgaaactgaaattgaaaacgccgtgcgtagcaggtgattgaaaccctgatttccggagtggatttatcggaggaagaag

SEQ ID NO: 2959 - DNA, 487 bp, Glycine max
aaggtttccagaccacgcaaccctcccactcatccttcctacgaggaggttcgatccgaaccacaattcttaattttctccattttcctctcagaatttgtttgtgatctgattaatttggatctaattttgattttcttttgcagatgattaaagacgcaattacctcgctgaaggagaaaaccggttcgagccaacacgcgattgcgaagttcatcgaggagaagcacaagcagcttccaccgaacttcaggaagcttcttctctaccatttgaagaaacttgtagccgctggaaaactcgtcaaagtcaaaggctccttcaagctcccacctacccgaccttctgcatcttcttcttcttcgccggcgaagaagaagaagcccgcacctgctaagccccaacccaagcccaagcctaagcctaagcccaagcccgctgctaaagccaaggacactaaggcaactaagtcaaaggcaccagctaa

SEQ ID NO: 2960 - DNA, 329 bp, Glycine max
tctttagaatccatgcttgacttcactcaaagcattcttggcttcacatctgatctaaaagttttgtccacctctcaccaaaccaaatcaagtgtcactttccaaaactacactatgttagaaaatatcatagaaatcccagcttccaagatggtggcttgccataccatgccttacccttatacagttttttactgccacagccaagaaagtgagaacaagatttatagggtcccacttgctggtgaaaatggggatagggtggatgctatggttgtttgtcacatggatacatcacaatgggggcatggtcatgtttcatttcaagt

SEQ ID NO: 2961 - DNA, 721 bp, Glycine max
  misc_feature (43)..(45): n is a, c, g, or t
  misc_feature (714)..(716): n is a, c, g, or t
  misc_feature (718)..(718): n is a, c, g, or t
tgagctgctccttgtctcttattaatttttttctgcactaacnnnatgtaagcataatggccacgtaaacgggcataatcctcaggtgtcgagcctgtgctgtcacgagcatttttccatgcttcaattcccacctgtattaaaaaacttcatgttactaatgtagcactaacctgaacacatgaagctccagatttccaacaagccataaaataaaaaaataaatcatcactttctatccaggtttcagctcattcaaagtcacacaatactggcggcaagtgtagtttggaaggtcaaccagctatatggattgttagtctagaacagcacagattaatgttacccaaacaaattttaaaaaggaagtatgcaatggtgacaaaagttcaaatactgtaacagctaaatgcacgattcggaaacaaaatgtgcaagaattaaatccagtgatgaagatccaaataaaactgggaagaaaatctctgtagtaaaagaagtctattctcagagcgatataatttaaagtaacagaaattttaccatgcaaggatcattagtcaaagcatcaagtacatcctcagaaccatctttcccggctgctatatggagtggtgtcaaaccagcaggaccaacaacatcaggtctaaacaagaaggtctgattctcgccatcaaccagtgccttgtcttcaggtcctagtttatcagaaannncncag

SEQ ID NO: 2962 - DNA, 1209 bp, Glycine max
  misc_feature (57)..(63): n is a, c, g, or t
  misc_feature (100)..(101): n is a, c, g, or t
  misc_feature (1171)..(1173): n is a, c, g, or t
  misc_feature (1175)..(1179): n is a, c, g, or t
  misc_feature (1201)..(1203): n is a, c, g, or t
cttcttctgctaccttataatggaagaaaatgtggtaggtattacattggctcttgnnnnnnntgatgtgaagatcatttggtatctgctatttaattcnncacttgcttattttgtcaacctgaccaattttttggtcaccaaacataccagtgctcttacccttcaggtatgccttacttattcatataggcatatgtccttgtttttttaaatttaatattttactcaaatgaacatatctgctgtctttttagttgatacatcaaaattttgtgcttgtcatacacaagttcattgtcaattcacagatattatattcagcatgttattgtttattctaattcttgttttatttttttatttgttcactttcatatgtcctttagtgctgtcattttcgtgtggttgtgatttgtcttggtgtcttgtcattgttattttttcatttctctataaataaaattctttggaagcaaatttacctatcataagagtttctagattgtctagtaatcaactttctgaaaattctcgagtacttagttttccagtttctatttcataagtaattcaaacctcttggaaaatgaatccgtggattactgctgaatattttatgttgtatttctaaaactagtgctaggacagtattttcaaatgcctctgttgctattgacagacatctagtgctaatggtgtccaaattatttagtgaaattctctgtaaattttaattttttgacttagagttgctatctgtgttcactgttcagtgacatttcaggtggtattgattaagttctgggccaagttgattaatagatatatagttttttaagaactgtaggagttattatttggaggtgttgtggatttaaaattagtttctaggctatttcttttttaaatggtgtttaaattgtcaccatatgtgtgattcaaatgtggataaattaatcagtggcaatatgtacatttttcctgtaatccagtatttgatatttgcataaaattatgttaagttcatgctttaacaactattaatccaagagtgggttctttactcttgcaggtacttgggaacgctaaaggggctgtagcagtagtagtttcgattctgatatttagaaacccagtgtcagtcacaggaatgatgggttattcactnnnannnnncggagttgtactttatagtgannncaaaaa

SEQ ID NO: 2963 - DNA, 407 bp, Glycine max
  misc_feature (386)..(388): n is a, c, g, or t
agtatctgcgacttccccaccgcggaatcaccaattagcaccaccttgaacacgtaatctaccttctggttcgcgtctccgtagcttcttccactagccattgttctccaatgcaatcttcttcttcttcttcttagttctaaatttgttgttgctctttcaatttcaaatctagcttgtttgtttgtttgattatttgagttttagtgataattaaccaacggtttttggtttagatttgatttttggaggagtgttaaagtgaaaaaacgactagtgccgtgccgtttgggtgacaggtggtggcacgttattgggtgctgctcctgataagcttgattgtgttcggaaagggaaaggaggatggttgggaacagctttattannngttgggaacagctttatta

SEQ ID NO: 2964 - DNA, 836 bp, Glycine max
  misc_feature (47)..(52): n is a, c, g, or t
  misc_feature (825)..(832): n is a, c, g, or t
tcagcagaagcagaagagaagaagaagaagcactctggttcttctgnnnnnnacctcgttccaacagccatggcggttcctgcaacatcctcagcccctgtccttcgacccatcccccccaaccgttccttctcttccccattccgttcactccccactcccaccacccgaaaacccctaaccgtcttcgccatggcccctaagaagaaggtaccattccatattcaatctctcaccaatattttatttcgtaaatgtccggtcccgaaaattttacatttcagatctctactttgtggcgtcaaaacattgtgttagaaatcttaaattgagcagtaatatgatcaaaattgtgtctttatatgaaatagtaaattgaacactgatatgatcaaaatgatatatgtatattaatttgttactacctttgtcctagtgggagaattttggagaatgttatctctccttttcttttttcatccttcttcgatccctgaatcaaagtttttggttaatgaaagggattcgaacctataatatcttcctcttgccttgtttcttcaaccttcaaccaccaagtagattttataacttgttgcgtttatatatctgagaccaagcttcatgttgtggatttgattatagctttgtatggtactgtggtaggtgaacaagtacaacgaaaactggaaaaaggagtggtttggcgcggggatattctacgaggggagcgaggaagtggaggtggacgtgttcaagaagctggagaagaggaaggtttgagcaacgtggagaaagcaggcttgctctccaaggcagaacatnnnnnnnntttc

SEQ ID NO: 2965 - DNA, 373 bp, Glycine max
actgaaccgcatgcgtaacagcaagggggtcatcgttgggctcgggctagggctctgtgcatcgggcatgatgtccggcccagaagcgtcggctagtgagattgctatgattgccgatgctgctgccagtgacaacaggggacagcttctgctgtttgtggttacaccagcgattgtttgggttctgtacaacattttgcaaccggcactcaaccagcttaacagaatgagatccgagtagagtgactttgctatgctaaggctaagggaatggaattttgtgcacccgattcgttccaatgcttttttccttgtaccacttcctgcttgtaacttgtatctattgctctctctctctctctctctctcaaaa

SEQ ID NO: 2966 - DNA, 809 bp, Glycine max
aaaaaagaaaaacaaattaaaaaagcaagagagagaatagatagaggatgatggtgagcacatcctctgtttccattcccagtttgttcttttcctcttcctcccattgaagcattttttcacaagcccgtgattttttcgctatctccatcatcaaatggtaaatttttctcatctgggttgctcctactttcaccgatctctcgtaaagtttttgaattttgttgtctgatctagttccttgttctttttccttgatggggtgttgagattagattttctggttcgggttttgattgatgctcggaagatccgatgctgctagatcgaatttgacaaaacccacttcgtgtctgatcgaagcaacaactgggttctgtctgaattttgagataaggtgtgtcttttcttctcatctgcatttctgatcggtttttgctttggtagaaaggttagatttatctgtttatattgaaaactgtgcatttagattgattccatggcttgaattttggctatcattcagtgatttggatatggattattgaattgtgaatttttttgtgctttgagatgaaaattttgactcaaaatgtgtgtccgttttgaattttgttcaatctcaatattggaaatttggaattggtgattgatggtctattggtgatggttggtgttggaacagatggaatcggatcttggcaagctcttcattgggggaatatcttgggacactgatgaggaacgtctaaaggaatattttgggaaatatggggaggtgatagagactgtgatcatgagggatcgag

SEQ ID NO: 2967 - DNA, 1169 bp, Glycine max
  misc_feature (48)..(49): n is a, c, g, or t
  misc_feature (1113)..(1113): n is a, c, g, or t
cggtgacatagcttctggagtttgtcgtggatggagagatgctatttnntttggccttgctcgtttatcactctcatggtatattgttttctctcttgatgtcttgaggatccttttctgtttctctccaattggggattttgttatggtgggagttttctttgttctttttgcttgtttgtgtgagttgattttgctatgctgtaatttgtgatacttgtgctgtttttctttttcttgcttttatcatgatttctttgttccattttgcttggcaggggactcagctgaattggtgaatccctgagtttgatggcatatttttagttgtttaagaatgagctgggattttctgttcagaatgtgatgtaatatatatggggtcaaataagggtttttaacttgctaagtcgatttaagaggtgtcttatgggttacttgctgtggggctgttcaaatctttaatttttctttgccaaggtgttctcgtgactgaactgttaagctctctaatctatttctttctccccttgataaattaaaagatgcaaaagttgtgtatgtcttcttctgctgattttttaacatgaaaatcttgaggtttttttaaattctaatgttccttgcataagtataacatggctaaccggtttttacttttaagtcactttggtataatgactttttgttaggtaagtaaaatctatttcttaaaattccttcatttgcctccattatttggcatctggtcagaatatcttgataaaagtagtggttttacagaatatacttattttgatccagtggcatgaagtgtttgtaattattctgcgttggtaaaggaactgatatttaaagtgcttgtagttattgtggagtttatttttttgaagtcatggaatgtactaataacaggtttttgttattcatctctcttcaggtgtagcaagaacatgaataacttggtcctatctcttgttcctaaattcgcaaaactgcaaactctaatcctccgtcaagacaagcctcaactagaggataatgctgttgagactattgcaaaatgctgtcatgaactgcagatcctggacctcagcaaaagtttcaagttanctgatcgttcactctatgagctcgcccttggtgtcgcgatctacaaaactcaactc

SEQ ID NO: 2968 - DNA, 612 bp, Glycine max
tatgaaaaaggtagatcatttattcttataaagtgatagaccttgtaaaatgtaacatttgctgatgaaatattggtgcttagcttaccatctttttcttaaaaaaaaaacaggtaattccttacatagcaagtgattatagtaaagatagaatatggctgagacgaaccagacccaacaaacgtgattaccaagttgttatagctgttgatgattcacatagtatgtcagagaatggctgtggtgacgttgctattgaggcattggttacagtatgtcgtgctgtttcgcaattggaaatgggcagcttggctgttgttagttttggaacgaagggaaacataaaattattgcacgactttgacaggccctttactggagagtctggtgttaaggttagcaggattaacaatttaacttataattgatttttctttcatcgacatcattattcatttcttgaatatgttcgagaggatctaattgtttgttttggctgaggagcagatgatctccaatttgacattcaagcaagaaaatactattgcggatgagccagttgttgacctgttgaagtacttgactaacaagctaaatactgcagttgcaaaa

SEQ ID NO: 2969 - DNA, 379 bp, Glycine max
atgatttggaattcaagtcaagcattatcaagaacgatgattttgaatcgagaccaagtgttactaagtatgatgattttgaactcaagtcaagcgttaccaagaacaatgattttgaaccgagaccaagtgttaccaaatatgatgattttgaactcaggtcaagcgttaccgagaatgatgattttgaaccgagaccaaatattagcaagtatgatgactttgaactcaggtcaagcgttaccgagaatgatgattttgaatcgagaccaagtgttaccaaatatgatgatttagaactcaaatcaagcattaccaaaaacgatgattttgaaccgagaccaaatattagcaagtatgatgactttgcatccaggtc

SEQ ID NO: 2970 - DNA, 324 bp, Glycine max
agacccaaccaatttctgggacctccaatcctcttttgctaaatccaccccctcgggcttctccgccaactacatcatcggcaacttcatcgtcttcatcagagactcccatctctcccacaaaatattctccaatgtcaggcctgacgcctttcaccttgtgggccaccccttcggtaaaaagctcttcggccaacacaacctcatctacatgactggccaagtccacaaagatctccgccgtcggatcgcccccaactttacacctaaagccctctccacctacaccgcgctccagcagattatcatcctcaaccacctcaa

SEQ ID NO: 2971 - DNA, 1093 bp, Glycine max
  misc_feature (582)..(584): n is a, c, g, or t
  misc_feature (699)..(701): n is a, c, g, or t
  misc_feature (703)..(704): n is a, c, g, or t
  misc_feature (729)..(729): n is a, c, g, or t
  misc_feature (1014)..(1015): n is a, c, g, or t
  misc_feature (1048)..(1050): n is a, c, g, or t
  misc_feature (1082)..(1089): n is a, c, g, or t
aggattgtagagttccttcagaatgaagttggcgtagatgttaaggtcactgatccctttggtggttcagatgaacagataattatcattacttcagaggaggtacttttcttctcttattttttctgtttctctgtctgatgtgtagtttgtataactagtgaaaattcttatgggtcactagtgcaggttgcaattgttataggggcactagtttccctgcttaatttcaacttttctttagtgcaatttgacataatatatgttgcatatttgaaattctaactgttactattatgtacccaagggtcctgacgatgagctgttcccagctcaggaagctttgttacatgtacaaactcgcattgttgatcttgttctagataaggacaatactataaccaccaggcttgttgtcccatctagcgaaatcgaatgcttagatggaaaagatgtttctctatcggaaataaggaggttgactggtgctaatattcaaattttgcctagagacgagctacctctctgtgttgcaaaaactgatgaactggtacaggtttgtcacttgacctacagcttgcnnntatattctattagattcctttgataaatttaggctgaaagagttaatgataaatgttgaggtttataatagatgttcttcctcaaagcatcatactggattgtatgtgtactacnnnanncactaatttttgcaaactaaagaangtactgatttcattggtttttctcattaagatatttccaataaatggtatagagaggatccagatgagagtgagcttggacacaatgataaggttattgtcccgtgacctagaggtcattgatttaaatctagcaaatagctcttcacttgtgggggtaaggctgtggatatatttatcctccctcccctgaccccccatagatgggagcctcttcatgcactagggtatagagaggatccaaaaccttaccttccagttctacaaggttaaaacaaagacccgnntaggcaagttctgctttctacatttctcaattnnnttctttattgacattacagatcgtagagagannnnnnnncccc

SEQ ID NO: 2972 - DNA, 982 bp, Glycine max
ggttggggtcagaaggaaagtgtcaagattgtttttggacgatggcaagatgttctgcctcagcttgaaacatatgatggtatttgctaatcgcccaattcttatgcttagttgcagccgcattacaattacaattaataggatattctcctgtgaaaaatattgcaatgttattgtcttatttatttgtttactagtatatacattaagtagtgtatacaagtgggagagcctcatcccccatgagtagcagcatttggaaatgtgtcagatttaaattcaaattctaagatgatattacagcctactccaacagttgttcttgttttagggtctatcagttgaccacttattattttttatttatttatcgacaaatgttatctgttagtggagggattcaaacccgcgatctctctctcctttccttctcccttcaccattagaccaaccttgtatctccacctattattgggttgatattgaaccacccacaaatgtcctgcaatcacttgtaaatgtccaattctataaacttcacattctaggcgtcaaatgttaggtgtgaggtagtgtgttggagatgctctgttcactagtaatatagccaaaatagtgtatataagtgaggagtaatcctcaccctatctatcagttagctttcatagtcatgttagaccttaactcaaactataaaagagtttttaaccgactctactaacatcacaatcatgcaatcccatatagcttatcttacctagtgggaaaagacttctttgttattatgtctttgatatgggtcattggcgtgaattttgttcaggaatattctttgacacctatggggagtactacgaagatctgagggagttccatcagcatctccccgcattgttgaagcctggtggtatctactcattcttcaacggtctttgtggcagtaatgcatttttccatgttgtttactgcaatttggtatccc

SEQ ID NO: 2973 - DNA, 829 bp, Glycine max
agcttattggcggagaagactacggatgctgcgtgacatatgcaagtaagtgttatggttattcatacttagaatcttatttcattggcatttatgctgaacaggtgttacatattaattacgatgggtgtcctcttccaataaatcataaaattttccctgcccatttactttaaatagctgtcatcttttttgttaatagtgttacattatttattttttgtggatttggtcacaatatttaatttgggaatgattattttatcttattatattaatataatacattttaaaaaatacatttattgttacccatttgataatgatttaacaaatgaattatgaacaccaagtaacttggttgaatatccagttcagttttaagttttatgaacgttggtattacccatttcaaatgtcatctcaattttgacgagaacaacttgcttgtgtgtaggggtttgatgtgcatacaccgaatgaaggttgttcaccgtgatctgaaaagtgcaaattgtctagtgaataagcattggaccgtcaaaatatgtgattttgggctttcaagaataatgacagaatctccaatgagagattcttcctcagctggaactccagaatggatggctcctgagcttattcgaaatgaaccattcacagaaaaatgtgatatctttagccttggggtgataatgtgggaactctgcaccttgaacagaccatgggaaggagtaccacctgagagggtatattcaacatattaactgttcatgttgcatgatgatttctgtttctatcgtgtgctttattgaaaatttttcattttctc

SEQ ID NO: 2974 - DNA, 635 bp, Glycine max
ctttacgagacagtgactgaattatcacttaacctggaagttggtcccattagtatgacgaagtggcagttattcctgcagattgaccagtccttccagattcaccgtagttatggaagcatgcttgaaggcgaggctgatgaactcaaggtttgttgttttagaaaattgtctcaattctacataattatcgattcatagtatattgaacttatttgatggaacatgcttgctgagtacttgggtattatgctgaactatttgattggctaactatttgattttgataattatatcagagggtattcttggaagggaatccttacctcctggcaattaccatggttgtttctcttctccattcagtctttgacttcttggctttcaagaatggtaagtcaattgtccaacagtctttaagaaagcacctccaataaggaaatgcatatggatttggttagaggtacaggtaatcatctaattattttctctcttcccagatatccaattttggaataaaaataaatctatggaaggactctctgcaaagaccgttgttgtgagctttgcttgtcagcttattatcttcctttatctgcttgacaatgacacctcttggatgattcttgcaagct

SEQ ID NO: 2975 - DNA, 978 bp, Glycine max
  misc_feature (941)..(943): n is a, c, g, or t
  misc_feature (975)..(975): n is a, c, g, or t
acattggtggattagagaagcaggtgagctttggttcttgccttaatttattgaagcccttgtttgggttagttaatgcaatctctcaggtcatttcaataacttggtcttcctcaacagattcaagaattagttgaagctattgttttgcccatgacccacaaggagcgattccaaaagttaggagttcgtcctcccaagggagtgctgttatatggacctccggggactgggaaaacattgatggcccgtgcctgtgcagcacagacaaatgccacttttctgaaattggcaggccctcaactggtccaggtatgacaatttatttctagtttttctttttctccattatatatttgtaagcatgactaatgattccattgttacatgtttgtaccaactaattataccatcgttacatttttgtacctttttcccccatatttttttcctagtagtcgtgaatagtcattaagtagggtcatattgatgatttttcttcagtttctgttggttaaaatttgccagtgatgtatgtcaacatcacttgtttgtgcaaggattattcctcatgttactttttttaatattctgagtacaaacttgcatcaaaatagggcaaatagcaagtgattcatctgacacatctaaaatagtcaagacttgtttcctctatttcacttgcacactactaccttatttgtttgtattcacgtctcttgactgggtttggattataatgatctaacctgcaattttgtacagatgttcataggagatggagcaaaacttgttcgtgatgcctttcaactagcaaaagagaagtcaccatgcattatttttatagatgaaattgatgcaattggtacaaagcgttttgataggtattaggtggcagtaatttagatatacatttgcaattgacttttttctttcttttnnnaggtagagagatcagagtgttacttagttatntcg

SEQ ID NO: 2976 - DNA, 401 bp, Glycine max
gccctgtttggaaggccagatattcgtgtctccgacgatggttcaattgaaacatccaatgatgaattgctttcactcactttctcgggcctgactatgctagttttggaggcaattgcttttggatcattcctatgggacaaagaaaactatgttgaatccaagtacccttttcttaatgagtagactagatgacagtacacagattctttcctttcactgcatggaacttggtaacttagtaatatgttaggcggcgtttgggtggtcttgctatcttaactggtgtgctttcaaactattatagaatctgaaacaaatcatgggcgtggagttatataggaaaatgtacatatttagcatgtagacatgataataatctatgcaagcctggactttga

SEQ ID NO: 2977 - DNA, 300 bp, Glycine max
tcttcctggcctacgagggtgagcgccgcgtggccggccccgccttcaaccccgccggctccttcggccgcaagatgaccatggatgacctcatcgccaagcagatgcgcgtcacgcgccaggagaatccgcactgcgagctcgtctcctttgaccgcgactgcgccaacgccttccagcactacgtcaacgacactctcgccttcgccgtcaagcgcggcggcttcatgtatggcaccgtctcggaggagggaaaggtcgaggtggacttcatctacgagcctcctcagcagggttcgg

SEQ ID NO: 2978 - DNA, 648 bp, Glycine max
gcaaagaggctttgccactcacccaagaagtattgcagagagggtaaaattctatcacatctagcaattttaaatctatagtcagttagtcaatttccatactaacaaggccatgaacttaacggttttatattttttatcctcaggtaagaagaacaagaattagtgaaagaatcaagaaactgcaagacctttttccaaaatcagaaaaggtaactttatttgaaattccatttgattgaaatttcactcactttgaaagttgatgataacttataattcttcccttggcagcaaacaagcacagcagatatgttagatttggcagttgagtatattaaggacctgcagcaaaaagttaaggtactagagaagtataaatctttccataaattctgaaaagaatatacacattaaactccaccaaagttatagtgtctaactaaatttatttctcctcgtgcagatactctcagattgtaaggcaaagtgcaaatgtacaagtaatgagaagcattacactagaacttgtgcttgatttatttgcatgtagatagcaaaaggatggaagattttttagtgtgccaaagttagcaattgtaattagataaaataatgctgacatttgcctggagtgagtttaggaca

SEQ ID NO: 2979 - DNA, 360 bp, Glycine max
  misc_feature (310)..(310): n is a, c, g, or t
  misc_feature (315)..(315): n is a, c, g, or t
  misc_feature (329)..(331): n is a, c, g, or t
cacccttgacaaaataaaaacacaaggaatatataccctttaaagccatatttctctgactctaagggtaataaaaatgtaaacaatgccaggtagttaaaatcaaggactacaacccattgaagtaatatcccaaatctcctactgttcagtaagactgaaatgcattaacagaattctataatttaccccagtccaactagggttgtgtgctcgtccatgtgataaattaatgatgttgtaaggaattcctgtaggtgtattccatgcaggcagtaatctgtctgcaatttctattgctttgttgagnaaaantttgtcccctgaannntcatatgccctaaaaagaccacctactac

SEQ ID NO: 2980 - DNA, 783 bp, Glycine max
gacccaacataggcgactcgggtttcctgcagtgtctggaagaggcaggacaaggaaacccactgaacaaaacctttgtgaaggtgagtttttccagtgacataatattttttcaattaaaaaaaaatcattctcatgtattgcacttttacttaatatgtttttttgttacaggtttataagtcagggtcctttggaaggtcattggatatcactaaattcagcagctaccatgagctgcgtggtgaactcgctcgaatgtttggccttgaaggcgagttggaggaccctgtgagatcaggctggcagcttgtatttgtagaccgagagaacgatgttcttctccttggtgatggcccctggccgtaagcctctcatacttcacatgccttattctttgtttcctcttcctttttccttcaaatacaaaattgcaagtatagaatagaaaatgacagacttgtttaaattgatatcgatgttttctattaactaacacctttggaaataatggaatagcataaacttgtattacattgctttttggccttccatatggcggtgatgatttatatgttgtggatttaagtatctttatttttttataaaaatcaaatgatcaatgccctttttttgtacatatttgtcacagggaattcgtaaatagcgtatggtgcataaagatactttctcctcaggaagtgcagcagatgggcaacaatggccttgagctgttgaactcgtttccaattcaaaggctctctaatggcatctgtgatgact

SEQ ID NO: 2981 - DNA, 369 bp, Glycine max
agtgcggaagcttcctccgccgcttccggctgccggaggatgccaaccccaaccagatcagctgcacgctcgaaaacggggtgctgaacgtcaccgtgcccaaggtggagaagaagccggagaacaagaacgtgaggcagattgatgtggtttgatgatgatggagcatcatgaggacttgtaatgtttgaatgagttttgtgttatgtgtgtgtgcgcaactgtgcatattactgtacaagttaataactacgtgtctgccatatgaatcaatgtaagtttgatatgaatgggaggaaactttgtttgcatagtttgggaattttttttctttttcttttctttgttttcatcttattaattaaggtg

SEQ ID NO: 2982 - DNA, 400 bp, Glycine max
  misc_feature (32)..(32): n is a, c, g, or t
agtatgtgcagaagatgacctttgatagctanttgtacaagacagtggtgcctggcaatccattggaggatctgaaattggccattaacaccattgggagcttagtgagggccaatgccataaggagggagatgaacaaacttaacgtatgacaataatagtcattatcatatttatcattcatttttgctttgtgtttttcctagtggacatgatctccttataattaagtgataattaactatatatgtgtaagaaaaaggattgaatttcatgcaatcccataaccggtatttgtaccttttatctgcaatgatgtaaaatgctagagtactagcaaagatttacttctcagttctcacacattggccataggttatgtcagctagatttaaagatt

SEQ ID NO: 2983 - DNA, 411 bp, Glycine max
gaaagccagtggatatgtctcaacctcagggacaggagaatcttgtaacttgggcgcggccaatgttgacgagtagagaaggtgtagaacagctggtggatccatctttggctggaagttacaactttgatgacatggcaaaggttgctgctatcgcttcaatgtgtgttcactcagaggttacacagagaccttttatgggtgaagttgtgcaggctctcaagttaatatacaacgatacagatgagacttgtggagattattgtagtcagaaggattcctctgctcaggaatctgattttagaggtgaccttgccccttctgatagcagttggtggaatgcgggagggctaacccctcgaataacttacgggcaagcttcttccttcatcactatggaatacagttccg

SEQ ID NO: 2984 - DNA, 373 bp, Glycine max
  misc_feature (370)..(370): n is a, c, g, or t
gttgctggcggtgaggaatgatgatgagctggggaaactgcttcaaggtgtgactattgctagcggtggagtgttgccgaacattaacccggttttgttgcctaagaagagtaccactgcgccttctgagaagtcctctactcctaagtcccccaaatctcctaagaagaaatagaagtttcattttgtaaaggcttatcgttttttatttttattttttgggggtaggggttggtaacattaccatatatatatatatagttcttaggttaggtgaaatatgatggtgtaatttagcgccaggtgttcgcttttttgctttttttggtcaccccatcgatggctgaatatgatgttaaatgtagggggnttg

SEQ ID NO: 2985 - DNA, 825 bp, Glycine max
aaaaaatatgaacaatcaaaaagaagcttgtaaccaaagcttgtactagcattctgcatagcggcccccttcccccttcaaaaagttgtcaatttgttctagcgcctgcaagatacaaagggggaacattagataacatcaatgaaacaaaagttagattcaactttagctcccaggaacttttcagttcgcctagagctgacgaaattagaaggaagggcatgaggcagaaattgtgcaagacctcaattgcaatatctgttggagacaattcggacacatctcttttgcccagttttattgctatatctgtcacaaacaaaacagcatcagacattgcattttaatgttatcatcttgttgacggatggtgttaacacatctaagaagctttcaacaataaatacaaagcatgtttgttctttcccagatattctggacaaattccacactatttattccaaaacattaaggaaagattaatagacatactttttaatgagaccctggcattggcgttggcgtatgcttcacctctctcttcaaaaagagcagacaaacgcataaaagcctgaacgtgaattccaaagggtaaaattatttagtggaaaaataattttgatgcaaattcctatgatgataagttggtccaacttggtagcttaaataagttggtcctatgaagaacactcctactatagaacataaatacttacccgtgtgtaaggatctcctgcttcatagtgtagaagggggcgagaattagttcctacagctgcaattctctgtgccagggcttccactggtacatccaaccaaacacta

SEQ ID NO: 2986 - DNA, 517 bp, Glycine max
tatctacaatttcatcaatcaaatctatactaattactaattaaccttgttttctattcaaactcaccttatattatttagttagtatttgtgataaattcgtgtaaattaagccttcacaacatttattcttgtttaattgtgttaattttcagggaaagatagcattagtgactgggggtgactctgggattggacgagcggtgtgtaacttgtttgccttagaaggtgctaccgtgggcttcacatatgtgaaggggcatgaggacaaggacgcgagggacacgttggaaatgatcaagagggcaaagacttcggatgctaaagatccaatggcggtaccagctgatttgggttacgacgagaattgcaagagagtggttgatgaggtcgtgaatgcttatggttgtattgacattctggtcaacaatgcagctgagcaatacgagtgtggaacagtggaggacattgatgagcctaggcttgagagggtctttcgtacagggtctttcgtaca

SEQ ID NO: 2987 - DNA, 477 bp, Glycine max
  misc_feature (465)..(474): n is a, c, g, or t
actggactatgtaagcatgccttgaccttgtttaccgatttggtcgcagtttttgtccggattcttgttattatggtgagtttgatcgttaagcaacaacctttttatatattctcttctaccttgcaaatttgtattgacggaatttttcctattatttttcagttgaagaattcgactgagaggaatgagaagaaaaagaagagaagagattgattttcttaccaatctgctcgattaacacttcacctcgcttggtctgtaatacataaaaacagccgtctatacagtgttttccactttttaagcttgctcctcctactgtgcagttaagtcgtttgtttaccaatagtacatgttgacatgttttgagctctctaataagagaaatgtttacattacatttgttttaaagatgaaaaggggagtggggaagaagtcgatggtgaaggtccctaataatgnnnnnnnnnncta

SEQ ID NO: 2988 - DNA, 399 bp, Glycine max
  misc_feature (58)..(59): n is a, c, g, or t
gcggtactattgtagctattgttatattcaagagcttaatgattttatgagaatgtannattactagggaactcctatgatttgttatctcagtttataatctttgcatttacttccctattatgaactttgtatttattttatgcatattggaatagaggaccattcttgtttcagattgaatggttttggctatatttttggataccaatgatgatatttacttcgatgcttttacatgttcatttgacatgacactgctggttttcaggataatgaaccattgatgagagcactgtcaaagctcgtctacctcaacaatcctaaccttatcttatttgttggagaagcactggttggtaatgatgcagttgatcagcttgcgaaattcaaccaggc

SEQ ID NO: 2989 - DNA, 399 bp, Glycine max
aacgaggctaagactttggagcaggaggctcatccggccttggacaagctcacctccaagatcagtactctcaatttggaacgcgttcgtcaaattaagagccgattagtcgccatcactggccgtgttcagaaggtcagggacgaattggagcacctgctcgacgacgacgatgatatggctgagatgtatctctctgaaaagctagccgaacaagatgacttggagaaggcggaggatacctcttctgccgacgatgttgatgatcacattgacaggcacctcttccttcccttttgactctccttctttcccttctaacctctatatgtaattcatccttctattttttttttttttaggaccgctcctgaaatatcgttggacaatgttgtggga

SEQ ID NO: 2990 - DNA, 366 bp, Glycine max
  misc_feature (9)..(10): n is a, c, g, or t
agagcgaanngaagtagaaatgcactctcactcacacccacatgccttgccacgcccacattcactactcccttcttcttttcttcttcttcttcctccttcctctctccgcatctccaatactaagaggctgcagtcctcaactttcgccctctcccaaaatgaaaccaaattcccaacgcagccttacaagaattccaacaattcgtctcaatcacttgctcacatctccaattgcaaattccccttggctcggccccttgtttcttcttctcatcccgctagtactaattcatccaccaagcttctcaactctatgctgctcttcgccttcctcacacttcaaccctcttatcctgcacttaa

SEQ ID NO: 2991 - DNA, 627 bp, Glycine max
  misc_feature (390)..(391): n is a, c, g, or t
  misc_feature (396)..(398): n is a, c, g, or t
  misc_feature (551)..(551): n is a, c, g, or t
gatggcttcgaatgcaacggcggggaacacggtggggacagcggaggagttagggctggtgaaggtggactatgacatgccggctggaggttacggtggctggtcggcggcggactccatgcagacgtcaaatggtggggtgttcacaatgtggaatgattaaggaagggaagctagttctagtatgggacaacgtactagttagttgccatacaattttgttatgcatttttatttttttgtctttgggtttttaatattctcgcaattggaaaagaaaaataggtgctgattttctgtgagacattgatcacaaaggaagtgagcaaagaccatatatctattatatatttatgtctctcttattatgccgaatgtttgtgaaactanncatgnnnatattagtctactacctttgcttttatgtgctctttactttcacatgatgatgaaatgatcattgattcaatgtttttcattggttggtcaatgttttctaatttctcataactacatggttgattgttcctcaaggtacaagcatttaggtnaattcgctcctctaggaggagagcaaacagctgcacagcttcctggggattgggtttcaattggacacagctctca

SEQ ID NO: 2992 - DNA, 760 bp, Glycine max
ttcgagcttcagacaacattcctcaatacagtgttgtgttctacacctcgtaagtattctatctaaattatgtgtcttattgtatgtttaactttcgtggtttgttgtgtttgaaaaaagatatatattgttaatgtgagtggttttggtttgactaaaaatgaataggatactggagaaagcacctgcagcaaaggacttgttctcatttctagcaaatggagtagaccccactaatcctaagctcacgggccatgctgaaaaactttttggattggtaagtatcagcctactaaaattaaaatcctattagtattttttattatttttcttccatgattgtcttgtcacatattatatattttttgaattataggtacgtgattcagctggtcaacttaaagcaagtggaacagtggtgattgatgccgcacttggttctatccatgcccaaaaagcaatcactgatcctcaatttgtggtatgataaataatgaaaagctacaataaatgcacaaatacttaattttacatagtgcagtgctatatgatcatcacttttgcttagtaatgaatttacttattttttttacagaagtaatggatttacttaaaatcttaaattatgtccttctttaaagagttttgtatggaattttaattataaggaaaaatgtaagagctaaaccattgctgatgatttcgaaggtggttaaagaagcactgctgaaaacaataaaggaggcagttggggacaaat

SEQ ID NO: 2993 - DNA, 405 bp, Glycine max
tctgagttcttgcttggcttctggtcaatggaaagtcacggctttcctccaacaaaaatctatacacttcccattgacgttcttgtgttgaatgtctaacaacttcagcctacaatacaacaatgaaagagcttttattcagaaactgttactagattcctttaaagaacatcaaacattgtcacaataagctttaaaacataaaaacttaccgagaaaatgcctactcccaacgcttttaaagtcaacgtaacatcatagaatacacggggtctcccctttccactcagctccacaggattagcaaccagaagttctgtgtctggaccccggttcactatcgtcacccgcaacggatgaagcatctcttcttttaagcatgaacacaaggttttctggctttca

SEQ ID NO: 2994 - DNA, 603 bp, Glycine max
  misc_feature (55)..(55): n is a, c, g, or t
  misc_feature (107)..(107): n is a, c, g, or t
  misc_feature (131)..(131): n is a, c, g, or t
  misc_feature (140)..(140): n is a, c, g, or t
  misc_feature (145)..(145): n is a, c, g, or t
  misc_feature (148)..(148): n is a, c, g, or t
  misc_feature (150)..(150): n is a, c, g, or t
  misc_feature (167)..(168): n is a, c, g, or t
  misc_feature (173)..(173): n is a, c, g, or t
  misc_feature (177)..(179): n is a, c, g, or t
  misc_feature (182)..(182): n is a, c, g, or t
  misc_feature (196)..(196): n is a, c, g, or t
  misc_feature (198)..(198): n is a, c, g, or t
  misc_feature (205)..(205): n is a, c, g, or t
  misc_feature (207)..(207): n is a, c, g, or t
  misc_feature (230)..(231): n is a, c, g, or t
  misc_feature (237)..(237): n is a, c, g, or t
  misc_feature (242)..(242): n is a, c, g, or t
  misc_feature (244)..(244): n is a, c, g, or t
  misc_feature (250)..(250): n is a, c, g, or t
  misc_feature (260)..(260): n is a, c, g, or t
  misc_feature (271)..(272): n is a, c, g, or t
  misc_feature (277)..(278): n is a, c, g, or t
  misc_feature (280)..(282): n is a, c, g, or t
  misc_feature (288)..(288): n is a, c, g, or t
  misc_feature (294)..(294): n is a, c, g, or t
  misc_feature (299)..(299): n is a, c, g, or t
  misc_feature (303)..(303): n is a, c, g, or t
  misc_feature (308)..(309): n is a, c, g, or t
  misc_feature (311)..(311): n is a, c, g, or t
ttttttagggttcctctgttcttcttcgcccccaaaaaaattttctggctcaganaaattcaaccgttctcgccattgccgaagctccaactcctcgcatttccaantcttcacccaaaaccctttttgtnggaacagantttcngananagacccttcacaacacnncaaanaggnnnccnggcagaaaagacgngnattcctncnccatcagcggcaccaacaagatnntaagangtaanancaaganaccctttttncttttcagctnnccagnngnnnaaacgncctcanaatcntttnttttnngnagggaaggggagggaatggtgtgaaaccaggtgggtgttgcgatgattagtgaaaggtgttttgttttttttgttgtgttctgcagctggggactgtgtgctgatgcgcccctctgataccagcaagccaccgtacgtggcgcgcgtggagaagatcgaacaggataataggaacaacgtgaaggtgcgtgtgaggtggtattataggcctgaagagtctattggaggacgcaggcagttccatggagcaaaggagctgtttttgtctgaccattatgatgttcagagtgct

SEQ ID NO: 2995 - DNA, 353 bp, Glycine max
cttcaagggctacggcaaagttgacgagttggagcagcaagcctatcagaagaagacacgtaagcgcctcataataatcacagtctcttcaatcgttctaattgcggtgatcatcgccgctatcgcaggggttgtcatacacaagcgcaacacctcatcatctccctcatccgactcgcccccgcaaactgagttaaccccggccgcgtcactcaaagcggtttgcgacgtgactcagtaccctaactcgtgcttctccgcaatctcctcgttaccggattccaacactactgatccggagctcctcttcaagctctctctccgcgtcgccattgacgaattatccaagctct

SEQ ID NO: 2996 - DNA, 812 bp, Glycine max
tcgtacttcttaaattaacgtttttttttaagcacgtggttgtttggtcccatcgtgaaatttcatgtcgtgtctcattttattgttgtagtgagaaataggaaaggatatttatctatggcgatttgcaagttgaaatctttgctttctctttcgaaatgcaactctgcgttggtctcctcttcaatacgcgctttctcttcggcacaggttccccctaatcacttgcgggtctctctctaatcttgtcattaattttctaagctgattaattatgagttgattaagttgatgcatgttttgtaaattttcacttttctctcttttcactgatgcactgcactgcagaatgttggattcattgggcttggaaatatgggatcacgaatggcaaataatctgatcaaagctggattcagactcacagttcatgacctgtaatttttaaacattttcttgatcttatcatgcctttgttcttggatatataaggccacagtttgaatccctctgctaacaatacaaacaactaacatttgctaaaaaataaaaaataaaaaaacatgcctttgttcttaagttcgtccctgtgatagtgctactatattctcatttcttttgtaggtgcaatttcatatgatatagattagatatttggggcatggcttgagagtttgagttaatggcactgttaacataaattggttgtttcattttttgttaaatttaaacagattgtttgtggtggtgttaattgagtttgttcaaaattagcagaaactctgatgttctcgagatgttctctcaagggg

SEQ ID NO: 2997 - DNA, 375 bp, Glycine max
tagcagaaacttctacaggggagcaggaagctattttactaggtacaggtttaaaccaacaagatcacgaagcagatgttggactacggttgaggcacgtaaatcaacaggtgggctgaattgtattttcagggaggaaggccactgtgtaggttgtgaagcctcgtgctgacatggttcatgaatcactgatgtatactctacacttgtgttgggttagttataatacctcgtcatgacacacctgtgcttatagttaacgttaaacattttgtgcgtgtcgtttaaaatttagctaataggaggaaaataaaattgttgatagcgcatttttttttcaaagaaattctttgtgaaatagggaagctggtctag

SEQ ID NO: 2998 - DNA, 864 bp, Glycine max
tctaactcctcaaatgaattgcgcaagcctgttaccccagatcgtcttagagtccccaaggcattcaaatacccagaaaggtaatattatccatttatatattaagagtaaatagtgtcgattatttttcattaatagattaaaatttatcaaaaattataattttttaagtatgatgaacacttctccattgtgatacaataagtttgttgattttaacaaaataaataatacagaatatgatttttaattaattcacggtgtcgaaattttcacattaacaccattgaaattaaactcaccaatatatacgtagtctttttatgaaattttaaggagaaaacatgcagatgagttgacaattgggttagtgatgtgaatatgtgaggtcttaaatcttaatgtgtttcttcattttgtcagatatacaagcccaacagatttgatgatgtcaccagtaaccaaaggccttcttgctagaactagaaggggtggtggtgcggtgttaccacctgggggtaaaaatcgaccaaaggtaaacccaatgaggcaataacatattgttctgcattcactttttctagctatgctactttactcttttttggtacttgcaatttgcacagtgcttgtatatgtatgtcattttcaactattgcagattctagacatgcccttgaaggatgtcggtcctatccagaacaagcttccaatgcttattgatgagaagatcaactcagcttgaaggattcaaaggacttttgttcaacatgataattcatttgacagtggttcaaagggagtttaaagatgatgatgtaataacaataacatcacacagagagagaaagagagagtttatct

SEQ ID NO: 2999 - DNA, 383 bp, Glycine max
agctgccccggagcctcgctagcgttgcttgtcatgcaagcaacgctagcgagtttgatccagtgcttcgactggatcgttaatgatggtaaaaaccatcatgttgacatgtctgaggaagggagggtgactgtgtttttggccaagccactcaagtgcaagcctgttccgcgtttcactccgttcgctgcctgaagactgtgaatggaatggtttctctagttgtgtgtgctttacctactctatatttttaccttatttttgcttactttgtggcactagtatttgttttgggaagtagcgttgcttctgtaaacttggtggcaggggtatattatttatggaaataagtggtggcttggtagttattcccgtccatttct

SEQ ID NO: 3000 - DNA, 913 bp, Glycine max
tcataaaaaaccggtaacatagtatttttactctgtagtacaaaatctttaatataacaatcaagtgctaactcaaaattcatactgcacaggttggtctactgaatgttgacggttactataactgtttgcttgcattatttgacaatggtgttaaagaaggtttcattaagccttgtgcacggaatatagttgtctctgctacgtcagccaaagaacttatgatgaaaatggaggtctaatttcaactagccattttcctcttatccttttaaaaggaacacagtagaaatgtgtgcatataaaatttttgttcaaattaatggtaaattggtttaccagggtcatgaggaaaaaataattgaacatctaccattattataaaatgctaataatattgtaatgcatagacataaaactctttgcatgacttattacttgggctagtgagaatagattggaggtcatattttttcttaaattctcccccccttggcactttttgtgtgacagttgtcaagtaggactttgctgcattaagcactttgttgagtaattgttgtcatccaggacttttctgcttatgtggcaatcgtaagcatgaaggcttatataggatacatgacttttaaaaactctcaaaatgatcatacgcataaatgatttcaaagggaccgtgctttctcttctctctcttttgccttatttcctttgagggataaaagaagtgtacaaattaccgtgttgaacttgaattctagctgacttttcctttttgcagcactacactccttcgcacgaacatgttgcccctcatcagagctggcagatgaaacaattaggtaatatccagatgcagagtgagactgttattgatggaaggtttttctccgaaaattgatttatgatgtga

SEQ ID NO: 3001 - DNA, 401 bp, Glycine max
tgatgacgacgatgacgatgacgatgcacctcagcggtttaataaaaatgacccttaccttatgagtcctgaggagagactggaatggaggaggaacataagacaggtgttggataggaaacctgatgttgaagaggagttagaccctctggaaaagaagaaaaaactggagaagcttttggaggattaccctcttgttgtggacgaggatgatcctgattggccagaagatgctgatggttggggattcagcttgggccagtttttcgacaagattaccattaagaacaagaaaaaggatgatgatgatgatgacgacaacgatgatgttgatcgtccagaaatcatgtggcaagatgataattacattcgtcccatcaaagacataaagactgccgaat

SEQ ID NO: 3002 - DNA, 1452 bp, Glycine max
  misc_feature (413)..(418): n is a, c, g, or t
  misc_feature (420)..(436): n is a, c, g, or t
  misc_feature (438)..(449): n is a, c, g, or t
  misc_feature (455)..(455): n is a, c, g, or t
  misc_feature (457)..(459): n is a, c, g, or t
  misc_feature (462)..(465): n is a, c, g, or t
  misc_feature (467)..(469): n is a, c, g, or t
  misc_feature (472)..(475): n is a, c, g, or t
  misc_feature (477)..(489): n is a, c, g, or t
  misc_feature (499)..(504): n is a, c, g, or t
  misc_feature (506)..(522): n is a, c, g, or t
  misc_feature (528)..(533): n is a, c, g, or t
  misc_feature (538)..(543): n is a, c, g, or t
  misc_feature (547)..(547): n is a, c, g, or t
  misc_feature (549)..(554): n is a, c, g, or t
  misc_feature (558)..(584): n is a, c, g, or t
  misc_feature (588)..(592): n is a, c, g, or t
  misc_feature (594)..(597): n is a, c, g, or t
  misc_feature (599)..(603): n is a, c, g, or t
  misc_feature (606)..(612): n is a, c, g, or t
  misc_feature (614)..(618): n is a, c, g, or t
  misc_feature (620)..(626): n is a, c, g, or t
  misc_feature (634)..(634): n is a, c, g, or t
  misc_feature (636)..(636): n is a, c, g, or t
  misc_feature (638)..(648): n is a, c, g, or t
  misc_feature (651)..(651): n is a, c, g, or t
  misc_feature (655)..(656): n is a, c, g, or t
  misc_feature (659)..(659): n is a, c, g, or t
  misc_feature (661)..(664): n is a, c, g, or t
  misc_feature (667)..(671): n is a, c, g, or t
  misc_feature (674)..(681): n is a, c, g, or t
  misc_feature (685)..(685): n is a, c, g, or t
  misc_feature (689)..(691): n is a, c, g, or t
  misc_feature (695)..(702): n is a, c, g, or t
  misc_feature (705)..(718): n is a, c, g, or t
  misc_feature (727)..(735): n is a, c, g, or t
  misc_feature (739)..(744): n is a, c, g, or t
  misc_feature (747)..(747): n is a, c, g, or t
  misc_feature (751)..(752): n is a, c, g, or t
  misc_feature (754)..(762): n is a, c, g, or t
  misc_feature (766)..(778): n is a, c, g, or t
  misc_feature (780)..(782): n is a, c, g, or t
  misc_feature (784)..(788): n is a, c, g, or t
  misc_feature (791)..(795): n is a, c, g, or t
  misc_feature (798)..(800): n is a, c, g, or t
  misc_feature (802)..(803): n is a, c, g, or t
  misc_feature (805)..(806): n is a, c, g, or t
  misc_feature (810)..(815): n is a, c, g, or t
  misc_feature (821)..(827): n is a, c, g, or t
  misc_feature (829)..(841): n is a, c, g, or t
  misc_feature (849)..(854): n is a, c, g, or t
  misc_feature (856)..(856): n is a, c, g, or t
  misc_feature (858)..(875): n is a, c, g, or t
  misc_feature (878)..(880): n is a, c, g, or t
  misc_feature (884)..(886): n is a, c, g, or t
  misc_feature (892)..(896): n is a, c, g, or t
  misc_feature (908)..(915): n is a, c, g, or t
  misc_feature (917)..(922): n is a, c, g, or t
  misc_feature (927)..(933): n is a, c, g, or t
  misc_feature (935)..(940): n is a, c, g, or t
  misc_feature (942)..(943): n is a, c, g, or t
  misc_feature (945)..(957): n is a, c, g, or t
  misc_feature (961)..(967): n is a, c, g, or t
  misc_feature (969)..(970): n is a, c, g, or t
  misc_feature (975)..(980): n is a, c, g, or t
  misc_feature (983)..(987): n is a, c, g, or t
  misc_feature (989)..(994): n is a, c, g, or t
  misc_feature (996)..(998): n is a, c, g, or t
  misc_feature (1003)..(1008): n is a, c, g, or t
  misc_feature (1013)..(1026): n is a, c, g, or t
  misc_feature (1030)..(1030): n is a, c, g, or t
  misc_feature (1032)..(1032): n is a, c, g, or t
  misc_feature (1034)..(1039): n is a, c, g, or t
  misc_feature (1041)..(1041): n is a, c, g, or t
  misc_feature (1043)..(1049): n is a, c, g, or t
  misc_feature (1053)..(1056): n is a, c, g, or t
  misc_feature (1060)..(1068): n is a, c, g, or t
  misc_feature (1073)..(1081): n is a, c, g, or t
  misc_feature (1092)..(1095): n is a, c, g, or t
  misc_feature (1097)..(1097): n is a, c, g, or t
  misc_feature (1100)..(1114): n is a, c, g, or t
  misc_feature (1118)..(1124): n is a, c, g, or t
  misc_feature (1126)..(1135): n is a, c, g, or t
  misc_feature (1146)..(1149): n is a, c, g, or t
  misc_feature (1155)..(1156): n is a, c, g, or t
  misc_feature (1158)..(1165): n is a, c, g, or t
  misc_feature (1169)..(1178): n is a, c, g, or t
  misc_feature (1180)..(1199): n is a, c, g, or t
  misc_feature (1201)..(1201): n is a, c, g, or t
  misc_feature (1204)..(1213): n is a, c, g, or t
  misc_feature (1219)..(1223): n is a, c, g, or t
  misc_feature (1225)..(1231): n is a, c, g, or t
  misc_feature (1235)..(1249): n is a, c, g, or t
  misc_feature (1257)..(1257): n is a, c, g, or t
  misc_feature (1259)..(1268): n is a, c, g, or t
  misc_feature (1273)..(1282): n is a, c, g, or t
  misc_feature (1287)..(1290): n is a, c, g, or t
  misc_feature (1292)..(1295): n is a, c, g, or t
  misc_feature (1297)..(1308): n is a, c, g, or t
  misc_feature (1312)..(1327): n is a, c, g, or t
  misc_feature (1330)..(1337): n is a, c, g, or t
  misc_feature (1339)..(1340): n is a, c, g, or t
  misc_feature (1345)..(1352): n is a, c, g, or t
  misc_feature (1354)..(1361): n is a, c, g, or t
  misc_feature (1367)..(1386): n is a, c, g, or t
  misc_feature (1388)..(1391): n is a, c, g, or t
  misc_feature (1393)..(1401): n is a, c, g, or t
  misc_feature (1403)..(1411): n is a, c, g, or t
  misc_feature (1413)..(1417): n is a, c, g, or t
  misc_feature (1422)..(1439): n is a, c, g, or t
  misc_feature (1445)..(1447): n is a, c, g, or t
atgacagaaggcacgtgacttgggtggggacacgctgtactattagcgctgcgacgctgccattgattgggccatgtatgtaatgtaacattacgctagatggaaagggcggatgaccatccttgtatgtaactcgcggatgggatgaaaagtgtcaaagtcaaagctttgcttgagcgccaaaatttgtaatataaggatttatgtattcttgataagctggggttaaagaacatgtcaaaatggagtaactgaagcaacccctaaaagattcacttctcgttttcctttttaaggaacatttgtgggttacagcaaaatatgtagataaacgtgtctgacatcattacatttttcgaatttgattcgtgtattctaatgtttccatcctttgaaccgagttgttcctaacnnnnnncnnnnnnnnnnnnnnnnngnnnnnnnnnnnnactatnannnagnnnncnnntannnngnnnnnnnnnnnnncccaaattannnnnngnnnnnnnnnnnnnnnnnagatannnnnnccctnnnnnncccncnnnnnnttcnnnnnnnnnnnnnnnnnnnnnnnnnnncccnnnnncnnnncnnnnnccnnnnnnncnnnnncnnnnnnnccactacntncnnnnnnnnnnnccnttcnnccntnnnnccnnnnnctnnnnnnnncaantccnnntccnnnnnnnntcnnnnnnnnnnnnnncactcctcnnnnnnnnncacnnnnnnaanactnncnnnnnnnnnacannnnnnnnnnnnntnnntnnnnnacnnnnnttnnncnncnncccnnnnnnttcccnnnnnnncnnnnnnnnnnnnntatacatnnnnnncncnnnnnnnnnnnnnnnnnncannnaacnnncccccnnnnntcccccctcccnnnnnnnnannnnnncacannnnnnncnnnnnncnncnnnnnnnnnnnnntcannnnnnnanncctannnnnncannnnntnnnnnnannntaccnnnnnnccatnnnnnnnnnnnnnncctncnannnnnncntnnnnnnncttnnnntccnnnnnnnnntcccnnnnnnnnntctcttctccnnnncnccnnnnnnnnnnnnnnncccnnnnnnncnnnnnnnnnnccccccccccnnnnctactnntnnnnnnnnttannnnnnnnnncnnnnnnnnnnnnnnnnnnnnanttnnnnnnnnnncttcannnnntnnnnnnncacnnnnnnnnnnnnnnncaaccacncnnnnnnnnnncatcnnnnnnnnnnctccnnnncnnnntnnnnnnnnnnnnctcnnnnnnnnnnnnnnnntannnnnnnntnnattannnnnnnncnnnnnnnncccctnnnnnnnnnnnnnnnnnnnntnnnncnnnnnnnnncnnnnnnnnntnnnnnccctnnnnnnnnnnnnnnnnnnacttcnnnacttg

SEQ ID NO: 3003 - DNA, 744 bp, Glycine max
  misc_feature (642)..(642): n is a, c, g, or t
  misc_feature (684)..(684): n is a, c, g, or t
  misc_feature (737)..(738): n is a, c, g, or t
gcgtgctagggttctcaggtgttgtagagagacacatctattgacactgtaatggtgccaaattaagtgcccatttcttcttgtagtggttattagaggatttgctcgctatcatatcacagtatatatcttcttatttgtttaatttttatgtttcttaggtgaattactcaagagggctcgacaatcccacaaagtgtaagtctaactttgtttttacttctatttgtttactttttctcgcttatgaactagatcccgcttgttctgtgttgtattcgtgacctaaattgtgttttgttcgctttattttattcaccatgattgactttatgatttacctccctggaacataatcacttttttatgttataattaaattaaatttagatcctttttttttatttgaacggtacttctatttttttttttttttactaatgtgttattccttcagagaacaactgtgaaaaatgaagtttgtaacatcaatttatttggtctaaaaaggaaaaaaattatgttagcctaggaggtgtttgtgaatttgtctgattgaggttgttatgttatgtgtagagaaaaagaggttatgttatggcgggcaaaggtgttagttcggtggctaaggcggtagcaaantatcagtatccttggcgtgagaagttggggaaatataaggangagcttgccaagggtgtgtggggatactgggagctgggggcatggaagccgcnnagtatt

SEQ ID NO: 3004 - DNA, 376 bp, Glycine max
tggacattcatgttgtttggatttgttgctctcattggcatcttcttcgttctcattttcgtgccagaaaccaagggagttccaatggaagaagttgagcaaatgctggaggaaagagctgtgcacttgaagttttgggagaaggcgagtcctccccagaagggttgattaagtttgaattgaacctgtgtttaaagaataatatttcaccatccgtgatgtgagataattatggcttcttcttaggttaagtagtgaagatgaataagtttagatgttttctagtttttgtttgtagatttttctctttagatttgcttttttattttagttagtgtttggctagtatgtttttatgaaatccgaacggatgaac

SEQ ID NO: 3005 - DNA, 364 bp, Glycine max
cctcttcttgtgtcttatttctacctattccaatttccagccaccatgtctggcgaaatgcataccgattccgcgtcatcgtcacgagccgccgccgcctctgatcagcatcatcagcagccggcggcggcccctctgagccggtacgaatcgcagaaacggcgagactggaacacctttggccagtacttaaagaaccagacacccccagtttcgctttcacagtgcaacttcaaccacgtgcttgagttccttcgctaccttgaccaatttgggaagaccaaggtccacttgcacggttgtatctttttcgggcagcctgacccgcccgcgccctgcacctgtcctctcagacaggcttgga

SEQ ID NO: 3006 - DNA, 375 bp, Glycine max
aaaattttgaattgaattaaattaaaataaaacctacaaatgttcatctcaccgttttctattgctagtattatttatttcactcatttttaattttctttttttatgacaataccaaataaataaataaaaaaaaagaagaggacaaaggagtgacgcgtcacgcgtaaattgtaaacattgtggaagtgttgttgttgttgtttatataaagggcttaaaggattccttcgcaaatggaagagtagcgatagacagaggagagagaaagagagggagtaagtgggtaaaggaaagaaaactaaagaaacaaacctaacacaacacaaatccttgaaacgacgacggaaatggccgtttcgagctcgcacatgc

SEQ ID NO: 3007 - DNA, 384 bp, Glycine max
aaccggttcaataaacggtttcattggtgggccatctgcatctggacgtccacttttggccttctttgctggtgggcttcacggcccaattaggcccgttcttcttgaacactgggaaaacagggacgaagacattcaggttcacaagtaccttccgaagggtgtgtcatactatgagatgttgaggaagagcaagttctgtctttgtcctagtgggtacgaggtagcaagtcccagagtggtggaggcaatctacacagggtgtgtgccagtgctcatttcagatcattatgtgcctccattcaatgatgttttgaattggaaatccttttccgttgaggtttcggttaaggatattcccagattgaaggagattctgttgaa

SEQ ID NO: 3008 - DNA, 617 bp, Glycine max
aaatctctagtgcactagatgaaagtttcgatgaaggagaaaatgaacaaactgataaagagattactaatgagatggaagcaactgctgctgcctattacattttcaggaatgttgctgcccctggttgcacgtaagaatatatgcactataacttctagttgcttgtaaatgtattatttgtcctcctctttttttgtgatatctaccactcttgtttctccttaatagttctgtcattatgaataggtacattgatgaggatgaacttcggaggttcatgattaaggaagaagtgcgaatggtatatcccctactggctgaagcagaaacggggcaaattactagaaagtccttaacagactggttggtaaggtcttctatatgtgctcatctaaaatttgtcatgataatgcaggactgaaattctgttttggttgctaacatttcacttcataatgtctgtgttcttcagttgaaggtatatcaagaacgcagagcattagcacatgccttgagtgacaccaaaacagctgtaaaacaactaaacaagctcgtgacagtactcctagtagtggtgaccataattgtgtggcttctactaatggagattgcga

SEQ ID NO: 3009 - DNA, 692 bp, Glycine max
  misc_feature (652)..(654): n is a, c, g, or t
tagtgctttactaatcatcccagaccttggtttaccttgccacacaaaaaaatatataaaaaggcaaaataataataaaaaaaagagaaggcttggagccaagaaaataaacacaaagcacaagtcatggaaagaataatggttggaagtgcaacaaaggttgctttcaacctcttggtcactttcgccattgtcattccatgccttgaggctggcattgctgagtttgatgactttctcaaagcccaagctgatgaagcacaaaaaattgctcttgaggcctatgtcccagtgccagaagatgtcaccgacgaactcaatttccatgttcatttgtacgtatctcctttatatccttttagttttacacactaatttttactattaccttacatctctgctctttttctatttttttttattgtaatcataatagatttataactttttcttcttacattttaatgagaaataattcttttgttttcaaaataagctaacccaatcaagaaaattttggattacaattgaccattgattattaattagttcaaatgaacacttaaaccttgaatgatgttagaatttactttaaatggctatttatgatatttctaagagaattaatttgatgcaataattcaggtcattnnnaaactccacaaggagggaactaaggcaaaggaagggta

SEQ ID NO: 3010 - DNA, 525 bp, Glycine max
  misc_feature (52)..(54): n is a, c, g, or t
  misc_feature (521)..(521): n is a, c, g, or t
ggaattaaagaagcagttgagctacccctgacacatcctgaactatatgaannnattggtatcaagcctcctaagggggtcattttatatggagaacctggtactgggaagaccttgcttgcgaaggtttgcatttatctttgcttcttctagagctgttttaatagagtttcagcatctcctttttactacctttatctttaggcagtgttttgatttaaggagtgttccagcatcttaagacaatgccttttgtgtattcaggccgtggcaaactcaacatcagcaacattcttgcgcgttgttggtagtgaattgatacaaaagtacttgggagatggcccaaaacttgtgagagaacttttcagagttgccgatgatctttctccttctattgtattcattgatgaaatcgatgcagttggtacaaaaaggtaattttaacccccaactttagctgtcatgaaggtaccggggatggaagagtgatgccttgtatcactctatgagctcttgggatncttt

SEQ ID NO: 3011 - DNA, 708 bp, Glycine max
  misc_feature (639)..(640): n is a, c, g, or t
  misc_feature (681)..(681): n is a, c, g, or t
  misc_feature (683)..(684): n is a, c, g, or t
  misc_feature (690)..(694): n is a, c, g, or t
agaaacaaagaagaaagcatagtcaaagctattgaagataagaaggatgccatgattaattctctatggcagatcaatgttattgatattgaatcaactctgtcacgtgtttgccaagctgtaagttgcagtatttactttctatcatttaaaaataacagtcttggctgataactcagaaatataagtttttccccctacttacctgctgtgcatgacatttgttaatttgcaatttttggcctacttggaagaattcatctttttaaccctcaattctagaaacaacttggatcactgtgctaatatcttttaggcttcattggagttttttgcccctctatctctattatggcctatttgcaattttcatcccctatcatttttttgcttgaattttatcccctaattttttaattttgacaatcaagtcctttaatattttagttaattacactaactacccctaagattttgtgaaactacacaaacacttcctgtttttttaacatttacagtaacctcccttacaggggaccacggtataatgtttttcaaacaattaagggggttagtttaatgtatatgggaatgtcagtgtatatttttcaatcaattaaaggggatagtgtagaagtnnaaaaatcaggggatatttttgtaattttacaaaactccagngnnagttannnnnatttactttttttt

SEQ ID NO: 3012 - DNA, 519 bp, Glycine max
gaggtatgtaaaaatgatattctagtaaaacgtttctttatatagtaaaatatatatagactctactaaagtttatttcagattttttatatgtactatctagtatctattggatgttaattattattatttttttgttgcaattttgcagcaagaatgctgttcattcttctcctctaggtccttcaccttcattgaaaaactcaaatggtgtcccacatcgatcaggaaggcatccggctccagttgacgtgaaacgtagaactgggaatagaaaataaacgtgtttactgaaaaggtaaagagagtgattgtttatatttgattttttttttaattttttcaatttttagatcgacgcgagagagagagagagagattgttataattttttttgttggtttgtattttgtaatcacacgggtaatggagcaataatgcttgttgctttgtttgtatcgtggcattttttattttactctacactaaatttttaggggatgtaaaaaaatgaaactc

SEQ ID NO: 3013 - DNA, 511 bp, Glycine max
gcgatcactaggtcacacttcatcaatggcgggtagaggcaaaaccctaggatccagcgccgctaagaaggccacctcaaggagcagcaaagccggcctccaattccccgtcggtcgtatcgccaggttcctcaaggccggaaagtacgccgagcgcgtcggcgccggagcccccgtctacctcgccgccgttctcgaatatctcgctgctgaggtaattgcagcaatttcctgtcgattttcactttgtttttttaaattatccttccctgtaattagatctagggttttgagattcaagtatctgtttttgagtaattgaatgatcggaacattgttttaggttttggaattggctggaaacgctgcgagagataacaagaagactcgaattgttccacgccacatccaattggcggtgaggaacgacgaagagttgagcaagcttctaggagatgttaccattgctaacggcggtgttatgcctaacattcacaaccttcttcttccc

SEQ ID NO: 3014 - DNA, 370 bp, Glycine max
tttgcaagagggagagcaccaagcaattccacaactccaaaatcaagttcccattggtcttccagaaagttagaccacctaccaggaagctgaagaccacatacaaggccaaaaagcccaatttgtttatgtaatgtggttgatgaatgtatcagaaatacttaagggtgtcttccaggcgttttcagtagaaacgtactcgttggttttttacttcctgatttttgtttgaggtttttttattgggtttatctttatgtttctgttggatattatcttgatcattatgataattgagtagtagaattgaacaaatttatatatatggccgtcaatccagatcttattaattctgaatattgccacaagt

SEQ ID NO: 3015 - DNA, 415 bp, Glycine max
ttttttttcttttcgtgttgacttttttgccctcaacttgtggtcccacaccacggcgccgtgtaccgccgccgctccgccagcagcccctgccggaacactaccgagcactccggcagctctccgaggtcggcgaagagcgactcgtcctcctccctcatcggaatcagcgccacgtcagcatggtacgtcgtagccataaacgggctttcgagaaccgtggacgacgtcgcttccatctcccccagccaccccaattcttccgcggttgttatcatggactcgtccgcgaacttctcctccggttcgaccgggtccggaaccggttcaggttttttggtgggcctggcgtggtttctagaaggtggccagggatggttgtggtcggaggagtaagtgacgactagcatcgtgg

SEQ ID NO: 3016 - DNA, 1377 bp, Glycine max
  misc_feature (1317)..(1320): n is a, c, g, or t
  misc_feature (1372)..(1374): n is a, c, g, or t
tgggggctgcgaaatgcattcctttcccgtgaaggtacacacctcctcaagtgacttagtagtgcatggaaaagttagattgctaacaagtatcaatatactaatattatgtcttaatttggtgcttacatttttattttatacattccatctctacatgacattgtaagtttagatttaatttgattctactatctgtcatgtattgtcacttcattaaagaagtttgactatagtaatagctacttgcctacttgaaaatttaaatgatgtgttaacacatgacttgattatagtgtaaaatggaaaaaatatttaaatcaacactagatcaaaattaaactcttaatttttttcattggaagttaaatatgcttatccttttttcctgacataaaataagcttgaagagttaatagtagagcttcataattggtacttttaatgattgacataggctttcttgttgtcttttgactagtggacaaccattcacatatattaccattgttttgcactgctgtggttagctcatagctggatgaaattaactgcccaatacttttctcaaccttggaaaattagctgaaggaattcatgttaaaggtgtcggattggtttgttgaattttacatcccttttgcttggattagtaatccagatttccactaccactgatgaaactgtgatgctagaaacattgaaatattatgtgttctaaaagtttttatctcataattgttaaaatcttcttacactggtgttaactatgtcgttgcccaggcaaaggttgctaccgttgataacctctgtgcacaagctggttgtgctcaaccatgtaaagtaacacaccatcaagctaaggaagctgacatacatgcagtttctgaattaaagcgtgctctagataaaaaggtttataatttttcatgcgcaaaaatgaatacttttgtgcagttcttttggaatctgtttaacttctgctttcatgtatgcttgtgatttacttattttctaaatattaattgcattatttacattgctgtgggtggtcttgcacctactttttgggctgctcgtacaggagacattgttgatggagcttcgaagtgcaaatagcgacatattggaaaaccaaaatggcatagaatgcttaaaagattccgaggttttcaagaagcattatgccacggtactggtagagctaaaggaagccagtggacaggcatgtggcttccaatggattatttatttcattacaacattctgtgttaatcttgagcaaaatatgattggttgttattttcaggtttctgnnnntatgctacaactgaggcaacgcaatacttacagaggaaactctctgccaccnnngag

SEQ ID NO: 3017 - DNA, 384 bp, Glycine max
caagagaagaagaagcggaatttgccctacttgccttcgagaccgtctcgtaactctttgccctgactgtgctaacgtgcgcccctgttcctgctacgccaccagctcctcctcctcttcctcgtcttcctcctccttatcgcgtttttctggcgccggcgatggcgtcggttccgtcggccgcgtccacaacctcatcgagcaagagcctgggctccgccgctcgcgctccatggcgattccgtttctcaggtcacggtcgcggttctctggcggcggagatagggtttcggatctcgacagcacgagggactcgccggcaatgaacggaagccggtcggcgaggtcgttctggtcaatgttcaagtcgcagaagagcagtag

SEQ ID NO: 3018 - DNA, 389 bp, Glycine max
aaaagtgtatacatgaggattgagggtacatatatttagggatgatttaccccatgtacatgtggatcccaattgctaacatgaagatgcacacgagagcaaagtagaggatagcatggatcaatattgataatccactggtctgaaaattaccaaactctatgaacctgcctcttccaggtatttggaccaagagccctggagtgaggagaatgaaaagcaccacagacacaaaaactggcccccaatctcccatttcctccttctccttaatttctctttgatctcctaattatttctctatctagctatgtgaatggtatagtagttgcaatgacaatgagtgcaggaggacttaaaaaggaatggagctgaaaagtggtcacttt

SEQ ID NO: 3019 - DNA, 399 bp, Glycine max
ctgcaggaggaaggcgcgcgcgacatgatgatcgaggtcgtctccaacggcgacctccctcctccgcctcctccgccgccgccgccgatgattctcggcgagagcagcggcgaggaccccgaggtcgagatcaaggccccgaagaagcgcgccgagacctgggtccaggacgagacgcgctctctcattggccttcgccgcgagatggacgcgctcttcaacacctccaagtccaacaagcacctgtgggagcagatatcggcgaagatgagggagaaaggtttcgatcgttctccaaccatgtgcaccgataagtggcgcaacctcttgaaggagttcaagaaggccaagcaccaggaccgagggagtggctccgccaagatgtcgtattacaaggag

SEQ ID NO: 3020 - DNA, 386 bp, Glycine max
tgggttgatcgaatttcaaggtcaggaaaatgataaatgctgtggcagagttagcatttcagtgcttgcagagttccaaagagatgaggccttctatggaagaagtggcagacactctcaaggatatacagagtgatggcaaacataaaagccagcctgaggtaatggatatcacaagcacagctgatgatgttgtgttgctgaaggatgaccctcctccaccatcacctgattctaatgcggtgagcaagttgacaacaccaaatgctagcggataagaggaccttctttctcacttccatgaaattaaccttatccaaatttatgtaagcagagttagttagcatcacactggtaccagtatccacccagttactgcccgcata

SEQ ID NO: 3021 - DNA, 369 bp, Glycine max
acaacacctacaaagaattatgcttcttattagctatgcacttaaggaaatctaaataaatatttttcattctaggtgatgtatcatgtatgtaccaaaatattttggtacgtaagtcttttaaaaagtttgcatctcctctttggttttccttagttctgaaagttatctcctaagaagacaatcatatgtactgtacgtagtgtgaagatatagtattgtatgctgcagaatatgattgtctaataaggtggactagctgtaataaaagatatttccaggttgaaaacagagcaaatcatgttaaagagctataacattttctgcaggttagaaaagaattttggtaactgatggagttgatgagaa

SEQ ID NO: 3022 - DNA, 539 bp, Glycine max
ctgcatccgcgatgctgtgggacagccaatgcccattcaagctttggccacggctcttgcaaatgctccccctgaacagcagaggactgtaagtaacttttcctgcaactgtttttggcacattttgggttgagtaatccctgatttatgtgttctatatgttatatgttatataataatgctgtactgattctttatcatgaatgttttgctagatgctcggtgaagctttatacccgcttgtggatcagctggaacacgatgctgcagcaaaggttactggcatgcttctggagatggaccagcctgaagttttacatctgattgagtcaccagatgctctgaaggcaaaagttgctgaagccatggatgtgttaagaaatgttgctcaacagcaaactaacccagctgatcaactagcttcactctctctcaatgacaatcttgtgtcttagattcctttagtcttttgactggaatctgctttccagttattcctattccgtatgcttccccccagtttatttgcaggtgtctta

SEQ ID NO: 3023 - DNA, 751 bp, Glycine max
  misc_feature (530)..(532): n is a, c, g, or t
  misc_feature (626)..(626): n is a, c, g, or t
  misc_feature (645)..(646): n is a, c, g, or t
  misc_feature (666)..(670): n is a, c, g, or t
  misc_feature (673)..(675): n is a, c, g, or t
  misc_feature (677)..(677): n is a, c, g, or t
  misc_feature (721)..(724): n is a, c, g, or t
  misc_feature (730)..(732): n is a, c, g, or t
gtcggcggcaccttccccttttctttcggctgttccatcttcaaaaccgtgggctcggatcttcaaaatcaaaacgaatttccattctttatcatataaatacctcatcttcatccccaaaaccactttcagtttcagaacacaaagcaatggtggcgctcctagtggcaactacatccgaccctgcttccatcaacccggccaacgcgctgttgggcatgcccgggtggaaacccggtccccatttccaggttgaaaccattaaaattataccctttttgctggctatttgtttgtttgaattgaatgttatttgttggcacttactaggatgatatgaagagctatgtgaatgaaggggtgagggtgttggtacatgggaagagcatagttgcggaagatgagttggacaagaggtgggaagaagttacatggacaaattccacactatttattccaaaacattaaggaaagattaatagacatactttttaatgaaaccctggcattggcgttggcgtatgcttcannnctctcttcaaaaagagcagacaaacgcataaaagcctgaacgtgaattccaaagggtaaaattatttagtggaaaaataattttgatgcaaatncctatgatgataagttggnncaacttggtaccttaaatannnnngtnnntntgaagaacactcctactaataaaacataaatactttacccgtgnnnnaggatnnnctgcttcatactgtaaaaa

SEQ ID NO: 3024 - DNA, 387 bp, Glycine max
cttagggaccaaattgcagaaactgaaaactgatcaaaaccctgttgtagatgcaaaggttaagaagacatcgaagttcgaggattttaagattgagaaccaaacatcatcatcctcggcgttgtcggatgaatattcttcttcttcttcttcgcccgaatccgatattactttcttggatttctcggattcttgtgaaacaacatgcaatcttgggttggacttggaaaagtatccttccgtggagattgattgggcagctttatctgagtcatgaatgatgttagtggttttgtctttgttgaacggtttaatgatttgatgtgttttaggtttttttttcatgtgtcttgggcagcagctgcaacgaaattttttaccgttgaa

SEQ ID NO: 3025 - DNA, 688 bp, Glycine max
  misc_feature (592)..(592): n is a, c, g, or t
  misc_feature (607)..(610): n is a, c, g, or t
  misc_feature (629)..(630): n is a, c, g, or t
  misc_feature (633)..(633): n is a, c, g, or t
  misc_feature (635)..(636): n is a, c, g, or t
  misc_feature (638)..(639): n is a, c, g, or t
  misc_feature (650)..(653): n is a, c, g, or t
  misc_feature (660)..(660): n is a, c, g, or t
  misc_feature (663)..(666): n is a, c, g, or t
  misc_feature (668)..(668): n is a, c, g, or t
  misc_feature (670)..(671): n is a, c, g, or t
  misc_feature (673)..(674): n is a, c, g, or t
  misc_feature (680)..(680): n is a, c, g, or t
  misc_feature (685)..(685): n is a, c, g, or t
gttcgttctcgttcttttcttctctttattttaaatgcacgctaaatgtattgcttttcataaattcagataattatggttgattacttttctaataattgttttaaaagttttatctaattggttcatagtttaattattattgtattgtgctcacaagctcgatcattttaaagtatataagttagtgattttgatttatgcttgctattggtttttgaaggacgttgcaactgggaattctatcctatttgctcctaggttaccttctgagtatgctgtttggttgggggagattaagccactctcctactttaaggtcaccctcccactcccactcatcaattttttaacggatttaatttgcatgtagtgtatgttattgtttagtgcttcacatttatgcatcctcctttgcaggaacactacatggttaccacgtgttgcttctcagatgaaattgaaagtgtattgcaacaacattaccagtgttccgggaaacctttgctgtttctcttgcatggccttaatacagatagcgataattactctaaaccagcacagtttcaggttcttaacccttcactagatncatttttctttttannnngacagtgagtgatttgttnnatntnnannatttctgaccnnnnctgtcantgnnnnantnncnnctgtancgatncta

SEQ ID NO: 3026 - DNA, 493 bp, Glycine max
gcaaatgatggtgtgacgaaaaaggtttatgaaactaaggtgttggagaaaccatggttgaacatcaaggaggttcaggaattcaagcccatcactgttgctgttaatcctctttcggtgacggtctagcacatagctaggtatatattttaccatgaaaaaaaggatttcttgatttctaatattatgggtcttcacatgcctagatttcttgtctgtttggattattaaaagcgcctctaatttcgtgttttttcaggttatggaagtgactagcttggccgcaagagtaataatatgtatgaactgaataaatgtacctattaactctacaaacggtgtggggttgtgcatgtttgccatcctatatatttcagtataaatattgccatcgagattaataaaataattgattatgtattaatttatgcgtgtttcgtccaaagcgtggatggtgatgattcgaactttatagcagaatgatctggtggag

SEQ ID NO: 3027 - DNA, 403 bp, Glycine max
tcccgactctctgcacctgcaactgcaacttccaacttcaacttcaaccactgcaagcttagctctgaaagaaaagaaaagaaaaagaaaatatctccatttggtttggttggtgaaagttgaaaccttttcacgagctcaagttggtagtaacttttttaacttggcggtctctttttttctacatcgactctcgttgtgttttgcaaagatctgatctgggtcgtggatatttcaatgtgaaagttaaggttttttttgttgcatagtaataattgaaagaaacaaaaaaaggtgggatttttaaagggggtggtggagatggatcgttctgctatgactgttgggccaggaatggatatgccgatcatgcatgacagtgacaggtatgagctggtccgtg

SEQ ID NO: 3028 - DNA, 407 bp, Glycine max
cggcgcgccgagcacgcgcgcgtggagatcgatgctccagagcttcgccacgtcatcaacgacgatgaggtcggagtcgaagtaaatgattcgccgcacggtcgccggaagaagatctgcgaggtacatgcgcgcgtagtttagcggttgatccagcgcgcgccggatcgagtacgagatcttgccgcggacgaggttcgcatcgaagtggtacaggtggaaggagaggtacgggaacgtcgcggtgatgatgcgacggagctccgtccggcggtgcgtggtggcgatgaagtggaacacgacgttctccggacacgacgcgtgctgcagcacggagaacactccggcgacggagcctcggaggtaggtcgcgtcaagcgtcatcgcgatgtggatcacggagtcgc

SEQ ID NO: 3029 - DNA, 401 bp, Glycine max
gctccggcgaccggaggagtgaagaagccccaccgcttcaggccgggaaccgtggcgctgagggaaatcagaaagtaccagaagagcaccgagcttctcatcaggaagcttccatttcagaggctcgtgagagaaatcgcgcaggatttcaagaccgatttgcgtttccagagcagcgctgtttccgcgcttcaggaggctgctgaggcttacctcgttgggttgttcgaggacactaacctctgcgcgattcatgctaagagggttaccattatgcccaaggatatccagcttgcacgcaggatcagaggcgagagggcttagaaacaaggttgagaggtttgggtgttaggtgcttagggttagggttagggttctggtcttgaaggatgtgtttggga

SEQ ID NO: 3030 - DNA, 334 bp, Glycine max
cggtatggctgatgtcttggatgatggttttggaggtggtaagaggaagggttctgggattagaatgtttggtgatttatggaaaaagaagagccaaaagtgatttatggcttatatattcagtgagtgaattagtagtactttaactaaggtcatgttttgatggtagcagaaacttccaaagcagttacttactgttttgcatctttctggtatctttagtcttttgtggtattattaaggccattaagcgtgtagtgttactgttgcatcatctgtgcaaggtagtgatgtgaactttttgaaagatggattatatatttcacttctccta

SEQ ID NO: 3031 - DNA, 891 bp, Glycine max
cgcatgaaagaagggaaatgtggaggaaatattttcagaagatgcatctattgtcttcatcaccacccctggacaggtactcaagtatcttctagttattttgcaagcaccaaacatataaagaaaaaatagatggaaaaaatgtcaacattaaactgtgaaatattgaatgaataaatcatcaaagaaaaatgctagtaacactttttttaacacacgatatcattgactataatttaataaatcatccacatgaacgattttcacatcaatgacgatagatcttatttcttaatgagtcatgttattattttttaaaaattttaaccaacaataaagtatgttaaaaagattgagttaaaaagtgagttcctagattcctcgtcatcaactaagatgctataaaaaaaagggaaacagaaagagaaagggcataactaattggatttcattctttggttgtatgcttcagctagctgctcttattaatgactcagctggagtgatagctacaaatacaactgctgttcagcttgcaaatgcacgcgagaaaccttggtaattttatcattcaaataaattataatgatttcctaagggtgcctttatttagcttttaaggggaaaaaatgtctaaagatgagcatgaaacgtttctttaaagaatcatgcaacatactatcaccagttccataataaaactgttcctcttatcgtgcagtattgcactattttgctctgaagagaagggaaacaagtttgttccgcgggctgaagagaagaaatgtattataatatcatccaagacaggaaagttaatagatattgatgttgaggctgtaaaaaacgcagttcaaacattcaatttgtctccagctttagtatagtgga

SEQ ID NO: 3032 - DNA, 546 bp, Glycine max
  misc_feature (322)..(324): n is a, c, g, or t
  misc_feature (346)..(348): n is a, c, g, or t
  misc_feature (504)..(508): n is a, c, g, or t
  misc_feature (525)..(528): n is a, c, g, or t
  misc_feature (530)..(530): n is a, c, g, or t
caatggggatttctacttgctggatttggacttctaattgtgggagctgcagggattagaccttgtaacttagcatttggagttgatcagttcaaccccaacactgagtctggaaagaagggaatcaatagcttcttcaattggtacttctttaccttcacatttgctcagatggtgtctttgtcactaattgtctacatacagtcaaacgtgagctgggcaatagggttgggaattcctgcggctttgatgttagtctcttgcacactctactacatgggaagcaattattacgtaaaagttaaagcaactggtccagctnnnaaacgtttgactgtatgtagannnttagtgacaaagacaccatctgagcaaatgtgtaggtaaagaagtaccaattgaagaagctattgattcccttctttccagactcagtgttggggttgaactgatcaactccaaatgctaagttacaaggtctaatccctgcagctcccaaagttnnnnntccgaattaaaaaatcnnnntntgcctttggggtgggg

SEQ ID NO: 3033 - DNA, 1287 bp, Glycine max
  misc_feature (1203)..(1205): n is a, c, g, or t
  misc_feature (1242)..(1248): n is a, c, g, or t
tttcaacggatgtgctttgtaatgcttgtggtatgctcattaataagctctaaaggttatctgtttctactatattgatttcactgcacctggaaatgaagttctcaaccccaaaccttttgcttaatgatctattacaggtggcagtggtgttccacctggtactaggcctgaaacttgtaagcgatgtaaagggtcaggagtggtcagtattgtcttgaaaataatttaatcttttttttatatataattttaagttagagatgtattgttaaattgataattttgggacatgttcagttatttgtacaagctggcatattcagaatggagagtacttgtggtacctgcaagggaactggaaaaattgtatcggtatggtataaatagccccttcttttacttttgtaatatttaaatctcttaattttagtatatttctcaatggttcagaaaatatgatggatggagtcactatgatagtgtgatccacataattgggttatttttcttaattatattgtttctgcttggtagtattcaatgtctcaagttattcttccactcccccgccccccccttttagtaaaaatatacaatgaatgactctatgttcattatactatatggtatttcatacaaattccaaaattgtgggaatatatttgtaaatagtaacttttcgtcttttgttggtatcagaattactgcaagtcttgcaggggtgcaaagattgtcaaaggaacgaagtcggtcaagttggatattatgcctggtaattgtcatttcaattttttagggatgaattgctgttactagttacgtaggccatgtggatatgacatccaaggaactaggcgaccccactcctctgcccactaaacttaattatcataataataatagcacataggaaagaaaatacctaatgtcctattgaaggtggaaaaccctaaattttttgaataattttaggatgcatgttgactctattgctgcctttctatatatgtttgtagttgtttctttttctgggggggggtatgcacatcccttctcttatttctcttcgccttaattgctatggagaggtttgactgatttatgtttttgacattttcagggatagacagcaacgagaccataaaggtttttagaagtggtggagcagatcctgatggagatcaccctggtgatctttannntactatcaaggtacttcaatagcttgggagttggaannnnnnntttttttgttaatacttttagtctagacatttttatttt

SEQ ID NO: 3034 - DNA, 883 bp, Glycine max
  misc_feature (848)..(848): n is a, c, g, or t
tgtatggaaattgtttgggctgcatggatacttattttcacccaaattgttttcgctgtcactcttgtggttaccccattaccgagcgcgaggtagtttggccctctttgatatttttaggggatgttaagatcatcacttacctttttgaccatctcttactgttttctttttttctgttgatccaagttttccttgtcagggaagcatccatatcacaagtcctgttttaaagagctgactcatcctaaatgtgaagtttgcttccaatttgtaagattagtttgcctttccttaatcaaactgttcttctttattattgattttctctatttaaggttgttaaatttcagtttgtttcatataccttaaataggacgggcattagattgtttttgatggaggaaccaaatattctagtttctcataagatgacatttgatagaaattgttagaacttgcctatcatagaaccagtctagtaaaatgattacctctggtctttcatttaacctatcatcttcattcttcacagttaagaaggatctttattaacacaaatgactttttatttgaatttcagattcctataaatgctgctggtttgattgagtataggtgccaccccttttggtcgcaaaagtattgtccatctcatgagtatgataatacagctcgctgctgtagttgtgaaagattggaggtattaatttaagcactccagactatttaatgattcgtattttcagaacaggtatttatctgaatcttttttgttactgttgtgtttcgcttgaagcctctgaacataaaatactatagactagaagatggacggagtttgtgtntagagtgcatggaatctgctataatggatacgggg

SEQ ID NO: 3035 - DNA, 551 bp, Glycine max
gcgatactcagcaactggagctggggaaccttgtctctactcgctctcgtccccgccggagatccaccatggccggcaaccccgccaccacttcctcctccgcattatctcccgagaaatttaatttcaatttctcccccgataacccctcccgaatcaccctcacttcggatcaggtcaaccactgcacccaagccctcaacattctgaaggagaagctccacgctcctaacgtgatcactcaggagttcgcacacttgcaggttcgcaccctaatttattattctgacatgatacccctaacattgagctcactgtgttgcgttgcgttgcgttgtgtttttttgtggtttcaggcgaacaggataacgccgagcgagatgaggagaagatgcaccgtcgcgtatgacgacgtcaatttgaggaaaaaccgatacaccgacgttctgccatgtaaatttgtttccaagggcttcatgtgttgttttcggggtttagttggggaaaataaaatgaaattcgttatttattgtttcatttgacaagaacag

SEQ ID NO: 3036 - DNA, 391 bp, Glycine max
atcgaaaacagtaccaccccaacacaaagctttcaaggcatgccctggaagtagaagtacttgactcctctcacatctttgtgtagtaggttttggtgttgtgacagacacatcagactctacttgttatgctctattacttggtgtcttttatgctttaagcatttaggatgcacacctgttatattagctttgtgtaatattaattggaggaattttagggataaagtatgcggactcgtagcttaatttggttagatgttgtgttcacttgggtgattcaagaggttctggcaggatcgggttagtatgtaggatcttgatgagatgccggtgactttgtcatccgttagttgtaatttattgtcggtccatatgcctaaactaaaaa

SEQ ID NO: 3037 - DNA, 1049 bp, Glycine max
atattactgattttggtaactttttctcactttcctttttgagtttgcattaattgttcatgtgcatgatggttgctcattgttcaatagctcagagatttgatgttttttcagcagttaattgctctattgatacttgttcatttctttgagaaagcctatacactccttggagaagggaagaaaaggaaagtagtgctgacattggaagagaacaatacaaagccaaaggaagaggcaaacatgttggcaattttcaaggataatttggtcaatccaccagaagagctaaacagccctgcttctttgaattcatcaaaaaggtctaaacttccaaatgaaatccttcaggaattccaatcctacaacccctccaatgctttctccatgagctttggaaatgatgctttgctagcttattccccttcaaacaagccctccattcataacgggtatgtgcccctacctttcttttaaaaaaagtgattttgaggtaaaataataactttttagagattttaataaaagttaatttatgtttgtttatgatcataaaaatcacttttttttttaaatagaaataactgattttatgagaattttgtatttaaatttcatgataactcataataatagactacagtaatcacacgttacgagccagattaatcacttacctaatgggttaaagaatgtccataattttttacagaagataaaaaaaatagcttttcaatattaatgataaaaaaatagcttttcaatattaatgatattcaagatagtatccatctagtgaaattttatatttttttgtttttattattctgaaaagctaaaacaaacacataaaaaacctttaaaatgattaatttttaaaaataagtgatttaaaaaagtgtaacaaatggacactttgtgtttaaatttcccaacaactcgtaacaatgagatttgaatatttgatttgatttaaaatttgagaaatgaatgtgcattaagttctgtttctcattctcatacaaaagatgtctcacacacacaggttt

SEQ ID NO: 3038 - DNA, 1119 bp, Glycine max
  misc_feature (61)..(64): n is a, c, g, or t
  misc_feature (591)..(592): n is a, c, g, or t
  misc_feature (640)..(646): n is a, c, g, or t
  misc_feature (653)..(659): n is a, c, g, or t
  misc_feature (672)..(677): n is a, c, g, or t
  misc_feature (681)..(681): n is a, c, g, or t
  misc_feature (683)..(686): n is a, c, g, or t
  misc_feature (690)..(690): n is a, c, g, or t
  misc_feature (692)..(694): n is a, c, g, or t
  misc_feature (706)..(706): n is a, c, g, or t
  misc_feature (708)..(711): n is a, c, g, or t
  misc_feature (725)..(726): n is a, c, g, or t
  misc_feature (728)..(729): n is a, c, g, or t
  misc_feature (731)..(743): n is a, c, g, or t
  misc_feature (746)..(747): n is a, c, g, or t
  misc_feature (749)..(749): n is a, c, g, or t
  misc_feature (751)..(754): n is a, c, g, or t
  misc_feature (758)..(764): n is a, c, g, or t
  misc_feature (773)..(781): n is a, c, g, or t
  misc_feature (783)..(790): n is a, c, g, or t
  misc_feature (794)..(794): n is a, c, g, or t
  misc_feature (797)..(805): n is a, c, g, or t
  misc_feature (809)..(813): n is a, c, g, or t
  misc_feature (816)..(830): n is a, c, g, or t
  misc_feature (836)..(841): n is a, c, g, or t
  misc_feature (843)..(845): n is a, c, g, or t
  misc_feature (847)..(847): n is a, c, g, or t
  misc_feature (849)..(851): n is a, c, g, or t
  misc_feature (855)..(855): n is a, c, g, or t
  misc_feature (857)..(857): n is a, c, g, or t
  misc_feature (859)..(872): n is a, c, g, or t
  misc_feature (877)..(889): n is a, c, g, or t
  misc_feature (896)..(902): n is a, c, g, or t
  misc_feature (904)..(910): n is a, c, g, or t
  misc_feature (925)..(938): n is a, c, g, or t
  misc_feature (943)..(946): n is a, c, g, or t
  misc_feature (950)..(977): n is a, c, g, or t
  misc_feature (979)..(988): n is a, c, g, or t
  misc_feature (990)..(999): n is a, c, g, or t
  misc_feature (1001)..(1001): n is a, c, g, or t
  misc_feature (1004)..(1008): n is a, c, g, or t
  misc_feature (1010)..(1014): n is a, c, g, or t
  misc_feature (1016)..(1034): n is a, c, g, or t
  misc_feature (1038)..(1043): n is a, c, g, or t
  misc_feature (1049)..(1060): n is a, c, g, or t
  misc_feature (1065)..(1078): n is a, c, g, or t
  misc_feature (1080)..(1090): n is a, c, g, or t
  misc_feature (1094)..(1115): n is a, c, g, or t
gcattgagaagaatgatgtctccacaaaatcggaagctagctcagccacctgaaggtgcgnnnntcttatttctgattgttgttacttgatagtttatttataatgtaatctttattttagctattggataagtgattggatgtgaactttatatatttgttggttaagtgattgaatattaattgtcaaagattattgagagtgttgatcctgttgagctttggaatagaggtaattgaaaacatgaagacatgcctaattacttatgagctatttcaagaatataattttcaaatgaattgttctgtgctagtcatcttattaagaatttttgttggtagacaccttgttttgttagttgacacactgcattacatttgtgggtattcccaggatttgatatttatagacttgaatctttgacaagtattttagctaaaaattaccaattcagtgcctaatgtatgattagtatgtaactataaatttatttatattgataatttacaaaagaattattatcttttttcatgatattatacataataaaaagaagttgaagtacacacacactatcgtcatgtatcgtnnaaaaattgatatttcatcatctgcctttattttactttaacatgtttnnnnnnntataatnnnnnnngtacaattttgannnnnnatcnannnntgtntnnntcatgtaaaatntnnnngtttatgggcattnncnntnnnnnnnnnnnnnttnnancnnnngggnnnnnnnaaaaggtannnnnnnnngnnnnnnnnatanaannnnnnnnntggnnnnnctnnnnnnnnnnnnnnncccctnnnnnntnnncnannnctangnannnnnnnnnnnnnncctgnnnnnnnnnnnnnaaaaaannnnnnntnnnnnnnaaaaaaaaatttaannnnnnnnnnnnnnccaannnntttnnnnnnnnnnnnnnnnnnnnnnnnnnnnannnnnnnnnngnnnnnnnnnntnttnnnnnannnnngnnnnnnnnnnnnnnnnnnngggnnnnnntttttnnnnnnnnnnnnaaaannnnnnnnnnnnnnannnnnnnnnnngggnnnnnnnnnnnnnnnnnnnnnnaaaa

SEQ ID NO: 3039 - DNA, 366 bp, Glycine max
aatgtccttcttttcctcctccaacctggccaccgccaagacggtgctctcggcggcggcctcggtggctgccaccgcaatggtggtccgctccgtggcgagcgacctccttccgtcggagctccggtcctacatcaccaacggcatccacagcatgttctggcgcttctcctccgagataaccctggtcatcgacgagttcgacggcctcctcaacaaccaaatctacgaggccgccgaaacctacctcggcgccaaaatctctcccaacacacgcagacttaaagtcagcaagcccgagacagacacaaccttcgccctcacaatggagcgcaacgagtccttaaccgacgttaatttatcatg

SEQ ID NO: 3040 - DNA, 748 bp, Glycine max
gatcgcagtgatttgggtcagccttgtcgagaaatatgtctttgttgctgtcaacctgggtaatagctctgcttttaaatattcatgagcctttgacactgttaaaacacacaagtatactcgtaaatcttaacaacttcttgaatcatcatatatttactttttgctttttttaaaaaaacattttatgatccagaaactatgcttggataatttccgttatattggagaccctaatttgcactaaggaatacttatgaacttcagctttttaaaaaacataaaaatgtagctcttatataatacatccttggacatgctaaatatagagagtatgctgcttcatggtatatttgaattttgaagtatatgtcagtagaaagtctgtgatccacgatggtagtgactaaggttggtattgtattgtttgtttccattgcagagtttgtgctgatcgtcatttgcatggtactccttatatgtacggtactccttatatgtcgactgattgcaatgcatgctgtgagaattgtggaactgaatgctgtggttgcacttgcatgagaggttctgaggacgaagcagggctaccattattattcataatggttttgttttttctggtactctttgctgtacttgggatattttacagtgtattagtggctacaatgataggacaacggatatggcagcgtcattatcacatacttgcgaaaaggatgctaacaaaggtgcccatgcctta

SEQ ID NO: 3041 - DNA, 484 bp, Glycine max
tcttcttccccttgtaaacacgaccaggcgtggttccagcaccaattgatcctagttgtcggtgactcttggaaccatgtgtcattggaccccttttgaagttatgacgcttgattccacctgtcaattaagccacagtcacccccattgttgaaggagcacaaatagataagaaagtaaaaatgaaaaagagacgaccttggaaacccttgccaatggtggtgccagagacatcaacaagatcaccctccttgaaagtttcatcaaaaagaaggcgctgattaaggtcgaagccatcgatggcttgaagacggaactcctgaagatggcgcatgggaatggcgccgaccttatggagatgacccatttcgggtttggtcaatttgcggtctctgacccttcggtaaccaacctggacggcgtcgtatccatcggtggcctcagttttgatctgggtgacgatgttgccttctttgaaacaaaa

SEQ ID NO: 3042 - DNA, 420 bp, Glycine max
tggagctcaaacacgatacacttacatgtcaggatcgtgaataaaatccagaacaaatgcctaattgccctccaagattttggaaagatagatattcttactcttcttccacactacctgctgttccaaacttttcaaatgatgaagaggtatcaaacctgctactattatgatttaaaaataacaaaccattgcaagcttgaacttttcttttgcttgacaattccaaacatagaagatgttaagctgcaacccatgtgtgagacaaattgtttgcaaggatagctacactatcaacaactcagtataaattggaatatttatttgggagattttgttctactcctattcacaaaatagaggtgggtgagaattacacttgtagttctgagcatccattggcaggttagaatgtgattc

SEQ ID NO: 3043 - DNA, 1233 bp, Glycine max
  misc_feature (883)..(884): n is a, c, g, or t
  misc_feature (1128)..(1128): n is a, c, g, or t
  misc_feature (1130)..(1135): n is a, c, g, or t
  misc_feature (1162)..(1166): n is a, c, g, or t
  misc_feature (1169)..(1172): n is a, c, g, or t
  misc_feature (1174)..(1178): n is a, c, g, or t
atgcttttggtatggattatgaaatcactaattaatatccatatgcagatgataggactacacatataaccttttttttcctttctatttcacattttttgtaggctcaagaggttcaaatatcagattagactggagaaaaagatctgctatttgcatgggtactgcaagaggtcttgcatttcttcacgaagaacatgtgccacacattgtgcacagagacatcaaggcaagcaacatactacttgacagagacttcaatccaaaaataggagattttgggttggctaaattgtttccagatgacatcactcacattagcacaaggatagctggaacaacgtaagttatatttcagatttaaagttattttttatggtttttatttttctgttgcattggaaggtttctaccaagttttctttctttctttttcttttggttagctactatctagtttcctggatataatattaattagtatgatatcagagggaagagaaactctttatatttggtgatccttcatcagctaggtatgacagcagaactagcaatgtttacaattgataaaacttcaggatcaatcaggagatctgaaataatgttttctgaatgtactaggtacaagtctttgtcatagtgttcataattcaattgcacatgcctccaacaatattcaaggagcacatgcttcataaagctagactgcatgttgatattggcacaaactcatgggcaatttgttctggtggttccgggatacctattttgtatccttgacatcagccaaaagtaggatattatatttcaagaaatgtgatgaaggagataatatagtttttatgaaaagtatcaagctctatggcccatttgttcgaannaagagtgttagagtcccagtcactctagtactcactatcattggttgaatttttttgaaaactacaaaatcaggagagagactcattagataagaagcgggacccacatatttgtgattttcaatgaatttgcgacccatttctctttcatttgtctatagtttatgcattttcaaaattcttcaatccatatttggacagtggatctcgttaatgcgatgccctgctttggtttcaaaatgcngnnnnnnttagcaccagagtatgcaatgggtggnnnnnggnnnngnnnnngctgatgtatacagttttggggttctctatacttgaaataatcagggcaaaagca

SEQ ID NO: 3044 - DNA, 292 bp, Glycine max
  misc_feature (238)..(240): n is a, c, g, or t
gttgatctctctgtatatactactgcaccctactatgccttttgggggacagagatgaattttatattctctgactaaggttgaagaaaaccccctttttcccctttggcttgaggattcggcagagtatagagtacagaggagtgtgtaaagaaacgcaacttggaggttgggttgttcttttctttgttattgttttttttttttaatgtatgttgtgttttgaaataacttgccnnntggcaactctagttagaaacaatgtttgatgtataagtattagtgtataact

SEQ ID NO: 3045 - DNA, 898 bp, Glycine max
  misc_feature (841)..(844): n is a, c, g, or t
ggcagtttctgtcctctcccttattgcgatctttggtgctgccaccacagccatggtaaatttttttcacatgattttactgcctttattgtcatgtcagttttggaccaatttacagtgccctaacattaataagacccatgtgaaaaaacaaccgccatgcgccatgccgtcttactcttaaatgtcattgaatgaccaaatgtctagtctttctataggactaaaaatttgaatttgaattgaaaattgaacaaacataatgaaaaaaatattagtacacactttttaacatgattttatattaaaataataggtgaaattcatgtgagtctaaatcagttggttcagcaatgtaggcgagttgttgtaaaactttcttggtatctgagttcgatttcgatttttgcagataaaacgaaatatctagatatttagtgagacccacctgttattttatccaatccatccattttgtcacacctgaaacctgatctagatcccactaccagattagtaaacatgttgagacgaagtggaaatcaaaactcagcaaaattttctctcaccctaatattcaagtcaagtcaagtcaataattcattggtgacatgaatataaaaataacctgcatatatgtgatcctaacttctcattgaattttgtcacagataacaacggcaagaaaggcagtgacattgctattgtcgtacttgatatttacaaaaccattaacagaacagcatgggagtggactactactcatagctatggggatcacattgaagatgttgcctgataacaaattcactagcaccaagaccaagagggtcttaacctnnnntgcaagggacaatggtgcaaaatctacaagtgatgaagagttggggactctgcc

SEQ ID NO: 3046 - DNA, 401 bp, Glycine max
  misc_feature (23)..(23): n is a, c, g, or t
  misc_feature (49)..(49): n is a, c, g, or t
taccgagccgcgaagaaggagancccgccaaagtgacgaaggccaacgnctgagaaaaaggaatcgcgtccaaaacgaagcaaaaccgcaaccgccgctgctccgaagaaaaccgaggcggttaaaagggcagcgaagaaggtagggccgaagaagacgaagaaagtgtcgacgcctgcgaagcccaagcagcccaagtccattaggtctccgaccaagagggcccggaaagcagccgttgctgcggcttgatatttgtcttgtttagttaaaactatgacatatatatgtagatatgaaaaggtgtgggtgtgggtgtatgtgtgtgccttgctgcacaatcttgaagaaagttgtgtagtgtaggatggtagatagtttagtgttctgcaatgttcgct

SEQ ID NO: 3047 - DNA, 688 bp, Glycine max
ggatcagcacagctcaatcattgaatcttagcataaacacatacagaagaaggaaaagtggcaccctggtacgattaaattctctctctttctgcaaatagagaagttgattcagaagaaacgagtccccaaagagacaaagctactagctctacctttcttcaccccttttcatctctatatttttatttttttttgtattttattagggaggagctgatattgaaggagggtttggaagaaaaagaattttgttttgagatatatatacatatatgtgcaagtgcataggaaattaacacaaaaagatgacatggtgcaatgactctgatgaggatagggttattgaatcaacgacgccaacaataactattactcctaacactgatggcataaagctcaccgaagaaattagaaccataacatgcccctcgtgcggccataacattgaattcaaagatcaggtacttattatataaatataggtttctaaaccccacatagttttatatgtttccttaacctatacatgtttgtgcttttctcttttttaagtagttgcttttgtttatatatgggccaatctttaattagtttgtgttgtacgtgcgaggtgaaatattagggtggaatccatgacttgccggggttaccagctggagtgaagtttgacccaaatgaccaagaa

SEQ ID NO: 3048 - DNA, 380 bp, Glycine max
ccttatcctcttccaagttccttagctttgacaactccttttcaaccccatccaagcaagagtgcccctttctctcatcttccaataatttcccatcatcatcatcagtgaaaagggagtgcaaggaggaggtccctccctcaatttcctccaatgattacctcatctcttctgacctcacttttgatagctcaccaaggcatcatgtcactctatcatcaacacttgactctgagtacaagagtgtggacatttcggatgtcttgtatgattctgcccagcttgattttgtctttgaacccttccttgaaattagatgagcatgtccttgttttggtttgtgatttttttttttaaatttaacctttacttcagcgaag

SEQ ID NO: 3049 - DNA, 380 bp, Glycine max
attgactatttacagttgccgtgcttgcaaccacgccataaagccaaaaaatactaaagattgttgaaaatttagacaagggagcaagaagatgatattcatgaaaataggctatatagaatgcgtaaacgatttagattcgtgaactgaaacaggaacttagaaaccacttcatatgaaacttgacccagttatttgatcacgttttcgtttatgatcctccggcagcggcagattatcaacttcattgttcacagatgcagttatcgaagaagtacacaagtctttgtccacagcaaaatggctatcgctagctggaatcaccagttccccatcttctattgaaatcaaattagactgctcctcaactgagacatcac

SEQ ID NO: 3050 - DNA, 389 bp, Glycine max
gatatgctctccggaaacgaagacagctccgccgcgggctccgaccaaacccaccgtcaaatcttcgaccactatgcgtcccacacactcatccccgaccacttcctacacgcgccaacgcactccaccgccaccaccgccgccgcagccaccgtggatttcacccatcaccaccacttcaccccgcaaccccaccaccacaaccaaaaccacatgaaccaccaccaccaccatgccttcttcgacccacgcgcttttcatggcgcgtcgaacacctcttaccccccaccccattccatgctctcccttgacccgctacctcacgtcaacgcagttgggcctgggcacgggcccggttccgggccaggcggacttctccttgtcccaaa

SEQ ID NO: 3051 - DNA, 613 bp, Glycine max
tcactgggtcacttgtctttctctctattttcactttgctcctttcttgcaacttaggtaatttattcttgggttgcacttctaaagttctcatctatgtgattatctttttaaaaaatgtccataatttccatagaaagtttatctttaattataatatgttaatatgacttttcttttttcctttgaaataaattccaatacccactccacaatgcttagaatttgcataaactttaatttatttttacctctttctaatgagttatcattatttggttgacttgtgcaggagggcacttaaagtttgctaatggaatggtaaaaattgatcaccttaatttaagtatctttttccatgtatataaaaattcatgaaagctcatagttttgttgctttaatttggtgatgaaatacagctagaccaggaaagttggtgcgtagcaaaaccttcaacaattgatgttgcactgaatgataacattcaatatggttgcattgccttgggtgattgcaaaatgatccaaccaggtggatcctgcttctacccaaacactctgttaaaccatgcctctgttgtcatgaatcagtactatgcagctaatggtagaa

SEQ ID NO: 3052 - DNA, 713 bp, Glycine max
  misc_feature (663)..(663): n is a, c, g, or t
aacgacctcttgcctctgctatctgatgacggtgtgccctcatctacatttctatcagcctttatcctctgcagcatctcgagctgattttgcagaatctgtaggttcttcaaaatcatgaaaactcaatctttgccaaaccattttaatcagtgaatgagaccatgcaacgaaaacattgatgcagtgcaatcctacttgtatgcattcatttgttatgtctcagtacttataaaagcctaattaattgtgatggttatttataataatatcagttaatgtcccttttcggggtgccagaatttagcatgcatacaggagaagggttcatttggtggtcatcataatcatcaaatttgatcttttatattcaggtaaaaccaaggtgacacatcacttactgtgtgggtaaaagaaaaaagagcacacattacctgaatctggcattgaagaagttttctataagcttcaagctgagagcttgggatatttggatcattttcaaacccctctccatagttcacaggggatgcatgtgcttgggaaggtagaaaatggaagttttgcattggaggaaaggatagatttggtggtctaccagcgataagaaactgcttttgtgcttcttcactggaagtttgctctccattacggtccgtattngaagattcagccatagatatttgaactgggggatgaagagtgtatccagg

SEQ ID NO: 3053 - DNA, 662 bp, Glycine max
  misc_feature (6)..(6): n is a, c, g, or t
ggtganttgatgaccactgcccctatggtcgttcgtgagaccaccaatctcgaggatgctgcgaggttcttccatctttttccttattcacccttaaatacccccctttgcttttaccttttttaactttgttttttagtatattttaagccgcctacaaaaaaagatgagcatttttgaatgtctatctttaggttgttgctagaaaccaaatttcgacgcctaccagttgtagatgctgagggtagactggtacgataatcctccaatctgttatatttgttttgtttttcttttaattttatttttaatgtttctaaatggtgattattaatatctaaaggttgggattatcacaagaggaaatgttgtaagagccgcactgcacatgaaacaagcgaaccaaaagaaagaatgataggattcagaagatcattaaaaaatttgttgctggatttccgtgcagtagttcgattcaagtgttcacagaatttgtccaaaaaaagaaaaaagtgttcacagaaacttgcttgaattagaattaaaattttagcttaggcatgtatatcttattgttttggaatttacacgaatgtttgtcacgggcaatattttgcaagggcaattattatcattcttaatgatctcgttgtagtttatat

SEQ ID NO: 3054 - DNA, 657 bp, Glycine max
  misc_feature (521)..(525): n is a, c, g, or t
  misc_feature (564)..(564): n is a, c, g, or t
  misc_feature (566)..(567): n is a, c, g, or t
  misc_feature (589)..(590): n is a, c, g, or t
  misc_feature (595)..(597): n is a, c, g, or t
  misc_feature (599)..(600): n is a, c, g, or t
  misc_feature (603)..(606): n is a, c, g, or t
  misc_feature (622)..(639): n is a, c, g, or t
  misc_feature (641)..(644): n is a, c, g, or t
  misc_feature (646)..(654): n is a, c, g, or t
gagtagtgagaaaaagagtaattgggagggagacatgattaaattccatttgatgcagggcatagtgctgatgttcttgctgatgaatgcttcttagaatcagtagcaaaggctcttcgacccggaggagtgttctctgctccagcagacagcctgtggcataagaactttgtggttgcagacaccatagcaaattgcaagaagatattcaaaggctccgttaactatgcttggaccacggttcctacatatgcaaggcatttcttatctaactatatgtttacttttctaaattttatatattaagagaagcttttggtaacaagtgtttctttgtttttgtttaccagtggggtgattggattcatgctttgctctacggagggtccaccagtgaacttcaaacatccaataaataaattgaatccagagaaaaatggggtggcaaagggacctactaagttttataacccagaggtaatctttcagatcacttgcttgttttgctttataagaatttnnnnntattcctatcttgccttttatttttgttactacttcagntnnatgctgctgcattctgtctgcnntcttnnntnnacnnnnttgattgatccaacannnnnnnnnnnnnnnnnncnnnncnnnnnnnnnttt

SEQ ID NO: 3055 - DNA, 441 bp, Glycine max
gtttgacagctatcatttggaatcttatgttttctaggctgaaggatctccaaattttcaggcccaggaattcaaaaagcaaggaactcatgtccgtcggaagatgtggtatcagaacatgaaaatcaaattggttgttcttggaattttgttgcttttggtcctggttatctggctttctgtttgccatggattcaactgcgcaaactagaaacaaatgaaagtttatggataggtatttaaatgatgtttaaagagcaatttcttaaaagctttagcaagaatctgcttagaaggggggagtttggcaactggagaaaaagtttcctaccttctttatttgttgataatcatatacgatattcttggaaattcttaagagaaaggagatcgggtgtatttgtaatgtatcatatgctggactgtttggtcttgtcaaac

SEQ ID NO: 3056 - DNA, 571 bp, Glycine max
gctacttggtttagcagcaaaaggagcgacccgaacctgctcactggtgctcttgttggtggacctgatgcatatgatgactttgctgatgaaagagataactatgagcagacagagccagcaacctataacaatgctcctcttatcggtattctggcaagactaggtggaggtcatggtggctataaccagcttcttccaggtattgccatcattattctcgctttatgcccctctcctgttaaaattcttgtactgatgataatatagtaatcagctttagttacttccttgtagttgttgttccagctcctaagcctgttgttaccaagcctcaaccaacccccagtcccaagacaactccacctccaggtactattttggctagtcacttcacttgcacattctttattgcttaagttaactacctgagaaatacttgaaactaaaatgatatgtaagttttgaccaatatctaaccgaggaatttctctttcagcttcgtggtcaggtccaatttccattgaacagaaaatgaccacctcgtggattgcccatggaataacttact

SEQ ID NO: 3057 - DNA, 355 bp, Glycine max
  misc_feature (346)..(346): n is a, c, g, or t
aggtgaagcaagcaaaagccagatcgtcattgctgatttatcccaagaaagagatgatttgaaggaggctctagataatgaatctagcaaggtgaatcatttgaagcatgaactccaagttacccaggagaatcttgcaaaatcaagaaatgagtctgctgaattggaaaaccttctaactttgtcaaacaaactgtgcaaagagctcgagctcgaggtctctaagctctcgtctgagctcactgaggttaatgaatcgctacagagaaaccttgatgatgcgaaacatgaggcagaaatgctagcaagggagcttacaactgccaaggaacacttgaaggaagcncaagcaaag

SEQ ID NO: 3058 - DNA, 383 bp, Glycine max
agatcaacaattataattcaataacaataccaaaaacatccaaaaacatttaaagaactgcatctaagttttctgcttcacaaaaatattttagtatgaaatttcagccaacatcaccatctgccccagattcacccccatgaccatgaccacttccatcttgaactccattggcactcatcaaagaggtatgagctgcagtcatctcagcagcagctactcctacatcattgttagcaactgtgttggctccatgaacattgatgccaccaccatcaccaacaggagttgttgaagtacaccctttggtttttcccttgtgattaggcttgacatgggagagtttctctaaatctttcactttgctttccttgctcttgctt

SEQ ID NO: 3059 - DNA, 649 bp, Glycine max
  misc_feature (642)..(642): n is a, c, g, or t
tttctctacaaaaaataaccccacaaagaaaacaaactgaaacaacagcaaaaaagaaatcttcacctcagcttcctctgttccgtccttcctcgtcgccgcgccggagcatctcgccgccgtcatccaccgcatcattcgcgaggtataaaaaacaagaaaccctaaatttcattgccttttttcttctttaatactctcgcccctgaaaattgagctcgattttttttatttaattacgaaaaagtcccaaaataaaccctaaaaagattaatagtgtttctgaattcatgttagattttcatgattacattgaagaaacattaggtaacgtaattgtaagtattcatttcgagaaattgatttcaggttcataattgattttgagttgaaacaacttgcattgaaagaatcacgtcatttcgtaatcaattttacaaaatcaatttcagagtcaatttgcattcaaaatttataaacccttaccggaacacattaaaacatttcgattcttttgcattcagggaactcggaggtcatcgaattcgcgaagatgtcgcggttcccgttcttcaaccgttcgaacacgattcactcgacgaaatcggaatcctcgcagaaaccctacctcgtccaccaccnctccaca

SEQ ID NO: 3060 - DNA, 492 bp, Glycine max
  misc_feature (14)..(14): n is a, c, g, or t
  misc_feature (485)..(486): n is a, c, g, or t
ggtttgcttattcngttgtctttgttcttcttaagcatctgtcccagatatatgtaataagtaattcaattattctgaatgcttctcgcgtgcttattggttatcttctgaatttccatgaagtattcaatcaattcaatgcttatttgcaagctctccaactgctttgttgcatcattattttctaccttgattgcagataacaacaattgctgctgcgattaatcttagattggcaggaaggccgcctgtgcttccatccaacaaactttcttacacagagaacttcctatacatgctagattctttgtatgtcttgctgtattaagtctgattgatatttggaataacctgaagttgttttttgtgttttaagttattttttcttctgaattctgagcttcatgatggttttcatttttcttttcctctggctctgatacaaaaaaaatctatatcttatcaaaagtaatatgatttacttnnaaaaaa

SEQ ID NO: 3061 - DNA, 1007 bp, Glycine max
tgattactgatgtaacaagcactaaatttgattatagttgctcatttacagggcaccaatgttcttgagaccaaggacaaccccaaccccaatgatgtggccaacagatccacaggccaaggtgtcagcaagggtgaagccagcagggtcaccagtctgcaagcctgagtccctcccctccagctttagccctgcagtggctttcctgtttgctgatggagccaatccaaaccttccagcaaacagcatcagggttgtagaagccaccataatctgccccaacatgtcaacaatcagatacacataatcatggtaacattgcaaatcaagcaattcacaactgtaacaactgcttttgaaagttttacttctttttttttcacaggaatcaaagacagatacatgaggtttacaccaactcacacatcatgctcaaccaattgagatagatctcctttttttgaaagttttactttgttcaatccatagataatggtaaatggtacaagtacacatagaaagggggtttgtttagataaaaatctctattaagcacttttgggagaaaaaaaattggaaagaaaattgaaataatttaaagaagctatgcagttcgtcatttttacattattattacaagatttccttttaaaaggaatctagtatgtgatacaagtgaattcggtactcagtataaggttattgataaaatttcataactacgattcaatcaactatataacaaactttcaggaattccaattaacattcatacataattctcaatcacttctttctcatggtaactgaactagaaactacatgaattttagtactattatgcatatgcacactcagcaattcacaagattgttgcatgcacaaacaagattttcttatgtacccctccaaaagaattgaatctactatctattatgctttgtaaataaagtcagatgaaactacaaaagtaacaaggaaacaatgaaatgactcaaactattaaa

SEQ ID NO: 3062 - DNA, 375 bp, Glycine max
gagcaacagacaacttgacagtggtgatgatatgttttcactcagaaccaccagctcctatggttgtagaaaggcctagagtcagaagaagcatatctgctgaggggcttcaaaatcttaagtgcttgctagaaggataaaattttctacttctcggcaacacaaatgattctttttgagcttagattattatgtacataaattcatccgtcacagtgttgctgatccctgaggggatgttgtaaggaaaacaccaagatggcaaattcaaataaatttcctgtcatcgtataattattttccccattgctattgccttaatgggaaagtgataaacttgaattacgtatatcttgtgaaatgtaatttatgcat

SEQ ID NO: 3063 - DNA, 362 bp, Glycine max
aattggcaggtgacacagtgacctcatttgcgaaacgtaagaatgctaaaatgcagaatattgaatctctatcagctccagaagcagaagttggaatgggagggccatcaacatggggtgatgagtgatgatatctggacatatgctacagatgcatcaaaccttgtctgcaaggagttgaggaccaattttgagtttgactctgctgttgaatttcgcattgcatttgtcagatgtttgagtcgagctcctcagctattttctgcttctgaattccatggtatttttgctatgctttaagctggtggttatgttgttaatcggtgaattgtatgtcagattcaggaacttccgttcaaact

SEQ ID NO: 3064 - DNA, 300 bp, Glycine max
tttcggtgtcgccgcgaagtccacgctggattgtaggaagctggatccgaacgggattgttgttctgcaccaggccgatgtgggagagtacttgaggatggaggatgagctttgattgatgcattttcttgtaattggttttgatccatcttatgaaattacattatcttctatattatctgtacctcctttgaagttgcctatcttctatattatcttcgacttcgttctcgtttcatatatattagttcacagaatggatttggtttgttgattcgttctcacttggcttcgttcgct

SEQ ID NO: 3065 - DNA, 430 bp, Glycine max
ccgcaactgtgcaatgtttttgccgccagaattgtgagatcatgctctatttatgttacatttcttcattgtttttaggttaggtagggtttttttttgtttggaatgatttacttgcatgaaacttgagatatggttgttggtgattgtgtgatgtagaaccatagaagataaaagcatgttgcagggctattgtgtgtgttatttagggattgttatattattataagtagaaacttaagagatctttcattattttgtgggaattttatatataaacttgcttgcatgagacttgagaatcagatatggatgttggtgatcgtgtgatgtagaacagaggaggagcattttgtttagggattatcctgccaagaggagtcatattattcttggtatctgttaatttaaggagtatttctgtttgcct

SEQ ID NO: 3066 - DNA, 433 bp, Glycine max
ggtaagatccatgaacaacaacacacactacacatcctagtgtagtaagtagtatagtacaatacaaacatgttagatgtttcactttttttctaacattggaattggttgttgcagttgaagaagttttatcaatctaggaggagccaaagattgctgagtgtatcagtgatgggtaacaagatccctctatatggaagtggtgctagcctaagtagcacaacgggtgtgccaacactgcctgtgccattgaacctcagctttgtgctacgatctagggcttatgtgcttgggaaattggtgaagcctaagtactacaaaaccattaaatgttccatcacattggatcccaaaaagctcaatgctgctatttccctcaagaaatcttgcacatatgattaatatgcatatgatggagaacaagtggaatgca

SEQ ID NO: 3067 - DNA, 375 bp, Glycine max
atatcttctattggaactaaaagtaaaacatgaagaagacataaaatcaggaatcatgaaacactttttatggagccactaatatataatgtcagctccacactgcagctaatcgtttatgtgcataccatgattctctcatgctacaaagataattgaaaactgactgtttaacagaaatctctagcacacatgccaattgagtaactaacctaatcatatgaaatgagatcactacttaagttatacaatttcataacagtgacacttgttattaaaatgatcacatagttcatcagtccagtcatgcagtcctcaatggcggggaaaccaatatcaccccatctcccctgacaaacaggaaaggaactgtca

SEQ ID NO: 3068 - DNA, 257 bp, Glycine max
tttctcgagacgtgattcgcgatgccgtgacgtacacggagcacgctaggagaaagacagtgacggccatggatgtcgtttacgctctcaagaggcagggaaggactctctatggtttcggaggctgagggtttggccttctttggtggctttggtttgtgtaaatggaaggaatttgtgttttgtagtgattatatatgtacttggattatcttctgctcggtacatgctcaaggttcttctgtttttttttttta

SEQ ID NO: 3069 - DNA, 380 bp, Glycine max
ggcgtttgactcggccgggtggagatccgagttcgagacgcgtttcagaacgagatccaggcgagtttgtaaagatttgactcgggctgagtcgcgagcgagtcgagataaggttagcgatttgtagtctctgtgggagggtttctgaattgaggctcgggaacgtaagtgaataccaaacgacgacgatagaagcaaggcttcttgttgtcgttggtgttggttaaggtgatggggggtgaaggcaacggcattgtgtgcgttttggagggaggaaacgacgtcgaggagtgtcgttttggaggagtgtggtgtgcttcgggagtgtgttaaggcaaagaggaggaaaagtgggaagaagagataagtgagaggtgcca

SEQ ID NO: 3070 - DNA, 470 bp, Glycine max
  misc_feature (380)..(383): n is a, c, g, or t
  misc_feature (387)..(394): n is a, c, g, or t
  misc_feature (396)..(401): n is a, c, g, or t
  misc_feature (425)..(425): n is a, c, g, or t
  misc_feature (429)..(433): n is a, c, g, or t
  misc_feature (435)..(435): n is a, c, g, or t
  misc_feature (441)..(446): n is a, c, g, or t
ccgaggcggttggcgaggatgtcgattcggccggcgatgtcgagggtgccgaattgcgaggggaggggagacgggggagggcggaagggctggtagacttgatgctgcggcagcagaggctgctcaggtttcttgaaggaagatgagttgaggacggcggagatgggtttcacgaagtagcgacggtgaggtgagggagaggctgatgagagaaagaggtcattgggtgttatgggtttgaggttgagaggagggacggagagggaaagcattgtgcagagtgcagagtgcagagtgattcaagattggagttgcgtgctttgccttaccttaccttatctcctgtttctggcttcactgtcttgctcaccagtaacaannnnaaannnnnnnntnnnnnngcacgcaactccaatcttgaatcnctgnnnnntngggggnnnnnntgctttccctctccgtccctcctc

SEQ ID NO: 3071 - DNA, 595 bp, Glycine max
  misc_feature (529)..(529): n is a, c, g, or t
gatcttactttcacggacaattctagctggataagaagcagaaaattccggcttggggttaaggtggcttgtggttattgtgaggagattcgtattcgtgagggaaaaactgaaacctttgctgttaaagatcatagaggagaatgtgagttttctaatagttagcacttcatattttatacttatgatcgaacagtttgagatattggttcactaaagttataattgcatggcatagattacaaaacttgttggaaaaatagagatgtaaaagatattgtttcttcccctaacagcataacctctcgagagttggttctctacacttgtattaattctctataggacaaatcttcatttttacaatggatttccttacatgtagagaagctataggattttcttgagtggataccacattacagataacatgtgcataaatgacaaccatttgtatcccagctacatgcataatgaatatagaaaatttatctcgatctatagttggttggtttctgtgcatagtttnccaagacagcaatattttcagtttttatacttttcaaaaatcttgtttaatgaagttctctaatca

SEQ ID NO: 3072 - DNA, 568 bp, Glycine max
ttttgcttgttaacaagcacacaaattctcactcatactgaatgacattacctacaagttgaaggcttgaacatgtgaattgcttaagttcaaattacagtgcaagcaaaagggaatacgaaacaagagacatagaaaaccaaatattattttgaccttgtatgattttctttttgttcttttcaggattcatctgttattgcacagttggggatacctgacatgcgcttaccgctcctttatacattatcttggccagaaagaatctattgctctgaagtaacttggcctcgtcttgatcttagcaagtacaaacaatttcccctgtatcatgttttctttagttcaaaaatggattactttattgagagacaaaaggaataattaaacacttttcaaatgcacaaccagaacctttatcttgaagcattcatcaccattgtgaaacctttcttgatgaatagattttaccttctttgaatttcaattttctttccacaacaaattcctaaccagaatacttcatttttttctttacttatttaactcattatgtatcatgaaccgt

SEQ ID NO: 3073 - DNA, 349 bp, Glycine max
cggctgctcaaagtataaatgtgtcggtgaacatgtttttcactttcttgattgcacaagtcttcttgacaatgctttgccacatgaagttcggcttgttcatcttctttgcctttttcgtgttgatcatgacattcttcatctacttcttcttgcctgaaaccaagggcattcccattgaagaaatgaaccaggtttggaaggcacaccccttctggtccagattcgtggagaatgatgattatggcaatggtgttgagatggggaggggaactgctatcaaagaagtgtagttacttgtttatttttctcaatgactagcgttttagcttttgttggtaaatcatac

SEQ ID NO: 3074 - DNA, 944 bp, Glycine max
tgctgatgttggatatgctggaatccttaccctggcatttatggcatgaatccagtaagtattgtcgcatctcagatgtggaccagaagctacaataatgcgaagagaagtgtattttccactttttgtattctaactctgaggattaccttgaattttaagaggatggtgctgttaggagataggacaacagaagggaatggaaaaaatagttagggacaggtagaatagttagttagaagaattaattagataaatagggggaagaaggtattcagagaattagcagattaagatttgaaagaaagtggaaaccatttgtgaaggggaaaccattggagtctttcttcttgttctgttcaatttcattcaatcagaaaaaacaaatcattttttcttttctttataacctgcatattgctacatttggtctctcagtttggtcagtatgaaaatgtcaattggttattgtgggtgacagaattgtattgtatagcttgcaaatagcttggtttgtctattgacctaaatgtattggattgtatatggtggaaattattgtctacagagtatatggttatttaataatcttttatgacctttcagtcaatttggatattgttctttgctaatactggtaaatttcaggtacagcctggagtggagaattttcctcagtatggacctgggcctgctgcttggggcgcatatgacatgcagcgagttcaaggacaccgataaattcctgttgaggaatcttataactggtatcttgggttgcaactatctagatgattgattcagggttttaagagttatctactcatgaacgtcatggaatttgtctattagatggtccttgaagttgtacttatattaaaaagctcatatgtaggttgatggtgcagtagatgatgtttatctacgggtcaaataaaggacat

SEQ ID NO: 3075 - DNA, 465 bp, Glycine max
tgcattttccaaggtggtaaattttagcaatttccttttttttttacctttgtttccagagcacaaataccccacagaggaaatgaaattagtacttgctgaggagttaggattgacagaaaagcaaatatctggatggttttgccccagaaggttaaaagataaaagattgatgaaagatgaagctgttgctaatgggagacaagatcgttcaagtggtgtcatccaagatcgtggcagtggacttgggcaagattcatgcggaagcagtaagcatgctgatcacaggtatctggatcctaaggaggttgagagccatggcctctacaatcacgaattgtcagttgcagatatgactcatggatgtaggaaccgttatcctgaaaatgttagcggggtggatgacacatcatctgagagcagctcttttttgcaaaaaaggttgttttctcaagggcaggatcc

SEQ ID NO: 3076 - DNA, 339 bp, Glycine max
caccgtttctttcaccgtcagcaagttttccccacgccaacaaaaccttatcttccaaggagatgctgctatctcaccctccggggtgttacgactcaccaaggttgacagcatcgacgtgccaacgacgggatccctaggacgtgccctttatgctaccccaatccagatttgggacagtgaaacaggcaaggtagctagctgggctacatcgtttaaattcaaagttttctcgcccaacaagacggccgacgggcttgccttcttcttggcgcccgtcgggtccaagccccaatccaaaggagggttccttggtcttttcaatagtgactcaaagaa

SEQ ID NO: 3077 - DNA, 1152 bp, Glycine max
  misc_feature (528)..(530): n is a, c, g, or t
  misc_feature (532)..(532): n is a, c, g, or t
  misc_feature (563)..(566): n is a, c, g, or t
  misc_feature (589)..(595): n is a, c, g, or t
  misc_feature (598)..(598): n is a, c, g, or t
  misc_feature (600)..(602): n is a, c, g, or t
  misc_feature (605)..(606): n is a, c, g, or t
  misc_feature (618)..(622): n is a, c, g, or t
  misc_feature (637)..(647): n is a, c, g, or t
  misc_feature (650)..(654): n is a, c, g, or t
  misc_feature (656)..(658): n is a, c, g, or t
  misc_feature (676)..(686): n is a, c, g, or t
  misc_feature (692)..(709): n is a, c, g, or t
  misc_feature (711)..(720): n is a, c, g, or t
  misc_feature (724)..(725): n is a, c, g, or t
  misc_feature (732)..(732): n is a, c, g, or t
  misc_feature (735)..(741): n is a, c, g, or t
  misc_feature (743)..(743): n is a, c, g, or t
  misc_feature (752)..(761): n is a, c, g, or t
  misc_feature (764)..(780): n is a, c, g, or t
  misc_feature (793)..(793): n is a, c, g, or t
  misc_feature (795)..(798): n is a, c, g, or t
  misc_feature (800)..(809): n is a, c, g, or t
  misc_feature (811)..(813): n is a, c, g, or t
  misc_feature (815)..(816): n is a, c, g, or t
  misc_feature (819)..(819): n is a, c, g, or t
  misc_feature (821)..(830): n is a, c, g, or t
  misc_feature (841)..(844): n is a, c, g, or t
  misc_feature (852)..(855): n is a, c, g, or t
  misc_feature (857)..(859): n is a, c, g, or t
  misc_feature (869)..(875): n is a, c, g, or t
  misc_feature (877)..(887): n is a, c, g, or t
  misc_feature (892)..(895): n is a, c, g, or t
  misc_feature (898)..(898): n is a, c, g, or t
  misc_feature (900)..(903): n is a, c, g, or t
  misc_feature (905)..(907): n is a, c, g, or t
  misc_feature (909)..(909): n is a, c, g, or t
  misc_feature (911)..(929): n is a, c, g, or t
  misc_feature (931)..(935): n is a, c, g, or t
  misc_feature (937)..(942): n is a, c, g, or t
  misc_feature (944)..(966): n is a, c, g, or t
  misc_feature (970)..(971): n is a, c, g, or t
  misc_feature (978)..(982): n is a, c, g, or t
  misc_feature (984)..(986): n is a, c, g, or t
  misc_feature (990)..(994): n is a, c, g, or t
  misc_feature (1012)..(1012): n is a, c, g, or t
  misc_feature (1016)..(1017): n is a, c, g, or t
  misc_feature (1021)..(1034): n is a, c, g, or t
  misc_feature (1038)..(1045): n is a, c, g, or t
  misc_feature (1047)..(1048): n is a, c, g, or t
  misc_feature (1052)..(1054): n is a, c, g, or t
  misc_feature (1056)..(1058): n is a, c, g, or t
  misc_feature (1061)..(1069): n is a, c, g, or t
  misc_feature (1071)..(1078): n is a, c, g, or t
  misc_feature (1081)..(1087): n is a, c, g, or t
  misc_feature (1093)..(1096): n is a, c, g, or t
  misc_feature (1099)..(1099): n is a, c, g, or t
  misc_feature (1110)..(1127): n is a, c, g, or t
  misc_feature (1129)..(1138): n is a, c, g, or t
  misc_feature (1142)..(1147): n is a, c, g, or t
tagaaccaaacaaaagaaaggtccattatggattattatgatgatcttctctctacacctttgttttctcgaagtctcaacttgccttgtcggatttcccacctgttccggtcaccaaacctccttctctggtcactccctcagattcaccctctctagtctctagttcccaacaacaaactccaaggtctttcattcttctctgtttctcactttcttcttctttcaaaactaaaaaaacaaccaaatggggagttttcaaattgaaccagaagcttaacaataacaaactactctctttttttccttagatgttttgtttctgtcctgactttgatgaatttgggtggactgtggagatgtcaggtgtgggacaaagtcctcaacatgttttgccttctttcataattattttgcagagttaaagcagattctggtcctcttttaaaatggtgtttaaacatgttccggtgtatatgggttgtgacctgtgacatatcatgcgtcttttaaattttgtttttctcnnntnttgaagttcttattattctttaattaatgtnnnnaatctctctttaaatttgcttcnnnnnnncancnnnacnntatgtttctttnnnnngacactgaatcccannnnnnnnnnnacnnnnnannnaaaaaatttttatttttnnnnnnnnnnnccaatnnnnnnnnnnnnnnnnnnannnnnnnnnnatcnntgctttnttnnnnnnntnaaaaaaaannnnnnnnnnggnnnnnnnnnnnnnnnnnatatatttaaagnannnntnnnnnnnnnncnnntnnccntnnnnnnnnnnaatttaatttnnnngggggcgnnnnannntttttttttnnnnnnncnnnnnnnnnnnccgannnntcncnnnnannnancnnnnnnnnnnnnnnnnnnnannnnnannnnnnannnnnnnnnnnnnnnnnnnnnnnttannattttannnnntnnntaannnnnttaaaaatttgaaaaatntaannactnnnnnnnnnnnnnnaaannnnnnnntnntttnnntnnnccnnnnnnnnncnnnnnnnnttnnnnnnntttttnnnnttntttttttttannnnnnnnnnnnnnnnnnannnnnnnnnnaaannnnnnaaaaa

SEQ ID NO: 3078 - DNA, 389 bp, Glycine max
  misc_feature (345)..(356): n is a, c, g, or t
  misc_feature (367)..(367): n is a, c, g, or t
cgatatccccaaagacactgcttcgaaaccctaattcagaaaccaatggaaccagaaaccaaatgcatagagctgaaactaatttcctgcaaggacataagcgccttcaacttcttccaaaaactcaccctttacgcgctcgtcttcatcgagagcgaggatcccaatacggatctaacggcggaacagaggcagatgcagagaacgttaacggaccgagaccccgacggcgatggcagcaacccagagtggaatcaccacgcgcgtttcgatttgtggtggctttcgcactcttcgcgcgattccgatggatcagatctctttctccgcttcgagttcagaatnnnnnnnnnnnntatgcagatgnaaatgtgggaaaattgcttatg

SEQ ID NO: 3079 - DNA, 333 bp, Glycine max
ggatctagcagctccagaatctaaccctacaaccccaaacccagatctcatccaaacctataaaccctctttcttagtaaaacacttgacaaacctaaacttgagtcaaccccacaaaacccgtccaccccaaaaacactctcctcttattgacacccatttgcaggccaaagccatacaagagaaagagagttctgttactgtgcctgtgaagagaacccacaaagagaagccccaaaggcactgtttgaaattggaaaggagggaacttggtgatcataatgataagggcatggtcgaggatgctaaggttgtaaaagctaaggatgtaaa

SEQ ID NO: 3080 - DNA, 910 bp, Glycine max
  misc_feature (848)..(851): n is a, c, g, or t
  misc_feature (903)..(905): n is a, c, g, or t
atatttttcttcatttcctcggttatcctagctactccatttatgctttcaataatcttttcttttatccctgttttcaataattaatgtcttgatgacaaaacacagatgaaaacaagccaaaaataaatactcacgtttctaaaccttctacagtacttgctacatgtttcgtagtataaattaaacatacaagcacttattacaccttctaacgagtgtattaattaaggaaaataattaaagttacctaaattaaaaatgaacattaatgaaagagactctctagcaaaaaaaaagggcattcattaatgaacatttaaaatattttattacttaaaacatgagcattaattcgcgagaaaaaaaatggtccgttgaatgttttcactagaaataactaggatatgatgtcacctagtaaccgaaaaaagatatgatatgactccaattaaactaaactaataatacaacacggtgagcttgtttataactttctggaaacttcagagggtggacctttctgtgtattaattgacaaaaaaaattattttttgaatggtgcatatggcagtatcattggaggcattgtaatcgcagtggggctttactcggttgtgtggggcaaagccaaagattattcagaacccaaattaccatcaacagatgcagaagacacagaatcactgccaattactgcaacttccaaaattgatattatttctgggaatttggaaaaacaaccatcaactgatcagaaattagaggagaccaacaaagtgggggaagaaaaagagttgaatgttgtgaaggtttaattgactaatcaacgattccttgtccacccnnnnatgttcggagaaagtgaagtctcacgtgtgcactaccagaaatgcattgccnnnaagtc

SEQ ID NO: 3081 - DNA, 384 bp, Glycine max
aagttggtgatgcgtctgtggttaagattatcgagcttgaagattaagtgcattgatctaactacagtttaggcttttctgttttttggcctgcaagtttttggcagtcgcagatcattctgcttccacattttgaggttatctccaccgggtttggtgactagctatatattttgtgattgaaaatgaatgttaggctaactattattacaggatgtcaaacttaaaaaataatagggaatatgttcgatgccaattttttggttaaagttttccacatggagaatgtaaaaggaagtgtatacgttctatattgtagcaatagccagttgtacgacgttatacggtttggtggtatacatctaggtctagttatgagcaata

SEQ ID NO: 3082 - DNA, 1099 bp, Glycine max
  misc_feature (1031)..(1033): n is a, c, g, or t
  misc_feature (1035)..(1037): n is a, c, g, or t
  misc_feature (1047)..(1054): n is a, c, g, or t
gagttaaggtgatatttttaccttctctctctctttctgccttgcatattttttatgctgataggaattgttcattttgaaatattagttattcttatgaaacagagagaggtaaagcatagttggattaaattggatgttttgtaggtgcaaaatctagttgcagaaattgttgattcaaaattggggaaacaagtaattctcttgaattttttttaacctttcaaattttatattgtggtatcttttgatgacgatattatataaaatgctgcagattagtagaatcaggccatcagtgacctccattgcagcagaggaaataatgagcctcgtaacagctcaaggtcattaatttttattctcttctgggttgagtttttatagttgtggtctattttatttatcaaggttaactttatttttcaaacttgaaaaatcagtggccgagaacagtgaactgaatgaagtttggaaagacttactagatgcagagggagatgaaatatatattaaggtaatatctttggactttcatgttttgatacatttttcagtaaacattcatcccaagaaaggtgatatgtgtgataccttggtgtcatgaattttcctaccataccattttctttcatggatgaattccttcctttattaccctacattccttttgaaaaaaatgtaccttaggaaatgaatagatgacaaattgatttggcccgacttgcttacaacatcaacctatgttacaaacatgttttttttttcataaaagtatacggcccttaaattagaacatgaatgtcaacctgctccaaaacaaacgaacaatgctgaggagtgaggacccttttatttattgtctgcatggttgctgttgtagcagtgcagtttactctcctgttttcttattgcaggatattggcctatacatgaaagaaggagagaatccatcattttctgagctttctgagagagcatatttacggagagaagtagctataggatatgagaagaacaagaagaatgtnnnannnagcagtccannnnnnnntcagtacttcattgaacatgctactgacaaaccttttctattgca

SEQ ID NO: 3083 - DNA, 424 bp, Glycine max
cactttcagaactatgcaacccacgagacaaacaagtccttcttaaaatcaagaaagagcttggcaacccaaccactctttcttcatggctcccaaccactgactgttgcaacaattgggtaggtgtctcatgtgacaccgtcacccaaacataccgcgtccacaacctcgacctctccgaccttaacctccccaaaccctactctattcctttctccataggtaacattccctacctggagtttctttccatcaccggaacccccaacatcattggcacaatacccccgacaatcaccaaactcaccaagcttcgtaatctctatatcaaatacaccaatgtctctggccagatacctcgtttcttgtcccaaatcaaaaccctagaattcctcgacctctcctacaacaaactctctggcaa

SEQ ID NO: 3084 - DNA, 369 bp, Glycine max
gagactcctccagttgttgagcgcgtttcagaatgcttcatcaagccgcagcactccaaccatgaatcaaaccaaatctgctacttaacaccttgggatattgctatgttgtctgctcactatatccaaaagggccttctcttcaagaagccctcatcaccacttgttagtcacaataatttcatagagaacctgttgcagaagctcaagcactctctttctctcaccctcttccatttctatcctttggctggtcgccttgtcacccaccaaacccatgaccctcccttctatgctgttttcgttgattgcaacaacagtgatggagccagattcatccatgcaactttagatatgaccatatctgat

SEQ ID NO: 3085 - DNA, 761 bp, Glycine max
  misc_feature (198)..(198): n is a, c, g, or t
  misc_feature (224)..(224): n is a, c, g, or t
tcgtggatcttttctcggatagtggagtcagtgtggtggcaggtagatgttgtctcttgtgttagatatttgatgcattcactgatgtaagaaaataatcattcttgcatattgtccagtacagtgggaggagtacattgtctattccaaccatcttattcccatgtttagcttatctactggtttaactccaaatangaattaatcattatatgttctaaagntgatatatcattagtagggttgatgattcatatactctagtacgctattgatacagtagatctttgtatcattcttcacagtatttttgataacttgagaagcatgttattttttcaggctttgactccctacatgcagtctccagttgggaactcttcaaataaatccattgggaagctgatgggacctgctcttggtgatcacaatcaaggaaacttttccatcaatctctggagaaatgctttccaagatgcttttcaacgactctgtccttttcgagcaggagggcatgagtgtggttgtttgcctgtattggctagaatggtgtgctttttattattatcaatgatatccttaatccttccattcttgcagtgtttataatttccctttcttttgctcaggattaagtagatttaaattcttttaccaggtcatggaacaatgcatagctagactagatgttgctatgttcaatgctcttcttcgggagtcggcccttgatatcccgactgatcctatatcagaccctattg

SEQ ID NO: 3086 - DNA, 669 bp, Glycine max
agatgaaggcgaagaagcatgcccacgctgaagaggagggagttgctccgcttccttcaccaacactatccgattccgactctgattacgaggtactctatcctcaagggtctgttaattcacctaactttgtaactatactaatgctatacacgcgcactcgcatattctgtttgtaggactcttcagccgatgatcaccacgaatcttctgtctcgctggattctcaatcccaatcggaattagaagacgcttcacctgaaaatggtagctccggcgttgtagaatctgcagaaaatgaatcatctcaatacgaggtgcatcacttcaattttgttcttgataaaataactttagcatgcttagctagaagtgctatcttgttgttctattcgcttagctataactaatatgcttagaagcaatcctttcaggacactgttaatgaagaagacggtggaagtgagagctctgatctccatctggaaggagctgagagtgactcctccgaggatgaggttgtcattgttgtcatcgtcttctaatatttatgatttggctttggttttgctgactttgtttttccttttcataggtggctcctcgaaacaccgtgggagatgtgccattgaagtggtatgaggatgaacctcatattggatacgacat

SEQ ID NO: 3087 - DNA, 591 bp, Glycine max
  misc_feature (286)..(287): n is a, c, g, or t
  misc_feature (305)..(305): n is a, c, g, or t
  misc_feature (316)..(316): n is a, c, g, or t
  misc_feature (318)..(320): n is a, c, g, or t
  misc_feature (332)..(332): n is a, c, g, or t
  misc_feature (334)..(334): n is a, c, g, or t
  misc_feature (336)..(337): n is a, c, g, or t
  misc_feature (341)..(341): n is a, c, g, or t
  misc_feature (348)..(348): n is a, c, g, or t
  misc_feature (362)..(364): n is a, c, g, or t
  misc_feature (366)..(372): n is a, c, g, or t
  misc_feature (374)..(376): n is a, c, g, or t
  misc_feature (381)..(383): n is a, c, g, or t
  misc_feature (385)..(388): n is a, c, g, or t
  misc_feature (395)..(401): n is a, c, g, or t
  misc_feature (403)..(432): n is a, c, g, or t
  misc_feature (434)..(436): n is a, c, g, or t
  misc_feature (443)..(451): n is a, c, g, or t
  misc_feature (453)..(461): n is a, c, g, or t
  misc_feature (463)..(475): n is a, c, g, or t
  misc_feature (477)..(477): n is a, c, g, or t
  misc_feature (479)..(491): n is a, c, g, or t
  misc_feature (497)..(531): n is a, c, g, or t
  misc_feature (533)..(550): n is a, c, g, or t
  misc_feature (552)..(562): n is a, c, g, or t
  misc_feature (564)..(570): n is a, c, g, or t
  misc_feature (572)..(586): n is a, c, g, or t
  misc_feature (588)..(588): n is a, c, g, or t
ttttacctctcctacaaaacttccatatgatgggcgcacatctctctcttcatggtattcatctagtcagcagtcatcagcagcaaactccccaccacggggacgatcgcttccaggttttaatgatttatttttaatctaatcttttttcccatcttactaatattggtccttgaagtttgtcatgttcgtttgctccttagccttttcacttcagttcttgattggaatgttatctatctaatgctgctggttagggcattgttccttatgaagcgtaagaaanngctagtgcctctttaatntgtttcattantnnnatattctcagtngntnncccntcatgtnaaaaattgtttagnnngnnnnnnnannntgatnnnannnngtttttnnnnnnngnnnnnnnnnnnnnnnnnnnnnnnnnnnnnnannngggactnnnnnnnnnannnnnnnnnannnnnnnnnnnnntngnnnnnnnnnnnnncttttnnnnnnnnnnnnnnnnnnnnnnnnnnnnnnnnnnntnnnnnnnnnnnnnnnnnnannnnnnnnnnnannnnnnngnnnnnnnnnnnnnnnantta

SEQ ID NO: 3088 - DNA, 390 bp, Glycine max
gagccccattccaggagagtaaaagtcaaggtcaaggttcagaaggaggttctgaatggagcaatacttgaacagtcttatcctgtggagtatgttcaacaagagcatatgtgtgaatcttgttctagggtccaggctaatcctgaccagtgggttgctgctgtgcaactcaggcaacatgtttctcaccggcgtactttcttttatttggagcagctgattctgaagcatggtgctgctgccactgctataagaatcaagcagatggaacaaggtattgacttctttttctctaatcgaagtcatggagtcaaatttgtggagtttatagggaaagttgctccagtaaggagccgtcacgataagcagcttgtttctcatgatccaaag

SEQ ID NO: 3089 - DNA, 681 bp, Glycine max
  misc_feature (305)..(305): n is a, c, g, or t
  misc_feature (310)..(310): n is a, c, g, or t
  misc_feature (318)..(319): n is a, c, g, or t
  misc_feature (321)..(321): n is a, c, g, or t
  misc_feature (324)..(330): n is a, c, g, or t
  misc_feature (334)..(334): n is a, c, g, or t
  misc_feature (346)..(348): n is a, c, g, or t
  misc_feature (356)..(361): n is a, c, g, or t
  misc_feature (363)..(369): n is a, c, g, or t
  misc_feature (371)..(374): n is a, c, g, or t
  misc_feature (378)..(387): n is a, c, g, or t
  misc_feature (389)..(393): n is a, c, g, or t
  misc_feature (395)..(399): n is a, c, g, or t
  misc_feature (403)..(403): n is a, c, g, or t
  misc_feature (409)..(409): n is a, c, g, or t
  misc_feature (411)..(411): n is a, c, g, or t
  misc_feature (414)..(423): n is a, c, g, or t
  misc_feature (425)..(430): n is a, c, g, or t
  misc_feature (432)..(438): n is a, c, g, or t
  misc_feature (453)..(455): n is a, c, g, or t
  misc_feature (463)..(464): n is a, c, g, or t
  misc_feature (476)..(480): n is a, c, g, or t
  misc_feature (482)..(484): n is a, c, g, or t
  misc_feature (486)..(487): n is a, c, g, or t
  misc_feature (490)..(490): n is a, c, g, or t
  misc_feature (492)..(501): n is a, c, g, or t
  misc_feature (516)..(516): n is a, c, g, or t
  misc_feature (518)..(519): n is a, c, g, or t
  misc_feature (527)..(530): n is a, c, g, or t
  misc_feature (540)..(541): n is a, c, g, or t
  misc_feature (548)..(548): n is a, c, g, or t
  misc_feature (551)..(552): n is a, c, g, or t
  misc_feature (558)..(561): n is a, c, g, or t
  misc_feature (566)..(567): n is a, c, g, or t
  misc_feature (572)..(573): n is a, c, g, or t
  misc_feature (582)..(582): n is a, c, g, or t
  misc_feature (584)..(585): n is a, c, g, or t
  misc_feature (601)..(604): n is a, c, g, or t
  misc_feature (607)..(609): n is a, c, g, or t
  misc_feature (611)..(612): n is a, c, g, or t
  misc_feature (619)..(628): n is a, c, g, or t
  misc_feature (630)..(631): n is a, c, g, or t
  misc_feature (635)..(640): n is a, c, g, or t
  misc_feature (648)..(648): n is a, c, g, or t
  misc_feature (652)..(658): n is a, c, g, or t
  misc_feature (662)..(665): n is a, c, g, or t
  misc_feature (670)..(678): n is a, c, g, or t
aaccgaaaacgaaatttacaggagaaaatagaaccaattgatgagaaaattaatgttgttgtaaacggatcaaatactgatgagttgacaaagtgtaatggttttcggcataatggaagcaggcgtaaaagcaaacctcgtcgagctgcagaagctggtgtgcagtgtaagcaagactatgcttgagatagcattattctcaattctcatcttgccagctatgtcatcatctatggcaattcatttctttcatttcattttattttattttatttagttttttttttttttcccccctggtctanaggcnttaaaaanncnccnnnnnnnacancatcagcaggannntgacttannnnnncnnnnnnntnnnngggnnnnnnnnnncnnnnncnnnnnctcntccctnanttnnnnnnnnnntnnnnnncnnnnnnnccccccccccctctnnnttaccccnnctccccatcttnnnnncnnncnnccncnnnnnnnnnncacccccccttcccntnnccctcccnnnntcccttcccnnccccctnctnncctctnnnntcccnntcatnntccctttgntnnccccccctattttttnnnntcnnncnntcttttnnnnnnnnnncnnactnnnnnncccccctncttnnnnnnncccnnnnccccnnnnnnnnnttt

SEQ ID NO: 3090 - DNA, 876 bp, Glycine max
acccttgctggacacatgggtatgtgaatactgttgctgtttcccctgatggctctctctgtgccagtggtggcaaagatggggttattcttctgtgggatttggctgagggtaagcgtctttactctctcgatgctggctcaatcatccatgcactctgcttcagccccaacaggtactggctctgcgccgccaccgagcagagcatcaagatctgggatttggagagcaagagtatcgttgaggatttgaaggttgacctcaagactgaggctgatgccacctccggtggtggtaacgccaacaagaagaaggtatattctgttcaattataatttttgttatcgatttcaagtttttactgtatatgctctgatttattatgctcttatggttaaagttatcttttaatttgaattgatgtgtttccttaaaatttgtttgctcttcaatctgctgttgattatttgataatttggtcattagtttaggtcttgttgaattatgaattggatgcttgcattgtagttttgctaattgtttttgtttattttccggtgcaaatcttgtttgcgaaagagggcttggttaactgtctcttctgtttgaggaggaagttatatgccttttgtcattgaaattttaatatttcccctctaattggattgtcattgttacaaactcttccattggattgtcattgctacaaactcttcgtcgtgatttgttgtacttatatgttggtcatagcaattatagaatttccctggctttattcaatatgttgcttgacttttgtgttgtgtttgtctgctatcactaccttgcaggttatttattgcacaagtttgaactggagtgcggatggaagcactt

SEQ ID NO: 3091 - DNA, 404 bp, Glycine max
atgaggtactgtctctcaagatacttgctcgattaactcctagagatattgcatcagttagctctgtctgtagacgattatatgagctgacaaaaaatgaagacctctggagaatggtgtgccaaaatgcatggggcagtgagactacacgtgttttagagactgtgcctggtgcaaggagacttggatggggtcggctggcaagggaattgaccactcttgaagcagcagcatggaggaagttgactgttggaggtgctgttgaaccctcacgctgtaattttagtgcttgtgcagttggtaatagagttgtgctttttggtggtgaaggggttaacatgcaacctatgaatgacacctttgtattggatctcaattctagtaatcctgagtggcaacacgta

SEQ ID NO: 3092 - DNA, 514 bp, Glycine max
atgggatagcgcgggcattgtaccggtggtggagccatggttcttatcggaagtggaatcgtaaatgtagccgcaagagttgcatccggtggcgatgacgatcacctggttgagctggccaaggagcaagatcgagttgagaaaagcgagtacctgggaaaaaggagataaagagaagtttgagattggaatcagagaggtgaagtgttgaattagggtttgtgcgtgtgttacttgggagaggaactcggcgaaggggaaggggaaagtgctccagaagaaagggttggtgtctagcgttacaacgaggaggctcacgtcatctgcaacaaagcagacaaacaaagaggggtcaatggaattggtgtagagtgaataagagattgagtgatgagagagtgcaaaggacctgcgtagagtttggaagaagcagaaggcatggtgtgtgtgctgtgtcttctgctttcacttccaactcatttcttggcagctcaacgatgcaattaacacttcc

SEQ ID NO: 3093 - DNA, 833 bp, Glycine max
tattacatgcaaaggtatcaatcaaccatcaagcatgtattatatatgtttaaatactttcatttttcagttttgttatacaactttttctgtagtatattatatataacatatctccagttcattttgtataattatatgtatgaatttttggtttgagtattgtagctgctatttgctggggaataggaaaacctgtgactgtggaagagatacaagtagaccctcccaaagccaccgaagttcgagttaagatgctttgtgccagtatatgctccacagacatctctagcacaaaaggattcccacatgttagaatcctttcaaactcatgctaatttcactttcagtttcagtttgttttctctaagaaagaaagaaagaaagaaaatctattttcttcaccgttgttccactatatatatagtctagattaattacttaccaaaaacaatctaatttgcagaccaattttcctatagcacttggacacgaaggagttgggtaatgaatctcaacaaacagtacatttgttgttacattttcctataaaaaataattaagagtctcaaatatttttgttgttacactaacgtatctatatatagttatctactaataagatcatgtgttgcattaatggcagtattatagagagtgtcggtgatcaagtaacgaatctgaaagaaggggatgtggtaattccaacatacataggcgagtgccaagaatgtgagaattgtgtttcagaaaaaaccaatttgtgtatgacatacccagtaagatggactggtctaatgccagataacacttcaaggatgtccatccgagga

SEQ ID NO: 3094 - DNA, 375 bp, Glycine max
aatttcttattcaaatggtgggaccatcttgagcaaggaactcttggggaggccactgacatgaagaccattcacaagttgacataagtaagttcagaggagcttcctgcatccctgtaatgaagggtggctgcattccgaccaaataagaacgaaattggacctattttgagaagaattttcggagcagtgacttataggatgttgttggtctttttgttattcgatgatagctagaacaataaacgtctgagtgtttaaattagaagaattttttgttgttgcaaatttcggattttgggatgcaggcaagtttatcggaataagaatacaagatgttagtgatttgaatcaagtttatcatggtggcggtgt

SEQ ID NO: 3095 - DNA, 429 bp, Glycine max
ccagattcagattgcaccaccaggatcattggatagaggagctagcactgacattgatcccatgtcagagatctatgactcaaaacctgtgcttcagagtgaagagaaaaagtttgatgcatcatctatgaagcttgaaaggccttcaccaagaagagcacctcttcagcctgaaaggatgagccctatgatcagcactggtaccatggcacaaggtagaggctcaccatttgggtgaatatcatagtttttaattaattagatcatttggctatgttatgtgtaattgatgacttgatcatgtgaaactctcttaatagtagtaccatatctagggtttttgaatttggtcttggaaattagcagttcttacgagggttatttcccccctcgtcaagtactgttatgtggtataatgcctttacatgg

SEQ ID NO: 3096 - DNA, 663 bp, Glycine max
  misc_feature (60)..(61): n is a, c, g, or t
  misc_feature (65)..(67): n is a, c, g, or t
actttatcatcggtaagcgtctcacagtgattactacattgttcttaagcagtaatgtanncttnnngcaatgtgcaaagtgcaaactccaaaatttatgagaagctacttgtccagctcaattgattgaacagtgtgcctgagttgttggaaatctcctggtacctgtgttcgattcctatggaaaaaaaattgttaagaagcttgagacaacaacattcaacaatgtatagatgtcatatgtgtgctaacaatttctggttcttttattttttcagggtgtatttactggtgaatgtgggacaagtttagaccatggtgtggttgttgttggatatggctctgaaaatggtgtggattactggctggtgaggaattcatggggcactggatggggtgaggatggctatttcaagatgcaacgcaatgtgagaacccccacgggcaagtgtggaattacaatggaggcctcctacccagtgaagaatggtttaatctctgctaattcagtttatgaaagcaatgaggtgtatgttagcagtgcttgatataacaaccatcatcgttatttatgatctttggaattgggaagaggaacaagtgctcaagttgcaaatgtttctgctatctttgatgcttctattgaatatgtctgttgggcta

SEQ ID NO: 3097 - DNA, 382 bp, Glycine max
cccgacggcaacaccgaagaggacacgcgtctcttcgccgacaccgtcgtcaagctcaacctccagaagctcgcctccgtcaccgaaggaaccaaccgcgacggtgacggtaagtcacactcgcggtgaagaagcaaatacgcctcaataaaacaaaatatatattaaagaaaaaaaagaaagaattggaatttgaaactaatcgctccctcgtcaattcataaaaggagaaaagcaaaacaagtttttctctcttttctctttattttctttttttcctcaaattcattttgttttcgttttattttatttttttcgggtgagactgtcgtttttttgttctgttttttattattttctgttgctattacaatgggtgagg

SEQ ID NO: 3098 - DNA, 416 bp, Glycine max
atctgagtatttgcctcaatattttaggcgggtctctaggaaccgtggatgattgttgtgccctcatcggtggtcttggtgacattgaagccattgtgtgcctttgcatccaactcagggccctcggaatattaaaccttaaccgtaatttgcagttaatattaaactcctgtggacgaagctacccgtcaaacgccacttgcccccgaacctaagaacagaatatgtatggcactaattaccatattacttcgtatcatggtgtttgtttgtttgtctgtgtttaaagttaaggatgttatacccttcgtgcctgctacatatatatagtgggcactataatattaccaataaattaacgtccatatataagaataataataaataaataaatatttctatacaaataaaggtta

SEQ ID NO: 3099 - DNA, 1290 bp, Glycine max
  misc_feature (1236)..(1236): n is a, c, g, or t
tatatggtgcttgtatctcacagcagctctttccttttcactcgttttatttttctccgcctaagttgaatttctcacacggtttcttgtatagaataatgaatttcgatgattaatattgcaaataaacgatcaatttcgtccttgatctattaccctctctactaaatggtcctgaagtaaaataataaagtttattagtaatctctcaagtattaaaattcatgttaattaggaaaatatatcaacttagggactaaaactgatggatgttcaatacttgggacttgggaggcgactacataggggagagagtaatacttagggaccaaattgattgtttattccattattttgggtggagattgctgtatagatttgccaataaaggcagcatttctgttacggctaaaataattctctgtgtagtgttttctattcatcctttgggactagggctgtttcatttttctatttttcttcatttctggaatatcttttgaatttatgttccctgttcatggaaaaggtggtatagtgttattataatgtgccagacatcagtcaaaatgggattcaggttgcatacaagacctagtaatcgccaattattaaatatatcaccacttcaattacataattttttttctgaacttaaaatatctcagaatattaaaactaattggaacaaaaaaggaaaatgcagcaaagaaaagactaagagtcatactttctgtttgcatcaaagccatgggttatttttgggctggggaagatgcaatctccttgttttaccttgcactgcatgatctaagctgtctgatgctgacttctgtttttaatttggtttgtcaatgtcatatatactctatttagacatgcatgggatctgttcacttatattttttagtaatattattgaaatatacatgttgctgtagtgattgcagcagcattggaactctttactgaacatcaataatgttgtgattgatgattgcagtgcaaggtgtgcatgcaaacatttatgtgccccacatcggaagtgaagtgtagggagcatgctgaagccaaaccccctaaatttgatgtttatgcttgttttcctcatctcaaaaagtgaacatattggagagtgcaaatggagaaaaactttatatcatcatggcctcttccttaaacctattgacagagatcttccccattttctatctatataaaatgtgtttttaaggntttgtgccttgggaatttaggagggacaaggagaggaagactattttattatga

SEQ ID NO: 3100 - DNA, 390 bp, Glycine max
  misc_feature (383)..(386): n is a, c, g, or t
ttatgattatcatttatctccctttagccatagagatctagatattgtgatggacttgattagagacatcaggttgactatccaaaggcatgtattgggccataattgtacgtatctccgaatccatatatctctgcacataaattagcttttaaaaaaaaaataacaaaattttatgatgagaatgcttaaaaatgttggcaacacaaatcaagactagaaaaaagagagaaaaaaagccagagtcactttagaacatattgagaactctatattaacaaaacatcaaactcgcaataatcatacctggattctgtacttgtaaaatgcatatcctccagcaacagcaacaaccaatacaaggaaaaacaacccccaaaaannnnggaa

SEQ ID NO: 3101 - DNA, 829 bp, Glycine max
ctaaatcctaatccttcttcactttcagttctcaggtatctcctctcttttcactcttttgttcaacctttttaagttgcaatgcctcactactttctcattcatgcttcatgttttcatactttgcttttctttaatcttaatacctgattacctgccatgacctcctatttaggtactaaatatttttgcaaaatttgtatcggcgagttaatatttttcatatgcaccctttaatttattttattgcatttttataatgttgttccattccatgtgccctcgtgcgggggtatgcatgtatgtgcttcttgtaatctctgtcggttggttttcatctcccaagattctgtatgtgtttttctgtctggtccttccttaaaaacagtaacttgcatgacggaattgttgtttctagttatattttatgcgtttctgactaattcattcatgtggggtgtgcagcatgggaagttctggaacaaccgactatggagcatacacataccaaaaccttgagagggaaccttactggccctctgaaaagctcagaatttccatcactggggctggtggtttcattgcctcacacattgctcgccgcctcaagaccgagggacattacatcattgcttctgattggaagaagaatgagcacatgactgaggacatgttctgccatgaattccatcttgttgaccttagggtcatggataactgcttgacagttaccaagggtgtggaccatgttttcaatcttgctgctgatatgggtgggatgggttttatccagtccaaccactcagtcattatgtacaacaacaccatg

SEQ ID NO: 3102 - DNA, 558 bp, Glycine max
gaaaggatgggatcctttggattctcaacttgtagaaatgggtctttaagaagctcctctgctgacaatctctcagatgctggaaccaaacatttctcaataaactccttaagttggggatcactcaccttattaagggaagcaggtttgatgccctgcaatgacatgcatgacaatataacataaagacgagttaaaagttttttattatgagcatgcaattataactaataaggatatgccaataattgatttactcactgaggtaactttcttaaagatttgagcaggatttttgcattcactatagggatattcaagagtaaccatctccaatatgcacatcccaaaagaatagatgtcaacaagttcagtgtatgcctcttcatatagttctggagccataaactcaggagtcccttttaaaatagagaaacaacaaacaaaagcatagttcagtgccatatgggaccagaatgataaaaaaaaatcacatttaaggaaagtaaatgttaccaataacactttgggcagttggttgttgcatgacaactgcta

SEQ ID NO: 3103 - DNA, 386 bp, Glycine max
gtctacggcctcttccagtgccgtggcgacctccccaacgaccagtgctcgcgctgcgtctcgcgtgcggtcacccagctcggcaccctctgctttgcctcctgcggcggtgccttgcagctcgacggctgtttcgtcaagtacgacaacaccaccttcattggggttgaggacaagaccttggtcagcaagaaatgtgggccgtccgttgggttgacctccgatgcgctgagccggagagatgctgtgctggcatatttacagacgtccgatggggtttacaagacattcagaacgagcggttatggggatttccagggtgtggcgcagtgcaccggggatttgagtcccagccagtgccaggattgtctttctgattccatcca

SEQ ID NO: 3104 - DNA, 658 bp, Glycine max
tcgttcaacacgcgccctgtcagccgccatgtttgtcagaaaccatttgtttattacttgtctaaggcagtgtatgatgagggtgctaatgaaactgcaagtcaatatgtacgggttcagcaaaacccggattgcaaatggaaaatggaggatccgacccagatcaaagtggtggaggtttataagaaacccgacccgcatttgtgggacaaggtaacttcacatttctctaataaaaatggatggctcttttaatgtttatacatacacacctcatgtacacatatttgactatgattagtgataacaaaacatcttttatttgttgaaattcacatggaactaatttgagaacgagacttgcatctttaactagtccatgtgaatttcatctattagaagagaatgtggaaagtagggtaagttgttaatatttttgtatttgacattgaactgaatgaaactcaaagttggttaatgaagtggattttgttttgttgatttgagcaggctccaagaagaaattgttgtagggttagacgcacaaagaagaaaggaactatggtgattgatgttggggaatgcagggaagatgaagttgttgaattgtagttagaggtccaacacatcaattgataattcttaactcaagcctttg

SEQ ID NO: 3105 - DNA, 365 bp, Glycine max
gagaagtattggacttcaagattctcgggctctagtgaatgaagctccggagtactacgattggtgttcagtctaggacgagcaagaagattttgggtgcaagattagtgtgattttgtgggacataaaaactgaattaaagttggcatagtttataggtatttgtattggctataaaaaaagaagtggggcagcaactatagaagctggtttgtgttatatttctccatcttgaaatgttccttggtgtgatattttccatcttgaaatgttccttggtgattggtcttttctgaattgtacttagtgctgttcatcttcgtgtatcttattcatttaccattttggctttttatcttgcgtct

SEQ ID NO: 3106 - DNA, 787 bp, Glycine max
  misc_feature (745)..(745): n is a, c, g, or t
  misc_feature (757)..(757): n is a, c, g, or t
  misc_feature (761)..(761): n is a, c, g, or t
  misc_feature (767)..(767): n is a, c, g, or t
  misc_feature (769)..(769): n is a, c, g, or t
  misc_feature (772)..(772): n is a, c, g, or t
ggtcttgagctcttctccaaggacgggtattatcattatcttcaacctttccttccactctcttcattcttctgttttcctctatggtacaaccatgttgttttagtggggccttaaaagttcctttttttttcctcattggatttttcaggttaaagatgctttaaccctgtttgaaacagcactttccttgaaccctaatccaggggaggcccaagctgcgtactacaacaaagcttgctgccatgcatacaggtatagaattttttacaatggatgaggggggattacacaattttcagtaggtaatttgtaatttcatcggtttaataaaatttgttagggttatggtagaagttcttattcaatcaaattgaactcactacttgagtcatgcctgccatgggacttgtatattgtgaaatggtaaagcaaggaatgagtaagcaagtgggcatctctaaaattattgaatttcctcggttccttgtatgttctaaatgtaataaatcatatgaaaaaaattaaatcaattgatttatacagggtactggttagctaatacgtatatttttatctttaaattctaatctaaatgttgtttggtcattattttcatgaaggggagaaggaaagaaagcagctgattgtctccgcactgctttgagggaatacgatctaaaatttggtacaattctcaatgatcctgacttggcctccttcaaagttttgcctgaattcaaanaactacaagaanaggnttcctnantanttcttgagcattttg

SEQ ID NO: 3107 - DNA, 690 bp, Glycine max
  misc_feature (609)..(609): n is a, c, g, or t
  misc_feature (611)..(639): n is a, c, g, or t
  misc_feature (650)..(650): n is a, c, g, or t
  misc_feature (653)..(655): n is a, c, g, or t
  misc_feature (661)..(662): n is a, c, g, or t
  misc_feature (664)..(669): n is a, c, g, or t
  misc_feature (671)..(674): n is a, c, g, or t
  misc_feature (682)..(682): n is a, c, g, or t
attcctcatcaaagcctgctgttttgggaaacaaaagagggttctcagatgtcatgagtggattcgccgaggtaaataccaattcaaatccaaggggacatatcacatatgtaattttttaaatgctggaccaggcactaaaagcccccaatttaccatgcaggagaaattgcttgttagttccgaggtcaacacaatattgccaccaaggccttcttctaatgtggggttgaaaccaagctctatgcttgagaacgtcggggctcagcagcaagccaaagaactcgcaacggtgaaggttggtcacgagaggtctcatgctgtcaacgaaagcagaccaaatcttaatgattctactaataacaatagcagtgcaccagctaccaagtaagtggatagtgggaattggcataaagtttgggcttacccttggaaatgatctttgatgaatgatggtccttgtgtggcagggcacaggttgttggttggcctcctataaggtcatttaggaagaattcattggtcactacttcaaagaatgttgaagaagtagatggaaaagtggggcctggtgcactgtttgtaaaggtcagtatggatggtgcaccnannnnnnnnnnnnnnnnnnnnnnnnnnnnnaacaaaaaagnagnnntctcanntnnnnnngnnnngattcccnaaaggaaa

SEQ ID NO: 3108 - DNA, 461 bp, Glycine max
aagagtgtaaaagtaatctgaacctgaaagccactgaactcaggcttgggcttccgggatcacagtctcctgaaagagattctgatctttgcttaagaagctcaactcaattagatgaaaaacctttgtttccgttgcatcctttgactgatgatcaccattcttcagccaaaactgctgtcttgggaaacaaaagagggttctctgatgccatgaatggcctctcctccgaggtaaacaccaatttacatgaagaacatgtactttttaattgtttgcttggccaaacactaaaagtccccaatctatcatgcaggggaaattcctagttgatttggaggccgccaatccgatactatctcccaggcctgcttgtaacttgggattaaaacctggttctacccttgataaagttggggctcagcaaaccaaaatgaaagaagtagcaacaacaaagggca

SEQ ID NO: 3109 - DNA, 917 bp, Glycine max
  misc_feature (65)..(65): n is a, c, g, or t
  misc_feature (863)..(864): n is a, c, g, or t
  misc_feature (899)..(899): n is a, c, g, or t
atcttgcctctgcataccctcttgctccctctcctcaagttccaccattttctccatttcccttntcaatgtctgcttcctctccaggttctatgaaaattcttacttttttttctgatttattttttggtttttcgcatttatttttttcggagacaatcatgtttgaagaactgtcacatactaaatgtagatacttttctcaacaagaattcgaaccggatgctattcttacgtgctctctctgtcacactatctgttgtttctttcttatgatggagttggtactcaacagtttcaaattcaatacaagcacttagtgcagataatctatagtaaccatttttttaaaactcatttctggtactggtctaatgtgttttattgtgtggatttggatcctacccttttgcttaaactctattaacttgccattaatggtttgaaatttgaatgaatagtagtacgtattttgtttctatgtatttgatttgatgcttagtgccatatactgcatattgatcaggaattgtgatgggggctgaacagcaacacatggattcacacaagaaaatggtaattgctgttgccgttgccagcacttcacttggtgcagtcattttgtgtgtgttgtgcatctggatttactacacaaagtacccttcaaaatccaaagggaaaaacgttcaaagatcaggtttttattttctcccttttatcacaattccatttcttagaatcttatgaaatttgatcggagaaaactttttcatttttatttacatgttctgttttcactttgtttcctatttttatacaggaaaaaatgacaacagaaaacaataaagttgttttttgttttnntgtttcctatacaaactttttaaatcaggaaacanagtaaaaaaaaaaaaaaa

SEQ ID NO: 3110 - DNA, 395 bp, Glycine max
tcaacattttcagctattaccatttggaggtggtaggaggatttgtcctggaataaacttaggccttcaaacagttcgtttgacacttgctagttttttgcattcctttgaaatcttaaatccatcaactgagcctcttgatatgactgaagtctttagagcaaccaacactaaagccactccacttgagattcttattaaaccacgtctatctcctagttgttatgaaagtatctaatatttaattatgtgttagttgtgtgaacctgctgtctgtattttttatttttaaactatatgtaatctgttttaaaataagcctggtttgccttgtaagctattccaaaactatgtattttgttgcttaatctcatttgaataaacatgaagcaaga

SEQ ID NO: 3111 - DNA, 296 bp, Glycine max
tcttgtggggcttgctcaaagctattgaccgagagatcaacatggagcaaccagaagtttattgccaacagtgacctgtcagttgttgctgtactagtctgtggtcattcatatcatgcagaatgtttagaggctatgacatcggaggcagataggtatgatccagcatgtccaatttgtatggttggagataagaacttgtcaaagttgttgtccagaaaaggtcttcgggctgaatcagacatgaaggccaagaaccacaagatatccagaaaccgtgtagttgatagctacct

SEQ ID NO: 3112 - DNA, 343 bp, Glycine max
tctgcagtatcatcatcatcttcttcagctccaatgatacccccatcatcactttctcttgatcatgcatggaacaatggtagtagcattagtactactgttaatgcaactagggttagtgaccttgagtccccaacatctaccttgtctgagaataatgcaccaccaattaatattactagtgttattgagtttgtgggttcttcagagagagggacggtgaaggaagagggagagcaagagtggaacaaattaggttatcatgaaagcttcacccatttgggagaatacaaagatggcaaggagaattcaatgcctttcacgtctagtctgcatgagttga

SEQ ID NO: 3113 - DNA, 1128 bp, Glycine max
gcattaggtttagcttactttatcatctgttagtagtgttttcgaagaaatttgcttttctacctgtctccatgtgttactcgtgccaaccacattctctatctccctctgctttgccttacctctcatatgattcattataacgttatgaatccttttatctcaattggattcattaattttcgttttaatacttgacaactgactctgctgtatctgtattgatagatattttgagtatttgtgctttataataaacattatttcttcattacatagctctgctttaccaatggctgatgactctgctaaaggaattgaaaatgcttctttgaactcaacacgactagagaaccctcagattgagcccataagactgccctcggtagaggaaatccgtggtcaagacatttggaacaattgtgcagtgcgcagtgttgtcagtggagtcatgggtatgccattcaatcctcacttcttcttttcttttttcttttttctttttttcctgtttttccgatagattttagcacatatttcacctctgcttaatgatgcagaagtcatatgactgatatgagcctagcgttacttagtactcagtattgtttgacaatgtaggacctatgaatgttctttccacaagtaccttttaggtacttagtatgatggacagctataagatgggatttttaagatcatgcataattcgactcaccatccttactgctgaaactttatcatacttgtgagacaagtagattagtattcccactagtttttttctttagggtctgtttcattcagtccatttagagcctttttaagctcatgtactttaccttcaacagattcaaaccgagggggtacctccatatcaaatatgtcattgaatgaacttgagctttttttttcctagattttgacagctattgcatgttgagatgtatattgtaaaaaatgtgtttcttgggattcatgtgatgttttttcaggtggcgggcttggcatcttcatgggtttatttcttggagcactggacaacccattgatgcaggaggaaatgaccggcagacaacagcttatatatcaagcaaaacagatggggcgaaggagtggagtcagcca

SEQ ID NO: 3114 - DNA, 404 bp, Glycine max
tgggtgcatgttcacctttcgagatgccaccgtgccgctcacgtgattgtcgttgtgtccctataggactagttgctggtttctgcatacatccaactggactttcatctgttgcgaagatgatcgacgaacatcccaacttatgtcaatctgatgatgaatgcatgaagaaaggaagtggcaatttttgcgctcgttaccctaataattatatcgattatggatggtgttttgattctgattctgaagcactgaaaggcttcttggccatgcctagggcaaccaccaagtaatatggtgggtatgccaaagtgggcatgcttgatgcatcttctactacttaaaaataaaagcttatgatgcatctactgctttaaacaaaagagtgctccactacgcaactt

SEQ ID NO: 3115 - DNA, 359 bp, Glycine max
ccatggggaaaagtacctgctttcagctgttgacatgaataacaatgcaaggaatggtatgaagagtagtagtgcagttggtccaactatagttataattagttgtcctgagaagggtgaggttgttgggaagcttgttttactgcctggaagctttcaagagctatttgagattggagccaagaaatttggtttctatcctaataaggttgtatgcaaagatggaggtgaaattgaagatatagagataattatggatggtgaccatcttgtttttcttggtgcaagtggagggggctagaatccaatcgtgcagctccagcaacaccactaaccaatggcgtgcgtatataatatat

SEQ ID NO: 3116 - DNA, 332 bp, Glycine max
cctggttacaaaaggaatctttgaccgcaaagggtctccttgttgaagctaccacatcaaagctggttggggagacataaaggtatgtagtagataaaccattaaataattcgtctttcttaggacaatcaataagctctttgtgactagataaatccagaccattggatttatcttggaagctgatatcattctgcaataaataaagggaatcactattaaacttttcccctatctcaaaatttatgtccatatgtccaacttgtttgctcaaacaatcaatttgatcatcatgatgagcattttcctggttattgacacccttaagtgga

SEQ ID NO: 3117 - DNA, 385 bp, Glycine max
caaaggaactcagatggctcagagccaagtaccaaatggagttaagggatcataaggatggacagtttgggcaatgctcacatagtagtaacagtgagcacagaacagaaaatggctttttgtcaccttcactgacagaaacattaaaaggaggcaacaatgggactcggttgaaacccattactactaagtggaattgtgattccagtagccaccctcatgtccatgaaagcagccccaattcggacacccaaagggcccaaaattgtgaggcgattgaatcccctggagaaggtatggttactgcaaagagtttttatacaggctcattgctgccgcactctttgcacaggacagtttctctcccagttgatgctgttgatat

SEQ ID NO: 3118 - DNA, 881 bp, Glycine max
  misc_feature (777)..(779): n is a, c, g, or t
  misc_feature (795)..(796): n is a, c, g, or t
  misc_feature (814)..(827): n is a, c, g, or t
tctccaagagcacgagtaacacctaactggccgttcaagtaaccatcatcaacgaagccgcctagggactcaactcgcgtcctttcattgatgcagcttggcctatgatctttggacatttctatggcccttccatggcgggacaggacagctcggcaatctccagcattggctacaagtaaggacctgtacaaaagaatgaaaagggcaatgtacatgaacaaaaaataatgagacaaaaacaggtgcagatgtagttgtgattttgtatgcctgatgtgttgcctatgaaggatcacccttattttgaggagatgctagggaccaagagaggagaaatagaaaattgatagaaacaaatcaaaagaaatgaacacttgtacttaatgattgagaataggagaggtttctcctctaaagctttcccctttacagagtatttctcctttctcgcacaagccatctaattcacagaatgaatccctcttatcttattgatctaactaatcctttctaactaactaactaactaactaatggatatgtggataactactattcttcttctatcctaacagggaaggggatacaaagtaagcgtagaaataagaataaaacagaaaaaataatgttgatgtcaggcacctcatttgacttgaatgctaatgtgccattttcacagctacacttattgtatgaaaagataatatatcccacagttctgaaggacagagaacagtagagacaagtgctcaccttccaaatataattgcagannntgcagttgtaccagannaaacggaaggctcatgannnnnnnnnnnnnnaatgctgcatctgtctccaaaatgaccttttgacaccttctcaggtccaaggaa

SEQ ID NO: 3119 - DNA, 364 bp, Glycine max
ccttgattatttttttgtgtgatggatatggatatctgtaaataattacagctccaaaaaatcagctatcctgtttatttgcatacaaaatgctttattcttttaacagccagttaagattctgaagtccctcagcagaaatgcttcttcttactcgtgttctttccacaaccacaggtggtggaggatcaaagttaaaacacaccatcacaactgttaagttatctgttgatcctctcttggttgcttcctgtactatttccttgcagcattgtttctcatcattgtgctcttgaagcttccttctagcaaaatccacagcattttggctactaaaaacatcccatattccatcactagcaaa

SEQ ID NO: 3120 - DNA, 357 bp, Glycine max
aagagtgaagaggtgaataagggagacggtattgaagaagatgcagttaaagaagcagtcaaggattcgaagaatgacatggaattgcaatcatatgtgccatccaatggtaataatggtcgtgttattgcatgaagaagggacgcggcagagtgagattcctcgcaagatgctagtagctaaggattgagaaagtttcggttatttgtctttattctatttttgctccctaccagtaaatttgaattttgatatgtgtaatcttgtgtcacatttgaaagtggtccacaactctttgcagttgcattgaagacatgtattaatattattattattattatttatatattaataaac

SEQ ID NO: 3121 - DNA, 672 bp, Glycine max
agaatcccgtcttcagggtcgcatcctaagagtcgtaagtccattcattatcatcatctgcatttgctcactaatctttacacatcaatagaattatgttcttaacttggatttacaaaattgcaattatatatatttcttatattatgttttatgaatttttatatgtatctaaatatttatcttacacgtatggtttcttataacttgcaatttgtttttatgactttcaaaattacacgtatcttatctttgcttcatgggggaccaacaatggtggtttattctatttaaaatgtatgagtaacataacactagcatggtattatgattatgattatgaatcctaatatactactccattgtagattttgttctactgtagatcatcagagcgaccaaagcatcagtggcctgtgaaccagaagctcttcactttggatgttatgtaccttcatgataaacctggaccagataactgcccccaggaggtttacgatacactggtggaggcacttgaacatgttagtgaatatgagggttatatcttggagagtggacaggggttggcacgtgttctattccgtcatgtgctgatactattgtcacatcctcagcagcgttgcatccaagagtatgttgacataccaaagtcaatgcaaagaagcctcc

SEQ ID NO: 3122 - DNA, 428 bp, Glycine max
  misc_feature (391)..(391): n is a, c, g, or t
  misc_feature (393)..(394): n is a, c, g, or t
caaagaggggtttggagaaaattctcacaggttgtgctgctccttgccatccatagacctgctccaattattggtatggatgctaaaagtgtgaacaagttcaagaacccgattactgtgttgctgaacctatacatgtctctcactctcactctatctttagtttgttatctattgattgctcgtgtggtgtcttcagctttgtttccatttaaaaagggagagtggcattcatattttgctatgtttatgctgtgtttcaaactcagaaacttatgttggaggatgtgaaaactaacaaatgaaatgagattgtccttcttagttattaaggaagttattttttgtcttaaagtgacgagtttgcttttcttccctcctttcccgacgnanncgaatttgatccctgatggggcaacacatgtgac

SEQ ID NO: 3123 - DNA, 553 bp, Glycine max
acttcaagtatatatatatatactattacatccattaaaacttaccttatatttttagtttctgttaagttggtagttctttagaagacattggtccaagttgcattttgattaattcgtgccaattaagccttcacaatttttatttttattttcttgtgttatgtgttaattttcaggggaagattgcattagtcactgggggtgattctgggattggacgagcggtgtgtaacttgtttgccttagaaggtgctaccgtggccttcacgtatgtgaaggggcatgaggacaaggacgcgagggacacattggaaatgatcaagagagcaaagacttcggatgccaaggatccaatggcaataccatctgatttgggttacgatgagaactgcaagagggtggttgatgaggtcgtgagtgcttatggtcgtattgacattctggtcaacaatgcagctgagcagtacgagtgtggaaccgtggaggacatagacgagcctaggcttgagagggtctttcgtacaaatatcttctcctatttcttcatggc

SEQ ID NO: 3124 - DNA, 1382 bp, Glycine max
  misc_feature (48)..(52): n is a, c, g, or t
  misc_feature (356)..(371): n is a, c, g, or t
  misc_feature (377)..(397): n is a, c, g, or t
  misc_feature (400)..(407): n is a, c, g, or t
  misc_feature (409)..(431): n is a, c, g, or t
  misc_feature (437)..(444): n is a, c, g, or t
  misc_feature (454)..(463): n is a, c, g, or t
  misc_feature (466)..(466): n is a, c, g, or t
  misc_feature (475)..(487): n is a, c, g, or t
  misc_feature (491)..(493): n is a, c, g, or t
  misc_feature (495)..(499): n is a, c, g, or t
  misc_feature (504)..(505): n is a, c, g, or t
  misc_feature (507)..(515): n is a, c, g, or t
  misc_feature (526)..(526): n is a, c, g, or t
  misc_feature (528)..(528): n is a, c, g, or t
  misc_feature (531)..(536): n is a, c, g, or t
  misc_feature (538)..(538): n is a, c, g, or t
  misc_feature (541)..(542): n is a, c, g, or t
  misc_feature (544)..(556): n is a, c, g, or t
  misc_feature (578)..(582): n is a, c, g, or t
  misc_feature (586)..(590): n is a, c, g, or t
  misc_feature (592)..(594): n is a, c, g, or t
  misc_feature (603)..(603): n is a, c, g, or t
  misc_feature (605)..(605): n is a, c, g, or t
  misc_feature (607)..(610): n is a, c, g, or t
  misc_feature (612)..(619): n is a, c, g, or t
  misc_feature (621)..(642): n is a, c, g, or t
  misc_feature (644)..(649): n is a, c, g, or t
  misc_feature (658)..(658): n is a, c, g, or t
  misc_feature (666)..(670): n is a, c, g, or t
  misc_feature (672)..(673): n is a, c, g, or t
  misc_feature (675)..(678): n is a, c, g, or t
  misc_feature (688)..(694): n is a, c, g, or t
  misc_feature (696)..(703): n is a, c, g, or t
  misc_feature (705)..(707): n is a, c, g, or t
  misc_feature (711)..(713): n is a, c, g, or t
  misc_feature (718)..(720): n is a, c, g, or t
  misc_feature (732)..(732): n is a, c, g, or t
  misc_feature (734)..(735): n is a, c, g, or t
  misc_feature (737)..(741): n is a, c, g, or t
  misc_feature (743)..(745): n is a, c, g, or t
  misc_feature (750)..(761): n is a, c, g, or t
  misc_feature (767)..(773): n is a, c, g, or t
  misc_feature (779)..(787): n is a, c, g, or t
  misc_feature (792)..(807): n is a, c, g, or t
  misc_feature (811)..(811): n is a, c, g, or t
  misc_feature (817)..(818): n is a, c, g, or t
  misc_feature (820)..(821): n is a, c, g, or t
  misc_feature (831)..(841): n is a, c, g, or t
  misc_feature (846)..(851): n is a, c, g, or t
  misc_feature (863)..(875): n is a, c, g, or t
  misc_feature (877)..(886): n is a, c, g, or t
  misc_feature (888)..(888): n is a, c, g, or t
  misc_feature (894)..(896): n is a, c, g, or t
  misc_feature (902)..(904): n is a, c, g, or t
  misc_feature (906)..(908): n is a, c, g, or t
  misc_feature (912)..(916): n is a, c, g, or t
  misc_feature (929)..(931): n is a, c, g, or t
  misc_feature (933)..(945): n is a, c, g, or t
  misc_feature (948)..(949): n is a, c, g, or t
  misc_feature (951)..(955): n is a, c, g, or t
  misc_feature (958)..(960): n is a, c, g, or t
  misc_feature (963)..(967): n is a, c, g, or t
  misc_feature (971)..(975): n is a, c, g, or t
  misc_feature (977)..(977): n is a, c, g, or t
  misc_feature (983)..(985): n is a, c, g, or t
  misc_feature (987)..(987): n is a, c, g, or t
  misc_feature (992)..(997): n is a, c, g, or t
  misc_feature (1003)..(1003): n is a, c, g, or t
  misc_feature (1006)..(1010): n is a, c, g, or t
  misc_feature (1013)..(1022): n is a, c, g, or t
  misc_feature (1027)..(1035): n is a, c, g, or t
  misc_feature (1037)..(1037): n is a, c, g, or t
  misc_feature (1043)..(1060): n is a, c, g, or t
  misc_feature (1062)..(1062): n is a, c, g, or t
  misc_feature (1064)..(1067): n is a, c, g, or t
  misc_feature (1069)..(1076): n is a, c, g, or t
  misc_feature (1080)..(1081): n is a, c, g, or t
  misc_feature (1086)..(1093): n is a, c, g, or t
  misc_feature (1102)..(1114): n is a, c, g, or t
  misc_feature (1128)..(1128): n is a, c, g, or t
  misc_feature (1130)..(1132): n is a, c, g, or t
  misc_feature (1137)..(1144): n is a, c, g, or t
  misc_feature (1146)..(1146): n is a, c, g, or t
  misc_feature (1148)..(1151): n is a, c, g, or t
  misc_feature (1153)..(1171): n is a, c, g, or t
  misc_feature (1173)..(1179): n is a, c, g, or t
  misc_feature (1190)..(1195): n is a, c, g, or t
  misc_feature (1202)..(1204): n is a, c, g, or t
  misc_feature (1210)..(1220): n is a, c, g, or t
  misc_feature (1222)..(1232): n is a, c, g, or t
  misc_feature (1234)..(1245): n is a, c, g, or t
  misc_feature (1248)..(1258): n is a, c, g, or t
  misc_feature (1260)..(1263): n is a, c, g, or t
  misc_feature (1265)..(1267): n is a, c, g, or t
  misc_feature (1269)..(1274): n is a, c, g, or t
  misc_feature (1276)..(1276): n is a, c, g, or t
  misc_feature (1288)..(1302): n is a, c, g, or t
  misc_feature (1305)..(1307): n is a, c, g, or t
  misc_feature (1310)..(1311): n is a, c, g, or t
  misc_feature (1317)..(1324): n is a, c, g, or t
  misc_feature (1326)..(1327): n is a, c, g, or t
  misc_feature (1330)..(1350): n is a, c, g, or t
  misc_feature (1353)..(1361): n is a, c, g, or t
  misc_feature (1363)..(1377): n is a, c, g, or t
aagttagtgtaaacaatacaatgtttgttttttctttctcagattacnnnnnagttcgatgccaagaggggaaccttccaactattctgaggaaagaatactgagggcaaaagggggaggtatcaagataaaagttgaacatgtgattggagacatcagaagccaaagcatcagtgtaactaacaattcaatacatgcggttcctaatctaaatatcctaaacaaacgaaagttgattggtgacgataaatttcatgatctgcattttctctctgatacagctaaaagggcacatacaacatcaaattggctgttagatttgaatctcccagcagaagagaatgaacagaaaaaannnnnnnnnnnnnnnncccccnnnnnnnnnnnnnnnnnnnnnccnnnnnnnncnnnnnnnnnnnnnnnnnnnnnnnttgctnnnnnnnnttttttttcnnnnnnnnnncgntttttttcnnnnnnnnnnnnnttcnnncnnnnnttctnntnnnnnnnnntccttcctgcntnctnnnnnntnttnncnnnnnnnnnnnnnccggtttccctgtttccctccnnnnntttnnnnntnnnctccctttncncnnnntnnnnnnnntnnnnnnnnnnnnnnnnnnnnnntnnnnnncttttttcncttcttcnnnnntnncnnnnccttttttcnnnnnnntnnnnnnnntnnncttnnntttgnnnctccttgtctcntnntnnnnntnnntctcnnnnnnnnnnnngttccnnnnnnncttttnnnnnnnnntcttnnnnnnnnnnnnnnnnctcnctcttnntnnttttttcccnnnnnnnnnnntcttnnnnnnttcctcttcccnnnnnnnnnnnnntnnnnnnnnnntntttttnnntctttnnntnnncctnnnnnttttcttgtgtcnnncnnnnnnnnnnnnnttnntnnnnngtnnntcnnnnntttnnnnntntcctgnnngnttttnnnnnnttttgnttnnnnnctnnnnnnnnnnttttnnnnnnnnntntttttnnnnnnnnnnnnnnnnnntntnnnncnnnnnnnnctcnnccctnnnnnnnnccccccccnnnnnnnnnnnnnaaatttcccctttngnnncccgnnnnnnnntntnnnnannnnnnnnnnnnnnnnnnntnnnnnnnctttttttttnnnnnntttcttnnncttatnnnnnnnnnnnannnnnnnnnnntnnnnnnnnnnnnttnnnnnnnnnnncnnnncnnncnnnnnncntttatatactcnnnnnnnnnnnnnnntgnnnatnntctttnnnnnnnnanntcnnnnnnnnnnnnnnnnnnnnntannnnnnnnncnnnnnnnnnnnnnnnatgtt

SEQ ID NO: 3125 - DNA, 559 bp, Glycine max
agaccatataatttactttgtttttatgcatccttaattttatttttactttattaatatattcgctttaaggaaattaaatccagaatgtatagttgacttcttcaagtgtttaaatcgttttaatcgtgttactttatcatcacttcaggaaataatgggagtcttcaacaagaattgcatgatcacatacgccgcatacagaaacatattccccatttgggcgttgggagaataccaatcccaagtattgcaatctcgttaatcgagccttagttagggtgtcatcctaattatttcgacctgtggacagtaaaagaaataataataataacctatttttcttttatttccatggctctcttaaaatgtttgtgactaatgagtttagtagtcagctaaaaaaaaaagcaaacacgtggagaatgcctgtaagttttttctattactcatagacgcctctcttgctttccctgcagcggaggaattaaatatatacataaatagagatataaatgtttatgtcacttcttttgggacaaaaaacgcaattctttct

SEQ ID NO: 3126 - DNA, 703 bp, Glycine max
  misc_feature (689)..(690): n is a, c, g, or t
  misc_feature (694)..(699): n is a, c, g, or t
tcggcggtttctgacgtagctgcttatataaaagctgggttctatgaaattggtcagaatgaatctagactgtgtacttaaatgccatggccttgttatttctttggcctaatcttcctaatatttgatgcagggattggggctggattggagtctatgacagtagatcgtgtgaataggcttcgcaacattaacccaaaggtatggtgaaattgtatattattatgtccacattttccgttgaggtatattccgcttgacttctcattatattcacaggtagaaacctttgcagaagcccgggattgtcttcttccaatgggaattacttctgagaatgtagcgcagcgttatggtgtgacaaggctagagcaagatcaagctgctgtgagtatgacaaaagtatttagtgtgccaagtatatatgaaaaagattatcaggaagcatgaaatttttaatttgtataattaggttgagtctcatcagcgtgctgcagctgcaacagcagctggtaagttcaaagaagaaatcattccagtttctacaaaggtaggtaccaactaccaaaatgaattttcctatagtgttaataatgctattctactaatgatttgtttacaaagtttgtggaccctaaaactggagtggagaagaaaattgttgtttctgtcgatgatggtatcccaanncacnnnnnncttc

SEQ ID NO: 3127 - DNA, 379 bp, Glycine max
cttctgactccaccccttcatctatcagttttggtcgccgccacaaaggcttgtcatttgtccctcgagcggttcagcgtggaggtggatcaaactcaacagcatctgtgacaaagaaataagcttggactcaaacaaatctgcattcttaattgctgaataatcaacatgcagatgcagctccattataaaatccgtgtggacgtcttgcattctaagtttgaagaagccaattaagttgaagatggaaaattagaatcatgctggaggatgtaataacagcatttgtcattattatctttttttgctcccacttggggctgtaagtttgcccaacacaggcaatatgagcatgcgaatatgcctggcttgtataatg

SEQ ID NO: 3128 - DNA, 626 bp, Glycine max
  misc_feature (553)..(553): n is a, c, g, or t
  misc_feature (570)..(572): n is a, c, g, or t
  misc_feature (574)..(579): n is a, c, g, or t
  misc_feature (582)..(584): n is a, c, g, or t
  misc_feature (587)..(600): n is a, c, g, or t
  misc_feature (604)..(606): n is a, c, g, or t
  misc_feature (614)..(615): n is a, c, g, or t
cgtcgttttctcagccacttcattcccgaccaccaatacgacccgccgttctccccttccccaaaaccctactacaaatcaaagaagaaccacgcggagaagaagaaaaagaacaattccgaaaacggtgatccgaacaaaaacggagccccgaaacttcctttcaagtcgaaccttccgttcgacttcagatactcttattcggagtccgacccttccgttgggcccatcagcttccgcgaatcgcccaagttctccccctttgggccgggccggatcgaccggaaatggaccggtgtttccgctccggttcagggtgaaccggaccgggagagggtcgaggaggagcggaaccggattctcggagaaccgcttagtgaggtggagatacttgggcgattcgcggaagctgatgggcccaacggaagggtcggactccgaataagagtatctgaagtcgaacggaaggttcgacttgaaaggaagtttcggggctccgtttttgttcggatcaccgttttcggaattgttctttttcttcttctccgcgtgnttcttctttgatttgtnnntnnnnnnttnnnggnnnnnnnnnnnnnnggtnnnattggtgnncgggaatgaag

SEQ ID NO: 3129 - DNA, 412 bp, Glycine max
ccacctcctcattttgctcaacctggatatcccccaacaagtgcttcccttcagaaccccccacaagggcataacctcatggtccgaaatccgaaccagtcacaattcgtccgcaaccatccctacaatgagttgattgagaaactggtgagcatgggattcaggggtgaccatgttgcaagtgtgatccagaggatggaggagagtggacaggccgttgatttcaactcagtacttgacaggttgagctctgtgggtcctcagagaggaggatggtcagggtgatgaagaacttttctgaacagttactttgtctaccaaactaaatactctgttcaaaccctcaaaatcattgcgtgttttattatgcatggaataaaagtttttatgtaatgtgacggtttaccatcga

SEQ ID NO: 3130 - DNA, 324 bp, Glycine max
cgacgtcgtattggtgctacagttgcacgcgcttcgttcacatccacgagcagaacgacgtcgtgtgcccccgctgccatggcggcttcgtcgaaaaggtcaccgccgggcaatcggcaaggcaggggttccgccgccgccgccgcaacgccgggagccactcgccgttcaacccggtgatcgtgctccgtggaccgggggaggacgaggagagcagctttgagttatactacgacggattcgacggcgaggggctccgcccgctgccgtccaccatgtcggagtttctgctcggatcgggattcgaccggttgctggagcagg

SEQ ID NO: 3131 - DNA, 608 bp, Glycine max
atagtcattcaattttagtgtttgtgaacatctactcatcccttgttatttgcttttggcaacagtttggcaaagctattgtctgttctgatgctgcagcagaggctgcaagatatggttttactgctgtggacaggccagaaggattcttggttttggccattgcttctctaggaaatgagattaccgagttgaaaaccccacctgaggtatccaaaatgcacttacagtcaccttttcaactttcactcaactaatatatatttgttttcaaaatttttgacacaggatgcatcatctttggaggaaaagaaggttggagtgaagggaccggggaagaagaaaacagatgaatcggagcattttgtttggaaagatgatataaaagttccttgcggtaaactagttgcctcagaccatcaagatagccccctggaatacaacgagtatgctgtctacgataaaaagcgggtatgaccaaaaatctctcaagtatgattcatattatcaataaagaaggaaaaaagagaaaaacatatataattctgagatctgtgcactttttgctcacaggcacgcataagctacttggtgggagtgaagtatga

SEQ ID NO: 3132 - DNA, 350 bp, Glycine max
agggttcactgaaccggaccggtttgacccggaccggttctcggaggagagacaggaggaccaaatatttaagagaaactttctcgcgttcggggctgggccccaccagtgtgtaggtcaaaggtacgcgttgaatcatcttgttctcttcatcgccttgttcacaacgttgatcgatttcaagagggacatatccgacggctgtgatgagattgcgtacgtgcccaccatttgccccaaagacgactgcagggtatttctgtccaaacggtgcgcacggtatccttcttttccttcggtagaggacctcgtcaaatgaccatattgcccttctctcatgggtttattta

SEQ ID NO: 3133 - DNA, 347 bp, Glycine max
ttactcttttcttcaaagaaagccacatttttttttaattttaattttctgggtcagagagaaaatggctgattgggcaacggttttgatcggggtagttctgttcgtgctgctccaaccggggctgcttttctcctttcctgggaacgggaagcagcttgagttcggtagcatgaagaccaacggcaaagccattttcatccacacgctcatcttcttcgcgctctactccgtcctcatcctcgccgttaaaatccatatctacaccggctgatccggttcccgggatctgaggtatcatttcgttataggttactaagcaaagaaaaggaaaaacacaccacctt

SEQ ID NO: 3134 - DNA, 266 bp, Glycine max
ttggaattgacatcaattccattaggtctgtggcaactgcgccatggccacttgatattcaaccacaagggtcaataggaaaggcacgcataagctaccaatcttccaccaaaatattgagtgtctcggtggcttatccaaatagtcctgtgaaactgaatgccactgttttatcgtatcccgttaacttaggggctgttctgcccgaacgggtcctattcggtttcagtgctgccaccggtgacttggttgaaacacatgataaa

SEQ ID NO: 3135 - DNA, 745 bp, Glycine max
tggatgctggcactggtttcaccgcacaagtttatgaactgtctccccacttccttcacaaggtttgctagtttatgttttagtggtggcattatgcatgtggtgttggtgatatcatattatcatctttggaactattatcgttttatctgtactgtattttactaattttgtttttaacttaacgtaggctaacaaactcacgtttctgtttaataggaatggattatggaacagtgggagaagaattattacattagtgccatagctggggctaataatggatcctcattggttgtaatgtctaaaggttaatacccctgaagtttttattcttcatgtattgtatttggggtggcaataatatacgtattttgactggttatgtttaaattgtcttcttacttgtatttggattgatccttttaggtacccagtacttacagcaatcctataaagtcagtgattcgtttccatttaaatggatcaacaaaaagtggagagaaggattttatgtcactgctatggccactaccggctctagatgggcaattgttatgtcccgtggggctggtttttcagaccaggtcttgtatttcaaaaattaattgtgattaattatccttgtggcactgaaaaatccatctgatttatgtattctctccaaacttaatgccaggttgtggaacttgatttcttgtatcccagtgaaggcattcatcgaaggtgggatagtggttatcgc

SEQ ID NO: 3136 - DNA, 572 bp, Glycine max
  misc_feature (408)..(409): n is a, c, g, or t
  misc_feature (418)..(418): n is a, c, g, or t
  misc_feature (473)..(474): n is a, c, g, or t
  misc_feature (484)..(486): n is a, c, g, or t
ttctcactataaacacaaaacccttcccatcctaattaaggtgaaaatgaaggcatcacccattgcttggttcactttggtggttgtgtttcttgtggctgaagttcaagtttcaatggcagtgacatgcagcccagtgcagctgagtgcatgtgtaagtgcaataacctcttcaacccctccatcaaacctatgctgctccaagatcaaagaacagaaaccatgcctctgccaatacctcaagaaccccaatctcaagaagtttgttgactctcctaatgcaaggagagttgctagcacttgtggaactcccttcccaaggtgctaagtgttaataaattggaagaggttttaatttctctgcctgattatgcatcttgatatctatccaagtgtttggccagaaanncttgatgtnaacttttagtcccaagaaaaacagtggtctactttaggtccttcatttatggaanngtgtatactnnncaaaaagtcatatttgtgagaattatttaattcatgatattatgatttttaaaaaaaaatctcatgacagggaaaactgtattaat

SEQ ID NO: 3137 - DNA, 778 bp, Glycine max
gatgtgatattggcgacttggcagacccaattgatggaggtccttgctataaactttacaccaagtccttctatgagttgattgtcaagcctagactgaagcaaggtggcatatttgtaacacaggtatatatgagtcagtaatactatgtatcaatactcataaaaaatgaaacaattaagtaacgtgtatgttagttaaattcttatgctttttcaggcaggaccagctggaatatttagtcacacagaagtcttctcatgtatctacaacaccttaagacaagttttcaagtgtaagtgtcttccgagggaaaagaaaagattattttttcctattaagtttttcctggttcaatataaagttcttttgacatcaattgcatcaaattccccttcttttcttttgtttgcagatgttgtgccttattcagctcacatcccatcctatgctgatatttggggatgggttatggtaaatattactgataattaatttcaagttcttgtttagtattatgtgttatgtatgttaagatatatgtgataagaaaagggggcacaaaaaaaagttgttcgaccactgaaaatatctttataagaaatgtaccttgagacaaatttagcatacaaaaccatagaaaattaaggtgtcatgcatggacattattgctaagactttttttggtctttggaatgtaacaggcttcagattctccattagacctgagtgcagaagagctagacctcagaatgagacataggataaggggagaatg

SEQ ID NO: 3138 - DNA, 334 bp, Glycine max
gaacagcatgagcagaagccaagaaaacagagacatgaggttataacaagtgtgataccagctgcagttgttccaatctctacccttgatccagtgccaattctatcagcagcgtcttccatccgaaacgataattggtctgctatgccagcagaggccaagaataagccagctgacattaacgtgtcgcttcctgcagggtaattaacttatagatcttcattccatctgaatttacatttgctgctgacaacattgtaatgtgatggattcctagttgttggctttgctttccgttgtttgttgtgtctgtaattgttgactttctaccggg

SEQ ID NO: 3139 - DNA, 530 bp, Glycine max
tgtcaaagaagccatcaatatctttagtgcctgaccaaaatagacataatgaacgtcacctctaaattgacaaaattaagacaaatattgttaaataaaaccattgatatgaatcaaaatttcttaatccaatattgtggcagtgcaaaagaacaagtcgtcgggagtactgaattgtgaatattacctgtgacttcctgattttcaccaaatgttcctccaaatcatccaacaaccggtcattctccataaatggacatggaatgcttgaagaagtcgtcattgctttcacttccagattatcgctaacaacaaaaagacatggcctcttcataaatcccacatcagattttcttgctctagaggatcttgggtccaaaagtttgatatcttttggatcttttagcatatctttgttctttgaaatcatattcttttcatagatgatacgtcccctattatccttcactatgccagttccataccaatacttggcagtgtcttcttctgaagcatttagtggattgctc

SEQ ID NO: 3140 - DNA, 472 bp, Glycine max
tttgattccagtcttccagaattgattttgagttcaagtaacttcattgcttttcgcattggatttctatattgagctttactggtaagtagcttttagaataaaaacattcaagcataaatcactcacttaaaaaaaaaaaaaattgtaagcttcaaaaccatttagttcaaaattaatttagcaaacactcacccgatcacacgcaatcaatattgcaggtattaaacaccgaagaaaaaacaatacctgctaattctcttcaagtgcatgaagttgcaataaccaccacggttgcaagtattctcctcatactgcctgcaagtagcttctcggaaatccgtcaccggcgagaaatcaacaataattggccgacctgcaaccataaaaaccaacatttcgcatccaatcttcaaaaagaattacaattacatctcagtatataaattaagcacacggaatcatgtgcatt

SEQ ID NO: 3141 - DNA, 508 bp, Glycine max
  misc_feature (485)..(485): n is a, c, g, or t
atcgggttggattcggaagggatgatggcggtgagttcagcctgcaaagatgggagcaaggtggcactggacaacggcaagtacgttaggtacacacctgaacaggtggaagcactggagaggctctaccatgaatgtccaaaaccaagttctcttcgccgtcaacaactcatcagagagtgtcccattctctccaacatcgaacccaaacagatcaaggtttggttccaaaaccgaaggtaatcaattaactacttctcctaccctcttctccgttcttctattctttcccttcctctaaccaccttcactttacttaactttcaactttcatttgtatacaaccatacatatatgtcatgttgaaacttgaaagtaattgaatttgattcatttgatcaaaagggttgcttgattggtgtaaatctggcttcttttttttttttaaaaccccccctttaggtttcttttcccctttcccttanaccaaggtttttttttttttttt

SEQ ID NO: 3142 - DNA, 1051 bp, Glycine max
  misc_feature (59)..(61): n is a, c, g, or t
  misc_feature (988)..(992): n is a, c, g, or t
  misc_feature (1041)..(1043): n is a, c, g, or t
acctgccgccgccgttaacaataacaccaccgccaccgccaccgctaaagcaggttctnnnaggagtgaaatcgaacaaccataacctagaagaggagcattccaatttgaatggcgaggagcacatggcagaacaagtggaggcagaagaagaggaagatcgagaagccgatgatggtgaaggagaacaaactggatctcgtcaaccttccagaacccctttcactaatctcagccaggtcgatgctgacctcgctctcgctcgaacccttcaggaacaggttccgtctcctcttctcattccttttttttttctttcaaaaaaaaataatttttttgcccgttttcccgtagggaacccaaatttaatggaactagtataaggtttcccatcccaatttggacagtgatttgatttgtgaatttcgagtaatagaaattgttttctgtaatgatagctgcccaatttggacagtgatttcaaactgcttaaaccctatattttgcatgtaatgatagctgcccaaggacatgcagataccaggcgttgatatccctgacccacgttgttggcctttcacaaacagctgtgtgtgcatgccatgaagctgtgtagtgtaaaacttatgattctctcccaaactgtttcctcttgaaacaaagccgaacttcacaccaggaaccaattttccggttgattttatacatcagtgccatcatgtattggatcagttttgctgctgaccaagattttatacccttggccttgatgttgataacacctagatatctatggacgagagagagagagagagcattgaatgcaacgaatgaatgttgttgtataatgagatttactattttgttttcattgagctccttgcctccccatgtttgtatttacaattatatacttatactaagtataaatacatatgttgatttttgttttttattttcatattcctcttatttatattgtgtcaannnnnaatgaacaggaaagggcatatatgatgctgagaatgaataatgaaggannntgattatg

SEQ ID NO: 3143 - DNA, 407 bp, Glycine max
aagcatgtggaaagggcctcttatgattcaaaaactgtaataactacctatgagggacagcatgatcatgaaattccccctggaaggactgtcactcagaatgcagctacaaatactcgcacaacggccactaatggcaaggcaggaaccaaatctgagggtaatactgatgatacaggggagcgaagcggcttgggcttaacaagtagattaacagagcaacaaactggcaagtcgactactaagtcaaaggctggtgatatggttgagtttcgtgtgatcaggctttctaatgagggtcctgaaattaaattaagtgagcaacaacaacaaaaggataactcagctactaaagatgattctgtcagcaatgacgttatatgccattcaagttctggagttctgtg

SEQ ID NO: 3144 - DNA, 392 bp, Glycine max
  misc_feature (361)..(363): n is a, c, g, or t
  misc_feature (367)..(372): n is a, c, g, or t
  misc_feature (381)..(383): n is a, c, g, or t
atgtggtgttgagtgctacgttggttgcggcggtgaccctaaaggaaagaagaaccgcatccgcagtcgccgcactccctcagcggatgacagttccagtcttctctaactacccacaacaatatgcattgtggagccaacatgggaatatttgtggcaatggactatgctgtaataattttattcattctttgttattccatcatctgtttttgctactccatcttttgtcaattgtaagacatgtcagtttaattcgttgggactccacaatacaacataaggctatacacatatttccttacttatatctctctgttttccttagttgccgatcatatgaatcaaaaccttgcaaaannngtgnnnnnnggatgcccnnnaaacacaga

SEQ ID NO: 3145 - DNA, 401 bp, Glycine max
gcaatatgtttttgggttgtcataacaattttagagctaaggtctaggctcaagaaagtaaccaacgggataattatggtacatgtcctacttctacatcgaaatacataaataatcaatcatcattttcaagccaataatctaaacaacaaaactgaaaaagaaaaagagaaaaaaaaaaaacccaaaagggacccctggtttttcaacaactttttttggcaaaatggttcctcaaaaaaaaacttccttttttccccaaaaatttccgcccctgggtttttggtttcccaatcttggactaagggaccccccttaaaagaaaaacttttggaaaccccccccccttttgaaccccggaaaaaattaaaaaaggggtgggaaaaaaagaattgaaacca

SEQ ID NO: 3146 - DNA, 400 bp, Glycine max
  misc_feature (63)..(63): n is a, c, g, or t
gccgaggagctcggcttgctcagcttgctcgaccgagccgccagcttctccccctccctcctngcctccgccgccctccccgccttcgtcgctgccattgccgccattgtgctcattcccgacgactctgccaccctcgtcgccgtccaggctgttgttgctgccgcgctcggcgtcggagccgtcgggcttttcgttggctccgtcgtgctcggcggcttgcaagaggctgattgattgaatggtgtgggaatggtatgtggatgaattcatcttagatttttttttttggtttttgtattggaaaattgggggagaaaaattttgggcgttttttttgggggaaaaaaattggtataaaaaaaatggaatggacataattggctgggaaggggtggct

SEQ ID NO: 3147 - DNA, 1012 bp, Glycine max
  misc_feature (60)..(62): n is a, c, g, or t
ctacttgtaaaatagatcctcagcagctggtaagtgacatttcactgtcacagaatgaannnaatcttcagactgatgtgccagaatctgatgctccaacaggctctgttgctcaagatgacaagtatactaagagaaacataatactgcctggaagagatatcgtgtgtgcttttaactacagctgctgttgtctacataaacgagcagaactggttctgtatttcaagcatgctcgtgaggccttgtcaactaaaggtggaatttttgtgatggatttatatgggggtacgtcatcagagcacaagttgaggcttcagagaagatttcccaattttacggtataatattcttgatgttaatttgtaacaattattagactaacatgaagatgttgccttgccacaatctatgtggaatttcctttctaggataatgtggatttgatccacttggacacactttaaagaaattttgacacacctgcacggggaacactggacagataaatagtcgatacgtagagtagtataaacactctaacattctttactaaaattgttccacttgtattcaattttgttgccacatgatcctgaattttcccatatcttacccttgatattattttcactcgttacaagtcttttatgattgacctattgaatttgcaggtatgtcagagcttcacggttaactttcttattccagttctcttttagctttttcttctcttttgccattgttgtagctttttccctgacctttgtagttatttatttttacatgcttatgatatataacttacatgacaccagatttgaggagctagaaccttttacttgtgggacaaggatgttatgtttttccaagttccaacacaatggcatcatatatattattagtacatgaaaataagtatattcttactgaatttctttgattgtcaatattgaagttgtgaatattatcctgtatatattttatgatgtgaacgttgtaatcaaatctg

SEQ ID NO: 3148 - DNA, 489 bp, Glycine max
acgccaactccatcagcagcaaaggcccgcctgcaagtgagtccaatccatattactttctcatcaaacggaattttttttaaaaataaaaaataaaaaacgaaaatcgatatgggtatgtaataaagcacctgaaagagaaagctcgtgcgaaaccatgagaactagcttggacttcatgaaaattaggggactggaagccgcatttgtgagttggacaggggaacgaatctgattatcttgtgcaacagtaaaatggttggtgttgcaggaatcggagttgttggatctcattaagagcaccgtcactgttgagacggacaagaatgccgccaacattatcggccaccgcttcttcgccattgccaccgaatgcttcgccatttgcaaaatctctaaattcgcattctattatttttattattattattattattatttcagtttctactttctagggtttccgctgagtgtcgattgattcgaggt

SEQ ID NO: 3149 - DNA, 407 bp, Glycine max
attgagcagtataaaattattagggtaaccaaacccggcaccagcaccggcaccaggtccaggtaggtagccatgagtattggttagtgatgggggcacaaattcctcagccatgggattcaactttgacaaaagctcttccaaatccctcatatcacgcttgaaactctcacccccattctccccacaaatgaccccattcattccatacccatcattgttcaccccatttgtgtgcatctgacccatttgggcctcgtagttataattgctattgggcactggcatagtgccaggaactctatcttggtggttgaagacaccgttgttcagcttctgatcgtcgttgatggacccacttctgggttttgattgctcaacctcgcctgagttcgatgacactaaat

SEQ ID NO: 3150 - DNA, 324 bp, Glycine max
  misc_feature (60)..(60): n is a, c, g, or t
  misc_feature (64)..(64): n is a, c, g, or t
gttttgcacctcagacatcaatcaagacaaagcagaatgtacggataaacttcttggtcnattnggttgtctttcctatgttggtggcgaagccaaagtccccaccatggattgttgctctggtatcaaagaggttattaacaagagcaagaggtgcctctgcatcctcatcaaggatcgtgatgatcctagtcttggcctcaagatcaacgtcacccttgctttaaacttaccagatgtttgtgaaacacccactaatataactcagtgtgttggtaagtagtctataactatatgcctatctcttcatgatctttttttttt

SEQ ID NO: 3151 - DNA, 658 bp, Glycine max
agttcttggctcttgcccagcaattcccgattctgcaagagattcttatgatgagctctaccatgcaatggacatgtatcttgaggtataataatttctttccaatttaaattttaatattggaagtctgtaacttcagtcttatggttactgcctgataaagataaagtttaatttctatgtcctgtttacattgtcaactactgataaagtaattattgtaaaaatcaacaaatttattatacatagcagtttgtgattaaatgacattgtaaaaagcatttacaatgtcagtgcatacactatttagtctaataattatttccaatttaatttttaaatttggaaatctataacttcagtcacatggttaactacttgattaagatatgttctattcattggaaatgctattatataatatcatgtgtaacacagtgtaaaaattgaatctgcctttaaattcatggcctatgcaaacatagtgtggttgaagtgttgagctgactagtattgttataggtgcatactcaattgtcccaggaagaaagattgaagatatgctgtggtttaaattttgagaagctttcacctcaagcttgcctacacctttctcagaacaaaaaatttccttcaaaatcgactgttcaagctctta

SEQ ID NO: 3152 - DNA, 669 bp, Glycine max
  misc_feature (369)..(392): n is a, c, g, or t
  misc_feature (394)..(397): n is a, c, g, or t
  misc_feature (406)..(407): n is a, c, g, or t
tctaccccttcacagccctagaccttcacttcttttaatcttgaacagaattccatggaaggcaaatcaattatccaaatatccagcatgtatcaagaggtgtacaactctacaatctataatcctatcagaaatagtcatgcatcttaatttgcagataagatccgtgacataagttgtataattttgaagttgttatgattatccttccactttgtgctactcggtacactttttgtaattgatggatgtgttgtagaggtaggtgtcaagttaacattgtagttattttgagatttagtataacatttaatctttcagttttggagcaagcaaataaggtttatgtatgaaattctgctttgtacnnnnnnnnnnnnnnnnnnnnnnnnannnngcatttctnntcggattagaaaaaacaacactaaaaacacaaggaattatatctaagttttgccataaatacaattctatccattttacattaaatggtaataactttggtgtctactttcaacagctgcagaagctgaatcatctaatgcagaagccaatggagccaggtcagagatgcacacaagttgaagcagcaaacagcatggacagtgaatcagaaaatggaggcaccatgaaatgtgaagctgagggaaagccaagcccatcatg

SEQ ID NO: 3153 - DNA, 1271 bp, Glycine max
  misc_feature (358)..(360): n is a, c, g, or t
  misc_feature (363)..(368): n is a, c, g, or t
  misc_feature (371)..(373): n is a, c, g, or t
  misc_feature (375)..(379): n is a, c, g, or t
  misc_feature (381)..(381): n is a, c, g, or t
  misc_feature (525)..(533): n is a, c, g, or t
  misc_feature (535)..(545): n is a, c, g, or t
  misc_feature (547)..(552): n is a, c, g, or t
  misc_feature (557)..(558): n is a, c, g, or t
  misc_feature (560)..(560): n is a, c, g, or t
  misc_feature (564)..(565): n is a, c, g, or t
  misc_feature (567)..(567): n is a, c, g, or t
  misc_feature (573)..(583): n is a, c, g, or t
  misc_feature (585)..(586): n is a, c, g, or t
  misc_feature (591)..(591): n is a, c, g, or t
  misc_feature (593)..(600): n is a, c, g, or t
  misc_feature (602)..(603): n is a, c, g, or t
  misc_feature (607)..(613): n is a, c, g, or t
  misc_feature (617)..(621): n is a, c, g, or t
  misc_feature (623)..(647): n is a, c, g, or t
  misc_feature (652)..(654): n is a, c, g, or t
  misc_feature (656)..(658): n is a, c, g, or t
  misc_feature (663)..(673): n is a, c, g, or t
  misc_feature (675)..(682): n is a, c, g, or t
  misc_feature (688)..(692): n is a, c, g, or t
  misc_feature (696)..(702): n is a, c, g, or t
  misc_feature (704)..(706): n is a, c, g, or t
  misc_feature (714)..(727): n is a, c, g, or t
  misc_feature (731)..(739): n is a, c, g, or t
  misc_feature (742)..(744): n is a, c, g, or t
  misc_feature (746)..(753): n is a, c, g, or t
  misc_feature (756)..(756): n is a, c, g, or t
  misc_feature (758)..(761): n is a, c, g, or t
  misc_feature (763)..(767): n is a, c, g, or t
  misc_feature (770)..(781): n is a, c, g, or t
  misc_feature (783)..(790): n is a, c, g, or t
  misc_feature (799)..(808): n is a, c, g, or t
  misc_feature (816)..(817): n is a, c, g, or t
  misc_feature (819)..(837): n is a, c, g, or t
  misc_feature (839)..(850): n is a, c, g, or t
  misc_feature (860)..(866): n is a, c, g, or t
  misc_feature (868)..(892): n is a, c, g, or t
  misc_feature (894)..(895): n is a, c, g, or t
  misc_feature (897)..(897): n is a, c, g, or t
  misc_feature (901)..(913): n is a, c, g, or t
  misc_feature (919)..(919): n is a, c, g, or t
  misc_feature (922)..(924): n is a, c, g, or t
  misc_feature (927)..(931): n is a, c, g, or t
  misc_feature (934)..(939): n is a, c, g, or t
  misc_feature (942)..(943): n is a, c, g, or t
  misc_feature (950)..(950): n is a, c, g, or t
  misc_feature (952)..(957): n is a, c, g, or t
  misc_feature (961)..(962): n is a, c, g, or t
  misc_feature (964)..(973): n is a, c, g, or t
  misc_feature (980)..(986): n is a, c, g, or t
  misc_feature (995)..(998): n is a, c, g, or t
  misc_feature (1002)..(1002): n is a, c, g, or t
  misc_feature (1004)..(1021): n is a, c, g, or t
  misc_feature (1027)..(1034): n is a, c, g, or t
  misc_feature (1036)..(1040): n is a, c, g, or t
  misc_feature (1043)..(1067): n is a, c, g, or t
  misc_feature (1071)..(1075): n is a, c, g, or t
  misc_feature (1080)..(1105): n is a, c, g, or t
  misc_feature (1108)..(1108): n is a, c, g, or t
  misc_feature (1111)..(1111): n is a, c, g, or t
  misc_feature (1113)..(1119): n is a, c, g, or t
  misc_feature (1123)..(1123): n is a, c, g, or t
  misc_feature (1125)..(1140): n is a, c, g, or t
  misc_feature (1142)..(1147): n is a, c, g, or t
  misc_feature (1149)..(1149): n is a, c, g, or t
  misc_feature (1157)..(1162): n is a, c, g, or t
  misc_feature (1165)..(1166): n is a, c, g, or t
  misc_feature (1169)..(1174): n is a, c, g, or t
  misc_feature (1180)..(1182): n is a, c, g, or t
  misc_feature (1187)..(1189): n is a, c, g, or t
  misc_feature (1195)..(1196): n is a, c, g, or t
  misc_feature (1198)..(1199): n is a, c, g, or t
  misc_feature (1207)..(1213): n is a, c, g, or t
  misc_feature (1215)..(1222): n is a, c, g, or t
  misc_feature (1230)..(1239): n is a, c, g, or t
  misc_feature (1244)..(1249): n is a, c, g, or t
  misc_feature (1257)..(1257): n is a, c, g, or t
  misc_feature (1260)..(1261): n is a, c, g, or t
  misc_feature (1263)..(1266): n is a, c, g, or t
gatgcttgcatgggatttcaatcatgcacaaacttaagaagggtgacatgaatctgagcaaggatgtaaaatcagaagaaggtgagagactgtgtcccatacctgatggattgccaaaatctgctgatgaactgagggaagaggagcaagcaagaatgcctgattcaccatacactaagcttcttagaaccatgggcaggcaccctgcatggtattctcctgcccctgaccatgaaacagattgatgaatgatgatcaccatacatactaagctcaaagggaatattccctttgagggcacaagtaataacatagtggagtagctataatacccccatgtgaatggaatgggtgtaannnttnnnnnnttnnngnnnnnanccgcggatgcagaggcactgctggatctcacacgcactctagtgggatctgttaagtcgttggcgaacgagggtgtgaccccttctcaatttgtttcatctttgctcatacgctacgcccatacccaacactctattgattggnnnnnnnnntnnnnnnnnnnnannnnnntaaanntntcannanaattannnnnnnnnnncnnagaanannnnnnnntnngttnnnnnnnggtnnnnntnnnnnnnnnnnnnnnnnnnnnnnnnatacnnncnnnaaggnnnnnnnnnnncnnnnnnnntttgannnnnattnnnnnnncnnntcgttctnnnnnnnnnnnnnnttgnnnnnnnnnttnnntnnnnnnnnctntnnnntnnnnngtnnnnnnnnnnnngnnnnnnnnataagtggnnnnnnnnnntccgtttnnannnnnnnnnnnnnnnnnnncnnnnnnnnnnnncctctacttnnnnnnntnnnnnnnnnnnnnnnnnnnnnnnnncnncnaatnnnnnnnnnnnnnttttanctnnntcnnnnnctnnnnnnccnngtcttcntnnnnnntttnnannnnnnnnnnatccctnnnnnnncaatctcannnncctntnnnnnnnnnnnnnnnnnnttcatnnnnnnnnannnnnacnnnnnnnnnnnnnnnnnnnnnnnnntccnnnnntaatnnnnnnnnnnnnnnnnnnnnnnnnnnttnacnannnnnnncagncnnnnnnnnnnnnnnnncnnnnnncnaacgtttnnnnnntanntannnnnncatacnnnctttnnnttttgnncnntttttccnnnnnnnannnnnnnntttttttnnnnnnnnnngttgnnnnnntttatctncgnntnnnncaagc

SEQ ID NO: 3154 - DNA, 385 bp, Glycine max
tttctgtggtgataatcagcaacactcaattaaagataatttaaccatgggaagccaagtaagccatggaaaccttcggagggggctagttcgccatccagagacatcgagttccaaccaatatcatggtaatactggtaatcacctcaatacagaaagatttcatgtttatcttcggaagtcactgatcttctttgtccagttgacggctaagttcccattggtcattatattccttttaattgtcttatatgcaataccagcaagtgcagccattttggccctgtatgtacttgttacaattctgtttgccctcccatcatttctcattttgtacttctcatatcctagtttggattggcttgtgagggaaattatcatcatc

SEQ ID NO: 3155 - DNA, 368 bp, Glycine max
tctagaaattgaactagaggctgctatatctgaaaagaatgaagccttggctgctcgagatgcagccattcggcagagggatgaagcacttgctcagagggataatgcccttttggaacgagataatgccctcgctgcccttcagagtcggaataattctgtcaacttcccatttggcggtggaattcaatgtggatcgaaacggatgcaccattcttctaaccatctatctaacatgactgaagctgcatacaacacaaaggatatgataataagagatgcctccccagtgactgttataccttctgaagctgtcaattctcatcaatcaaagagatcaaaggagaacaaggtaattaattctaagg

SEQ ID NO: 3156 - DNA, 377 bp, Glycine max
cttcttggagggttctaccttggtgaagtggtggaaagcacttcctcaacaacacaagcaacattcatgcattaaaactcttattagagagtgacacgagacaaacatgcattgtaataagtccattcagcgagtgttaattggctgagtgagcttttttttgtttctcttgtttactttgtttcttatgtagtttttcttggttccttctcgtgtgcggtttgtgattctatatatcgttttcctttaataaatgccacaaccaaggttgcggctatgtacaactagacgatttttttattttttttttcattttcaatacatagttttaccatgaaaaacatatataatactcccttggttccattacaagtgta

SEQ ID NO: 3157 - DNA, 981 bp, Glycine max
  misc_feature (937)..(939): n is a, c, g, or t
tcaatgtgtttaaatatgattttttcatcaactgtgtatattaaatttgagtcatcactctctttagagtgtggacttctctcattatactatcccttttaacatgctacatgacttctcctacatcaatcatctcatttttacccactccaatactgttgtttaaatttagtcaatatcaaattttcttgctgttaatttcaaaactttccatatttgtagatttaaaatttggcacatcatatcaaattaataattgattcacacaatttactcttcaatcctgtatgtctagcctcttcaaaactattcttatataacaataacaattccaaaaatggtatattttaatttaatcctatatgttgagatttttcatgatttatatggatattatttgtgatttgggttttaacaacttagaataagggatgggattctccttgtacagatttcttctataaatcagagttgaaaggatcaaacaaaagcaatattcatacaattctgagtttcaattctatataacaaaatatctcatcttaacaatgagggcatttcctattatattttattccttcttaaggcatgtagttttatcattatttagtaacagtgatattattctataatttttacctaaatttgaaaatatctgtgcaatgccccagaaacattttagtttaaataaaaatatgttgcatatagattgttcatattgtccaattttcaggttgtacaatcaagtgtgctgcctgctatgtttagggacacatataatgcgatcacccaagggaatcccatgtggaataatttatctgttccaactggcactctttatgcttgggaccctacatcaacttatattcatgagccaccttattttagagatatgagcatgtctcccccaggctctcatggagtgaaagatgcttannntttgctcaacttggagacagtatcacaactgaccacatctct

SEQ ID NO: 3158 - DNA, 1068 bp, Glycine max
  misc_feature (59)..(63): n is a, c, g, or t
  misc_feature (1061)..(1063): n is a, c, g, or t
catttcttctcgcttcttgctgcttccgcgtatgatctaattctcttcttctcgatctnnnnncctaacataagccgatccgcatcgaaattgtaaatgcgattcgctttgttgttgaaattcttccattgatcggtgcaggaatggcccgaaacctaggaggattactggcgctacttttcgctgtttcgatctgcggagccgtcacgattcccggccccgtctccgatgctcaccgttccgccgcgttagagctcttcgatggatcgttttcaaggtcaattgaaccctctctagctctgttttttcttgtatagtttaatttgatgcatgtttagcttatttctgatatgcatatgcatggatccttgtgttataagcctcgtaaatgtaactgtagtttcgttttcgtcgtgatttaatttcgtgaatcagtttaactagtgaagagtttgtctaagtagagctccgtgaatagaaattatgatgattgtggcattctgactctctgctgctatttaattatcgttttgttggctattttaacgttatttttgttgtcctttcaaatgcaacattgagatctaaccacatcctaagacattgaaagattgttatagctctggtataaatttcctattttatgtcatggattgatttgttaggtttgtatcactttgttgaaattttagacgactctatataagaagataactcatttttatcatcttatttgttatcagtttagaagaggcctatgaggcactaagagtttttgagattcttacgattgggaataagcctgatgtgagcacaacgacttgcaagaaagtagtggaaaaccttgggtcgtcatcgcctgtgaaggatttgttctatgcgttaaaggttaatgacatattaaaatgcaaggttaatggggatgttttcaaggtaattttgtgctatggttattacttttatgatttggttgcagcttgaatgtcatggcttatgaaatttatgttgggctgttaaatggcaagcctggaaactgatgctataatttgtttatcttgaannnggata

SEQ ID NO: 3159 - DNA, 635 bp, Glycine max
  misc_feature (603)..(604): n is a, c, g, or t
gagcaggcgatgagagacgcaattgaaggaatgaacggccagaacctcgacggtcgtaatataaccgtgaacgaggctcaatcccgtggaaaaggtggcggcggcggtggcggcggcggttacggaggaggtggtggtggttacggtggcggcggaggttacagccgcggtggaggaggatatggtggcggaggaggccgccgtgaaggtggttataaccgcaacggtggtggaggaggatatggtggcggtggcggcggatatggaggtggtggaggttatggtggcggtgggagagaccgtggatatggtggtgatggtgggtcccgctactcgagaggaggcggtggttcggatggaggaagctggaggaattaagatactttttgtctttattactcttccatagttcttgctcttacttttctactctgtcgtttctattttgttttaatagctcaaattccacggtttcggtgtttgttttctctgtagctttccgttttttatagacgttttttccacttttttatatgtttagtgtgtcgttttgttttgtatgtcagagcgaaaacggggggaaacggtgtcgttttgtgcttnnagacggaggacgtggattggggcagtagcta

SEQ ID NO: 3160 - DNA, 957 bp, Glycine max
cttcccattatttgattcatgcagagaagctttcaaaggccctgggactgttccttcaccacaagatgttaagagattgactcacatacttggtatgatgatgatattactggtactttttttattattattcttatcggcaatattactgatactaatatttgatggggctggataagaaaatttgtagcatcttttgatcctaattaaaaatttgtagtcacatgttggcaagtttaggaaacagaactttgcatttgtttggatatttaggttattagtaagaaaatttatattttttaacatccactttcccgaattacataaaattacaaacaagaatgctcccctcgatcaaattgtctttgggacatgacgtcttagttttataccccactaacggatcaattcattttcttttggccgcagtttattctagtgacgtattgtgcatttgcaatttattttctctaagaatttaggcatttattattattaattcatggttgtattattgtatatttatatcaacgtattctagcttagttgggtgaggagtgtgcttgaattgtggtaaattctctactggtgctgattcttaatgtcttcagataacatgaagccagaagatgtggggctaagtagagatctgcagttcttcaagcctggaaatattgtcaaagagaaccaaagggtcacttatacaaccgtgtacaagtgtgacaatttctcagtaagtgtttcattctcattactccctaatcaccaacactcaccactgtaattgctacttgctgctttgtgtgcttaattcatttatggggacattttctctatgtgcagctctgcatctttttcatacctgaaggaggagtcattcctctccacaaccacccggacatgactgttttcagcaagcttttattaggactaatgcacattaagtcctatgattgg

SEQ ID NO: 3161 - DNA, 384 bp, Glycine max
tgttgcaggccttgctctgatatcgattgcagcagcatcgtcgatactgctacaagttggtaagaatgctcctcctcagatccagacggctcaatactctggaccatcacttagttactacatcaacaaattcacgccgccggaaattactcaagtgtctgtgccaagtgaggcagaactatcctcatctgttcaacctgaaagcccacctccggaagtttcccaggttcaggttgaagctcaagcttctgagacctctagtgtgaacattgaatcgtaggtgtatcaagtggttaccacttttgctaccaaaacataccaaagaagtttattttgtgtatacacaactaaaggttaatggatgcaaatgttgaacatcattct

SEQ ID NO: 3162 - DNA, 1124 bp, Glycine max
  misc_feature (21)..(21): n is a, c, g, or t
  misc_feature (55)..(56): n is a, c, g, or t
  misc_feature (1060)..(1069): n is a, c, g, or t
  misc_feature (1118)..(1119): n is a, c, g, or t
ctgccttggatgcagctacangctttaggatttgttgaaaccccgtatattgatnnttgataaccctttggccaaggaattaatggaaatctatgagtccatgggcgacacattagcctttcaatatgggggttctgcagcacacaataaggtaatctctctaccttctggagtttggactttatggattttgaaatgtaatttgggatcagaatttctgcacataattattttatttaggatctgcatgagtttatcttaagcttaacattgaatacagaatgacataagttaatctaattctgaaagcttattgcttttattaggatgtctcaaaatccaataaaaatatgtctttttatttgattcgcaatcttctgcggtaggtagggtttaatttgttgtaggtttggttaattatatggatgcagttattacatcacatgattcttgtttaactaggtccctatacttttaaaattcataacagagatcaggaatattttctatatattgacggaactctattctagatactgaattacaaaggatttatttgttaaggacctaattataaatttttatagtatagggatgcatttaaaaataccgaaataggtcaagcatctatggattaatttattataaacagaccatcagaattttcccaaagctttaaaggaaatctaaatttgtctcttgtcctattttccttgcaatggaattttgtcggattgctgctcactcctttgagtattttgcaattggtatctctatttagatattttctgagagaagaggtcaatggaaggcagcagctcaatcccaggaatttattcgaacactacagcgttattataacaacacatatttagatggtgataagcaaaaagcaattaacttgtaagtcaaataagccaattttttagttgtatttacaactgttttcatatgtaatatggtttacagcaaacacaagttatgtatatatgtgattgtattataatgatttagtaattgaggggtttgattttgtttggttcagactcttggggcattnnnnnnnnnnaacaaggaaatccagcactatgggaactagattcggatcagcatacacnncaaga

SEQ ID NO: 3163 - DNA, 370 bp, Glycine max
gttatgactgatagtagccctcggaaatggaaatgattactgattagcaagtgtcaagaagcactgctgttccggtctaacattaaatagtagtctgcaatattgatgctggcataagtgccaagacattgtttgtgtatatgttatcagatgatcttccttcagtgtttatatcataaaatattcattagtatggggcctgtgttgtaagaatgctgtctgcttgtccctgactgtaataatttcattgagatcaaagctctgctaccctgattttagagatgaattttaggtgatatgctatgccactcaaggatgggttgctaatttgaatatcaacgtagcggtgtgctaatctcgacctttgatg

SEQ ID NO: 3164 - DNA, 1207 bp, Glycine max
  misc_feature (59)..(60): n is a, c, g, or t
  misc_feature (407)..(407): n is a, c, g, or t
  misc_feature (807)..(808): n is a, c, g, or t
  misc_feature (814)..(814): n is a, c, g, or t
  misc_feature (1123)..(1123): n is a, c, g, or t
  misc_feature (1148)..(1148): n is a, c, g, or t
  misc_feature (1195)..(1195): n is a, c, g, or t
  misc_feature (1198)..(1202): n is a, c, g, or t
caaagtgacatttagattgaagtcaaggaaggaagactcctctcaacaatcatccactnnatcccaaatgtcaaacaaaaacaaccaacaactcaacaccttaacctaaaccataacccaacgattcctacctgactaaccacaacacagtaaaacaagacacacaactgagcttagtaactcaaccttgactcacacacacaatgcttgtggatcatgaactacattgtttattcttaacattatcttcaattattcaataagtctccattttatttgcactcgaatatttatctatacaaaacttagatagagtacctcaagggttaccactattactctctgatcagaacaaaaatttcaccttgataattagtaaaactccaattgtcgaggtgaaacttaanatgttctgatcagagagtaatagtggtaacccttgaggtactctatctaagttttgtatagataaatattcgagtgcaaataaaatggagacttattgaataattgaagataatgttaagaataaacaatgtagttcatgatccacaagcattgtgtgtgtgagtcaaggttgagttactaagctcagttgtgtgtcttgttttactgtgttgtggttagtcaggtaggaatcgttgggttatggtttaggttaaggtgttgagttgttggttgtttttgtttgacatttgggattgagtggatgattgttgagaggagtcttccttccttgacttcaatctaaatgtcacttttggttactagtaatggaatttcagtttttctatggttggcccaaanngttctnatcagagagtaatagtggtaacccttgaggtactctatctaagttttgtatagataaatattcgagtgcaaataaaatggagacttattgaataattgaagataatgttaagaataaacaatgtagttcatgatccacaagcattgtgtgtgtgagtcaaggttgagttactaagctcagttgtgtgtcttgttttactgtgttgtggttagtcaagtaggaatcgttgggttatggtttaggttaaggtgttgagttgttggttgtttttgtttgacatttgggattgagtggatgattgttgagagnagtcttccttccttgacttcaatcnaaatgtcacttttggttactagtaatggaatttcagtttttctatgnttnnnnncaaaa

SEQ ID NO: 3165 - DNA, 356 bp, Glycine max
atgggaaaggaaaaggaggggctctttcttccacgtgcaacgctgctggtgagatattcacgattgctgctatcatcaatggacttgttcttgtcggggttgctgttggctttgtgctcttgcgagttgaagcatgggtcgaggagtccgaggcagagtgaaaattcaatcagataagcaagcaattaattaatatccagaatagttgtatgttcctatattgatgatgtggctgttcttgttttcgttatgacttgtatatttatttgtcaagtttcatcattttcctatttcattcgcaattggatctctcgtcaataatcaatcggcatgaaatctgccaatcctaaacttct

SEQ ID NO: 3166 - DNA, 630 bp, Glycine max
cagcaatcaagagaaaggtccaattatgagcaggcagccctaaatgaaagaatgcaagagtacaaacgacagattgatcgggagagtaggtgggcttcaaatggttctaatgggtctcctaatggagatggtatacaagccattggtagaagttcacataagatgatagaggcagttatgcaatctgctgccaagggaaaggttgaattgaggcctggaaattgttgattgaagttattaacaattactttctcccagtggttgacttttataactttcttgtcttatcatcattttaggttcaaactattcgacaaggttatctctcaaagcgttcctctaacttaaggggggactggaaaaggagattttttgttcttgatagtcggggaatgctgtattactaccgtaaacagtgcagcaaatcatctgtaagaatgtgaaaaataagttggtttttgagggacttaaactaagcctactaaaataattgcttctttataacaaatttcacctcatttttgtggttatttatcatgtgtaggggtctagtagtcaacattctggccagaggaatagctctgagcttggttctggacttttaagtcgatggctgtcttctcatcattg

SEQ ID NO: 3167 - DNA, 457 bp, Glycine max
aaggctatgtctcagaagatgaagcaggaaagagacttgctcaggtaatatcaataataaccctctagggaagataatgactacaagagtatgaagttttcaaatatctttatttctcatgtgtggttgtcttttatataggttgtaagtgatccaagcctaacaaaatctggtgtttactggagctggaacaaagcatcagcttcgtttgaaaaccagttgtctcaggaggccagtgatacagagaaggctcgtaagatctgggagattagtgagaaacttgttggttttgcctaagtgggaggagcctccaacatcccatgttgttctagagaccttgcacttgcatggaggaagaaaatgacgtctcaaaagagtggatagataacatcctatcattttgaatgcattgatgttgttttgttagctaggagcttctttgctttgatgtaaggtg

SEQ ID NO: 3168 - DNA, 1023 bp, Glycine max
acttgacattcctttcactttcattctatgaccaaataaattagaattcaagaattgcctataacttggaattcagtttctcttcaatatattagaatttagtaaataattaaagatcttttgaattcagtattgctaattttaatgttagttgttcaatgttgtgatgttatttgtaatatataattgttttgttaaagaagcctgtgcctgaacagtaaatgaaatatcagttaatatgcatgttaaagggaaaataaagagttggataatcacactttgttcgtctaacatatactgtattgccatgaatcacaggcatttgcggatgagcttggtatccctttccttgagacaagtgctaaagactccatcaatgtggagcaggctttcttgactatgacagctgagattaagaagaagtatctaattctagcttcccctgttctcatttagaatcattatttaatcacaactattaatcagtgtcacaaaatttctttttccatatcgagtttttcagcatgtttaaaattgaaacccaccatctgtggaataatgggttttgatgaaaagaaaaaagaaacagaatgtacatcttcagctaaattttcataatcaagattttgataatttacagataatgtgccaatttttattctttaacaagtttagatttattttgtggagtgttagttttataatcatgtaattccattacttgattcatgcaataatatgagttccaacataagacaagtaagtcactttgagatgttttgaacttgggtgcaggatgggaagccaaacaactgctggtaagtcggcagaaactgttcaaatgaaggggcaaccgatcccacagaagagcaactgctgtggttaggttctagttctacgttctgttatagggaggactctttcctgactctgttatgatatatggatgtttaagtaaatgttaaaatatcacctatcatctatttaaatccttggattatattgttctgaatcttatgatga

SEQ ID NO: 3169 - DNA, 209 bp, Glycine max
agcctccacctggctctgttctcggcaattctcgacatcctctgtttctcgtactccgacaaacccttcttcttcttcacaccattgccctctaccgtttgtgcatcctcgtactctgaacctgaactcgaggggtcctcggattcggaggtttcgcgttccgccattttcggattgttctgtgctttttgctattctctttcgacggg

SEQ ID NO: 3170 - DNA, 400 bp, Glycine max
tccacacacaccactacaacaataatctcaaacatggcctccaaatccttcaccctcattctcctcatcctcaccacattcctcatggcccaaacccaagcccaagctcccgcaccggccccctcaggcgcggtgaacctcaccgcgatcctcgaaaagggtggccagtacaccaccctaatcaaactcctaaaggacacacaacaactcactcagatcgagtcccagctcaaatcaaactcacaaggcttcactctcttcgcacccactgacaatgccttccagagcctcaaacccggtgccctaaacgacctgagcgatgacaagaaggtgaagctcattctcttccacataaacgagctcagcgacgaccagaaggtgaagctcattctcttccaca

SEQ ID NO: 3171 - DNA, 736 bp, Glycine max
actccacttttagggcttcttctagcttacgtttgggacgtgtggcaccttctgatgatggattgcatatggtgtccgaaagttactcttctagacatccaaggccattgaccaccgttggctggcagaacaataatagaaatggaaggtcaagaatacctagtgacagatatcggtcattggatgatgaggttggtctcaattaacgatttaactcttatctataagtatctaaactctcaagagctctgttcttgtgattggaaacactcgtgttcatgtttttcccagctccattttaggctatataaccttcgtattgagatatttgtatagctagcaaactttataggcacgttggttccaatatatccttcgtgaagtggactagttattaacttaatattagcaatacagtagtttctggatttaattccgataaatcaaattttgttcttttattggggtatatgactcaaatttggttttatcgttctttcatggtttcatgattgttgatcgcacttcactgtatggacctaggaatatgcttgatctacatagagacatgaggatggacatagacaacatgagttatgagggaattattatttttgtgtgataaaaattaacatcatgcactatcaaatctggttaattatttggatgctttgctcgaccaggaactacttgcacttggagagagaataggccatgtgagcacaggattgtctga

SEQ ID NO: 3172 - DNA, 369 bp, Glycine max
  misc_feature (17)..(17): n is a, c, g, or t
  misc_feature (287)..(287): n is a, c, g, or t
tacctaacatgttcccngggcgacatggaggaactgaggcgactgaggtatcgtctgctgctgaggcacctcctttggttgcagttgtaaataatgtattgtattctgctgattatgcccaacaagaggtaaggagatatgataaagacaataatttgtgggtcactattggaagattacctgaccgaatagtctcaatgaatggctggggattagcttttcgcgcatgtggaaatcgcctaattgttattggtgggccaagagctttagatggaagggtaattganatcaatgcttgtgtcccaggtgaaggtgtgccagagtggaacctgcttgctagcaggcaatcagggagctttgtgtataact

SEQ ID NO: 3173 - DNA, 599 bp, Glycine max
tcgcgttactggtttttttttatcgaggttagcttctttggtttttttgctgctataggaattgggagtgatggatttctcttcggtgagggctgcgttggattcgaagtcgtacgacaaggttgcggatgtgtgcgacaacttgatgcttcaggcacctatttctacctataatctatttgattgtgttgggctttattttttcattttccttagggtttgtgtttctgattacttcaattcaggttgcagctgagggcattgcttatcaggacgattggccctacacaattcacctcctctctcacatttatgttcacgacatgtatctctcttcactttttcccgctttacatgtcaatcaaatgaataatactattactttactcacattttttattgaaataaataaattctgttttacaattgattgatcttttatgtatttatgtcaatttggaagtgctgctgtgattttgtgtgcagcaatagtgcgcgctttctttggaagtcaataccttcctcaatcaaagagagccagcctgaagtcaccgcggtttggaaaattggtcagaagctctggttacgtgactatgccg

SEQ ID NO: 3174 - DNA, 1033 bp, Glycine max
  misc_feature (55)..(57): n is a, c, g, or t
  misc_feature (60)..(61): n is a, c, g, or t
ttactgttgatttaacatccaacaaggatgttggggatcaggctaataaaacaannnttnngggttttagatcctcaagcattttgaatagaattcgccttgagaactttcagacaagcactaaaatagaggctctggtatgtatcacaaagtagttagtgacatgttttctgttttttccatgggtttaaaagtatgagtacttcagctagcttttggtttctttagtcaatgcttttcctttagttttctaaagctttggttttggagtgataatggggacaatgtgatggatgacgaattgagaattatacaggcatgccaaatttgtttgaggacaaatattaaaaaatgttgataaatggggttgacaatctgtaaaggttgaaatgtattatgcattcttggaatttcaaatgaagatggcttggtaggaggataaaaatagttagtaaatatgatttctagcttcttaaaaattcccataactagcttatttactgaaagatccagcaattgataggaaggtgaacaatgagaattttgttgttgcttgggaggcaaagggaaggtgtgagaaactagcattaggctaaatagtaagctggaaaaaaatgctatagccgtgaataaaaataatgctattaattagttctttacttcaatatcttctgttctatgcttaccttttactatcttgcttgacttctacctgaatggttgtagagggaagaaataagattcatggttgaaagggacggctctgccaaagggattgtttttagccaattcacatcattcctggatcttataaactactctttgcacaaggtaatttaattgtcagcttgtttgattaatacaccaaattgcattgggatgatatgttttgtgcttgttgcagtctggagtttcttgtgttcagttgaatggaagcatgtcattggctgctcgggatgctgccaaaaagagattcactgaagatccagactgcaaaatttttctcatgagctgaaggctgggggtgtgcact

SEQ ID NO: 3175 - DNA, 379 bp, Glycine max
ccacgtccggcgccggaggtgccggaatagcttctccggctaccagatccggcatctccgcgcgtccactgaagagatcttttcccgaggagccctcgccgccggcggatcctccgtcttcagaccagacgaccccgtcggaggcgaagcgcgtggtgaaccgctgctccggctgcaggaggaaggtcggactcaccggatttcggtgccgatgcggcgagctcttctgcgccgagcaccggtactccgaccgccacgactgcagctacgactacaaagccgccggaagagaagccatcgcgagggagaatccggtgattagagccgcgaagatcgtcaaagtctgaaaaaaaacaaaaaagaaggaaaaaacccgaac

SEQ ID NO: 3176 - DNA, 377 bp, Glycine max
ttgtttttgtttttctttctgttagtatattatgttttgtatatcatgacttatatttgcatctacaggacttgatgttcaattgtctgctcttaagaaatatgtgcctacaatctggaagcagtctcttgtggggtcaagtatatgggcagtctcaactgcaaatgcaggcacttggagagaagccgagctcgagtccttggacgaaaaagctggagttggacaagttgttttccgagacaacggaagttctgtgaaagttggtgctgaagaaatggcgctgtctgagcatgcagaaatgagtgacttggagagcgattccagcttagtacaatctgattccagtgactacgaggaagaggaaccacaaggtttaa

SEQ ID NO: 3177 - DNA, 362 bp, Glycine max
ggctgagaggtgatagcccgtggaactccaagccaatggactttgaaacgtgcatagaacagatggaacattggatggggaaagctagaatgatgtttgcaacaaaagatcaggcttgcgaagaatctacaatgaatcagcaactcttgattaatgagctccagaagcgagataacatgattgagcatttgcataaggcaaagttagaagaggctcagaaaagacagattgaggtatatcggttcgagaaggaactttatatgatgcaaagtcttgttgatggctacagaaaagccttgaaagaaacacggaaggcttttgctgaatatagagcacaatgtcctcaaggtgataatgaacca

SEQ ID NO: 3178 - DNA, 717 bp, Glycine max
gggaaggttgtctgcgcctgcatcgctcctcctcaaaacttcaagagccaggactcttccttcattcatttcaatgtaaatgtctttaatttgattcattcctgttgttgcattgcaagttccttcttttttgcttcaatgatcacgtgttgtgtccttttctgttgttggggttggtgttaagtgagttcggattcctgggtaatcagaaagttttgtttttgtttttcttcttctgggtggctgacatcaaggttgttgctagggttcgtccaaatcagagcaattgagcactgcgcgggatcatgaggatgattctgatgttcttattgagtgtagagacgtgtacaagtcttttggggaaaagaaaatcttaaatggtgtcagcttcaaggtaaggattatgtacttgactatgactctcttttggataaacctctcaataagaattgagcttctctcataacttaaaaccaatttatacacttaactcttatagaagctctttcatctaacttatacaaaagctgaaagtgcataagttgattctaacttatgagaaaagccaaattcattttaccctttttctttttctttggcgttttggtttgcccttttcattgttttttgtggagtgtgttatctagcatgaaatgatgaagtaatgaatgcttacaacaaacaaccaagcctggtccatcgtggtgaggtttgccc

SEQ ID NO: 3179 - DNA, 496 bp, Glycine max
cagattggagccatctgaattgaatatcgttgaagattcaacattatactcagaaattgagtgttgtgaccttctgaggcggatacatgaaggaaacaagtcaacaggggggcttaaatttgtaacaacttgctatggaatcatcggtatttttctatcttctgtataagatcgaaattgttattaactatccgtagtcttgttccccacatttttcgttagaataaatccagcttttttcttttgatttagggtttatcaaatttcttgagccatattacatgctgcttataacaaaacgaagaaagatcggcacaatctgtgggcacactatatatgctatcacaaagagcgaaatggtcccaattcctcatgctactgtgcgatccaaaatggcttattctaaggatgagaacaggtctttagtcaattttgcatgtaattgtaatgtgtctatggtacatttaaagagacatgtagacagtagcattgagag

SEQ ID NO: 3180 - DNA, 374 bp, Glycine max
tgatggggcagtgatagagaaacctgtgaacttgaagccaggcgaggaatggactgggcggctgcagctctcggttgtgccgtcaagtttttgcagtgaccgtctgggtctcgacagaagtggtctttgaggaattgtacaaaatcggtcagagtttatgctacatcctgtaatgtagcattgagtcgtagacatagtctccttaggagtatcaggtttttctgttgtgtggtctttttaggctagaaatagtgttttagagaggcctatgttttttgtgagaatggctatcaaatgttacccggttattagttagttggttcggttctgctatggactcttcttgaagcgttagatttgttgtgtagatgtta

SEQ ID NO: 3181 - DNA, 467 bp, Glycine max
  misc_feature (14)..(14): n is a, c, g, or t
  misc_feature (405)..(407): n is a, c, g, or t
  misc_feature (410)..(410): n is a, c, g, or t
  misc_feature (413)..(413): n is a, c, g, or t
  misc_feature (428)..(428): n is a, c, g, or t
  misc_feature (430)..(430): n is a, c, g, or t
aacccatcggtggnccttccaccacccgaaaggacgacgacagcgacggaaccaaacagtacatcaccgaattcgacccttccaaacccgcaaaccccaaaatcacaatccccccaatccaaaaccagtggaacccccaacaagacaacgaacacagcaccacgcggtggcgccgcactccggaggagaccgagctgctgcgtaagctgaaactggaggaagatctgcagaggttgccggaggaccaggggttggaggagttcaaggatgtccccgtcgaggttttcggcgaggcgttgctcgctgggtatggctggacggaagggatggggattgggaagaaggccaaagaggacgtgaaggtggtacaggtcaaggggagaacctcaagggaaggattagagnnntgnganagcccccttcttcgncngggacacgggtatatggcgaggggctattttctttaa

SEQ ID NO: 3182 - DNA, 371 bp, Glycine max
ttccactcgcccaaaacctcagcaaccaaacaaacgccgccgccgtcgccatggccgcgatcgcgcgactgaggactgccgctctcgggctccggcccaaccgcgggttcggatcggcggctgcggtccagtgctactacgacgacgacgactacgactacgaggaggagatggaagaggagcgcgcgccacgtggcgcactggacgcgcagggttgcgcgccggagaacggagtgcagtgggtgatgataggggagcccggcgccaagaggcaccagttcgctcagagactctcgaagcttctagaagtcccgcacatttccatggccacgctcctcagccaggacctcaaccctcgctcctctctctac

SEQ ID NO: 3183 - DNA, 900 bp, Glycine max
  misc_feature (888)..(894): n is a, c, g, or t
agtctgaagagatgcagcttttgggttgaatacttctgtgggcttgggaggttatcttggtataatgggttctcgaagagatgttgttactgcaacgtggaaaactggccttgaaggggtctggtacaaggttggaaaagaaatcttgttcatttgtttatattgttttctgtcattctgtacatccttgtatgcaattaaggaattcaaaatgattattgatttttatgtgaatttgaagatctggcattcattattgtaagaagtgcatgtggttcatatatcccacgctaaaatgcatttaatgttcatgtgtattaatgcctaggaagttgcaacgcttattataatcctagggaatggtctccaccaagtctatctagagtctataaataaggatgataatgatatgcagaagaatagatcgaataacatttgtgatttggcaactgatggaagtattgatggtgactgagacattagaataggagcagtgtcatctaggtcaatcataattttgtaaatgaattaatgaaatcattcaaatgctcatgcttttaaattagtaaaacacacttgtgtgtattcttctacttgatcccttagtgttttttactgcatgattcatcttctattggtgattttgtttacttctatggtgcagtgcgtaagatgtcagcggcagacttcagcatttacttcaccagatgctactgcttctcctagtcagaatgaccgggaaatgtggtggatcagccgctgggtacatagctgcccaatgtgtggtggaacatgggctcgggttgtataaataggtgcattatgttattataatgtcagtttcactctatggaaagagagacatggatatagttatggctaactgtnnnnnnnatcaga

SEQ ID NO: 3184 - DNA, 1043 bp, Glycine max
  misc_feature (1022)..(1022): n is a, c, g, or t
atgagcagcttgtagtgttgttgtgaactgtgcaatattccacaaaccaatgtcaggctggtttgtaaaacagtatcttcgacctggaagatctgtagtatttggggtaaatttaggatcaaaagcatccaaaaatccaaatgggccataatctattgtaagacccaaaatgctcatgttatccgtgttcagcacgccatgagtgaaaccaaccccctgccatctagcaatcagggaagcagtacgctcagcaatctccaccacccatgctgatataaaacaccattaaaaagaagggatagatagtcaatacaatacaatacaatgaagacagcattacaatccagaagattcaaagatttttaaaaaaatttcactagtttggatgttgggtcaaactgtaacatctggttgccttacaatctgggattcttatgtttagtatgtggtcaggccgagttaacttagtcaacaccatttttccactcctagggttagttagtaatttctattaggttctcaaagtcaggaactaacattgtctatgaaggggattttagcccatgagtggtaacatctttttttggggaaatagtttttttgaaagctctcttaagaaactggcaaacaaaaaaaaggcaattatttgtccaaaataagtttttaggtaacattgtcttgtgaaaatttccttaatttgtcagttatttgggctgtttgtttatgtttgtagcagctagtttatttaacctgggccttgagcttacaattacctggtccccaagttcaactagtcataaaaaagtcatgcatttagcttgcagagagaataatgaatgaggagattaagccgactgatatttaagctgaaggaccaaataaccactcaaaagtgttttttcagttcaaacttcaaactgaataaagtcacagccattaattctacaaatagttttttgttttatttttacctgcataaatatttgaagtgagatctacaacagaatgatcttcatcaccangcagaaagataagctatcact

SEQ ID NO: 3185 - DNA, 359 bp, Glycine max
tgttttatagtcaacacagacactgacatgcaaattgctgaggactatgaaattaaggctgtaccagtggttttgatgtttaaaaatggcaagaaatgtgattctgtaattggtaccatgccaaaggagttttatgtggctgctatagagggggtgctcaagccctaatcatggatcagtgcaggcattgatgagttcttgtacatattttgtttccttttttcccataataggcatggtcaagtgagactgcttctttcgtaatgaatgttccactttcaatagctatatttcctagggaaaatcttcttcagctatagagaatatcatagttgaaatttaagtgttcctttggtact

SEQ ID NO: 3186 - DNA, 728 bp, Glycine max
tatggctatggctttgagtctctccaattccctgttcgtgggtctgtttctttgcccaaaagaagactacccagaagaagcttttgcattaggggcatgtcagaaacctcttccacttcttctgtgagcacccaacaagaacaaccaacttctgataatgcttcttcagtgacaattgctcctccccctaacttcaagccccctgagcctaaacgctttgcaattaggcctgataagaccagtgaagtgtttggagctttgcttcctttgatctttcgttttgccactggagttttcgtttctgggtaactatactccttttcttcatattggatttttgttttttctgtttacagttttgtcacaagcgtacctaaattctaacttctaaggccttgtttgtttgctagttttctgttttctaaaatttgtttgtcccatcagcacgtttcttctttctaaaaatttgtatcaacttgaagaagagaatgagaaaacatacccagctgattctgttttgttttggaaataattttaaaaacttgattgaatttggatgagaatttgattgctgagtagtgtaaaattaatttagaaaacagattttagagcaaaagagtgagaagtgaatctaacaaaccttttagtcttttgggctgtgactctggaaatttaaggttgactttttttaaaaaaatatataaaattttattttcttaaaacgcgta

SEQ ID NO: 3187 - DNA, 514 bp, Glycine max
gtcctcccttagctggggagagaaaatcgttctcaaatgttactaggcttgggtttgctgctgctcatgattctccatccttacaaattcaagaaactagtggtctgcataataacaacacaactgctgattcttctgtcacaacaggtattatatgttaatggaattggatatattctgcatgccaaaatttgttgtgctattatataactgaagaaacgaggtgctccaaatgcctgaaaatgttatgctcttaattgttgtgattctgtaggtttgagaaatggggagacacaatcatactccaatgttacatcaagaacagaatctaatataagctcgaatgcaccaaagacaaatgagttggggaagaagggaaagaaaccaaatcgagttcttctgtcaacagctggtggtaggcgctattgattttggttgccgacccttaccctagattatgcgagtgtcaatgattctcagcctcctccctgctatagtcccaagccaaactcat

SEQ ID NO: 3188 - DNA, 596 bp, Glycine max
ttacactgaaacattaaaaaactggaggttgatagttaatctatctgcaacagcaacattgtgacagtgacagtgtcgtaggatggagaaggtggtatgtgtgaccggcggcagcggctgcattggttcatggctcgtccatctcctcttggatcgcggctacaccgttcacgccaccgtccaaaacctcagttattaccatcccacactctttctttcattcatttattaatcacttcattgcaacaaaacctttctaagttaaatcgcttttccttcttctctcactaacaacagacgatgaagccgagacgaagcatcttcaatccctcgacggagcgtccacgcgcctccgcctcttccagatggatctcctccgccacgacaccgtcctcgccgccgtgcgtggctgcgccggcgtcttccacctcgcctctccctgcattgtcgaccaagtccacgacccccaggtcttgtttaaccaaacttctcttaaatcttcaatctttttggctttttgcatgaccccatttcggtttcaatgcagaaggagcttctggacccggcgattaagggaaccatgaaacgtgctaaaa

SEQ ID NO: 3189 - DNA, 555 bp, Glycine max
accgtcgatttggccataatgagattgatgaaccatctttcactcagcctaaaatgtacaaggttagcccttttgtttattatgtttttcttcattttgtatgcatattgcttttggacaagttaattagtttgcaactttgtggggttgatataggtaatccgaagccatccatcaactcttgagatctatgagaagaagcttttggaatcaggggagttgacacaagaagaaattgataggatacacaagaaggtcacatcaattctaaatgaagaatttttggctagcaaagaatacattccaaaaagaagagattggctttcagcgtattggcttggtttcaagtcacctgaacagctttcacgtatccgaaacactgggtacgaacaataaatttatgttctttctgtttgagtctttttatgtttaaacaacaccgctgaagtctgtgatctatcccatgcagtgtgaaaccagagatcttgaaaaatgttggaaaagcaatcacaaccatccctgaaaatttcacacctcatagagcagcgaagagga

SEQ ID NO: 3190 - DNA, 596 bp, Glycine max
cgtgcaataactgttcgagatactattggtgatctcccagctgttggcaatggagcctcaaaaggaaacatggaggtgtgtaaaataggaaagatacatgtcttatattcttcataatgcgagttttttctacactcactacttaactgggttttatgttgcatagtatcaaaatgatccagtctcatggtttcaaaagaagattcgaggtgatatggttgtcttgactgatcatatatcaaaggagatgaacgaattgaacttgattcgatgccagaaaattcccaagagaccaggtgctgattggcgtgaccttccagaagaaaaggtgatgttcaatatttgtgaattttagcacgacattttgtgatctaatctaatatgtgaaatctaatgaaatgcagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggatactt

SEQ ID NO: 3191 - DNA, 596 bp, Glycine max
cggaagaaaagaaggacaactttgatcatagagagaataaaagcatgggattaggtgtgattaagaaagtagcggtaatgatactactgataatgtttctcagctaccctgtagcatactcctcatcttcgtctgagactacgatgcacactaataattgggctgttttggtctgcacatctcgcttctggtacatcaacttttcttattcttactcgattagtatttttttttaatccgtaggaattgaaccccatatgaaggtggtttacaacactcagcatcgtggacaaatgcagtaaatgcggtcaaaattgcagttacggatagttaaagaaccttgatattgctgcccaaatcatggttgccacccatttttaaaaaccttgatatggcttatgacaatgaccataagggactgggttctttactttttgtttatggttttgttgtagaagtagaactgagactcctttggaaatgtattgcatcctagtgatcctacaatagaaaaattgtaagtctggtacacacaaaaacattcaactcggcttacagaggaaatatgaaatatagtttaccttgaggtttcttgt

SEQ ID NO: 3192 - DNA, 470 bp, Glycine max
  misc_feature (390)..(391): n is a, c, g, or t
  misc_feature (393)..(394): n is a, c, g, or t
  misc_feature (447)..(449): n is a, c, g, or t
ttgtggaactaattttgctgaaaaaggtgatgatggtgatggttttttctctcgtgagtcttcggattcggggttgttggaggagatagttaacaagttcttgcctagaacgaagcctagtaaatgcgagactacttttgcaaatcctcaggaggagtcgcttcttctccctccgcttgtttctgaatcaacgcttgtttccaccgggcaacaatactatgatgatgacatgaaaaaagggtttccaaagaacgagggtctaggtgttttttattctgatcaaggttttcccatgcagcaattcgacacctctaatgggtttaatagcatggctatggagaatgatcaaaacattattaataatgcagagaactgtgtcgttgaaaaatnncnntgttttgtttgttagctatctcagacacaattgttagaagctctactggctannnatgattgatgttctgaagact

SEQ ID NO: 3193 - DNA, 1058 bp, Glycine max
  misc_feature (1012)..(1012): n is a, c, g, or t
  misc_feature (1052)..(1053): n is a, c, g, or t
gcagcacgtcccctcttcatatcaagtaactaatcactactacatattaatttaatttatgccttttcatttttgaagaatccacaagcattgatttcataatatgaatagtaatatagacacaatgtatcttataaataaagacatttagatataataaaaatttaagtttttctctatcttttaagtgttgcatcatattcaatataaattttttaaatatcttcaatgatacaaatgaattgtttttcaaaaatgttcatatacgacaaaaataaaaattgtatttaattaatttgatttgttagatatattattttttcctttaatatcatttttcatcggtgaattaggtaaaaataatcgatgaacgtcatataaatacatgttattcatcgttaatctagttttaaaatgttcgggttcattccttaaaaaaaaaagtttgggttcatattcagtaacttggaacatcattttgttattttgaaaaacttacctactaatccatttcaatggttagttgacaccaaactataacccacttgtaatcctccacaaactttccatgagtgtgaaaatacaacatatttgttgtgccattaggtgggaccatatatggcataaactatttaacaatatgattggtgttttcacttttgatagtttagttagttatccctttaccacattttttttcttttctacaaagtttgtagttaccaacttaccatgtgtacctaataaactaagcatacttttgaacatacttaacattaacatttaagcatatgattttgtaggagtgagaattggaacaacccagatggtataaaatgtgccaaggagatcactccggttctcaacatgtcaaccccattggatgtagggacagatcgtcgcctttttacaattgccaacaatgtcactcagtcaatgaaggtgccagtgtacttcattaacatcacttctttgtcagaattgagaaaagatgcacacacttctgtttacnccatacgccaaggcaaaatgctaactcctagaacaacaannctgat

SEQ ID NO: 3194 - DNA, 452 bp, Glycine max
gctgagaatggtattatactattatgtatgtgtgaactaatttttgtgatgatgaccccagggatcttggtgaggtagttcaaagagcaaataacacacgttacgggcttgcggccggagtgttcacaacgaacatggacactgcctacactttgacgcgggcactgagagttggaacagtgtggataaactgctttgacacatttgatgctgcaattccctttggagggtacaagatgagtggtcaaggcagagaaaaaggagagtatagtctcaaaaactacttgcaagtgaaggctgttgttaatcccctgaaaaacccagcatggctttgagcaaacactagccttctttggataatcaataactatcagtgcctcaatgataatgatgataaaaataaaatcctgcttttttttttttggggttacccaaaaaaaaaaaaaaaaaaa

SEQ ID NO: 3195 - DNA, 401 bp, Glycine max
tcatcctcaccccttcctcccttcacgtccccgtactctatttttccctcctctccctcggcgtcaccatcgcccccgcgaatccactcagttcccaatccgagttgactcacctggtcaaactcgcgaaacctgtcatcgcgttttccacctcgaacgccgcgaaaaacattccctcctccctcaaattcggcacaatcctcctcgattcccctctcttcctttccatgctcaacaacaacgaatacgtcaacgccgattcacgaactcgccgagtcgaagtgagtcagtctgactcggcggcgattctgttctcctcgggaaccacggggcgcgtgaagggcgtgctccttacgcaccgcaacttcatcgcgctgattggagggttctatcaccttaaa

SEQ ID NO: 3196 - DNA, 685 bp, Glycine max
  misc_feature (642)..(643): n is a, c, g, or t
  misc_feature (645)..(645): n is a, c, g, or t
  misc_feature (647)..(647): n is a, c, g, or t
ctgctggttcccctgcctcttacaacctctacgatgacaaaaaagccgatttcaaaaacgcttatggttggagcaaggcactgcatggaggcgagtatcctccactcagcgaaccggatattggagttttacttgtcaaactctcagcggtatgcaaacatgtccttcaatattttggtgtaaaaacttgaataagtacttggatgcaattttggttaagtttaccatttgcatatggacaaaacttggatgcaattcttttaggtacttttggtgttctccaatcagaattcaagttttatcttagtaaccagcctaataacaaagatttacattaaatcttaacatggcttataagatgaaactccaattctaattttggtactttaccaaaatcactctgtcctttgaatatcacattggacattcattaatttggtcaatgctaatttttatattggagaatgacacaaatatacttaatagtactatattcaagttttgtcctaacaattcatgcaaattaattgtgatttgtcacatccatatttttcattcacagggatccatgttggcacctcatgtgaatccaatatcagatgagtataccatagtgctgagtggttatggtgaactgcatanngngntccaaacggaagcaaagcaatgaaaactaaaatcaaac

SEQ ID NO: 3197 - DNA, 518 bp, Glycine max
ttgtttatctataatgattttttgttaaagtatgaataaaaccattccttagcctccacctaatgatgatggcttgtgcgttggattgatttgtttcttgacttgatattgaaacttgttgaccaagtgatttggctggagttccatcttttcagtttccattcttcagggttaaattaagtttagaacaacttgggaattggggtagtagattctccacaatattgttcaaagttgaaacgtgaggagttaactacctgtgaaatagtggatttagaaaatgtaaaacatcctatatcatgaattcatgatcttgtttcttccctaaactctaacctaattttgtttatgccatcatttgatttcgatctaactttcatagttttcatgttatgtatttcaagattaaaaactgtatgggttattatcaggaaagataaattctgtgccatatcttattgcatgttttgtttttatcaaacatataggattatcgatcaggcttttgctcaaggagt

SEQ ID NO: 3198 - DNA, 960 bp, Glycine max
  misc_feature (949)..(951): n is a, c, g, or t
  misc_feature (954)..(955): n is a, c, g, or t
aatccttaactctcccgatcgtgcctgcaaccttgcaaaacaggttagattcagatatagtgaatatcttggcctttgttttgctctgtttatttttgttttacaacattttgagcaatgttttggatgtttcccgtgaaaagaggaaggaattgggccccatacagtgaaatttgcagctattattgtccattaattcgaataactttatggctactcccataatgcatttcgttaatgtcgaagcaacaatgatagctactcgttggattctggcggctaaatatggagttcgctttgtacagttgttgcttactttacctgtagctaaaatgagttgtcaaatatttggtggatttcacagtaggtgtttggaagtctaataattataagctagcaaacaacaatcgatcaatttttgactacttaatctaggtactggtatagatgggaatctgaccttagtaataccggtggaatatattcttttagtttttgatgtgaaaatgttctggtacaagttgcaagagcataactttactatgagttctgtttctaatggcatatttcgtactcatgaagaatctttttccttatgatattcgctaggcttttgatgaagctattgctgaattggatacactgggagaggagtcatacaaggatagcactctgatcatgcaactccttcgtgataacctcaccctttggacctctgacatgcaggtattgattttaggttgccatagctcatccatcacttctttttttatttcccttttttgtgttgtcgacttattattgtggtttcaggatgatggagcagatgaaattaaagaagcagcaccgaaacaggatgaccagtaaaaatattttactgctaattagaattgaacttctcctccatatctttttgaagggagaaggtgtttgttgctaatatctcttnnnacnnagatt

SEQ ID NO: 3199 - DNA, 685 bp, Glycine max
gctagggacacttgaagggttcattcaacaggtacttttttctttgttgcacttgtatgcaaatagtttgctacattggtgaataagtgaagaagaatcttttagtccagccttgatttcctaatattatttacaactgataattaacatcttgaacaactcattttggtttgactgaagttactcatgtttttccattccccctaaaaaaaaaaccaagaacatgcttgctcttgttaacaaatatttatatattatttacaataaatagccctattaaaatatctaattcatggctccatttctgtggtgtttatgattacaaggctgacaatcttcgccaacaaactcttcaacaaatgcaccgtatactgacaactcgccaatcagctcgtgcactccttgctatacatgactacttttcgcgtctgcgtgcactcagttcactctggcttgctcgccctagagattgatgggcgcggtaaatagtatggcaaattaattttcatggatccatcactagcaatacttggtcatcataactcttgacaagttttcttgtgttgttttgttgtactctttgtatcactgatgttagtgcttcattgagtcagtctagaaacgaaattggtgacaagaagtatgaatattactaataatattgtccattgtaattgttgaaagg

SEQ ID NO: 3200 - DNA, 396 bp, Glycine max
gaagcgcggccacgtgagcgccggtcatggccgtatcggaaagcaccgtaagcaccccggcggccggggaaacgccggtggcatgcatcaccacaggatcctgttcgacaagtaccatccgggcttcttcgggaaggtgggaatgaggtacttccataagcttcgcaataaattctactcccccatcgtcaacgtcgaaaagctatggtctctcataccccaagacgcgaaggaaaaagccctaaaatcgaaggacactgcccctctaatcgacgtcacacagcacgggtacttcaaggtcctcggaaaaggtgttctgccccaaaatcagccttttgttgttaaggccaagcttatttccaagatcgccgagaagaagattaaggaagccggtat

SEQ ID NO: 3201 - DNA, 715 bp, Glycine max
  misc_feature (682)..(684): n is a, c, g, or t
gatatgcatagttgattgattactctgctttcgttactctggagtcttttgcatcataattttgtccatttacattctcacacaattttcctatctttagcatctgatgtcattatttacatgagatgaaacctaccaaagttggtcgtcgcctgaagtgatatttatatgaattttcagatgagggtggagggtgtttcagcaaataaaacatcctatttctctgttatcctggaagtaagtttctatccctctagttgaatgtcaacagccccttaacattttggctaaatgaataattcttgtttctctgttccaagatttttgaagtggctcctacattttatatggtggacattcagaaagcagctggagatactggtgaatacctcaaggtaagtttttgaaatcatcagttgtgccctggcgattgcttacatttaatttatgacaaaagatacactccataatgttgcagttttacaagaacttttgtagcaatcttgaggatataatctggaaaccgccccatgaagcaagcaaatcaaggatctccaagaccaaaagcaaaagacgatagtttcatcattcgtgataccttctgatttgattgaaaagaaaagagagaaaaaaaaagtaatatggaacacatgcttttaatttaaagaggggttgacatatnnncgcatgtcccaccatatcgaggtataaatac

SEQ ID NO: 3202 - DNA, 387 bp, Glycine max
gaaggagagcaccgccaaagcgacgaaggaatcgcgtccgaaacgaaacaaaatcgcaaccgccgttgctccgaagaaaaccgaggcggttaaaaagcccgcgaagaaggtcgggccgaagaaaacgaagaaagtgtcgacgcctgcgaagcccaagcagcccaggtccattaggtctccgaccaagagggcccgtaaagctgccgtcgctgcggcttgatgtttgatgtttttcttgtttagttaaaactctggcatataatatatgtagatatgaaaaggtgtgtgttaaccttgttgcacaatcttgaatatagttgtgtggtttaggatcgtagatagtttagtgttctgcaatgttcgctctaagaagtgatcaattggaaa

SEQ ID NO: 3203 - DNA, 495 bp, Glycine max
  misc_feature (408)..(410): n is a, c, g, or t
ggagacgtattctacggcaacgatgaccaccgagaaatgaacgatgattgtatgtataaggaggatgtagtgatggagagcatgagaagccaacgggaaatcaaagacctcaagcgcagacaaaacaacaacaactgctgctacttctacttccttcgatgctttcactttctcacgcttctccctgctttcatcaacttctgatgtaacctactatttgtgttatgttaccaattaactcttgaaagtttttattcccaatctagatcaaatactgtgttgcagtattcatttttattttctttggtctcaaccctctgtttttcattgatttgatataggcgcaataatgataagaacttaattcttttttgttatcatgccgagcttaataccactttgagtaannnggaagggcgaaattggatctgcctctcaagagttttagggtttttgttttacccatttggactatagttttgattttattgcgtt

SEQ ID NO: 3204 - DNA, 409 bp, Glycine max
gcaagggaggaaaaattaagagatgatttttttgagaaatgagtgtctcttaaacattgaaaaataatagatgtgatgcatgcatagccttctgtgttatatttggccactaagataggaaaatatacactgtttgggagttaggttcagatgaatgtgattatgtgtatagattatggagtgtgctgaacaaaaaatgattttaggcgatggagaacttttcccaagatgctggaccaacaagctctactatttctgtagatgcatggaaatgaaaggagatgcagctggtcgacaagctaggattaagattcactatgccagtggtttgttttactagttgctttctcatttttggaacatacactgatttgtatgttgttaaagatgattgtatgtgagccctttg

SEQ ID NO: 3205 - DNA, 693 bp, Glycine max
aggatggaggttttctaagatctactgttttatacacgttacccaaacctatttgatcgcccctgctgtggtaagcatgatttctatgtcaacctgtcttaaattctattttatcaagtaaccacttctagtgctgctgcagacctatggtcctagcatgcttcctactatcgatttgaaaacaggtgtgttcttaatggaaaagatctcaccccggtttggtaaagttacttgtggagatattgtagtcttgcgcaatcctcaacaccctaggcactttatgaccaaacgtgtggttggattggagggtgatagcgttacatacatttccaatcctgagacctatgaatatgagggtgatagttttacacacatttcctctcctgataacggtgataagtctaagacgattgtggtatggtcaaattcttatgaaaattaaattcccattttttgtgatcattttgattatgggttttgctttgccagtattttaattgttatttttgggatgactggtatctagcatccttgcttcttcacattaagaattggcatgatattcgatggcctttggtctagaaaattctgacaataattaattttttccatcgctgaatgtgttttggagatttcattgtctaagtatgccttccctctataggtgccaaagggtgccgtttgggttgaggg

SEQ ID NO: 3206 - DNA, 412 bp, Glycine max
  misc_feature (60)..(61): n is a, c, g, or t
  misc_feature (148)..(148): n is a, c, g, or t
  misc_feature (372)..(372): n is a, c, g, or t
gcctcttactgtcaagctatagcaataaagctccttttgaagtgctgagtctagccgggnntattgctaatgctctacaaatttgaaagcaaaaattattcaagggaaaagcattgaactttgtgttaaaagggatactcaactacanatttttagcacatgaaacctgctaatttaatttgtcttgttctggactggactgtgacctgattgagtctcaactctggtacaagacctttgaatgcaaatcttctaatcttaccttaacattactcatcatcaagcatcggaatttgtatccattgtcacatgcttgaaaatatgtccgactaaataatctttgtataaatggcacttcttcaaatatcctcntaaagaatctttatagaaatggcagttcttcaaagatcct

SEQ ID NO: 3207 - DNA, 753 bp, Glycine max
  misc_feature (722)..(724): n is a, c, g, or t
atttcttatatatccttctgacgttcaatcctctacttcattcctctttctgatcagcaaatttcttctttatgtgcagggtgcttgaggattaccatgctactttcgtagaaacagttcctttcaagacaatagcaacattcaccattttccaaaccatttatcttcttatatgttttggactaacatgggttcctattgccggggtcatgtttcctatgatgatcatgctcttagttccggttagacagtactttctccccaagtttttcaaaggggtacaccttcaagatttggatgcagcagcatatgaagagcaaacagctctaccattcaaccttgcaacagtatgattttttatcttatccaacaaacatagcttaaatttacgacagaataaaacttagatacagtttcgtaagtgtttttagtactgctttccaatcagaattgaagattcacctcagtaatctgcataataaatttttccattaaaggtcaacataaattaccaacaagatgaaacttcaattttgattgtagaacaacaccagaaacaccaatgcagcctcatctaagttttgccctttatgataatccacatttgcgtcatttttatatatatattttgtggataaacttaattatattccatgcaactgtcctaacagcactcggagtttggagctggtgcttctcaaggtggagaaggtgaaatcctnnntgaagttattactagaagccgtggagagt

SEQ ID NO: 3208 - DNA, 638 bp, Glycine max
taaaagttggggatttgtctggggcagctgggatgcttcttggagccactgatgtaaaagatgctccattcacttatgcactgcccacagctttcattagtttaaggaactttaaactaatacattcttacatggtttcattgaggtattggtccatattttcttatctataagacaaatgttaatcagtatcttaaaaaacattatttaagacttctctaggacagaaagacatttatttaaaagttaagttattgacttcaacctgtttcattaaatgcttcccaattggcagaaattcgacggccacaatatttaggagtgacgaagacaacgatgattcacaaacccctttcatagtttcattttcatctagaggtccaaatccacttacaccaaacactctcaaggtaactccaaaatgattttcaatggcaaaatccacgtccaattgtcatcttcaacctgaagatgctcattgatgcttttcatgatattgtagcctgatctcgcagccccgggagttaatattctagctgcatggtctccagtctatacaatttcagaatttaaaggtgacaaaagagcagttcaatacaacatagaatctggcacttcaatggcttgtcctcatgtaa

SEQ ID NO: 3209 - DNA, 904 bp, Glycine max
ctttctactagagtgatcacataagaacagaaacaaccataacaatctaattgccccaaacattctttcttttttacaaaggaaagaaatcccaaaattggaagatgtggacaaaactgaaaacaaaaggcaggagcaaatacttccaaatgtaaccccaaaaatagacaaagaaaagcaaaacattaaggttgtcgatcttttcaacatttgggaagatcagagggtggaggtggcagcttctgattgcgccgtttaccatcttggactatccatgccattttcaatccccaactagtgtgcacttcaaggtggcaatgcatgaaccaaacacctgttcatgtaaaaccagcaaaacaatgttacaaacactaacaatgaatccaaccgaaaatccagagtatggtacttttaagaaagacttcgtgttagattaatcctcctttcatattgaataattgatattaaggtagtttttcaatgataattcctgtcctcaatgtgatttttaaagtttctccaaatcaatcttctataaattaaagaaacaggtgtcatgaactatatcatcaaagaagaactaacttaatgttatctatgaatagatgtctaatatgatattaaatatatattttctaagcaaacaaaattgataaatgagtttaatttatatgcaccatctggtataaaaaatgggttgtacattcaattaattagaaattattaatgataatatgtggttagaagatgattaaccaatcagaaataattgacggcaataatttgtgattggacaagagtacatttgaattaaattcaaaaaataaatatatactctttgtaattgtatatagtacccacctggatttcagcaagaaagcgcacagcaacccaccctccagag

SEQ ID NO: 3210 - DNA, 219 bp, Glycine max
aaagtgaggtcaaccattgcatcatggatgcactagatgaatcttggcagtgcattttagatgtgccaatgctgcatttagtagcagtttgttcgtgttatcttgtgtgaagttgtgttgatccctccaaaagtgcaaatagaacttgtgatgcacataaaaccatatcgtactctcatcaaaaaaataaaaccatgatgtgtatgtgtatgaggagta

SEQ ID NO: 3211 - DNA, 823 bp, Glycine max
tgcttgcgggtcatagctttgttctctcactgttgtttatagttcaggtaaccaatgaaaatctcaaacacccttttggcttatttgcaaacaagaaaagtaaaaaagctcaaaatattgatttgacttgtaacatttttttatgtttgtagacatggataatcagaaattaccctgcagagcttgtcatagtggtcactcgcggtatattagttgctatgctatctatcccaccttcgctgatttcagtaacggatccaaaagatttgagattgggatttgatgtgcatttgatagctattgcattgcaagtaagaatagatagttgatactatttcctatatcagcatgagtcttcttctatttcttgctctctgaattcaattaacttgatctgcttctgaatgtaggcaattttcggtgtatcccttcgaagtattgttcatatatgggtcatgagcaagaaggggcctctgtatgttgcaatgtttaagccaattggaataatctttgcggtcatcatgggaattgcgtttcttggtgactctatctatcttggaaggtatacgtttctttcatgtgtcttattcataagaaaaaagggaggcgtgtccacttatggacttattaagagtaacatttgtgttggcgtgtgaataaatgcaatttgaaaaatactttagtctaaggaatataattatgaaaggggaccttttgtttgcgtgtgtgaatgcaatttaaaaaatactatagtcttagaaggaaaatacaattatgtaagtatggctttgtttatgtacagtgttcttggagcagccatagt

SEQ ID NO: 3212 - DNA, 410 bp, Glycine max
catttctgctgtacaaggagcaccatatacggagtcgaaccattgcctacccctgaagagatagaggaaaaatcaaggccgtacacatgcttggatgctgtaacttgtcgatgttgttgatggtttttgtacaagtagaagtctttccgtctagtagtttaatcgtgaaaactcagaagtatgtcgatgtacccttttgctttagatgggtaggtgttatctttaggcaatttgcttcatgacatcttctgttcttcattttttccctaaattttggaggtagagttccaagttagatgtacagttgcagtgctattgtgttgttttgtttttactgtttagtctgtagacctggatatccagctattatcaaaccgactactgcctggaacgctagagacagagaataa

SEQ ID NO: 3213 - DNA, 359 bp, Glycine max
tacaagcctcgccgcgtcttcccccacgcgctcccctccacgccgtcctctctactatgttcagtctccctcacgagactctcacgacggcgagaaaaccgcaacgacgtcgtttcactcaacgcccgttctcagcccctctgcctctcctcctcactcgcgccactcctcctccacgcgcttctccaagaaagaccatagccacagcctcaagccgtggaagcaaatcgatgttattgaagaagaagggcttcttcaaggggatgatcaccataacgggcttccacgtcggtgctactttctcgcgttcgttgttgggtttttggttctcttctccttcttctcgcttatcctttgag

SEQ ID NO: 3214 - DNA, 365 bp, Glycine max
gaagatgacgacgacgtcgtttccgacgacgaagcacagaaacagatcgaggaaacgatgcaggagaccaaggccgctttggagaaaatcgtgaacgttaggttaagcgctgcgcaaccgaagaatgttccgaagcagaactccgatgcgaagtatataaagtacaaaccctcgcagcaatccgatgcgttcaattcgggtgctaaggagagggttattaggatggttgagatgccggtggatccgcttgagcctccgaagttcaagcacaagcgtgttccaaaggcttcggggtctccgccggtgccggtgatgcactccccgccgaggccggtgacggtgaaggaccagcaggattggaagat

SEQ ID NO: 3215 - DNA, 362 bp, Glycine max
cgttgcctcttctagctaagcatagaataaattgcattcgaactgccatcaaaagaaacatggatgtccaaaattatgcctattcaaagcaaatgctggaactactattgtctaaagcacctccaagcaagcaggatgaatttagaagcctgattgacctgtgtgttcagaggggtttgactaacaagtccattgatcctttggaagatccctcgcaattctgttctgccaccttaagcaggttgtcaaccattggatacgatgtctgtgatctctgcggagccaaattttcagctgtgactgtgcctggatgcatcgtctgcggaatgggaagcatcaagagatcagatgcactagcagga

SEQ ID NO: 3216 - DNA, 503 bp, Glycine max
gttggagatgttggacatgtaagcatagattaacaagatatttttatgtatttgaatcacattagctaaaccttattttaattttgaacattatgtatccactataaaataaatatatctttgtacaggtttggagcaatggaaaattttggaatgccagacatcgtgtaatatgcaaggaaacgggtactcgttattcatttggtgcatttatgttatcaccaagggatggtaatgttgaggccccaaaaaaattggtggaagttgaccatgtacaacgctatcgaccatttaagtacgaagatttgagggatttcagaatcaccacaggaaagagggatggcgaagtccttgatcaatatcgcatttgttagtcattttatgcatcgaaatacatcgccaatagaactttattttgaaaaataagttggcgataaaataaatgttgcatccattctaaataatttaaatagtttggtgtccttgttcgttcatgaatccta

SEQ ID NO: 3217 - DNA, 360 bp, Glycine max
gttgcatgatgaagaccagaacctttggaaaacattacagattttgatttcgaatttacatattggcataaaaaacaaaagaactatttctagcaatggtataaagtaatgacatctcaaaattcagccggcattctcaaccaaaaccatgtataacatagtataaatatcaacaagtcaattaccatagtaactcaactgtaattaattcataacttgaaaaatcaatgaatcttttaaggagtacacaaccttgctactgcatgctgctcaccttgccaaacaccgacaatatctttgagagctggtcttaagtcctccaatatcttctggtattctaatgtatcaccgctggacttc

SEQ ID NO: 3218 - DNA, 737 bp, Glycine max
caatcaaatgtggcagaatgagtctcatggtattgttaatcacccttctgagcaagggatccctgtcatgattacatggaactatggtggtaacaatgtggctgtggagggatcttgggataactggacatctaggtgagattcaacgactcccttttttggtaacaatagtgctggattgtattttttgacataaaaagttatcataactgcaaatagtctacaatagtaaaatgagattagtaccagtaaattttattacatgcaggaaggcattacagcgagctggcaaggatcactcattccttatagtccttccaccaggtatatatcattacaggttcattgctgatggtgaagagagatttatcccagagctacctaatgtagctgatgagatggggcatgtctgcaatcttcttgatgttaatgtatgcatcatcctatttgtttctttctctttatgaaaacaacatcattttgtgagcatatttccatcatgaagtttgttctgctgtgtatttaatcatcccatttagtgattgataaaccttccatttaatgatttgaatgttattgtgttctgcaggattatgtgccagaaaaccccgatggtgtgtctgagtttgaagcaccaccctcccccgaatccagttatggccaagcatttccagctgaagaagactttgcaaaagagccaatggctgttccttcgcaactgcatcttactgtcctag

SEQ ID NO: 3219 - DNA, 378 bp, Glycine max
  misc_feature (347)..(349): n is a, c, g, or t
aaagccaccaccaccaccatctttactctttactctttactctgccccgaaagtcacatttttcttttcttttctttttctctgaaagatctgtgattattattattattattattatttctgatttttgtgggaaaatggctgactgggcaccggtgttgatcggggtggtgctgttcgtgctgctccaaccggggctgcttttttcctttccgggaaacgggaagcagctagagtttgggagcatgaagaccaacggcaaggccattttcatccacactctcatcttcttcgccctctactccatcctcatcctcgccgttaaagtccacatctacaccggcaannnaaaatgtttgttgaataaattgaaataaa

SEQ ID NO: 3220 - DNA, 140 bp, Glycine max
aggtaaaaacccttgaagatgaaaagattgcactgttggatcagcttattgtaatggaaggccttgttgatccaacggagaagcactcttagtgtttgcaactatgttaacactctgtatgtcatttcatctcctgattt

SEQ ID NO: 3221 - DNA, 1029 bp, Glycine max
  misc_feature (52)..(56): n is a, c, g, or t
  misc_feature (58)..(58): n is a, c, g, or t
  misc_feature (995)..(995): n is a, c, g, or t
  misc_feature (997)..(1000): n is a, c, g, or t
  misc_feature (1025)..(1026): n is a, c, g, or t
atgtttgatcccttttgacacttgcagagtcacatattgagtcagtcatccnnnnnanatttattgaagccgtgcagaggtgcttccttagttcctagcccttgtgtattatctcctttatttgctcaattttgtattttatccaattttaacttgacttatatatgcgccagctgtcccgatccaagctcccaagctgctctgaagctcgtctgtgatctttatgctctggatagaatatggaatgacattggaacctaccgaaatgttgactatgtggctcccaacaaagccaaggtataataatccttgaaataaaattagtactccaatatgttgaaaataaattaatgcgcaattgagtacaaaaattaattagctgtttctagtttttcctaacagctcacagaaacccttaattaccaatgggttaatagctgatactggggggccgttctaagaaactgagaatgactagtgataacctaaatgagatggtactaggtctgcctgggacaattatgatggctggctttcatattaatttgcataactttggtagtagtttggttagataccatgaatgacatttttatccaagggacaatgtcactcattatttggctacgtaagcacttctttttgaacttcatttctcacccatcagaaaatttaagattattatatatattaaggaaaacatgatttaagatttatgataatttcatatccatacattgattttccctcaataaaacatatattatcgattatgagcatgagttggcttttgaaaatcttggttttggcaatcggtttttaaccttatgaagataacagtagtacagagtttatctgagatgaggatggatacgcttggaccttgcccttttttacatcataatgttattattgttgtatattgaagtttttccatttcacaggcaatccacaagctcgcggagtatcttagtttccaagtgaggaatattgcnannnnacttgttgatgcatttgatcttccnngat

SEQ ID NO: 3222 - DNA, 442 bp, Glycine max
  misc_feature (434)..(439): n is a, c, g, or t
ctgggtttcgctccgaagcatgggtggcggtcccagaacctttcccggcggtgtgaacaagtggaagtggaagcgcatgcacgagaagctcgccagagacaaacagaacagactcatccaacaagagaagcagctctacccagctcgcattcgctcccacatccgctcctccctctcccccgaccaccgctccgccgctgccgccactcaccgccctctctcccccaacgaccacttcaaagccctcgccgaccgcttcgtcaaagacggcgccgaagacctctggaacaaccacgacggtcctctaactccaaacccgacaacaccgaaccttgatttttgccccaagcacaccaggggttaccgtgctgttcccgaggttgggaacagtcgtgttggggcccacaaatataggttttggagaaagggtaggnnnnnnatt

SEQ ID NO: 3223 - DNA, 1094 bp, Glycine max
  misc_feature (717)..(718): n is a, c, g, or t
  misc_feature (1085)..(1090): n is a, c, g, or t
tgagttattgcttttagttagcttttatatttgaattcccacgattagtatcagattcttcattatatgataatcgtatttttttttatttgaagaatttctagtttcagtttgcaaatgcctgttagagtttgtggaatatctggtgtcctgtccacttctaacatataggtcatgccactcttgaagcatatttcatgcatgcttgatgcttataaaaatattgttttgacattttcaaatacatactttaccgttacattttcatttccttttgcctttatcttttctggtttcgtttagggaaaattgcattctgctttaatttggccttttagctaatcaccacccacacttttaagtttgactattaaatgcttgaactttaatatatctcccaataaacatttctattcaacttctccttccaatcatacactgaaaaaattgtgcacagtggaagttcaacagaatcacctactggataacttgtcaaagttcaattctttagctataattcatatccgtatcaatgaaatgtgttttgtgacaacagggcaagttggagctatacgattggggatcagcaaggctttgcaaaactgggaaccagatttgcggcctgcacttagaaatggtatagcctttttgccttttttctccattgatttcctttgatacaatgttttttttccatatcaatttctcttatgaaanncttgattaatcatttctcatatcaaacctccctagtggggattcatgttaattagtcctttacttgtggctggattttatatgtgccgtgctatgatgatttaataagctagtttttcttgaatcttgatcagctggtttcctgacaagggactcacgagtggtagaaaggaaaaagccaggaaaggccaaagcaagaaaaagtttccaatgggtcaagcgttgatactacgagcatcctttttctggacagccatttttgtatggaatattaggatttctcaataacatcttgaaatttgtctgtcttgtaatgcatcacctgtgatgtaatcaacattgaatttcaatgactcaactgtagaaannnnnncacg

SEQ ID NO: 3224 - DNA, 990 bp, Glycine max
  misc_feature (934)..(935): n is a, c, g, or t
cttctgtctggggcgtcatgggggtggtggtccagatctagcaccaaatggacggggtgttcactatggtggtcagctacctgtagatgcagtttccagacctggacctgagacagtacctctacctccagatgcttcaagtactctatatgttgaaggtctcccttctgatagcaccagaagggaagtagctcgtatccttttcattttgatgcaatgcttaggaatttcatcttgctttttatctatttctgagtttcattgatattagttcagttattcatatcatattccttaacatcaccttagatatttttcgcccttttgttgggtatagagaagttagacttgtgagcaaagaatccaaacatgtaagtttactgtttgtgccagatgcctgcttgtccttttttggttatttagttgattggtcaaaagttgtagtgtcctctttgtgctgaaatgcttgttcattgcagcgtggtggagatcctcattacctttgttttgtggactttgcaaatccagcttgtgcagcaactgctatgagtgccttgcaaggtatatagttacctgctgatataaaaggaaattaattctgttttggtttcccttcctaaatcatataactgcaccacttcaaaatgagataaaatgtagatgattgttatgaaatagagaatgctttctagcagcatttggtgtgcaaatagaaccgaatgggaacattctgttctatattctcatttgttccttccccttttagtgaaaccaaaatccatcacatcaaaatgcatcacttttcaacctcatcctgtctggtttatatctgaaatgcatgcattttagtggaaccgaatttcaaactcattcttgttctgtttattttcaaaatgcaccaaagacaacccatgctatattttatagcctgttnnatcacacctatcaaacactaccttggtgtttgctgacaatgttggtggtggtgca

SEQ ID NO: 3225 - DNA, 739 bp, Glycine max
gcagctcagtccagaaaggggaggattactttctaattaagactgattgtcaacgagtgcctgggaactcttcatcttccttttctgtatatgcggtatttttcaacttttctgtttcagattatattttcacctctagaaatgcatgatatatcatatatatagtaagttatagtttggagattgctgattgtttaatctgcttgttttcatggaaattttgctttactttttactcttggcatgtggcaacagccttttcagactaaaatgaatgtccttttggatggaagcacagtatcctataagatggccactcatttcttctggttaacaggtttttgatgggcataatggaaatgctgctgccatttttactagggagcatttgttaaatcatgtgttgggtgctcttcctcgagggcttggacgagatgagtggttacaagctttaccaagggcactggttgctggctttgttaagactgacaaggaatttcagagcagaggtgtgaactttagcttttattcttgtgtcttttggggatagagaagttattcatattgggagggtggaaatacagaactggaggatcaggattcaggaatttattttttctctcttcttattactgattgtatgagtcctcatctggttttgtccaggagaaacttctggaaccacagccacattcgtaatagtggataggtggactgtgactgttgcatcagttggaga

SEQ ID NO: 3226 - DNA, 528 bp, Glycine max
  misc_feature (364)..(369): n is a, c, g, or t
  misc_feature (379)..(379): n is a, c, g, or t
  misc_feature (410)..(411): n is a, c, g, or t
agttgccattaatgcagtgtgatggtgcttaatacttcttgagttgaagtgaaaattaagttaatggtcaattagctagcattagtaaatgttagtgtgtgctcatgtatgtactttttttatatgaagctgttatatatatttattaatcactatagttttgtgaagcaaagtgggagtgagctggcttggtagatcaattgttcctatgtttggtatgtgttgtgtagtgggagtataaaaatggtccattagtcacgggctcttcttattagacattggatctacatattttgaagttattgaaagtctcagagccaattatctgtatctgtgtgtcggtgtcacagtgtatggttctaannnnnnagtatagtancagaaataccatcattggtaaatagcattannatttgagtctaacctcttttccccatgcagttttctcttcatatccacagctaataacatgaatggcctctttgatcagcattgagggatcagcagattcaggaagccctccattct

SEQ ID NO: 3227 - DNA, 399 bp, Glycine max
gatagagtgatagtgtatgtttggaaaatagttcgttccaacgcaaacatacattatattcaacgaaacactggtgttgcttctccgttttctctcttgaaatgtgcaaataaacgtttttggtgattcatatggtaatccaaacacactatgcatcagtggattaggctttgcactccacttctcccacatttgtcatcaatgatgacagtacattctaactgcgtccaatagtctcaggtgggtttggaggaggcaaaaacagctccatagtcatttttatgtatcaaccaaactcccaacttgtcagggactcagaaaccttcggtaagcgcaaaagttcgaccagataaactgggaggcaatgcacttacagcgtgttgaatttcctctactgtg

SEQ ID NO: 3228 - DNA, 435 bp, Glycine max
  misc_feature (398)..(401): n is a, c, g, or t
  misc_feature (404)..(407): n is a, c, g, or t
  misc_feature (412)..(413): n is a, c, g, or t
  misc_feature (419)..(419): n is a, c, g, or t
actggctctcagcaattttggagtggaagtccagagaatcgtgatatcagcattatctttctccatgttaatattgagaccaatgatttctctgatgtagagagtggctagaaagtttggtgggtatgacttttagcagtgtcttggatgcagatttttttcgtagttgtaccattccaagcatgctgtctggttaatttaggtagagcgatttcaagtgtagataaatttgattctattgtctgattctgtgtatacatacatatgtcaaatcttgttcttactataaataaaataagaaccatgtatacattcaaggctagctaatgtataaacattcatgtgtactcttttatttatgaatgatatatcctcctgaatacataccctagtttagnnnnacnnnnagaannttttantattattatcattatt

SEQ ID NO: 3229 - DNA, 435 bp, Glycine max
actatgatcctctcgctcctctttgcctcttctcttccaatgcagctgcctcatttaacatatcagccgcatccttgtgcatgtccagttttgcaagagcaactgattgcatgtagaaagccgtgggccaatctggataaacgcactgtgcttgcattgcatctcgtagcgcaggatctggttgatcacataacagatagcatagactgcgccttgcaaacacagttggggagaccattgttccaacatcaataaactgcatgaataacaatgcagaagcatctcaaaataattggcgtgcacatagcaaagctacaatagtttacaatgtcaaacaagtgcagaattgcacctgggaatagttatcaatggctgtcctaaagtccttgtcacggaatgcatggtctccgcgcttccttgcttccagcatatctc

SEQ ID NO: 3230 - DNA, 399 bp, Glycine max
ctcatgttttgtttgcaatttgcttagtcaacttgttggtatcatcagagctttgtgaaacataaagttaaagcagggcatattgcagagggagcaaaccgaatatttcaaaacttgttctactttttattatcactgttgcatttatttcagatatttagtatttgcctacaagtttgttctttagtttaaacacagacaagacgactctttatggcggctataaccaatttgaacttttcttccttgtgtaaaaaaaggttttgtgtgcgtttgtgcgtgttggagttggctttttgaagtgggtgcatgctgaagttatatgtgtatgtgaaagatgaagaacaatagagataaagaaaagggtaacgacgttgaccagagttacagacagcatca

SEQ ID NO: 3231 - DNA, 300 bp, Glycine max
tcccaatatgtgaattttggtgtcagcaatcacaatccttgtctttgatgcattctcaattgcgaactttgttttaccacctttaccagataaccttccaatagcacgagacaagtgatcgcctcgaagagttttaacatccttgatctcaaaggactcgatgtagagctcatccaaacgcaaaagagcaatggcatctatgacatcaaaacccagcatgaaagcatggacaaaatcagcacatttttgcaggttactaatatcaggtgtatcaggccttgtcttcagctccactctacg

SEQ ID NO: 3232 - DNA, 527 bp, Glycine max
ttgctcagttcatggcccttgatggccttatagatggcaaattgaaggtaaggaaccaaaaaaaaaaattcattgtgaactattagtattgtgcatctttgaattttctatgaacattttactagctgcccaaaactcataagctttgcatgacatctatgcagtggaggccaatagttcttccggatcgttatatcgaccatggatcacctgctgaccaattgtctttagccggtcttacaccatctcacatagcagcaacagtgttcaacatactaggacaaacaagagaggcactagaggtcatgtcttagaaatattaaggggttcaatttttcactttacacgatgtacaatgcataacatgattcaccacgtgtaatataatatgaaaaagtaatgtaatactgtgaaattttgaagtatatgatgcaggtcgtcatatggtaaaacaactagttataaaggagaaaaatctgaacttttatgtaagtgcaaaaaaataccctttctgacatggtctaaac

SEQ ID NO: 3233 - DNA, 408 bp, Glycine max
tgacaagatcagtgaagtagagggtctgcaccgccttttgaaactaagtatcctggatctctcttttaacaaaatttcaacagccaaatgtctaggccaacttgcagccaactacaatactttgcaagctatcaacttggatgggaatccagcccagaaaaatgttggagatgaacatatgaagaaatatctacaaggccttcttccccatcttgtctactataatcggcagcctatgaaagtgagctctttgaaggatggagcagaacgttcagttcggttaggaatgaattcccatcagtttgatcgcggccttagagcggatcgcaagaccacaaggaagggcagccaaggtgttgcagccacacggaggccatcaatcgcgtctactcatgctcgcagaagtgt

SEQ ID NO: 3234 - DNA, 319 bp, Glycine max
  misc_feature (261)..(261): n is a, c, g, or t
  misc_feature (263)..(265): n is a, c, g, or t
catgctctttcattctcaattgaaattcccccaaagccaccttcttttgattcaataaatcaacacccaattttcaaaattccaacttgtaatcaatttttctttccatttgacacaccataccaatcaaccaaccttgttgcttcttgtgatcactcctgaaccacactaatggatattgatgagtgggagtttctctctgatgatggctaccttgatttcaatgaagagggtgggaagcaaaagcaaaagcagaattcnannngaaaattggactccgagggcatctttgacatggactactttgctcatcaccacc

SEQ ID NO: 3235 - DNA, 341 bp, Glycine max
  misc_feature (315)..(315): n is a, c, g, or t
  misc_feature (330)..(330): n is a, c, g, or t
  misc_feature (334)..(334): n is a, c, g, or t
ttaaaatgtttggattgatttcttatttcttgacttgtaatatatttttgttaaatactataataaacaattcttttaaatatattgagttgttttactaaccatgatatgtttgttggctacacaagtgcaggctgaacttggaaagccaagcttgttgcaacctgacaaaggaaaagtctctatatatgttgattgcagttcaacagcagagccagcttttgaggttgcatattctattgattttcttcattctatttgtttaatgaagtcatccatgtattttggctttcttcatgttattaactttaactnttttaagtaccatgnacantgatagc

SEQ ID NO: 3236 - DNA, 354 bp, Glycine max
agatccacaattagaaaatcaagttcaccccagtagacatcttttagaaactgcttgataagtccatttttgcgaggacctctccatataacagcttcatctggattgggaagcatgaacccaactgacatgaccccaaggttggactccacatagacaggggaccaaccaaggttgctctgatgtatctcttgaccttctaggccaagcatctttggaatgcttggaccacagatatcaacgtcaagaagacctacctgaaaatcccttgctgctaaagcaaatgccagctgggcagagaacgtgctcttgccaactcccccttttcctgataagaccaatatcttatgtttc

SEQ ID NO: 3237 - DNA, 411 bp, Glycine max
tttctctctttcacttatttattgactccccaaaagcttttcaaatatctctgttcctctctcacgtaccttctccctatctttcactccacttcttaacaccacaaaacagaacaacggccgagcaaacaacaagaaaaatggtgttgttgtccaaagcaacaacagaacaatactcctacattaagaactgcatgccaaccaaattttcctcaacaattcccatagtggacctctccaaacctgatgcaaagacccttatagtgaaggcttgtgaggagtttggattcttcaaagtcatcaatcatggtgtctccatggaagctatatccgaattggaatatgaagccttcaaattcttctctatgtcactcaatgaaaaggaaaaagtaggacctcccaatccattta

SEQ ID NO: 3238 - DNA, 622 bp, Glycine max
gccttgtactgggataagaaactgcagttttctcttcaggtcagtaatgcctgtatagcttcaggttatgaactgacatcaaatacttttgagccttctttattatttaacccacattccaatacatatcatagtgtacattgtgagcaagcaggctactagcctactgttattttttcatgttggtttgctaacagctatggatttgtcagggaagaacggcactttgggattccatcttgcttctgtgccataaaattaagatcgggtatggaggtgttattaggggcatgcatttaggcgcttcagctttaagcattctcccggttatggaagcagaatatgaagattaaattttgtatgattgagaaaccactctgcttctatcaacattcagcacgcggactacaacttctgcagtaaatcgcaattcttggagccagacattgcaggtaagaacacgctggagttgaactcctgattttgggtgttgattagaattatgatgtttacaattcccggctcaaccatttaactgtacctgggatattgcactttgtcagaaatgaaatttggatagctcctgaccaaaagatttacagtctctttgtatgcccttcct

SEQ ID NO: 3239 - DNA, 403 bp, Glycine max
cttttggtggaatgccatctattccacccccaccccctgttgcaagtgggacatcgggtttcaacatgggtgctagacctccatcaatgccacctccacaaggttttccttcccaacccatgcagggccatggtgtccgtcttcctcctccacccccaaacatgggacagtaggtcctcaggctttaggacagcaagcatcattggaagtgctaaacaactgtagtagaatgtgtccgttaaggacttaatgctttgtatggtagaggcaaggtttcttaagcaatacaccaaattacctgtacactcttcattgtgccatttttacatttacaaattaagatgttgaagtatcgagatttttggctttggtggtatttatgtctttggagtgaccatgtaaa

SEQ ID NO: 3240 - DNA, 319 bp, Glycine max
ttctctacttgggtgttcaaaatgttggttactgaggacaagtctcatgtcgttgttgccatagacaatgatggctgttgtcaccggagctctgccggcggcgagggtttcgccgacgccggcgaacggtcggatgaggagcaaaggtcctctcatgattctggcaccgagattgtgggagtgtgtgagaaggagagaggatcagagtgttctgtggaggtggatctggttcctgaggttaaggtgcatttggccaatgtggagagggattgtaggatttgccatctcagcatggatatgaccaaccatgaatctggga

SEQ ID NO: 3241 - DNA, 374 bp, Glycine max
  misc_feature (331)..(334): n is a, c, g, or t
tctttcctgggcttatttatacgcatttcccagttctcaatcactgattcagagtcatgagattcccatcaacagttctgactcacttgttcagagttatgagattcccagcaacagttctgactcacttgttcagagttatgatgtgattctaaaacccaatgtttcaatggacacatgcaatgtgtttgaaggaagttgggtgagggatgatagctaccctttgtatgatgcttctcactgcccttttgttgaaaggggtttcaattgccttgctaatgggagaaaagatagagattacacaaaatggaggtggaaacctaagaactgnnnnagagattacacaaaatggaggtggaaacctaagaactgat

SEQ ID NO: 3242 - DNA, 537 bp, Glycine max
  misc_feature (363)..(365): n is a, c, g, or t
  misc_feature (372)..(374): n is a, c, g, or t
  misc_feature (454)..(458): n is a, c, g, or t
  misc_feature (460)..(461): n is a, c, g, or t
  misc_feature (463)..(465): n is a, c, g, or t
  misc_feature (468)..(469): n is a, c, g, or t
  misc_feature (474)..(476): n is a, c, g, or t
  misc_feature (500)..(500): n is a, c, g, or t
  misc_feature (502)..(502): n is a, c, g, or t
  misc_feature (510)..(510): n is a, c, g, or t
  misc_feature (514)..(517): n is a, c, g, or t
ctaagcaatccgtcagcaatggtaataaagaaccagttgatgttcttacagtaggctcaatgcaggtcaaagttaatgggtttccttcgtcttctggtttcttgaaggttggcagtaccccatttgatgcaagagcattgcaaccgggaaaaggagatgctgccgttaaaagtggatcacaacgttaaattttgctttgctttgcatttgaggcacatctgattttagtcttcttttggtagatggattaattgtttgcccaattgtattaaactgttgggaagttgagcttctttttgatctttttgttttcatttactaatgatgctttggtacaaggctgttatatcgtgggtgtttagnnncttaccnnngtgtgattcacttttaacagaaagaacaccttttcccggttgcaatgccattgcatcttgtgggatactgccaacttcannnnncnnannncanncaaannnttaacttttactgcattgagcctncngaagaaantccnnnnttctttattaccattgctga

SEQ ID NO: 3243 - DNA, 341 bp, Glycine max
ggtgacccaggttagagtgaagtttctggatgatcagaaccgtcacatcatgaggaatgttaaaggaccagtgagagaaggagacattctcaccctactcgagtctgaaagggaagctagaaggttgcgctaagagggtctttctttcttgatctttatggtagttagtcggtgctaaaggttatagcaccctatcttgtcttggatctattttcattcgaattatggcttgagttttgcatgttttgagtctaagcttcaaggttgaagtatgttttggcttaatatatgattttaattatggcttgagttttggattaatatgatttggcttctatata

SEQ ID NO: 3244 - DNA, 412 bp, Glycine max
ttatagtattttgttggtacaaatggcatctttgtaacaactccttcattagactttcctcgaataataatctttactttggtgcctgccttgtgcaatcctgatttcacatatccaatggctatgttcttcttgaggcaaggactgaatccgccacttgaaacttccccaatgttgtttcctccttcatcttgaatctcactgtggcttctgggaggagggccagaagaaaagaaaccaacacgcctgatcttaggaccttcttcaagctgttttagtataacatcagcccctagaaaacccccttcagctctccttctcttccctatggcccatgtgagtcctgcctcaataggtgtaatgtgctgttccaagtcattgccatataaacacaatccagcttcaagtcgta

SEQ ID NO: 3245 - DNA, 505 bp, Glycine max
gggtctccgcttctcctctggctcggcacctcactcctcttccctcaacggctctcactgttcaggcaagtcttcaacttttcctcaccctttcaatattctgggcgaaacacgacatgggtcgtttcccttttcatcgaatgcgaattttcccatgatgggttcgattcctctgttttcaggttcagcaagaactggctgcaagaacgtggggttctccgcaaccgggaagagtcagttttcggagattgcgagtggaagcgacgatcgcgaagagtctcttggtcggattctgaaatggccaaacttgaaggtgtttagttttgaggagctgatttctgcctcaaggcgtttcaggtatgacatacaggggttagtgatcggtaaaggttgttttggcccagtttacaagggatgtttggatgagaatacccttacccctgccaaagtaggctatggaatggccgttgcgatcaaaatgtttaaccaagattacttccgaggg

SEQ ID NO: 3246 - DNA, 778 bp, Glycine max
ctcaaagcagcgtaaatcaaaatccttggaatcccttttgattccctcacttcagttttcaccttattcatctcaaagatttctcctttctctcctttcctctctctttcgccttctgggtgttttcaaaacgcgcttaaaaccgtgatgggtgccgtcgtcgagtgttacccacagccgcgcacggcggtgctgtccctgaacaccttgccgttagggttccgtttccgtcccaccgatgaggagcttattgactactacctccgctcgaagatcaacggaaatggtgatgatgtttgggttattcgtgagattgatgtctgcaaatgggagccttgggacttgcctggtataaaatacttcttctctttggaaatttgatttcggttttttgtgtaattgggaaagttttagtcttttgctttactaatcatcttttgggtgctgttgatggattggttcttcttttttatcttgatttttcttttgagctaaacttaagtactgttaatctgttattgttgttctataatcaaaatcagcatttttatcttgttgattaatggagattataaaaaagtgttggttttaattggagatcagatatctatggtagtgtatttaagttttatccttgttttggggcgaaaggggtagtttggaattgttggatatggaattagtggtagtaaacattgatgtggaaggtggctatgctgtttgatttgcttatttttttttatatttttccttgttgggtttggtgggggttgggggt

SEQ ID NO: 3247 - DNA, 309 bp, Glycine max
ccacactcgcgtgtggtcattgggcagcacgttgctctcgctcccgtcttcgccgcccacgaagaagcagaagaagcgggccgaggcccaggtccagcccgttggagtccagattcagcggcggtgcagtcactgccaggtgcagaagacgccgcagtggaggaccggcccactgggcgccaaaaccctttgcaacgcgtgcggggttcggtacaagtcaggtcggttattttcggagtatagaccggcgtgtagtcccaccttctgcagcgatattcactccaatagtcaccgtaaagtgttagagat

SEQ ID NO: 3248 - DNA, 417 bp, Glycine max
aattacaccttcaaaccaccgtcttctctcgctccccagccccaatgctccaatttccctccctccaagcccaaccagaaaaagcccaagcccaggtatcggcccccctcctccctcgaccaggccggccgcaagcccgtccggtccaacgacctgcccttcgacttccggttcagctacacggagagcagtgccaaggtgcgacccatcgggctcagggagcccaagtactcccccttcggaccgggccgggtcgaccgcaagtggaccggagtgtgcgcccccgcggtggaccccacggtggagagcctggagggtccggaggaccctaagttggaggaacagaggaagaagaagagagagatgattcaaggaaaaccgctttctagtgaagagagaaagacattggtttcgcaa

SEQ ID NO: 3249 - DNA, 382 bp, Glycine max
tgaaaccttgctgatcctcatcatgggaaccatttttcctcctcactctctctctccactcctcaacatcaaaccttcaccctcaagaattctcttggctccctctccccaacccaagtcaaattctctcttttgctccaaacccattgtttcaagtctcagaaagaaccaaacttcatctcccaaaccttcatcgggcacaagctggttggctcatgctcaacagggcctagcagctttggctatctccttggcactcaactttagcccagttttgtttaatggcaatgcattggcatctgagtttgatgtgcttaatgagggtccacccaaagattcttatgtgtttgatgatgcaggagtgcttagtagggtgaccagg

SEQ ID NO: 3250 - DNA, 373 bp, Glycine max
cttagcatcacctttggcatctgctatcactggtactgttctatatgttgacaatggtctgaatgctatgggtgttggagttgacagtccaatatttaaagatcttaacattcccaaggaccagcattaagtggtagctaccccacaaaagctagtgtcaccggaattagcatagcaatggagatatttttgtttcactgtagccatcctcaaattctgcggctcctaccttcttcccaacaagacagtgcaggatccactttgagcatttactttgctttttgtaggctatttttcagtgtttccggcagacttttaaatatttctttttgcaatgtactcagaagtgcaggccatatgattatgaatatga

SEQ ID NO: 3251 - DNA, 814 bp, Glycine max
  misc_feature (51)..(51): n is a, c, g, or t
atactacttctcttttggttgttttctgaatttcacaatgataaggtggtngtttatgctatttcttttttcatatttgttaatttcacagctaaaatacccatccgcacttgcatcttttgatcaaatcatgaactatgcaaaagggaaaagaattgcgctgtttatggattatgatggaactctttcaccaattgtggataatcctgactgtgctttcatgtccgacaatgtatgtggtactctccttgggtttactatccataacatcaattgggttttattcttttctcatttttctttggctaattacaatcctgtcaacactgtagatgcgtgctgctgttaaaaaggtggcagaatattttccaacagcaataattagtggaagaagccgtgataaggtagttgaacaatttttataaaaaacagacaattttctatctctttttaattcccttatctatctgagcaccactgcatacactcctgctttcaagaagcttccttgtcagttgctcgttctaactttcgaattacccctgttggctcaggtatatcaatttgtaggactaacagaactctattatgctggtagtcatggaatggacatcattgggcctgttagacaatctgtatctgataatcacccaaattgcattaggtctacagacaagcaggtactgggagttgaaagtttctatctgtgatctgttttatgaatatctctctcactttctgttctctttcttgaattattttattaaatggcttctgttattatctttaaatttacagggtaaggaagtaaatt

SEQ ID NO: 3252 - DNA, 441 bp, Glycine max
  misc_feature (169)..(169): n is a, c, g, or t
  misc_feature (180)..(181): n is a, c, g, or t
  misc_feature (199)..(199): n is a, c, g, or t
  misc_feature (207)..(207): n is a, c, g, or t
  misc_feature (210)..(210): n is a, c, g, or t
  misc_feature (212)..(212): n is a, c, g, or t
  misc_feature (216)..(216): n is a, c, g, or t
  misc_feature (221)..(223): n is a, c, g, or t
  misc_feature (232)..(232): n is a, c, g, or t
  misc_feature (235)..(236): n is a, c, g, or t
  misc_feature (238)..(238): n is a, c, g, or t
  misc_feature (241)..(241): n is a, c, g, or t
  misc_feature (244)..(244): n is a, c, g, or t
  misc_feature (254)..(256): n is a, c, g, or t
  misc_feature (260)..(261): n is a, c, g, or t
  misc_feature (266)..(269): n is a, c, g, or t
  misc_feature (271)..(271): n is a, c, g, or t
  misc_feature (274)..(274): n is a, c, g, or t
  misc_feature (276)..(276): n is a, c, g, or t
  misc_feature (278)..(279): n is a, c, g, or t
  misc_feature (284)..(285): n is a, c, g, or t
  misc_feature (297)..(297): n is a, c, g, or t
  misc_feature (299)..(299): n is a, c, g, or t
  misc_feature (302)..(302): n is a, c, g, or t
  misc_feature (318)..(318): n is a, c, g, or t
  misc_feature (320)..(320): n is a, c, g, or t
  misc_feature (322)..(323): n is a, c, g, or t
  misc_feature (332)..(333): n is a, c, g, or t
  misc_feature (362)..(362): n is a, c, g, or t
ctctttttaatgcagctcacatggtagtcatgttcacaagtttgaagtgttccaacatcgtccatattcttgtactcttcctgtaatctcaataaaaactcgtaagcacccgattaatgctatccaaagacatctatctaaaatatttattatgaatggaagaatacanacctaacatanntattacgcaccttccttngttttctnttngntcanatgannnatatattgnttnngncanacntttggaaagnnnatcnncagannnncntgngntnncatanncaatcctctcancnagngcaagtagttcatggncnanncagtcatcnnaataattaaaaaattttagtacataatantgataatattaattgcaacgctagaaacagtaataaattaataatcacctcataactcatgttatctacatccatcctc

SEQ ID NO: 3253 - DNA, 684 bp, Glycine max
agaactggctctgttgtccccaaattcaagtccacaccaccaccttctctgcctctctctccccctcccatttctccttcttcctacttttctattcctcctggtttgagccctgctgagcttcttgactcacctgttctccttaactcttccaacgtgagtttcaactctttatcttcttaaattgttttgttgttttgagtttggttgtttagaaaacttttaacaaaggaaaatggaagagttttgtagttttaggtggttctggtatcgttaaaaggagacaatcctgttggagttcttataagattattactatatgttgtatgagagagttttatggtttagttttttttcctttcttttttacttttttcaaatttggtaattgactatgacttgagttgacttgatagtttcatcatgcaagagatttgttcaatggtttgaatgttgaaacaagggaattacttacttttggagtttgaacatgcttcgcttgagatttttttttggtactttgttctgtcttgtatataggtttgtgtttcttgtctcaccgacttgctttttgttgttattgaattaatgggtttgtgtttgtaaatattcagattctgccatctccaacaactggagcatttgttgctcggagcttcaattggaagagcagttccgggggga

SEQ ID NO: 3254 - DNA, 398 bp, Glycine max
actcatttgcatcaacggaaggtgcaacgacgaccgcgacgtcggaacccacatctgcggcggcggaatgccgccaaatccgccaccaagcggcggaagctgccagtcctcgggaaccctaaattgcggcggaaaatcgtatcctcagtaccgttgctctccgccggtaacttcctcgacgccggcgatcctgacgctgaacgacttcagcgaaggcggcgacggaggggacccgtcgcagtgcgacgagaagttccataacaacacggagcgtgtggtggcactctccacggggtggttcaacggcagttcgctgtgtttgaaaatgataaggatcacggcggggaacgggaggaacgtgacggcgaaagtggtggaccagtgcgactctgttaacg

SEQ ID NO: 3255 - DNA, 471 bp, Glycine max
gctctttctgtttgtatactaccaggaacctccaatcctcttcctctttactggtacctttaccttcctctttcgtccactttaatttctctctctgtctataatggggatgcgttattattttaatgaaatcaggaaagaagcatgttaaatcgggcatacccagatgaaaatctcggaggagcggcacgcgaagccaaacggagacttgatcagaagttcatggcacatatcaaatcagaaagccacaaaagaaaaggcctttttcatggtttgtggcgccaactcagatcttagtcttagggaatctagaagaagatcaaaatgataaatcctagaacagtaactggccttttattcttttttcttgttctgtaacgaaattatttattttcattagtcaaaagaaacagagatatgtgaaaactaaacatcctttgatctttttgtcgattgaggaccaaatcaagt

SEQ ID NO: 3256 - DNA, 523 bp, Glycine max
aagagaagggttggccgaagcattgcccacttgaacttcaagcagctccaatctccgctccaacacatccagcttctcatttaaagacgccaacttgctcttcgtcgtagcctctgaaaaaacacgcattaaatgtcaacggggcagaataaaaattcaaactttgaggtgctttcggcgtgattcagtgtgctccagcactcagggatacccaattatgtgaaggacaaagtggtggtgttgcttcatggatagataaaacgacaccgggatgggtcgttctgcagagtgggaaaaggaaatgcgtgtgtaccgaattggacgaggaagtcgaagaggcgacgaacgttgagagaaatgtgagagatgaattcgcggttctcccaatcggcttgcactgcgattcccacgttcactgcgtttgttatccctcctgcgcgagccatttcttcttcttccacgcgtttccagatccaatgctgatgcactctgcagattagaatgcacagtttacttcccacac

SEQ ID NO: 3257 - DNA, 776 bp, Glycine max
  misc_feature (770)..(770): n is a, c, g, or t
  misc_feature (773)..(773): n is a, c, g, or t
ataaatactatggctactttgagcaggaaggaagatggactctcaggaagtcattcttctccaattcgcttaacctatgcagaagatgccttacgaaccatgagtttacctgaaggtgcaaaaactatatcactttgctgaatgcgatttattatattgtgcataagcacagataacaagttaaaaatagaaaaaaattattagaaaagaaagtatttattatactgaaaagataaaagtcattcaatacttgccattttaaagtaatttaaaatatttaatagggtgtatttaatgttgtcataccatgcactcatggatggacacacaatagacagttaatttttaagaatataattatttttggtcttttgtcatcagctgttcatgtcctaatcggatgtgtgcagctaagccagctaggtgagaaattagcatgcattttattttttttgaagtttctccaagtttatttcttcattgttctactgatagatctctcaatactgattttatattttcattcccattccagcatatgcagagattgtattaaacttaccacaggcgcttcagcagacgtatcatcaaaaagcccctgcttagagcttcgccctttgagtagcctagatgcatcagtaaaaattcttggtagagatgttaaatattagataaacaacttcagaattattacctattcacctagccaaattgctcataggttgagttcattttgctgtaatattgtcatatagcatttagcattgtantcngcc

SEQ ID NO: 3258 - DNA, 410 bp, Glycine max
gatagcataacaaaacgcatgatctggaagccaattcccatttgcacttaaatccaccatctgttcagtggataagctacaagatccacagagtctgttgcaacagtaagaagcaactgttggtactactggcttctcaaatctctattcctaaactcaggtgaactgtgatgagcatgatgagatgtcccatagacaaataaaaaggctagatttctttgcttgatttgtttttattctcattagaaattccaagaggtcccaataagtcattccacaacaacattcaccagttcatactcaatgagagacaagttattatcttccttcacagtgaaactagcaggttctgtgacttccacacggccccacttgtccgcagcaagcctcattgatcctttgaacatgtc

SEQ ID NO: 3259 - DNA, 791 bp, Glycine max
  misc_feature (777)..(787): n is a, c, g, or t
attccgaagaattgaaagtaatgagaaacttaccggtactatacaaggacctgttggaggaataatgaccgaatgccaggctgattcacctattgaacatgttcttgctgaggaagatgcggtatgtcataaatttttgttatgtatgggtgtaacctttaactcccttttctgttggttttgttgctccgtctcttggtagatattgtttcactatattccatgtttcaaacagagactttgttgcatactgttttttagtgtaactatcacagttttgatgtgtaaaatacaaattcttacactgaaggatggaatttgtaaatatatgtttgtgtatgcttggcgtgtatggggtattttcacctccacattatggtttgaatgcatgctagataattttaatatagtaactctggcctgacaataatagctgcatcctcagtcactctgaactctgctaatctcaaatttttcatttttggtgttgtactataggaatgttgcatctgcctttcttcttacgatgatggggttgagctaagagaacttccttgtggtcaccattttcactgtgtctgtgtggataaatggctgtatattaatgctacatgccccctctgcaagtataacatcttaaaaagtaacaccctcagtcaagaggaagtgtagaagatcgatgtcagggaagtttttagcagccatgttgaggaatctgcacactttcgattcacagccatgttaatatactttgatacgggcctatacagttgcagnnnnnnnnnnngggg

SEQ ID NO: 3260 - DNA, 527 bp, Glycine max
tagcttttcgtctatacccgagagaggatttcggtaccatttctgtgccgtgtttaatatatgttgtgttttctaatgcaataacatcttatacttataaatttatgcattgtgctgaatgttccaagcttctgataatgtctgacctgaacaggtatttgggacttgggagttatacagctgcaagatgtcattggcaaaaacagtttgggaaagaaatacacttacatgcattgagactacatgtacacagtttcaatatctgacaggcttcttcctagatgagtgtctgttgaaagtttaaatgtatgttccaaatttgatggttgtcatttgaaactgatttgtagtccgtattttcactatagaagtagatgtctcaaatttattggttaccccgttccaatattgttgtggaagaattttataatcgtgatgtgcctggaaaattatctaccacggatttatctgttggttcaattgtttgctggggagagcttctgttgaggacttgaggtaaatgacca

SEQ ID NO: 3261 - DNA, 392 bp, Glycine max
gatctgacctggcgatctcacgacgtcgtctagggagatgttcccgctgtgcttgatgttcttcgtcttcttcctgtccctctcaggctccttcagcgccttgatgacaagcgcggcggcggagggcaccaccgtcaccttcgcctgccggttctgtactgtcagcttcaccgtcacgcggaggcccttccagtccttcgcggtttccttcgcaatgtcttctccgatcttctttggggagagacccaatggaccgatctttggagcgagggaactcgccgcgccgacctcgccgccggtgactcggacgaacacgtccaccacctgcaagggatcgaacttcggtggcatcgcgcaccactggtttttttttttttttttcccttgggggg

SEQ ID NO: 3262 - DNA, 708 bp, Glycine max
agctttgacacagaaggtgaatatattggaagctgttctgatgatggatcagttgtgataaacagtcttttcactgatgagaaattgaagtttgagtaccatcggccgatgaaggcagttgcgttggatccagattatgcaaggaaaatgtctaggagatttgttgctggtggtttggctggtcatttatatttaaattcaaagaaatggttaggataccgtgatcaggtttgtaagaatgttttattacttatcacatatgttctcaacagtatcttttgtttgttaacgataaaattaccccgccctaccctccccaaaaggttttgcactctggtgaaggttcaatacatgctgtgaaatggagagcaagtcttgttgcttgggttaatgatgcaggagtgaaggtttatgatactgccaatgaccagcgtattacatttattgaaaaaccacgggggagcccacgccctgagcttttgcttcctcacctggtttggcaggttagtcaaatatcaatgcaggcatgctgttgacttatgccattctatcatgcagtgtccactgctgtaattgaaggcttgttctatagctttagaactttaacagtggcaagagcattatttcatttattctgtatatctcttgattaaactgtggagcttaatctctttccatcacttgtaggatgacagcctcttagttatt

SEQ ID NO: 3263 - DNA, 620 bp, Glycine max
agagtaataagggagcaagcgagagtgccattcggtgtacagacgaagcaggttacccaaatcgcgaacctaacacaaaaacaattcaatggagagatctaagccaagaaaacaaaccgagcaagttacgctaaataagcacgcttaacgtagagaggaaaaagttacgaataaaaattgttaatggaattaaaaacacagacggtgacgaaaactacacgccgtatgttaaattactagtgaataattgaaagagggaaaattaacctcgtggccaccaccacggtatttgaactcgcgagggaagtagcggaggacgtaaccgagaccctcgtcggagagaagaagctccggtgtgagcttgggctttgttcgggggagtttcttgggcttttcggcggcgaatctgggcttgaaagaagaggaagaaggatttggagtatttggattgggagtggtggcggggttagggttagggttagggttaggattagggttaggattggaattgggagcggagaaagggcaatcccgtgaccagtgaccaggtctgccgcacttgtaacaccctgttgcggttccctccatatttttctctgcaacaacgattcacaactcat

SEQ ID NO: 3264 - DNA, 663 bp, Glycine max
  misc_feature (57)..(59): n is a, c, g, or t
ggtatgtctggcttatgcctgaaggacattaatatcaccccttagatgtatgaatgnnnttgttttaactttggccgtgaaatttgtcaggctgatgacattcagaatgaagcaaatgaacttcttagaatcagagattaccttttcaatgagttggcacagaaaacgggtcaacctgttgagaaggtcagtttacccaacaatgaaataaacagagataaaggagtttgtgtgacttctgttatagtttgaattgaatctcttgactgtaaatttgcttgactaaccaacttcaaagaaagaagaaaactatcttgaaagatcattagcttctcttttcgttgcagttgaagtcaaattcaactttgacatgctgctttaaaaaaggatgtacattttaaacaattgtttctatgcctcttatcagtttttctattccatgtccattttttgaccgtgtatcttaattcctcacagattgagattgtaagttttattgaataggaaactaatttctaatgcatatctttagattactaaagacttgagtaggatgaaacgcttcaacgcacaggaagcccttgaatatggactcattgatcgaattgtcaggccaccccgcattaaggctgatgcaccacgcaaggaagcaggcacaggtct

SEQ ID NO: 3265 - DNA, 370 bp, Glycine max
atcgatgaccccactttcgctcttccgttttggaactgggacaatcccgccggcatgagaatccctcccattttcacagacaaaagttcgcctctctacgacgaacacaggaatagcgatcatgtaaatgctttcatcgacctagactacaagaaggaccattctcctgtgaaacctcctcaaacaattttatggccgccagtggagaaaaagaataactcgatcgtcgacaacttgatcgtcaacaacttgataaaagtttatacggcagttgcaagcaaaaccaactctagcccagactacttcctcgggccagcattcgaagctggttctgcacctcagaaacactttggatctctggaatcttttg

SEQ ID NO: 3266 - DNA, 402 bp, Glycine max
cttggccacccgatattcttggaggatgacgagtcagatttgttgtggcctggtagttttcgtcaagttgccgaggcaggtgatagtcatcagaatttcatactgactggaagttctaatatgagttttactgaggtgaacccacctgtagacatagagaactcaacaccagatttgactttgaaactttgaaggaggttatttggtatagttctggcctcgagttgtctgctttattgttatgttattgtacagtaagacatgcatgcaaggggccatgattaccagattgattcctatactcagttgggtttccttttactttcattttcagttttctctcttaggaatcttgctttgttattttgttttctatgtttctcgttgtataagagctccgga

SEQ ID NO: 3267 - DNA, 871 bp, Glycine max
  misc_feature (216)..(216): n is a, c, g, or t
  misc_feature (247)..(247): n is a, c, g, or t
  misc_feature (249)..(249): n is a, c, g, or t
  misc_feature (252)..(252): n is a, c, g, or t
  misc_feature (256)..(256): n is a, c, g, or t
  misc_feature (446)..(446): n is a, c, g, or t
  misc_feature (866)..(868): n is a, c, g, or t
atattatatttcccttcacaattagctttgatgggtccacatagatcaactttggtttgttggtaaggatgagctgcaccttcttgcttgttagtttttgtaatttcttcaccatagagatcataagaacagattccccaggttccaaaaattgctgcctgtaagacgagcataaattttgacagtttgacaaggaaggtaatgatggacttaagnctctgtacaagagcctttctttttaattttntntanatgntatttttctgcttgtgagtgagaacgaatttttatctctatataagaatgcaacttcttgaaataatccgtaccagggagagaacattaggaaaaatatatccaaacatctatgtaaattaatattatttgatcaaatgagacctcaccgtggctgttattttgtctttatgatgagcaaaggaactgancattataactaacatggtcattccccccttgtgtatcccaaaaagataaacaaatccatacagttctttgaagtgatcatgattggatgcaaaatttaactatccaaaaaaggaaggtttgtaccctccattttgaatcgaaggaatcaattgaagctagcctagttatgcggccggtcccctcggaagatgtagctccatcaggttgtctaaccgaagctgcagatccatccccaatgtgagaaggactccaagatgagtcatgaacatcatcacccacaggcgagtgagtctgcaagtgaaaattacaaaagagttagaaactttatgttcaacaaataacaaggataagaatgaaggttccttttcttatcctccataaataacatttcaaagagcaaagcaatggaagtcataccnnnagt

SEQ ID NO: 3268 - DNA, 637 bp, Glycine max
  misc_feature (603)..(607): n is a, c, g, or t
  misc_feature (611)..(611): n is a, c, g, or t
  misc_feature (614)..(615): n is a, c, g, or t
  misc_feature (624)..(626): n is a, c, g, or t
agttggttagttccattggatttcggacagtggaactgctactgtaaaggtatgaatctataatattactttaattttatactgcatactataacttttatctttgagtaaatagtttactgactaatattgtaaagtgttttacatcatgtataataaatttgttgacttttataataactaccttaaaaattatattaaccatgatttctaattggttgattgtaaaaattaaactcttcatctttttgtttgatggcttataatttgctttgttgcattgtgttttaattaagaaaggttgaccttgaactaaataataaatgttttcctgaatttggttatttttataaaaaattagttagccttgttgtagtactacggaagctataaagaggttatggttgaaattgcattttccgcgtcttgcaattggtgtaagaccaacttgttaaggcctaccaattcagtataattgaaactagggaatggagatattaaaaaaagaaagaaagagacgtggtcttgagatggacaataaaagacatttatttcagtatctgatagccaaaaccccgagtgagtaatgtacttttgtgcaannnnnaatnttnnatacctgtnnngtcaaattata

SEQ ID NO: 3269 - DNA, 534 bp, Glycine max
gcattcaaaatcctccagcaatgttcctgttcatgtatgttgaagctttgctttctgggtatttcaccaaaaaaaaaagtttttttctttctcttaatcttgaacctctatcttttatttcaggcacaagcaacaatttgtgtcagcaaggctttgaagtggtggaagaagaccctaaagcctaatatgattgagatccactcggcacaagaactggtccattctttgctcaacgctggtgattcattggttgtggttgatttctattcacctggttgtggaggctgcaaagcccttcatcctaaggtatgtttgtttttgttttttggtgctagaaaagtcatattcttaaattcttcattttttttctagtttttttctttttgtttgtctgtggttacaatatttgacttggtttcatgtgtgaccagatctgtcaaatagctgaattgcacccaaatgcaatctttcttaaagtcaactacgaggaactgaaaaccatgtgtcacggtttgcgaattcacgtgttaccct

SEQ ID NO: 3270 - DNA, 777 bp, Glycine max
ctgttcgcatcttatgcatactacattacggcaaggcatcctgatttaggcagtggtggcctcaaactcatcaagactggaaactcaacttgcccaaatactattttgcaatattttcccaagtacacccatggcctgccaatgtatttgctcatatctgtaataagcaatttcatcgtctatgaaggtgctcatctatcatttaattatgctttttttaagagtttatctgcttaatccttctggtcttctcaaaacaagtttcattgactcaaacataagtaaattttaattctatttaatgatgccatctaaaaaatacttgttaacaaattgagttttatttttaatagttattttttatgttaagtttcaataaagggtattttaaaaagtaaagaaaaatacctttttgagacaatttgaaagagttaattaatgttattgttttctcttgctaattaatttcgaggtctctagagtttaggaattttttctaaaaaataaatatagattactttgtcactaattaattattctattagtatgttaagccctttgtatgttgatctgtaggtaccccactggctatttttatggcaaagaagccaaattgtgttgaatcgttggttcctgatcctatgaagggatctccggatccaccaagtccattgaatcccccaaactcctctagattgttggtgtttgtggacaattcaatccacaagacatgtgtgggtactgctggtcctgaagctcatccaggcctactaacgt

SEQ ID NO: 3271 - DNA, 660 bp, Glycine max
cgctgatcaagtcctcaaagaacttgaaggcagttttggatttgtgatctatgacaacaaggatggaacagtttttgttgcatctgtaagtctctttcttgatctatacaaaagaaatgtgtggtttggccatgtatacatggtgttattaatttttctaggattgaatattaatttgtttgtttgagcagggttctaatggccagattgggctctactggggtgttgcagctgatggttccatagttatttctgaaaatctggagcttataaaagcaagctgtgctaaatcatttgcaccatttccgaatggtatgtaaatttgcagctttgaatattctaaaccaccattcaaattactaatttttatatatcagatcgacaattataagataatggcaaaattaaatgtggactaataaaaaacgtaaatacatttgaaagggtaacttgtgtctggaatttaaagctttactggcgttgaattgcagggtgtatgtttcatagtgagcatggtctcatgagcattgaacatccaacaaagaagatgaaagcaatgcctaggattgacagcgagggatttatgtgtggggctaacttcaatgttgactctcagacaaagatccaagtgatgcctcgtgttggaagtgaagctaattg

SEQ ID NO: 3272 - DNA, 353 bp, Glycine max
agagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagacggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttca

SEQ ID NO: 3273 - DNA, 415 bp, Glycine max
ttatatatccaatatatatggttagtcacagtcttctacattaatatatttgtggcgtgtttagttattaaacatctaagaatggctacttttcctactcttcatggcctgcacaatcctcttcctcgatctcaattcctaggccaagatcaccctctcactcaccaattccctctcaagcaacaagtgcatcacaaaacagcaccaactcatgaagttctaatgccacgtgctgcaaagttcaacatattggaaatgatgggagggagaggactatgcaacggggaaaagggtcttcagcaagagctgaaaaggcaagttgttgttccacaatcatcaatatcatcacaagaagaagaagcaccaagtggtgaaaaagaggagcaagaaggtgaaggtggtgatgatgatgaag

SEQ ID NO: 3274 - DNA, 431 bp, Glycine max
catcgtctttattgtaggcaccatcacactcagttgttcaagcagaaaggtaacttcagccaacttgacaagcaagaaaatgatgaaggggtgactgagaacacaataactgagtaatagcatgcatgcaactttcaagttactttggcaatacaagttcagttggtgactcattttaaggcatcaaatgcccttgtctcaatccacattaaattctgtttactgtgtatgtgaaaagttttgtgagacaaattttggggttgataattgagaagaattagtagatagtttggcttaattatacggctgaccagtctgcatttttctttgaagcttaatgaagtttgtatttttcattattgtgataaaatctggttttctctgtgtatttactgttgcttttggttattcgcatcacaaatatttcaatc

SEQ ID NO: 3275 - DNA, 429 bp, Glycine max
cggctctctccgaaatttcttagattgcttctgtgtcagagaaatcagtgcaacaaaaatggacgacaccgaaaccaaaggaagaatcgaagagactgtgcgtaggattttgcaagaatcggacatggacgaggttactgagtctaagattcgaaaacaggcctccgaacaccttggcctcgacctgtctcagccttatttcaaagcctttgtcaaacaggtcgtgaaggcttttctccaagaagaagaacaacgacagaaacaacaacaacaagatgaagatgaagaagaagaactaggaggagcttccaagggcaaggagtacgatgatgaaggcgatctcatcatctgcagggtctgttttttctttcttttccctgaaccccttttggtcattttgcaggtggcaatggggaaaaatgatttttt

SEQ ID NO: 3276 - DNA, 706 bp, Glycine max
ttcgccccgccgcttccgcttcccaccgctctttcaacaccaacgccatgcgccagtatgacaaccgcgccgacgaccacagcaccgacatcgatcgtcactccgaacgctctttccctagcactgcgcgccgcgacgatatcttctcaggtagttgtagtcgctctctccctaacctcgcactaaccgattctcttaattcttctattttttatgtagtttagttgattcaatcgtggttttaaattgcgttgccgcaattgtccaaatctataaaaaatttatggctcaccgaaagtgcaatcgcaatttaacaccacggattcaataaatatcattacttaaacgttttgttttattcgattctagctaaccttgcactaaacggatctcttcaattatttctttccgcggttttggtgattctgaactctacgttttgttcgattcttgctatccgcagatgtgttggatccattttttccgactcggagtttgagccaggttctgaacatgatggaccaggtcatggacaatccgttcctctccgcgtcgcgcgggatcggagctggcgctggagtgcgtcgcggatgggacgcgagggagacagaggatgctctgcatctgcgcgtggacatgcctgggctcggcaaggaagacgtgaagatctccgtggagcagaacactctcattatcaaaggtgaag

SEQ ID NO: 3277 - DNA, 369 bp, Glycine max
acggggcccacaagtgtaacgtggttttggttagtgcaccctatgggcttaaggcctcaaatctccatggtggtgtcactggtgctcttctcaggcccgagaagcctttcttgtctaagaggcttccttttgtgctctacactgttgggcctcttgcatttgagcccaattgccattaaatgcaagaaattatggatatatcatatttcaagttattttaagttatatgatagagctgtgttgtctctaatttgccttctttctggccttgttttgtttgtcttcatttttatttgtggttttgcgtttgtaggctctgggcttgaattgatcatacacaataatgagtgacagtacgtatgaaatgga

SEQ ID NO: 3278 - DNA, 393 bp, Glycine max
gttggttgagatcacaattcttcatttccaatatgtttttaagttgccatacgcgtggtgaatgactgttggaagaaaattataaaggcacgaagcagatttaagggttaataaccaattgttgaataatctatttgaatcaattttttcttagttgagttttctggttaattactgtatcacttagaactgctgtgttggtttgacatttgtaacactcgttttgcctatcctctgctcaaatattttcttccagagtgaaatatttctgggatcatagggaaaattactttatggaatttcttttagttatttgagattcctgtgcttgatatactaaacttggtggtcttctttggactggtgcctggtggacctcttatgaagtaaaaa

SEQ ID NO: 3279 - DNA, 395 bp, Glycine max
accgtttgatgcatgcttcgatacaagcaccattaggaattctatcaccggcctagctgtgccaagtattgatctagtgctacccgggggagcacagtggactatatatggagccaattcgatgacggttatgacaagtaaaaatgtggcgtgtcttgcatttgttgatggagggatgaaaccaaaagaaatgcattcgattcaacttgaagcctctgttgttattggggggcatcagttggaggacaatcttttggtcatagatatggcttcctcaaaattaagctttagctcctcgcttttgctccgcaacgcaacatgttcccatgtttgagtcttttattagaccctgagattaccactgttcaataatgctccttctatctatctttcgc

SEQ ID NO: 3280 - DNA, 649 bp, Glycine max
cttgcaaaccatgcaaaaaatttgcattctctagatctatcttggtgcagaaatttgacagacaatgcactgggtttgattgtggatagctgtttggcactgaggtcacttaaactttttggatgcagtcaggtatctatcattaagtgcatgtttggtttagcttttagcatttgtgatccacgtccaatccgaagcatccaaatgttgcttctgcgtcttttaaattttttatgtgaaccccgatcgtgcatcacggacgctgaagcaaacacactaaaaatgttctctgatttgtaactttgtatattgttatggttgtgtgcatattgcaatgatatgaatcatccgagtatatataagaaatgctatgtatattttgcaggtaacagatgcttttctcaatggccactcaaaccttcagatccagataattggtttgaaaatgtctcctgtgttggaacatgtcaaagtgccagatcctcatcaaggtgctttgaattattcatcagtctccgtagatttggtataaattaggatcggaatctaaatttgtagcggcattttgcataactatgtctacgaagatatttccagtaatcccagatcagacgaaaaccttctctgctaacatggcctttaattggaa

SEQ ID NO: 3281 - DNA, 542 bp, Glycine max
cccttttgctagagaccccgtgccattctttcttgcacctaagtacgtatttcttggcttttctattttcttaaaaacataagtgtatctgtgtggtgaagtgacatgaataatgtttgttcttgcatccacatttggcgttagtttaatggtgagaataaaatatttgattttatgtagggtaagcaatcaagaaggattagaagcagcagtggaagcaacggctgctttactgaacaacgctgtgaagccagtgattgtgggtgggccaaaactaagggtagcaaaggcacaaaaggcctttctggagtttgcagaagcaagtggatatccaatagcagttatgccgtccgggaagggactagtaccagagcatcatccacatttcattgggacatactggggtgctgtcagctctagcttttgtggggaaattgtggagtctgctgatgcatatgtttttgttggccccatcttcaatgactatagctccgttggatactcgttgttgataaagaaggagaaagccataatagtgcagc

SEQ ID NO: 3282 - DNA, 700 bp, Glycine max
  misc_feature (682)..(686): n is a, c, g, or t
tatcatgttagacattcatcgtagtactatcatattgaatactggtaaatgtagttttccatttatttactacaatccaattcatgacacgctgtataggatatgcttttggatagaaaaagactaaccatcaaagctgcatttctgtaattcaattcatttcaacaacagtttgacatatttttcacaagtaacgaccacttaatttatttgactcaattttttgagaattctgtgtataaactgaggctataagctataagtaaaaatgaccattctcttttatatagatagaaaaataagaaattactttactttctagcattagctaatactacagacttaacgcttgctaaaatggtgttgaagtttgttttagtatcatgatttagtttgcatgcatgtgttaacatggatttattctctgcagaaagtttaaagcttggctgtctttgaagtcatgttgtgaatgagagacaattgaacttgtatactcttttttaaactgagcttcaagatgtcaaactcaaggagcactcttctcaagttagctcagagggaagcatccattgtgattaactgagatatcaaagcattttgccaatctatgttgcataggaagccattgagatagttataacagaaaactgtatatagtcatacgaaaggatggtttttcttnnnnnatccctaggaaaca

SEQ ID NO: 3283 - DNA, 512 bp, Glycine max
gccagatcttgagaagaatgtgggtgttggagggtatggttatccagctttagtggcccttaaccttaagaaagctgtttatgctcctctcaagagtgcttttgaacttgaccaaattatgtaagtttgttcatctagctatatgctaaatactaaacactctattgagatgaacaagtgtttgaattttacctatttactttcttcagagaatttgtgaaagaagctggacgtggaggcaaagggaatttgcccattgaaggaactccaacaattgtaaagacagaaccatgggatggaaaagatggagaaataattgaggaggatgagttttctcttgaagaactaatgggggaagatgcttcaagcaaggatgagctatgatcaatttagaagaaatttataccaaattaaagtttcaaccaccgatttttacgttattggcaacttgtttctcatgatgattgtgatcactgttctgtttttccatgttccaatttaaagaccagtca

SEQ ID NO: 3284 - DNA, 467 bp, Glycine max
tctatctttatacttctttagttttcaatggtacaagttacactggtgatccagctagaacaaaaaaggaagctgagcagtcagccgcaaaggctgcaattctttcaattatgggtattcttctgtgtatgctttattacatatttccattagattttaggtagcaatgtgcatacctactaaatgaccatttaatgcaggtgattctagctcgggaactgtgcttgttgagattattaagtcaaagtctatattttatgatgcaatcaaaggaaagggacgatctctgtcacagcctagtgcagtgttatccacaacaaatgcaggacagatctctattacactggatcataaagatacagaagttgcagcttgtgtggctgataataataataatgagactaaagttgaatttcctgagtttcctaagatgctttccacatgtcaagaactccaaatgatacatc

SEQ ID NO: 3285 - DNA, 538 bp, Glycine max
gaagcagtaaaggaggctgaaaaaatatcattgctggttgaacatagtgattcaatgttacagctagcaaaagatatatatgaacaatgtactatagataaacgatctttcctgcctctcatttgtgaattttttaatcttttattgattatttttaactaccattgatcgtgtgggtctattcatgcaggttcccgtggtgaaattatcctcttggcttaagatggtctaagtaaggtctataaatagattcgtcctgatgttggtttctaaatgtaaaattttgttgatacaatgaaatactattttaacttttattttggttgtattttatcagattcccttaaacatttgtattccttaaaattgcatggaaagtcatgtttatagtaatatcattggtccaccaaatctggccagattttggatccaaaatgtaagcaatagaaactcatttatgttttttttggcgatgtaatacagatcattcatgtcttgattcttgactctagtctagaactcgatccttcgtatccaa

SEQ ID NO: 3286 - DNA, 408 bp, Glycine max
ctgatgtgggttatggtgatatcgcttcacgcacatctcatcattgcagctgtgtctaagtctaatggcacaatttccgtgtgcgatggctccgtagaggactgcctcaacgtcgtccacttggactcagagcttcttcccaccatctccagctcccacttccgcagaatccttgctggaaaatatgatggagttaccaacgatgcactaattcctgataaacccttcaagggatgtaaaatcggagaagcttatcgtagctgtctggcccaagttgaaggtagagcgagaaactgtgccatctacaagaggggttgctaatgaatatctaaggttgtgatcgcgccgagctatttgcgtgttttaatgcttttaatttgtttcctctctctctccactttgttgctg

SEQ ID NO: 3287 - DNA, 471 bp, Glycine max
  misc_feature (63)..(63): n is a, c, g, or t
tttttcctgagctaggcaaaattgaggtgagaaataacctgtgttcccttgtttcataatgtntgcttttggctattcatttattattattaacgtttatttttatatgttggctgtttccatatatgttatgtattttcctgataaattaaacactgatagtctgcgtaaatcgtctttgcagcccaagcgtctgtcctcatttctgaatgaggatcctgcaatcatggaaagacgaagtgccctatcaaagagacttgagttataccggagtgcacaagctgagatcgatgcagttgcatggtctaagtagatatgatatagatgtgtatgctacatcgcgttattgttaatattgatcaagaaatctctctctctctctctctcctatttttgttaggcttttgctttgaaaaacgcatattgtaattgacatctttaataaaaaggtttttggagagataatttgag

SEQ ID NO: 3288 - DNA, 736 bp, Glycine max
  misc_feature (733)..(733): n is a, c, g, or t
cacactttggttttcattgttgacttgcgggccgacaagaagaagatcaaggatgcagtcaagaagatgtatgatattcaggccaagaaagtaaacaccttgatcaggtgagcctttataaagtgatgcttatagaatttgtttgttgattcattattgctattttctaatgacaatggtatgcttgcagtgaatttgatattgcagttttccttccaaacatttattatactgagacatacatgttttgtgctttttggtttgtggcatgctggtgtgacaaagggttcatgttgtgcacagggcaacattgaaatgggacatgcattgaattgaatgtattttattgaaagtgtataatataatcctaagtaggtataacaaggcaaatgaaacaacaaatttatgaaaaacttgcattcaaacttacaacagatgccatttcttctgaattttaatttttctgttgcaggcctgatggaaccaagaaggcctatgtcaggttgacacctgattatgacgccctggatgtggccaacaagattggaattatctaaactaatatatggcctcaccaaagtagatttctgtttagatggtagtttgttatggggtgttgaggggagacatttgaagcaacattaagttataaattttcggtttgttatctggtgtattttagttcaattggaattatatttacttttgttacaattttcaatttgatgagaanggg

SEQ ID NO: 3289 - DNA, 447 bp, Glycine max
atgattctactccaggcgatttcaaccggccaggccatattttcccactaaaatacagggaaggtggtgtcttgaagagagctggacatacagaagcttctgctgatcttgctgtacttgctggcttggatccagtggcagttctgtgtgagattgtagatgatgatggttccatggctagactgccaaagcttcgccagtttgcagagcgtgaaaatttaaaaattgtatctattgctgacttaataaggtatgcagttacaattcatggaccatgtaataaaattcattgcatgcatatttatgtttagactctgctttagtgcagatactatacttttttatgtttaagtagtgttaaatatattaaatgagtttgatataggtgtaatttataagcctgaatcctgaatacataatagaactaacttggattctgtggtgatt

SEQ ID NO: 3290 - DNA, 549 bp, Glycine max
ttctaggtaaggtgcagaatgggtgaaggagatctatacgtaaggagaatccagttttcaatagctccaacaggcaacaacaactatctaaatgcatgtttaaacaacaaagtttagactttcaatcaaggacataaaaaggcattcttccctgtacctactgaccagacatatactgttttttaatatcagtaataatacatctgaaaactaaagttatttcacaaacacaaacagttatgaacaagttgcgattgacagcatcaaccttaaaatagatagaaaattccttcaagaatcttcttctgtggttttaggcttttagttatcttggacagaaagacacttcagtttcaacatatgcacatgtaaagctgtgacactaatacatacaaacttataatgcatgaaactttttttaaaatgtcgtgtttcattacagcagccaagctaagtcaccttttttgagaatgcagcaaaaggatttatatcatcctcatatatcttcttgtatttagattcaacatctgacgcgaaaccactttcaag

SEQ ID NO: 3291 - DNA, 706 bp, Glycine max
  misc_feature (687)..(687): n is a, c, g, or t
tggactaggtgagtttgattctcgttttcacaattgttaaatcttccaaattcacttaatttctctgtgtgtctgtgtctgtgtgttttagtgtgttttcatttttattattttagatttgtttgatgaattgctactgaagcaatgatctttgctgccgtgactgtacagtatcaaacccgccggagagccgccgtctcctcgggctgctcatgctgctgctgcagttggtaccatggttgtttttcaggtgattttgtgaattgggataaattgtggggactgagattcctcttcttcttcttcttcttcttcttcttcacttgcttgattatattaacatttgtttgattggttctgcttggctagggtgggataggtccagcggggcattctaccgatgatctctatgtgcttgacttgaccaatgataaatacaaatggcataggtgagatttgttctaattaaacatgtttttctttttacctacttctagaattttgacaaaatcgcacaattagtcaatattgctattaatttaattgtagggtcgttgtacaagggcaaggacccgggcctcgctatggccatgtaatggacctggttgctcagagatatctagtaactgtcagcggaaatgacggtgagaaaaattcattaccaggttgttgttttttcaaattctngtataaaactgtgatgaat

SEQ ID NO: 3292 - DNA, 319 bp, Glycine max
ctggctcaggctcctctagagcgggttctgaagcaggttcatacgcagggtctcacgcaggatcaggatcatacggtggtaatggaaagtaattaattaaatgcatgccagttaaaccatatcaattatatgcatgctgtcctgtggagaaaagaacaagtcggtgtctttgttagttcactagaattatactttagtaagtaagcaaaaataagttgatgcatgtgttgtgtccatcctgttctttttcttttgtacaagtaggaatcgtgcttctccctgtgtccaatatgcaatagtttccttgaaaggaggtaaa

SEQ ID NO: 3293 - DNA, 371 bp, Glycine max
tggatgagggtgaaactcacaacaacaatgcaacctcctcacccaataattcccatagtcctgctcctatgcctggaaggaatcgctctgttggaaaatataacaacagtggcactcagaagattaaaggtctgagtaaccaaaccggcttcaccgaaggcaacgctaacggagccatcaactttggcaatttacatgcctaaataaatcaatgtaccaagatcttgaaatccataaataataatgtgacgtacaaattaaaataagagcttcacagtttgagtgtggatccaatattttcagctttttattatatataaatatatgacttcttagattaacgtgcagcaacaacaacaagaagcttttga

SEQ ID NO: 3294 - DNA, 354 bp, Glycine max
ggattattcttgcctatctgctatcacctcctatgaggattttgcaacaacttttgagatccttcaaagaaatccaaaaggtagttttctaaatcatcaggactgtacttaatgattttgtcacttgtgtacgaactgaaccttccaacaaacgacctataagcttggattactttgacagatatagaaatccgcaaatcttcacgaagctgaaaatcagggataatccaagctgtctggatcctgtaaacatcctcaaagccaaggtagaagcttcgcagcctctctttaacaagactttttgagaccgaagttatacccggaacaaaaactccctcatccttaagcaagttg

SEQ ID NO: 3295 - DNA, 430 bp, Glycine max
gaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccaatcatcactcaaacacgagtc

SEQ ID NO: 3296 - DNA, 351 bp, Glycine max
caagacttaagaaatttgtgtccttcagtagctgagaccattttggaggatatggttccagaagcttgtgggactaatattccaggtccagatttgtctcctaagcaaagcatgggtactcctaacaaagcagtgacaccttttgtagctatgaaagaaatgaagacagtgacaatcaaggcaacatacagagaagatatcataagatttcgggtctcgttgacctgtggcattgttgaactgaaagaagaagttgccaaaagattgaaactagaggtgggtacatttgaaatcaagtacctggatgatgatcacgaatgggttttgatagcctgtgatgcagacctacag

SEQ ID NO: 3297 - DNA, 760 bp, Glycine max
attgctgctggatcacgagatggtgttcagtcacaagtttggctgcaggttaactttgtcaatcggactttctcattgcgttattggttattacttcactaaactcttattttaatcttcatcctttctgcttaacttttaggacgaaagagagcttaaaagacaaaggcggaagcagtctaatcgggaatctgcacgcagatccaggttacggaagcaggtgacagagagtataacctttttcatacttctggttgcaggtcataattgtcatattttaaatccctttttgtgcatgttgttctcaggctgaatgtgatgaactagctcagcgtgctgaagctttgaaagaagaaaatgccactctccgatcagaagtgagccagatcaggagtgagtatgagcagctacgttctgagaatgctgccctcaaggtgatttttgaaatctttatatactttgatttttgtctattttgcaaattggcaaccactgttgcccctacaaagttatacctactatcagtaacactcatttgaaccctgattcggagagaaggaaaatgcctaaatggactaatatggccattctagttttcaaattctgctcttaccaccataaaagatttattcaaagactgagctagctatctgattacaggagagacttggggacatacctggtgtcgcgacgcctgggaaggaggatcttaggtctggtcagaatgatcagcatgtgagtaatgacactcaacagagtg

SEQ ID NO: 3298 - DNA, 377 bp, Glycine max
acagtgcgatccaaaccgacggcggcttccgcaccttggcggagggtcagtcagtagagttcctcgtcactcaggacgacagcgggcgagccgcggccgtcaacgtgacgaccaccatggttaaatctagtgacagcggtaacggggaaaactctggtggtgatgctgccaatgttgagaaataagtgagaatgaattattggagtttcctgaattgcgagtatgatatttatattgatagttggacaatatactagtccattggtattttatattttattatattatctctggttattggcatttggttccaaacttgtaatacatttatcatgtgtttaacgtggttatgtagtaagttgttggatgtgtcgaat

SEQ ID NO: 3299 - DNA, 1034 bp, Glycine max
ttttttgtagttacattttcaattagtttgaaattttccttgtcatgttttaggaaaataggaattaagtaggcattagatctgatgcactctttgacacccttctcatataatattaaggacttttgaaagcttgaccagagtgacggggatactagattttgtgtctagcagaaaatacactaagtttaggcatgaaagatgataaacagaggctttttgtgaaagcctttgattgcagtgaaagtaatcagataagaggctcaagatttcaaaatgaggatagaattggaaggataaatgataagagtgcttaaactattcttgatatgcatcatgcatgtaaggccttagaaatagaagtatccctttatggtcttaaaaattaggatgggagcattgattagtttgagagaactccaggattcagttttgctacatagagactacaaatggttgaaataaacgggctacgcttggctggaaatgacagaaacaaatacttgggtgtagaattatgccttcggtggtacttgatggaaatttgtaatattgtatgtgactttatgttcatcatttacttggaaattttagtttttactttaattattggtatgatgttcttgatgggtgctataaaatcttatgtttcacatttgggattattttctagggccgttttgagatactttcattatctggatcattcatgcctactgacaaccaaggaacaagaagcagatcaggtgggatgagtgtttcattgtcaagtccagatggtcgcattgtaggtggtggagttgctggtctccttgtagctgctggtcctgtgcaggtaaacattcctttctcaactcaattaggtatgtgatcatgaccatggattgggtggtaaggactacaaggttggattcaaattagtccccaacatcctacattttctgtgatattgaaaactttgccaaacaatttttgctcaaatacatcccaaacaattgagggttgtcaaatgaaagaggcaaagttgcatgcct

SEQ ID NO: 3300 - DNA, 400 bp, Glycine max
cttggatgaagcgaacagcaagttcttgcatggttgtttcaaccctaattgccacaggagtgttttctgccgccttcagcgtcccaggtggtaccaaagacgattcaggatctcccaattatttgaagaaacatttgttcacggtatttgcaatatcagatgccttggcattaactctttctaccgcctcaaccctaattttcttgtccatactcatctcaagatatgctgaggaagattttcttaggtcattgccattcaagttgatatttggactagtgtcactatttctctcaatagtcagcatgatgggagcattcagtagtgctttcttcataacatattaccatgctaaaacgtgggttgttcctatcaccattgctgtatttgtgttgttcca

SEQ ID NO: 3301 - DNA, 366 bp, Glycine max
atccacttcaaggccatattaacccattgttcaaactcgcaaagctgcttcatctgaaaggctttcatataacctttgtccacactgagtacaactacagacgcttcctcaaatcaaagggtcccgacgcccttgatgagcttcctgattttcgcttcgaaaccatcccagatggccttcctccctcggatggtgatgtcagtcaagacataccctctctttgtgactctctcagaaagaacttccttcaaccctttcgtgaccttcttgccagacttaaccattctgccactactcccccagttacttgcttagtctctgattgcttcgtcacttttcctatacaagctgctcatgaacttggaa

SEQ ID NO: 3302 - DNA, 732 bp, Glycine max
  misc_feature (374)..(377): n is a, c, g, or t
  misc_feature (413)..(413): n is a, c, g, or t
  misc_feature (446)..(446): n is a, c, g, or t
  misc_feature (452)..(452): n is a, c, g, or t
  misc_feature (454)..(454): n is a, c, g, or t
  misc_feature (456)..(456): n is a, c, g, or t
  misc_feature (501)..(502): n is a, c, g, or t
  misc_feature (530)..(532): n is a, c, g, or t
  misc_feature (550)..(550): n is a, c, g, or t
tatacaccaatgtgcacatggagcatacttatttatgataagttattattatggctagaaaacagaaagaaaaagacaaacttaagcataaccaccttattaactaccatgcatcacattaatcatgcatgagttaactcatggtgcagctggtgctggaacacttccaccactgccgggaatgggaacctcataaccagggtttgggacaaaagtgtcatcaccaccaggaacataactgctacctggtggtgatcctgatcctgttgcggttcctgctcctccatttccattgccaccaggtaatggattttgaggtgtgagatgaaatttatgtggaaatccaacaggtccaatccctggaatatacacannnnagctttcatctcacacctcagaatccattactgggnggcattggaaatggaggagcaggaaccgcaacnggatcngnancaccaggtagcagttatgttcctggtggtgatgacacttttgtcnnacctggttatgaggttccattccggcannngtggaagtgttccagcanagctgcacatgagttaactcatgcatgattaatgtgatgcatggtagttaataaggtggttatgcttaagtttgtctttttctttctgttttctagccataataataacttatcataaataagtatgctccatgtgcacattggtgtatatggtgaacaccatggattgccaagtcattctg

SEQ ID NO: 3303 - DNA, 409 bp, Glycine max
cctctccctgctcccgccgctgttttccgccgctgtcgccgtcgttcccgcctcaccgtggcggcgcgcgcgtctccgatgggaaagtacatgaagaaagcgaagccgaaaggagaactcgcgctcgtcgaatccaccaccagcaacaccaccacctcctacatgggggtccgaacccgcgccaaaaccctagcgcttcagaaatcgcacgcgcagcagcacgagctcgccgccacctccgactcctacctccagctccggagccgtcgcctccagaagcctccgattttggtccactctccgaagcgccctaagcacccgaaccctaaatccccaatccccgaacctcccaggctcggactcgcttcggagcgcgacgctaccctcaaccacaacaaggacaatactt

SEQ ID NO: 3304 - DNA, 407 bp, Glycine max
gctttggtgccagctcacctacttgtgacgctcaatcacctacattcacttgcagatcatcattttcctcttttttggtggaaccagtcactccatgtctagtttctggtgggttttcattcaagagtgcaggcgattcccctgatttggaattttgttctcccgttccctcaatgcttagcttttcattcctcagccccagttctgttgttgagcaaaagagttgtaaattagagtgctcagctaacatggcagatgtaaatgcaattgctggaggtatgcttaaagccttttattttcatcgtctttactatttcttagcttcctggtctgatcttgtttgcaattttatgcagaaacaaacttgggaaaattgcttatgctacaagattctcctctttgcgttg

SEQ ID NO: 3305 - DNA, 771 bp, Glycine max
  misc_feature (40)..(41): n is a, c, g, or t
  misc_feature (717)..(718): n is a, c, g, or t
  misc_feature (763)..(764): n is a, c, g, or t
  misc_feature (767)..(767): n is a, c, g, or t
attgtgttgagtgctccagatgtcccaggaaaagtgatcnntggtgtatgtaatgtgtatccatgctttgtaacacttcgcagcttcaattcagcttctgaatcgccttgttgaatttcctgtttttcttgttgcaacagatagatttgactctttatgacccgaagggctccgaaacttcagatgtggtttcttgtgaccaagatttttgctctgccacgtttgacggtccaattcctggttgcaagtctgaaattccatgcccctacagcataacttacggagacggaagtgcaactactggatactatgtccaggattatcttacttataaccgtatcaatggcaatcttcgtacttcgccacaaaatagcagcattatttttgggtgagagtaattattattactaattactaatgctttacaattcacattgtatcatttattattgacttctcgtgatggaaattttcttggctgtcaatgttcaatatgagagaattgttttggttgtgaacgaaattttcattcttttgagtcaactgtttttggttatgtgaatattttgcattcaggtgggaagtttcagtttattatttttaattagaaatatttaggtaaattggtttataggttgatagagttacagaaaaatgttacattttcaactttttctcggtttatatgtctttggataatctcttgctgacaggagnngtgctgtacaatctgggacattgggttcatcttctgaagaagccnntgntgaa

SEQ ID NO: 3306 - DNA, 427 bp, Glycine max
tagtccttattatggtgatggctgcataatggcttctactcctgccacatatgatttaccagagttaggtaacattgccgtcgatggccacgtgtcgcttgcattggaattgaggaactgtgaaagtcaaggatttggtgtgtcaaatgatgacatgcataaacgacataagaaaacattggcttcttccccagagactgatttgctagattaccatttcacagacccaggaaagcaacaaaacaagtttggcaatcctcacctattgcacgagtttgttgtgtgaagaagggttggagaaaattctaaagttttcaagggaactaaggaaatgtgtaccaccaaagtagtagatagatagacaaaagcctatgttgttgttgttaacttggttgctcattcttgttgtcatgttgaacctttggtc

SEQ ID NO: 3307 - DNA, 932 bp, Glycine max
  misc_feature (923)..(924): n is a, c, g, or t
acttcctatgaccttcatctggccaagcgttactatgatgaagctctagagcatgattctgcagccaagttgccggtcacgctggctctttcaagcctgtgggttcgtaagaactatgctgacagtttcatggtgagtttctttgatttacctactgctacactgcatagtttttttattttttggaggatatatacatcatagttacaaaacaataagcggaagttgacagtgttttaaatacgttgatagttttcttttcatggtatctcagttgcctgttgtagtttgtgttcaattaggatatgtattaatataatatattatcagtaattacacaagaatcttaattaacggccaatcgagcagcttgtatttcttcagcaaagctttgatttttgccttttatatgcatgtcactgtattttcccacaatgtattggacaacaactggcatatttgggttataccttcaccttgtttaatattgagaaatcacttcacctttctttctttcttccttcaattttattgtatatatggccctaaggttcaacaacacggacagcagttattatatttaagtgttttttcactgattgaagataataaaatgtttattaacctgttgccagtagcctcgttactttgtcattattttaaactattttctgtaatccgtaacttgcaacaagatttttctcactgttctagatcctgattgcagagtgtgcttattgtttttattaggtacaggtaattgattcattgcctgaactgtatcctaaattagaagcttgggtggagaatgtgcttttggaggagggaaatgctacaattctgaccctctttgtatgcctcttaactgtgctgtatctacgtgagaggcaacgaaggcaagctgccgttgcagctggagaggnnctcagcca

SEQ ID NO: 3308 - DNA, 619 bp, Glycine max
tcagctcaaggtcgcccacattttttggttttttcaactaatcctaattcacctcccatggctcctgcttcttcctctccatctcagaggggggatgatgaaccaattcctacaattgctgttgccaatctgtctccaactcctgcaactggagaagaatcatcacagctgactttagttccgcctattcaagcagaacaggtgtctgcttcaggatctggatctactgctcttgctacagatcatcagggatcatcttacaacaataggtaatcttcattttcgtttttgaatttctggatcatattaatgttttcaaattcatgattgcctagtattcaagctttagaagttctcaactgttacgtccgaaacatcatacaggagatctcctaatcagtcatctccaagtagtcaagacagagcagggccatcagaattacaatcattttcagaatctctgaaatctaaactgaatgctgtatcaacaaggtagtggactatcctttgtcacaagtgggtgtggtgcagtacaattgaggagttctcccattgtaatttgaacttctatttttcttgtctttcagatacaaggagtcaatttccaagagcacaagaa

SEQ ID NO: 3309 - DNA, 829 bp, Glycine max
  misc_feature (789)..(789): n is a, c, g, or t
  misc_feature (820)..(821): n is a, c, g, or t
tttggggtactttgcaatttacattttatatcttagttggctaaggttggaaattagttgattaagaagatattgcattattggctccatgctccttaagccacatttgtttactgatatcagattaagctatctctttgtctgcattgatagaaacaaaagtttttcctttttcttctctaggctgtacctacctccaaagggcaagcacttgctgatgagtatggtatcaagttctttgaaactgtgagtggcaataacattttcattaaaattatttgtgatttcattatatttatattgaagaacacatgcagagtgcaaaaaccaacatgaatgtggaagaggttttcttttcaatagcaagagatatcaagcaaaggcttgcagacacagattcaagagctgaggtaatttgcaaacttttttctcaatgtcctttgtttttctttttttcctgagaaatgcaagtgctctcttcttctgaaagactaaaattttgccaccgtgtatcaagtacttaaaagaaaaataattgttaggaattaatgctaactttcaaaataagtgcatagatttgtttgtattgctgaacactgatattctcttctctgttgattcagcctcagactatcaagattaaccaaccagaccaggcagccagtggtggtcaacctgcacaaaagtcggcttgctgcggttcatgaaaagaatcagtatctgtagcaagaggtgcaggtttctgcaatagcactcttctgggtgctaatgttattctgatgacattanaaagtgggagcatgtatttgtccctctgtannttccccaa

SEQ ID NO: 3310 - DNA, 450 bp, Glycine max
caagttaattggagttggcacttgaagaaaggcacataaacatgctattggataaaagattatatgcagtaagactgtgaacatgttttactgtaaaagaaatggctacccgagtttttggagctaatcttttgatcaagaacaagaacgggtgtagcatattcttctaatctcttgatgacgtcacctgcatggatgatggatatagtttagagttcactacatctcttgatggcattaccttttctatatatggagcagcgtttgtttataatagcaccactgcgatataatttgtacttttactttatatccttgaaatgatagatttcaagagagtaagcatcattggacacgatacgatattaatgtaaaatttagttttatattttatttattgttactattagcctagaaatgtcaatttcttctgcatgagctggttctcta

SEQ ID NO: 3311 - DNA, 339 bp, Glycine max
cgagaggcagcttacaatttgcatttaatctacaaaaaaagtggtgctcttgatcttgctaggcaagttctcaaagatcattgtaccttgtgagtttacatgtaccttaatatgtacaaaattttagaagcatttgcattgcaatataatttattaggttttcatatatgataatggtattcattaattaagttactacagataccgagcaatagtgatttaaagacctactgcagtgcttatttattttatttgattttttcttgaaactttgctttctgtatatattgagatgtctcttgggcgtcaaacatgagtcagactagcttgggtaagctg

SEQ ID NO: 3312 - DNA, 405 bp, Glycine max
cagcctttccaatccatcatccgtggaagatgaaactaataactgtaatccatatagtgacctgactgataaccgagcagaccattatccttcttatcacaaggatagcaacaaacttgcttctggaaatttatccaatgatgctattaactgttccaatctaggtggtgcgggacttcctcctgatgcagattctttgtcagacaaacagcatgctggaggaacgactgcctccatacctagttctgatgtgctaaagctcgaaaacaagcattcaccagaggaacaaatcactgaggacatgagcaccgatgatgggttgatttccccagctctaacagggagggaatgtgtgccgttagtgggtagctcggaaggaggcttgcctaatactcccctgcaagt

SEQ ID NO: 3313 - DNA, 1386 bp, Glycine max
  misc_feature (390)..(390): n is a, c, g, or t
  misc_feature (393)..(393): n is a, c, g, or t
  misc_feature (395)..(398): n is a, c, g, or t
  misc_feature (400)..(403): n is a, c, g, or t
  misc_feature (418)..(419): n is a, c, g, or t
  misc_feature (717)..(718): n is a, c, g, or t
  misc_feature (789)..(789): n is a, c, g, or t
  misc_feature (795)..(797): n is a, c, g, or t
  misc_feature (806)..(814): n is a, c, g, or t
  misc_feature (818)..(820): n is a, c, g, or t
  misc_feature (822)..(823): n is a, c, g, or t
  misc_feature (827)..(832): n is a, c, g, or t
  misc_feature (839)..(842): n is a, c, g, or t
  misc_feature (845)..(845): n is a, c, g, or t
  misc_feature (848)..(850): n is a, c, g, or t
  misc_feature (859)..(861): n is a, c, g, or t
  misc_feature (868)..(869): n is a, c, g, or t
  misc_feature (871)..(871): n is a, c, g, or t
  misc_feature (873)..(875): n is a, c, g, or t
  misc_feature (887)..(889): n is a, c, g, or t
  misc_feature (892)..(895): n is a, c, g, or t
  misc_feature (898)..(898): n is a, c, g, or t
  misc_feature (902)..(903): n is a, c, g, or t
  misc_feature (906)..(909): n is a, c, g, or t
  misc_feature (911)..(911): n is a, c, g, or t
  misc_feature (916)..(917): n is a, c, g, or t
  misc_feature (922)..(924): n is a, c, g, or t
  misc_feature (927)..(929): n is a, c, g, or t
  misc_feature (931)..(945): n is a, c, g, or t
  misc_feature (951)..(951): n is a, c, g, or t
  misc_feature (959)..(974): n is a, c, g, or t
  misc_feature (976)..(977): n is a, c, g, or t
  misc_feature (999)..(1006): n is a, c, g, or t
  misc_feature (1010)..(1013): n is a, c, g, or t
  misc_feature (1017)..(1021): n is a, c, g, or t
  misc_feature (1028)..(1033): n is a, c, g, or t
  misc_feature (1039)..(1046): n is a, c, g, or t
  misc_feature (1053)..(1056): n is a, c, g, or t
  misc_feature (1058)..(1058): n is a, c, g, or t
  misc_feature (1061)..(1066): n is a, c, g, or t
  misc_feature (1077)..(1089): n is a, c, g, or t
  misc_feature (1091)..(1094): n is a, c, g, or t
  misc_feature (1097)..(1097): n is a, c, g, or t
  misc_feature (1099)..(1105): n is a, c, g, or t
  misc_feature (1107)..(1122): n is a, c, g, or t
  misc_feature (1124)..(1133): n is a, c, g, or t
  misc_feature (1136)..(1148): n is a, c, g, or t
  misc_feature (1151)..(1157): n is a, c, g, or t
  misc_feature (1161)..(1181): n is a, c, g, or t
  misc_feature (1188)..(1188): n is a, c, g, or t
  misc_feature (1190)..(1190): n is a, c, g, or t
  misc_feature (1194)..(1195): n is a, c, g, or t
  misc_feature (1198)..(1204): n is a, c, g, or t
  misc_feature (1208)..(1213): n is a, c, g, or t
  misc_feature (1215)..(1215): n is a, c, g, or t
  misc_feature (1219)..(1228): n is a, c, g, or t
  misc_feature (1254)..(1275): n is a, c, g, or t
  misc_feature (1278)..(1301): n is a, c, g, or t
  misc_feature (1306)..(1311): n is a, c, g, or t
  misc_feature (1314)..(1324): n is a, c, g, or t
  misc_feature (1327)..(1329): n is a, c, g, or t
  misc_feature (1331)..(1346): n is a, c, g, or t
  misc_feature (1348)..(1348): n is a, c, g, or t
  misc_feature (1352)..(1354): n is a, c, g, or t
  misc_feature (1358)..(1365): n is a, c, g, or t
  misc_feature (1367)..(1379): n is a, c, g, or t
tgattggcatgcggatgcaacagtgggaacgactggctgcgtcaaacatgttctttattgcaaagcgcaagaatgcaaaccaggacgtgttttacttctcagctaaactccctagagggataccattcttaattgaacttaccacgttgattggaaaccctggcgtcaaatgtgcaatcaagactccaagccctgaaatgtctgcacttttcttcgaagccattgagactcttctcatgggttaatgggttttaaatttagttttttcttttaatttttgtttatatattgtttttgttagaatatgtgataaatatcctggacaggtgtgtaatatcttatttggaaaaaaaaaaaaatttgatttttctttgccgtgcctggatgtanttnannnncnnnnattggattggagggnnaagatggaacagagggaaatgagataaaatggttttatgtttcattatttggatgataaaatgagaattgaacctatttaatcctattccgttttcccttcatttttctgtctccaatttgggaggaatgagatggaatggaaagttggaaattttgttcctttccatcataacatatccaaacattaaaattaaggttgtagtccattatgtttcattatacttcattccattttaatccattccatcccatggctttctgtcaatccaaccatggcccttttgcttttttgttagnnacacaagattgtattagtttaatactgatgttatattagtttaacaactaacttttattcaattatacagngaattnnncttgatctnnnnnnnnnactnnnannaatnnnnnnccgttannnntgnctnnntgtggaacnnnttgaggnnancnnncaaaaccttttnnnttnnnntgnaatnnttnnnntntcaanntttcnnnaannntnnnnnnnnnnnnnnntccccnaccaaaannnnnnnnnnnnnnnnanntaaaatgccaaagggattcccnnnnnnnngatnnnntggnnnnncaaaaannnnnnatggcnnnnnnnntcaaaannnngngtnnnnnntctcccccctnnnnnnnnnnnnnannnnacncnnnnnnncnnnnnnnnnnnnnnnntnnnnnnnnnnctnnnnnnnnnnnnnttnnnnnnnctcnnnnnnnnnnnnnnnnnnnnnttttttncntctnnttnnnnnnncctnnnnnnanttcnnnnnnnnnnccccccccccattccgccccacctcnnnnnnnnnnnnnnnnnnnnnnccnnnnnnnnnnnnnnnnnnnnnnnncggcnnnnnntgnnnnnnnnnnnaannntnnnnnnnnnnnnnnnncncctnnnacgnnnnnnnnannnnnnnnnnnnncttctca

SEQ ID NO: 3314 - DNA, 389 bp, Glycine max
agaaagggtttccaatacgcgtctctaccaggtccatattcccaatctcctttcattaccaacctcacaacacaaacttctttctcttcttacaattacaaatcccttcatctctctctctctctctctctctctctattctcatttcaatccccttcttcaacccctctctctctctccaaaacgccaaaccaaaaaatggctcagaaggccgagaaaaacgacaccgactttaaggtccccgaaaccatcatcaccccctgcaccaccaccaccgccacctcgattaccgaaccttctagattcttcgacgcaaccacccccgccacgtcatcgcgctcccccaagcgatccctccccctcgacgacgaatctcagacggaccaaac

SEQ ID NO: 3315 - DNA, 688 bp, Glycine max
gggtggggtaactaagctaaccacttgtgggccttagttgtagataggggttaatagaaagctttaatttcgagcatacatggtaataattgctcttgcaattttgcattgcgtatcaggtcgaggtgcctctggatcccacacaagagctggcaaggttgatttctgaacggaaatatgaggaggctttcattggagctctacatagaagtgatgtatccattgtatcttggttatgtactcaggtatgccagagatgttttatctttcagttaaccaatctgtaggcagcttgggtaaagtctccagttgggatggtcttctttaattgttaactccaattggttaaggagagacaatttgtgtataataaggtttcagctatttgcaatccaaagcttctgattcaacttgagttgaaggagcattaacttaatttataacattatgttgctttttataagcattaattgaaattcttactggtgtgtgtttagatttttctcatcttattcaaataattattgaccaccaagtattaacggaatcactccatttctgctaagcaggttaatttacacggacttttgtcaatggttcctcttcctttaagccaaggtgtactgctttcacttcttcagcaattggcttgtgatattaacaatgatacaccgcgaaagattgtgtg

SEQ ID NO: 3316 - DNA, 369 bp, Glycine max
tgtttcggaggcacttggaagcctccggcatgcatggatgagggacgccctggaatgcttctgtaaatggcaagaggataagttggcgaatggaacgaaagaataagatggatttgctgactaattacatttagtgcattgtatctttgtggtaaaaacacttattttggggttggtaccattactttaggacagttaactctaaatcagaattgcatagtagttattgtttcaaatctggattgatctctgatttgtttttcttaattcagagtatataattcataacattggttttagttgagacttgagatgcttgttctcgttgtttgaattgttatctattcatattcatggttagtgcccaca

SEQ ID NO: 3317 - DNA, 518 bp, Glycine max
  misc_feature (56)..(58): n is a, c, g, or t
  misc_feature (61)..(64): n is a, c, g, or t
aagcttttatttgtttccgtcgtacgttgtatgcttgggagcacaacacaatgaannnccnnnnaggaaaccctctgcacctaaagtctgtgaaccatatctctctcatctgtacctccgtgaaagaatctatcaacttctaccagaaccttctcggattttttcccatcaggaggccgggatcatttgattttgacggggcatggtaattactattttaattaacaattgacaaaaacgccaaacctttatacaaacaatatttgtttgttattttcttttcttagggagtaattttttctcactgttttttaaccttgtcggtattttctatttgatcattgtatcattgtacaggctattcggatacggaattggaattcacttgctgcaagccgaggaccccgacaacgttccaagaaagacgaaaattaatccaaaagataaccatatatcattccaggcaagattttagtatatccgattgtgacttttatttaagtcaaaattgtaaattt

SEQ ID NO: 3318 - DNA, 371 bp, Glycine max
atagtggtaaaatgaaagaatgaatgggtatatatatgtgtgggagtatacagatatagatatagatatggtggtgcagctgtggtgatttggcattttctggtttttgttcggtgcttgttggtattggttggtttgttggttccatttgatgtttacatagaggagctagcttagccactttcggcaaaagaactcacagagatacatttacacaaagaaagaacgcgtttactgtttagagaccaaaccccatcttttgtaccactcaatgaatcattagtccatactcaaactctgaaagcgagtgtttttttagagctgagacaaatagtatatatttgagtttgggtgattggagaagaaactaa

SEQ ID NO: 3319 - DNA, 358 bp, Glycine max
tatatatatatatgccactgccggaacctggtcatcaataatccactccgaaaattattttgaacacccttcatcgatctaaatgggtttggcaggatttctcagaaaactccaagatatctattctaaacataagctcatatccactgttttcttctgtctcttggtctcacctccgtccttcttctataccttctatgccacaagtcatttatccagtgtttttctcaccagtgaaggtgccgacaactctgtaggcgcaacctttcactatatcatagttattgcacaagttgaatgttttgccgttcttggcatatccatgttttccttgctaaagccactgctccatatctta

SEQ ID NO: 3320 - DNA, 376 bp, Glycine max
attgggaaagaccgctggaaaagaccttgtggctgataaggttacttaccccaagcttttggggattgagaagtctaaggagtttgctgcgaaactgaacaaggatgctcaggatcagcttgctggctttgaccctgttaaggctgctcctttgattgctttagccaattacattgcttataggcagaactagattattgttcttgtctctactttacaaacaaatcattgtttgttttaggaatatttagttttttatgaaatgaaaatcattggatttacatttatttacatattgcaatgcaactagggattattaaataggagcctcccctgcccttcttctatgtgcctgccatagtcgtcaattctctaa

SEQ ID NO: 3321 - DNA, 568 bp, Glycine max
gatcctccccctccagatcttcgagttccgctaccgcatcatgatgcacacgctcctccataccgacctccgcttcggcgtcatctacaacgacgccgtctcgggcaccgccgaggtcggctgcgtgggcgaggtcgtcaaacacgagcgcctcgtcgacgacaggttcttcttcttcttcttcttcttcttttcttttttattttttatcgatccaatgttagttattaatttgttaattcaccacttgtatttcatttttttatttaatataaagtcaatcttataatttaaattttttctgattcttttcctccttcccttatttcttatatctgcgcgacaggttcttcttagtgtgcaaggggcaggagcggttccgcgtgaacgacgtcgtgcggacgaagccgtacctggtggggcgggtgacgtggctggaagacaggccgtccgagattaatgtcggaggcgatgacgtggaggggctggcgcgtgaggtggaagggtacatgaaggacgtgataaggttgtcgaataggttgggagggaagaagggggagaataagga

SEQ ID NO: 3322 - DNA, 404 bp, Glycine max
agagaagcaggcttggctggcactctctcaggaagaaggcaaaccctctcctcctgcttttatcctcaagagaatagagggcatgaagaatgaacaggcgatttcagaagtgctgtgttggtctagggatccggcacagttgagaagaatggctaatagaaaggaagaaatctaccaatctttgcagggtgggatatataggttcttgtctggatccaaggagtttgttagtgttttgatgcattataagataccaatggcattggtttccacgcggcctaggaaggctcttgagtctgctatgggggagattgggattgaggacactttcagtgttattgtagcagcagaggatgttcataggggaaagcctgatccagaaatgtttgtgtatgctgcacaga

SEQ ID NO: 3323 - DNA, 754 bp, Glycine max
ttataattaacctctatagtcttcttttaaaacaagttgtctaatttatttcaaataaaaataagaataaactattgaatcacattcagaccttattgatgttacattcagaccttttcataagaaataggttttccatgaaaacttacttcttataaataaaaaactagctcggaggaaatataatttaagatgattaattgtattaatatgaaattgttacatacacatcttaaaaatcatattccacatataaagatcttaaaaatcatatttgtggttatcttttttctacgccctcatgatagcccccgtctacaccgccgaggtctccccggcctcctctcgtggcttcctcacatccttccccgaggttcgtttctttaattctatatatatatctccatcgttatatatatatatatatatgataatatgattttgcaggtttttattaatggagggatattacttggatacatatcaaactatggattttcgaagctgacactgaaggtgggatggcgaatgatgcttggagtgggtgcaattccttcggtagtcctaacggtgggagtgttagcgatgcctgagtccccaaggtggctagtgatgaggggtcgtttgggagaggcaagaaaagtgcttaacaaaacctcagacagcagggaagaggcccaactaaggctagccgaaatcaaacaagccgcagggatccccgagagttgcaacgacgacgtcgttcaggtaacca

SEQ ID NO: 3324 - DNA, 296 bp, Glycine max
  misc_feature (274)..(277): n is a, c, g, or t
tctctcactgtgggcaagaagagcttcttctttgccttcctgatctatgtcatgcaacacaaattttgtctccggaacatagccagcttctttcatttgtgactttaaacctctaagcagggcatatatcttatcattttcaggatgagaagtatctcctgctcgatattcacggactcgactccttacttcaagaagatttttgcttgccaaattctttttttctttctcttttgtcaagtctgaaggctttaacagggacaaaggcaagctnnnntggataactttcccttgtc

SEQ ID NO: 3325 - DNA, 716 bp, Glycine max
  misc_feature (66)..(67): n is a, c, g, or t
ctctaatgctgaagttaggagaggaaattatcaatatttcaatgcctcggctagttctacagttgnntcccctaacgcaagacacactgaaaatggcatcccctcactaccacattgtacttcgtggagcagatcaggcgagtctatgatggtgcgtgaccctaaccgtataactcaaggaaattatttaagtcaacactttcaaccagcagctcctcctccctggctggaccagcagttgaatagcaataataatgatggtcatgctttgccttggcatcagtctcttccaatgccatatgtacaaggtaaagatgtttttcttttctcctttttgttgttctgtggtttcctttttaaatgcattcatatatattacttttctagtgtataatttgcaataacatgcatgtaagaagttttattcaggctctattataaagtagaaaactaaaacttcttggatgtggtatcttaaccaagcaatattttttttgaaagtcttgttttttatggaaactattacgtaaccagacaatctactcattttctttaaattcttcacgtggtgattggatttggtctttctgactcacccttgttctccagctcccagtgctaatggaagttcattagagaatgcaagaatgggtcctcagagatatcatgatacagctggcagcagaagtggccacagatttcctcatcctcctctt

SEQ ID NO: 3326 - DNA, 389 bp, Glycine max
tagagggaagaagaagaagcttaattaattgagagcgagggagggaatagaaagaataaggcattttgcagggtgtatagtaatgggatggagagagaaactttgtaaaaatgaaatggtcaaggattgaagaagagagggaaattgaagagcttgagagagaggggatggggttgaagcacgcatagcgtggggtcggagatgagaggttgatgacgataaaaaaaaaggggggtaataataatcatcaacatccgtgcggggaaaggggagtaatttatgaataataataatgattaggtcgtaatgaagtgaaatctatctagtgagtaatgctgtaaaaaatccacaattcacctctgcttccacctttctttctagctctcacc

SEQ ID NO: 3327 - DNA, 744 bp, Glycine max
ctaagtacgaaaatcgttatccgccgcaacagccactaagatgttctttgagtcttggcacgccacgtgtcagaactgccaacagatagccccatctctttctccttctccctaaacctcgaactcagcacccccatccactggtccctccccactccatcatttattatactttcttcttcttctttattattgttgattaatataacatacacccacatatttcatatgggtacttgttaatttgggtgtggattgttagtttgttacttgttttgttccgttcaggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgtcagcaaggtaagctatccctactttgtgtgttttttatcgacaaatattaattgttagtattattaatcctttttcttttcttctcttttcgtcattagactaatcttatatctcgttatcatgtatttatttcactctattcaaatatattattctggtcttaaatataagaagaagaaaaaaaaatgattcatgctgactaagaatgaaatattgattagagttatgtgttgtgacctgtgcaggctggtcttgctaaacttattggactcgctg

SEQ ID NO: 3328 - DNA, 297 bp, Glycine max
atagtgaaaatggaatcgagcgttctggaatgtctgggcatggagataatcggcgtgatgagcccagtctcgatctgcatgttccttgtggtcctgttagtgtattctctctcctcgccgtccaccaccaccactatcgccaccgctgccaacctcgtctacgccgagaacccctccgacaccaccgcccagaagctcgagggcgccgtcctcaacgccgtggtcttcgtcgtcctcatcgcgctcgtcaccttcctcctcgtcctcctctactactacaactgcaccgccttcctc

SEQ ID NO: 3329 - DNA, 663 bp, Glycine max
  misc_feature (593)..(593): n is a, c, g, or t
  misc_feature (610)..(610): n is a, c, g, or t
  misc_feature (612)..(614): n is a, c, g, or t
  misc_feature (649)..(654): n is a, c, g, or t
  misc_feature (656)..(656): n is a, c, g, or t
  misc_feature (658)..(658): n is a, c, g, or t
tctcaggatatggtatactctttttaaatatgaaaatcagacttacaccatactatcattttttaaaaatcatgtcattaaacaaattgtaaatactcccattttagttatgcctattaaactaaactattttgtttaacaactgtttattattattttcaaaactcaaagaaagacagatttgaattgtaattatgtttatgtgtgaacatgcacacacagtaaaatctccttttatgtttatgtagtctaattttggattttgaatgctaattatatgggtctaaaattgttcttgattaatttgattagggaaatggcgattagctaatacttctagatttaaatttatttcttataattataaatcaataaaattaagagcacaactataaaattatgtctagctgaaatatacgtgaaagttattctgatgtcttgtcactctaattctgtgtatatatgcagaagatattatagacatctttttggtccttgtactagattatggccttgatgtgctcctgttaaaatgaaaacaggtctgactgaaacctgtgcgggaacctttgtctcattaccaaatgaaatanaaatgcttggaacagtngnnnctcctgtaccaaatggtgacgtgtgcctggaatcnnnnnntnanatggg

SEQ ID NO: 3330 - DNA, 368 bp, Glycine max
gcgtggacatgcccggagcagattaccagctcacgaagcttctcggcctgaggccctccgtgaagcgcctcatgatgtatcagcagggctgcttcgccggcggcaccgtactccgcctcgcgaaggacctcgccgagaacaacaagggtgcgagggtgctcgttgtctgctccgagataaccgccgtgacgttccgcggcccctcggacacgcacctcgactcgctcgtgggacaggcactgttcggagatggcgccgcagcgttgatcatcggatcagaccccgacccagcagtggagcggccgatattcgagatgatatcggccgcccagacaatcctgcccgactctgacggtgctatagataag

SEQ ID NO: 3331 - DNA, 345 bp, Glycine max
gggcatctccagcaatatggccaaatccactttcttcatctgccttaacctttcattactcttctctctagtcacggccacttactactcaagtttaaccccaacgcttctgggttttcgcgaggagaagttcacccacctacacttcttcttccatgatgtcgtgacgggcccaaagcccagcatggtgtttgtcgccgagcccaacgggaaagcgaaggatgcccttccgttcggaacggtggtggcgatggatgaccctttaaccgtggggcccgatcatgactcgaaacttgtgggcaaggcacaaggaatttacacttcaatatcgcaggaaagagatgg

SEQ ID NO: 3332 - DNA, 374 bp, Glycine max
caaaccaaatgctaccgtaatgacttttacaacatctttaattcaagtgcgtaggtgactcaccagcactcagacatatactaaattggccttatgtgacccgacaactatgtaaattgtaaaccactgcacccgaagatactattttaaccaagagattaaaatctatttaggcatttactttaaattattgcagtttttaatcccccctcccttctctctcttcgaactatacatgacttccttacacggtgccgacgcccatttatcacgggacaagaatatcacctgctacagttataatattacatggggattcaacgaaaagtgcattgctcttcacaaaaaccagtgctatgatttaggaagtctga

SEQ ID NO: 3333 - DNA, 641 bp, Glycine max
cctcaatatctctggaattggttttggaaaaggagtttgagctttcccacagttcaaagagtgccagtgttcatttctgtggatacaaggcatattacgatgccgataaatatccttgacattacttattggtagtaaaattaatattttaatgtcccatgtttatgttgagctatatgcaaatgtaggattgcaaacctaaatttgttaaactatcattttaaaatcctattagcttaatatatttctcattgcatttttcattttttccttaacttctgttttgtttctgctggcactagtgacgaggatgaatttactggtgagtctcaaacatttaccttagacctgttattatatttggattgaattgcttggtctaacatttgcaatttttttaattggacagatagtgatgaggatgatgaggatgttccattgattaacacagagaatggtaccttcttctcaatactaaatttattgttgggtgtctatgttactacataggtaactaattggcttatatcttatgttaggaaaacctgaaacaaaagctgaagacttgaaggtacctgaatctaaaaaagctgttgccaaggctagtggatcagcaaaacaagtcaaggttgttgaaccaa

SEQ ID NO: 3334 - DNA, 820 bp, Glycine max
  misc_feature (61)..(63): n is a, c, g, or t
  misc_feature (765)..(766): n is a, c, g, or t
  misc_feature (768)..(770): n is a, c, g, or t
ctcaacattttgaagagtctgctgccagatagtggacctcctttggctccaacttgggttnnngtacttgcaatcatctttgttcttcttcaactctttgccattggtctggtaagcgaacaagcttctcttttttcatggaatgggcaattgaccaggattgagttttgtcatgggaaaatattatttggttttgtttgatttttttagggtgggctcaaagaatttaatttttatacactaaaaacattatttagtacggaccacaacgtgaccataatctttatcaatgagtttttttagtttcaaaaaaaagaatcaaataaattttgattatgttttagataggaattgaccagacctatctggtctaagaccatacaataatttcttgtttaatagatatgacttttaattattgcaaatattaacaatcttaccatttatgtatatttatgattgatgatactcttgagaaaattttacactattcttttgacaaaaagaaaactttacacttggtgcattgtaaataaattccataaacaaaacaaccatgagcaagatttaatgtttgtcccaacatgtgacaggtttattctcaagttgcttatgagataatggagaagaaatcagctgatgtgaggcaggggatgttttccaaaagaaatctcattcctcgcataattctccgaacaatttacatgatattctgtggggttttggcagccatgctaccattttttggagacattaacggtgtgnngnnnctattggtttcatccctctagatttcattttgcctatgcttctatacaac

SEQ ID NO: 3335 - DNA, 1393 bp, Glycine max
  misc_feature (692)..(698): n is a, c, g, or t
  misc_feature (703)..(744): n is a, c, g, or t
  misc_feature (746)..(746): n is a, c, g, or t
  misc_feature (751)..(759): n is a, c, g, or t
  misc_feature (761)..(761): n is a, c, g, or t
  misc_feature (767)..(769): n is a, c, g, or t
  misc_feature (771)..(776): n is a, c, g, or t
  misc_feature (779)..(787): n is a, c, g, or t
  misc_feature (793)..(797): n is a, c, g, or t
  misc_feature (801)..(813): n is a, c, g, or t
  misc_feature (816)..(816): n is a, c, g, or t
  misc_feature (819)..(830): n is a, c, g, or t
  misc_feature (833)..(834): n is a, c, g, or t
  misc_feature (837)..(845): n is a, c, g, or t
  misc_feature (847)..(851): n is a, c, g, or t
  misc_feature (855)..(888): n is a, c, g, or t
  misc_feature (890)..(894): n is a, c, g, or t
  misc_feature (896)..(903): n is a, c, g, or t
  misc_feature (906)..(908): n is a, c, g, or t
  misc_feature (910)..(920): n is a, c, g, or t
  misc_feature (928)..(940): n is a, c, g, or t
  misc_feature (943)..(958): n is a, c, g, or t
  misc_feature (963)..(963): n is a, c, g, or t
  misc_feature (967)..(970): n is a, c, g, or t
  misc_feature (972)..(979): n is a, c, g, or t
  misc_feature (983)..(983): n is a, c, g, or t
  misc_feature (988)..(993): n is a, c, g, or t
  misc_feature (995)..(998): n is a, c, g, or t
  misc_feature (1004)..(1004): n is a, c, g, or t
  misc_feature (1006)..(1012): n is a, c, g, or t
  misc_feature (1016)..(1018): n is a, c, g, or t
  misc_feature (1020)..(1030): n is a, c, g, or t
  misc_feature (1032)..(1034): n is a, c, g, or t
  misc_feature (1045)..(1071): n is a, c, g, or t
  misc_feature (1077)..(1091): n is a, c, g, or t
  misc_feature (1093)..(1120): n is a, c, g, or t
  misc_feature (1125)..(1126): n is a, c, g, or t
  misc_feature (1129)..(1156): n is a, c, g, or t
  misc_feature (1162)..(1164): n is a, c, g, or t
  misc_feature (1166)..(1179): n is a, c, g, or t
  misc_feature (1181)..(1184): n is a, c, g, or t
  misc_feature (1187)..(1190): n is a, c, g, or t
  misc_feature (1195)..(1195): n is a, c, g, or t
  misc_feature (1197)..(1224): n is a, c, g, or t
  misc_feature (1226)..(1233): n is a, c, g, or t
  misc_feature (1235)..(1235): n is a, c, g, or t
  misc_feature (1237)..(1242): n is a, c, g, or t
  misc_feature (1245)..(1248): n is a, c, g, or t
  misc_feature (1252)..(1253): n is a, c, g, or t
  misc_feature (1257)..(1261): n is a, c, g, or t
  misc_feature (1263)..(1272): n is a, c, g, or t
  misc_feature (1274)..(1281): n is a, c, g, or t
  misc_feature (1283)..(1291): n is a, c, g, or t
  misc_feature (1294)..(1296): n is a, c, g, or t
  misc_feature (1299)..(1305): n is a, c, g, or t
  misc_feature (1308)..(1311): n is a, c, g, or t
  misc_feature (1313)..(1313): n is a, c, g, or t
  misc_feature (1317)..(1324): n is a, c, g, or t
  misc_feature (1333)..(1334): n is a, c, g, or t
  misc_feature (1336)..(1342): n is a, c, g, or t
  misc_feature (1345)..(1357): n is a, c, g, or t
  misc_feature (1361)..(1388): n is a, c, g, or t
actgggcctcaggattattcaggttcatggcccggaccaccttcccttcttggcaatttcttcaatggactttgtaacaccatatcttcttggttggtaaaatgtttttctcttcattaaggcctacaccatataaacaacaactagcaaaatataactttcctttttttttttctggtttttccctatttacggaataaaaaaaaaaaaaatcaaaatttttttggattcccgtttcccaactcggtaatattcaaatttctggggcttcccaatcggaatttataaaaaataaccccccaaaaaaaatggagggcggcaaacttttttggaaaagtaaagggggcagaaagggaaaaataaaactggaaacaaaatttccctatattcccattttggggtttggacagttccaacaaagccggcggtggcgggtggcaacaaaatggtttgggggcttccccggaccccccaccatttccaggggcccccccacaagcccccccccccccggggtcgggcccccccggacctctcagttggccgccatcacaacctccggacccttttcggcccccgggaaccccaatggggccccccaatggggttcccaaggggcccccgggaagctcttcgggaacccccccgttttataaaaaaaaaaaaggggattttacgggaaatcacttgannnnnnngggtnnnnnnnnnnnnnnnnnnnnnnnnnnnnnnnnnnnnnnnnnncnaaaannnnnnnnncntaaaannnannnnnnttnnnnnnnnnctccgnnnnnccannnnnnnnnnnnnacncannnnnnnnnnnntanntannnnnnnnnannnnntctnnnnnnnnnnnnnnnnnnnnnnnnnnnnnnnnnncnnnnntnnnnnnnnacnnntnnnnnnnnnnncacactannnnnnnnnnnnnatnnnnnnnnnnnnnnnnttacnaacnnnnannnnnnnncccntacannnnnntnnnncctatngnnnnnnnaatnnncnnnnnnnnnnnannntctctaaactnnnnnnnnnnnnnnnnnnnnnnnnnnnacacannnnnnnnnnnnnnnannnnnnnnnnnnnnnnnnnnnnnnnnnnaagannatnnnnnnnnnnnnnnnnnnnnnnnnnnnnaatgcnnntnnnnnnnnnnnnnncnnnnttnnnntccgntnnnnnnnnnnnnnnnnnnnnnnnnnnnncnnnnnnnncngnnnnnnccnnnnccanntcgnnnnngnnnnnnnnnnannnnnnnntnnnnnnnnntannntcnnnnnnnctnnnntngcannnnnnnncgtcaactnnannnnnnntgnnnnnnnnnnnnnacannnnnnnnnnnnnnnnnnnnnnnnnnnnacatt

SEQ ID NO: 3336 - DNA, 996 bp, Glycine max
  misc_feature (979)..(982): n is a, c, g, or t
  misc_feature (988)..(988): n is a, c, g, or t
tggcattgtattctcttgttgttttctaccatgtgttttctaaagagctggagccacataagcctcttgccaagtttttatgcataaaggggattgtctttttctgcttttggcaggtatattcgtatgctttaccttgattgatagacattatataagaatttgcttctgtagaatttggatggtgctattagaagtcattttttcagatgaaatactgaattttggtttggattttcaatttgccaaccactgatagtctttagtcacagcatgctacttttagttaactttttaggttatttaaattgagggatttttatttaggctaaggaaaacatttaacttatccaagattatgaacaccacacacgcactatagtggaactaaggttattggattggtgggagaagatggaacagagggaaatgaaataaaatggttttatgtttcattatttggatgataaaatgagaattgaacctatttaatcctattccgttttcccttcatttttctgtctccaatttgggaggaatgagatggaatggaaagttggaaattttgttcctttccatcataacatatccaaacattaaaattaaggttgtagtccattatgtttcattatacttcattccattttaatccattccatcccatggctttctgtcaatccaaccatggcccttttgctttttgttagttacacaagattgtattagtttaatactgatgttatattagtttaacaactaactttattcaattatacagggaattgtgcttgatctcctggcagcactaggaataatccgatcccgttattcctggctagctgtggaacgcattgaggaaggctaccaaaaccttttggtttgtgttgaaatggttttcttctcaatatatcagcaatatgcatacagtgctgctccatacaaagttaacagtgcaccttcagataaaaagtcaaagtgnnnncagganatggatta

SEQ ID NO: 3337 - DNA, 481 bp, Glycine max
ctttcgtcgtgaccctgttcgtttttcattgtctccaaggtcagcttttcttttttgttttgtacttgattggaaatgttgatgattagttgcttatgtttgtgattttttgtttcctatgtagattgagtaataagatggggttggaggctgcagtggaggcagcggcggaattccttaacaaggcagtgaaaccagtgctggtaggtggtcctaaactgagggtggcaacggcatctgatgcctttgttgaactggctgatgcgtgtggttatgcgcttgctgtgatgccatcggctaaagggcaggttccagagcaccatccccattttatcggaacttattggggtgctgtgagcactgccttctgtgctgagattgtggagtctgcggatgcatacttgtttgctggtcccatttttaatgactacagctctgtggggtattcgctccttctcaagaaggagaaggcgatcattgt

SEQ ID NO: 3338 - DNA, 325 bp, Glycine max
gagattcatggagcgatactcaaatgcaaatggtttgcaattcatcaaaaaatgagttaatgtgctaactctgcccttctattcttttgccctttttcaggaagtttgtgttctacgatatagtcacatataaaacctgagtgaaatgctatattggcgtacatgtaacttcaattcacatactcatgcattttctgacaccccaagattttatgaaattttgcttgtcctgctgctgtttcgctatcatgtaactgttttcttatagacaagttggaaagctcatcacgaaatgacttccttctattatgtttgaataagcaaa

SEQ ID NO: 3339 - DNA, 597 bp, Glycine max
gaagttatcagcaaggggcaaatatgtatccgtaaacattggccctgtccaagttgtttccagtgaacaggtctttttgtcttgtatactgatatcttttcctctcgttgaactaaacctttgtagcttattttttttgctaaagatggatttattcgtaaaaaaacatgaaactcccattacacaaacactaaaatgtgtgtccctgcaaatgacacttggtgaatatacctttgatatacaatgttgttgttgttgttttcaggtccaagctgtatataatgccatgaggagggatgacaggatgaaatattttttgtagtctgttagattttgaatagaatgcagtgttaccaagggatgaattaacacgtctgccttctagtagttaggctggttttgttatttgattaatccatggtatcattgcagtagatgtaatcatgatgcaaattggatctcttccgtattttgcgaagatgtaattagtatgatttgttgttaccgatagttatattaatataatattataaacagtatattctagtgtatggagttgaagggggtgagtcgtagatgtcctgtttggtgccttaa

SEQ ID NO: 3340 - DNA, 528 bp, Glycine max
caggtctcttaacttctgaaatttctttttgcttggttgtttatgctttagtttcctaaattaatatgtgctgttatcatgattattttgagaatgttagttttgtaatccttagtcaaattatatttgttctgtctagtcatagagtgttactgatttaagttcataattgcgtttcaggtttagcaatcaagttggatccaattgatcaagatatgatggagagtggaagctggcactgggattacaagatagaaggttctcacattcagctagaattagtagaatcataaaccactaaccactttaaatgtctgctgcgtgaatcatggttcacaactggcattggggttcattacctaaataatttcgattaccaagtgacaggttgaacagaagttaagcctttgtcacttttggttgttttaattgtaatatgttggtaggtttgtaaaatccgtgtcacttccctcgtgttcttctatttttccattctttacccccttttatttattgggatgatctcat

SEQ ID NO: 3341 - DNA, 930 bp, Glycine max
ttcttgtgatctacctttttataagcttaagcaaaaatctgtttctcgattatatataaccagtagcttgtttggaatgcttgtcttttgatagggaaactatgctgtctctgggggattaaaaggagttgaagtgctagaatccaaggcaaagtctttcaaggctcgaatgacggtattactttgcccaattttctattttccaatgccacctttcctcaaagaaataatgcctttgcttctctgtggcaggtgcgcctagctgttgctggtgctttccacactagttttatggaaccagctgtgtcaagattggaagcagcattggcaacaacagaaatcagaaccccaagaataccagtcatctccaatgtgaatgcacagccacatacagatcctaacacaataaagaagatattggcacgccaggtatgctactgatacttgtttcaatctaacaagaagacatgaatgggaaataattatacctgttatgcatttggcaggttacttcacctgttcaatgggaaacaacagtgaagactcttctaaccaagggtctgaagaaaagctatgaactgggacccggaaaggtaataaatatacaaatttaggtttggtttgggaaaaaaaatcaataagtattttatagaagaaaatgagtaggtaaagtgaataaaagttttcctacaagttaaaattagcttatacacttcagtttttggagaagttaaacgagggatcttctaaaataattgaattgcataagctaattagtggataattttgattcattttgcccttttcttttctttaagtattgataaccgattcttgtttgttaactataatgtggaactgctagttagcattgttagtggtgtcctctagctcaatgaatatgctgatatttgtttttctggactcatt

SEQ ID NO: 3342 - DNA, 766 bp, Glycine max
atcatcgctggcgccaatacaaaatctcatcccttcccctttctcttactgactctctttgtcaccggtaataacttttatcctcttctgttaaatttggggtccatccatgtcaattttttttatacatcaccgtccactttccatcgccaattaattcttcccctcaatttttttcacttccctctcatctcccataatacatgtttcttctataaacatcatcatcaacaacaaacaaaggtgcattggtggttggtttgtgagaaatcagaaatattttgtattgtaatttgtagggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgagtgagtcagttattagcaactatacatatccagttatcgatatcaaatgttttttgttttttagctcaaaatgttttttaatgtaaagctgcagttttttaatttttattttttggggattgggggttctgagaattttttaattactgaattccacgcacgtggttattatgacttgcagggcgagtgagaaatgccagaaggagaagagaaagacaatcaaggagacgattact

SEQ ID NO: 3343 - DNA, 638 bp, Glycine max
tttctgtagaatgattgtctaatgttgttgttatccctgtgtgtattatgtcgttgataactgcagagttgctgctgcgctgcatgatctccagattgactgttgggttatgaatgttgttcctgtcagtggatttaataccttgcctgttatatatgaccgcgggctgataggagttatgcatgattggtatgaaaaatttgcttggatatttgttgagttatttttttatgtgattggtgatttcatactgtgtgaagttgccattgtaaccgcataataatctaagctgattggcaagtgaaactcagagggccttattggtttctggtgtgagaaaaatggtcaagttccagaaaatatgttctagaatattattttcagaaaaaacacgtggaaaatgattgaaacaatcttgacttatatttactattcattgatatttttttaatctagcatgaaaatgaacatattttgtcgggggttgttaccacccagtaattgttctctccaaacatacatgctatatacttcttgcttgattttcattttagctttatattattaaaggtgatatgtgaatttgcttttttgttttatttgtgttggttgagagcacactatatattagaattcaa

SEQ ID NO: 3344 - DNA, 400 bp, Glycine max
tatttccttgatgctgataaggaacattgtcattaaagttgttgctcttgctagctttctggtagagtaaagattggtgatccttctgatttctattgcatatatcctgtagaagtctttgcttcctcaacaactctcataagtcataagttcatttattttctttcttttcttcttctcccttgatcattgcttagtccccttggtcattttcctctgattttaaattctccaattgcctacatcttttgtcaatgaacttttgttctttgcacatacttctctcacaactctttcctctctctactagctacttatcttactcttccctattaggaaaagctggtggcaaaggaaaaagtgatgatgagatgcagggtgaagaagatgaagaagatca

SEQ ID NO: 3345 - DNA, 207 bp, Glycine max
aagagctgattacatgtttaggctggttgtgattgttgtaaattcttaagctgggaagtttcaattttcaagataaaatttatctttttgtatcctgtaatatttgtttggtggaaagaaagaattgttattaaagccagaaaagttaatgacgccttaaaccatagaataatggcgtcacctttccctgttgccttccacgatctt

SEQ ID NO: 3346 - DNA, 372 bp, Glycine max
gagtttaccgaggctgagagcaacatgaatgacttggtggcagagtatcaacagtatcaagacgccgccgccagcgaagaaggcgagaacgagatcgatgacgaggaagccatggctgcatgagagcctcattaaagcctctccggaagaaattattatataatctagattaccacgtcatcatggtcgactcaattttcactgttacattaatcaaaatttttaatatacaataacaaattttgattagatgcaatgtgaagattgatcaaaattattactatttaatgatttctagtgatgtcatgagaaatgcaaatcaaaacacttggtatatgccatatggtgatggtaagggaaaggaaaggaaag

SEQ ID NO: 3347 - DNA, 525 bp, Glycine max
tttccctcatttccatggccacagaagagcccactgtcgcggtggaacccgctcccgaacctgcctccgccgatcctcccccggaggagaaggaggagaccaaacctgaagccaaggctaagaaaaccaaggagcccaaacctaaaaaggtttccagacctcgcaaccctcccactcatccttcctacgaagaggttcgatccgaaaccataattctaattctagttctaataataactctaattctaattctcttacaatttttgtgatctgaacttggatctaattattttgatttattttttctgcagatggttaaagatgcaattacctcgctgaaggagaaaaccggttcgagccaatacgcgattgcgaagttcatcgaggagaagcacaagcagcttccaccgaacttcaagaagcttcttctctaccatttgaagaagctcgtcgccgccggaaaactcgtcaaagtcaaaggctcgttcaagctcccacctaccagacctgctgcatcttcttctt

SEQ ID NO: 3348 - DNA, 528 bp, Glycine max
cccttttatgaaaaatgatgataaagttgatacatattcctcaaaactcactcaaccaagttccaaaaatgaggttagtgttgaagtacctaatggagatatttcggagggagcttcgcaagaagcccttgggaataaccctggcatccaaaattcaaggtgattattatattactgtttttatcattctatgattgttaaaaggaatataagactctgattttgtttccttccttatggtttgtttgaaaataagcagagtagtacaggatgttgctgatcattaaattttctttttttgttccttcaggtgtacaggaacagatcctaactcaaaggaagtaaattctaacaaagtagtaccaacttcatcagagcagaatgtttcaacatctattttgttaagccaggctgtttcacatcccttgggaaacggagcaattctggaccaaacaacaatcagcaacaagcaattaaacactgattcagtccaagacacgtctttagatcatgcagacaagtcaagca

SEQ ID NO: 3349 - DNA, 389 bp, Glycine max
cggcatttggctggcatcgaagcccgacaacgagtgcgtggccaacttccggtggcccattgtcatcatcggcatcctcatcctcctcgtttccctggccggttttgtcggtgcctactggaacaaacagggtctcctcgccctctacctcttctgtatggctctcctcatcgccctcctcctcctcgttctcgtcttcgcattcgtcgtcaccagacccgatggagcctatgatgtccccggaagaggctacaaggagtacaggcttcacggcttctcctcctggttgaggaaccacgtcaccggttccgggagttggcagaagataaggccctgtttggctgcttctgatgtctgctctaagctcacccaggattacatcactgctg

SEQ ID NO: 3350 - DNA, 387 bp, Glycine max
agctgatggggttcccccaaatgggcgaacagaaggcaattgaagaagcagccgccgaaggcctcaagggcatggaacacctcctccgtctcctctcccatcaaccttcccacctccgcactcaccacaccgacgccaccgtttccaacttcaaaaaactcatctcccttctcaaccgccgcaccggccatgcccgtttccgccgcgcacccctcccttccacttccaactctctcgccccatcccctccaccggctaacccggtcaccttcgccccttcgcagtcacagagtctaaccctcgatttctcaaaacctaacatgttcaacaccaccaacgccaaatccatggacctcgagttctctaaagaaaccttcagcgtctcct

SEQ ID NO: 3351 - DNA, 643 bp, Glycine max
  misc_feature (615)..(619): n is a, c, g, or t
  misc_feature (630)..(631): n is a, c, g, or t
gtgaaaggaataaatctacacttatttaataagcacaggattacttaaaaatgtctcatgattttgtaatttaatattaaccctttatgatttgaccccatgactataatttacctttctcactctcacgtaataatagtcccctattaattttttgttgtgaaattattcagtatttgtgagtgttgaattgttttgcatttggttcttgggggagaagtggggtgtaggagttgaacttctgctactaacaggattcaatgtcttgtgcaggtgtcaagcgcaacagccacctttgcaatgaccttctcctcatctatgtctgtcatagaatactacctgttgaaacgttttccagttccttatggttagtgcccaagaatttctaagttctaattaactgtgtatatttgatgcaattattcaattaattacttgtttgcctctaacttatgtgttttgttaaatgttacacagctctttacttcattcttgtggctactattgctgcctttgttggacagcacattgtgagaaaactaattatcctattcgggagagcatctcttataatcttcattctagcctctacaatatttgtcagtgccgtctcgnnnnntgagcgtcgtnncttttttttttc

SEQ ID NO: 3352 - DNA, 363 bp, Glycine max
gtggtaatggcaagtaacggatatcctggatcatatgagaagggaactgtgattgaaaaccttcaagaagctgagcttgctgctccaggtatcaagatatttcatgcaggaactgcttttgactctgaaggaaaatttattgcaattggggggcgtgttcttggggttacagccaagggaaatgatcttgaagaggcacgtgatcgagcttatcaagctgttgagaaagttaactggtctggaggcttctatcgtcgggatattggttggagagcccttcctcagaaacaatatgttacaaagggataaactacagctgagtcctagaacagtaatagacattggtcaacactcattagtgga

SEQ ID NO: 3353 - DNA, 366 bp, Glycine max
gtagaacggtggatcagaacttttcgcagaggaaaaccatcgagtggaacccaagggatggtaaattcttgctcgctatatgcgtttcggggcaaatgtcgaaccatttgatttgtttggagaaacacatgttcttcgctgcgttgttaaatagggttttggtgattcctagctccaaggtggattaccagtacgatagggttgtggacattgatcacattaacaagtgcttggggaagaaagtggtggtttcgtttgaggagttttcgaatttgaagaaggggcatttgcacatcgataagttcttgtgttacttttcgcatcctcagccttgttacttggatgatgaacggttgaagaagttga

SEQ ID NO: 3354 - DNA, 704 bp, Glycine max
agatcttttgggtgaaattcttttgactccattgttgagggctgtgatggcgtctttcatactgcttctccttttattatcaacgtcaaagacccacaggttcctttattccgttttgctttaatttgttcataaattaataattgaatgtggtatgatttcatggtcaaaattcaaatgagtattcaattttaactaagttgtttttctgatttcaggctgacctacttgacccagcagtgaagggaactcttaatgttcttaaatcatgtgtaaaatcgccatctgtgaaacgagtcatcttaacatcttctgtggctgcagttgcatataataaaaggcctaaaagtcctgaagttgtagttgatgaaacctggtggtctgatccagattactgtagggaattaaaggtatgtgttttctttttcctaatccatattcaaaagttgcaattgaataacacgttttccatataaacatccattttctaatgtatttgttccgatgagcagaaaagtaataattagtactactatttagtgtgactatgatgtgttagtattgtggttaactttgtagccatttgatatttgtgttgtcagctgtggtatttactttcaaagactttggctgaagatgctgcctggaaatttgccaaagaaaacgaccttgacttggttgttgttaacccagcaatggttgta

SEQ ID NO: 3355 - DNA, 393 bp, Glycine max
ctgctactgctatctttaacctatctatttatcagggaaataaagcaagagctgtaaaagctggtatagtagtcccactgatacagtttctgaaggatgctgggggtggaatggtagatgaagcactagctattatggcaatccttgcaagccaccatgaaggccgggtagcgattggtcaggccgagccaattcctattcttgttgaggttatacgaaccggctctccacgcaaccgagagaatgctgctgctgtcttgtggtcactatgcactggagatccgctgcaattaaaactagcaaaagaacatggtgcagaagcagcactgcaggagttgtcagaaaatggaactgatagagctaagagaaaagctggaagcatattggaactca

SEQ ID NO: 3356 - DNA, 544 bp, Glycine max
tgtcagactttttgaattcagttgttaactgggatcaagtaccctttgaggatcccaattgtcaacagcagagctaccccttgtttaatgttaaggataacatattaaacagcgacttagattctgaacttgccaatatgacagtgagtaacagctcttacactattttatcttttaatctttctaggtaggttctgcctcaatagtaaaacatagtagttcccaactcccggtgtcagctctaacaatctaacatggttttcttgtgtctcctgtataatgatagtcttattgtatgctgcagtgtatgcaagctggttatgcggagggggcaattgatggaaggattcctttgttgataacttcagaattttgcagcaccactggaatccccgttgactgtgttggtgacgagcagaaaagcaatgttgggttatttcaaaacaattcccagagagcttttactgatgttaatatgggtcaagtatacaatgtagtcgatgattatgagcaacaaagaatctgtagtgcagttgctagtggc

SEQ ID NO: 3357 - DNA, 564 bp, Glycine max
atactggcattcgaagtagctaatacaataaccaaaggagcaattttgtttcaatcacttgctgaagaaaacattcagttccttaaaaatgaggttttacaatcggagggggttcagctattggtatcgaatgatgtggagaagttaataactcttgctgaggctgacaaaaggttctagcttgttcaatgaatagtatgcttgttgtcattgctatgaatttcctttatgttttttatcctgatttttggggggcaatttgtagggaagaactcaatgtcttctcaagggaagtaattaggtttggaaatatgtgtaaagatccacagtggcacaacctagacagatatttctcaaggtgagtttccatgtacattgcttatgacaagattatgctaacttatcataattgaattagttgattacaatcacaagcatttaacattataatctgtccaaaaaatatcagattagactttgatgtcctggatgacaaacgatatcaggaagatgcagaaaagacgatgcaggagtttaccagcctagttcggaatactgctgaat

SEQ ID NO: 3358 - DNA, 643 bp, Glycine max
  misc_feature (579)..(580): n is a, c, g, or t
cgggtaagtaagaattgcttcaagtttatcttttctagttgatgatattgacagctaataaataacataaactaaaaaaaagttctggtaacatatatgattaggcctttaatttgactgaattcctttttatattcatgtcaacattacaccgttttcaagtcctgtgtttcctgaactccaagaagtcaaactatgattaatattacttggctgcattttttttgtaaactatacccctcaagagggactaatatggggttgaattgtatgtgtaatgcaggttgccttgctctttttcttttctgttttctggggattctaccctctctacaatgcagttttcacattccctcaagagaggagaatgctgatcaaggaacggtcttcgggaatgtaccgcctttcttcctactttctggctagaacaataggagacttgcctctggagcttgcactaccaactgcatttgtcttcataatctattggatgggagggcttaaacctgatcctatgacttttatcctttcacttcttgtggttctttacagtgttgttgtctctcaaagccttggttnnccttttggtgctattttgatggaggttaaacaggcaactactctagcttctgtgacaaccctt

SEQ ID NO: 3359 - DNA, 361 bp, Glycine max
atgacataatatctctctctcttctccaacctctctcatatatgtaaagacaaaaccaaaaccgtgtttatgcttcagcccttcatcatatagatctgcctgaaaaaaacccttgcgatcagatccagcccaattaatctctctctctagaatgtcttcccagcgcgcagatctagagtgccggatcttcccggagcccgaaatcgaccacttcgaccggctaccggactcgctcctccttttggttttcaacaagatcggcgacgtcaaagccctaggccgctgctgcgtcgtctcgcgccgcttccactccctcgtcccgcaggtcgaaaacgtcgtcgtccgcgtcgactgcgtcatc

SEQ ID NO: 3360 - DNA, 1034 bp, Glycine max
  misc_feature (975)..(978): n is a, c, g, or t
ttgtgttctatcctactcccactcgagtgttaggaatagagtattcattcagtacattggttaatgtgtgccatccaaagattcgtgttccagtgtttgctatgatggaatagagtattcaatttgtttttgaaaacctggatgaatagtgtctaaatcctacaactgtagttagaagtacttccataaattactttatgcgcatgcacatgtgtatgtatattcaaaagctactcttaacctttgtttttcttaatgaagttatctaactatcttcattttttttaatatattttttaattaaaaaaaccttttaccataaaatgtgctgacaaacatgccctttttttcctttcaaatgccatgttcaggaaatatctcgaaagatgcatctgtaacacctgatagaaccacttcacaggataaagataaagagagtatgtgttccttatgaatttcaagtatttagtttaattataaaagatagatttagtttattgatcttcttcaatagtgtttttttgaatttattgaactttggttgttgtgatgttaatggtaatgcaattattatccaatcattgtgattaaactaatttataaatgatgggtcattaaaatgccccctcactactcccacaaattcctgtgccataatttctgcaaatgattccagagagtgctgtagaaaatggtgttgtcaaggagcaagctcagcctataacgacaaagccaacatccaatgggagcaatgaagatcattctctacaaaaggcggacgtgtacaagacactcagtggtcacagagctggtgaggctgccattgtctatgaacatggagctgatgttgaggcactaatgccaaaactacggcgatctgattactacacactgcctcgtatacatgaactggcggccaaggaaagagctgaaccaggattctgcagtcatgttaaggacttcgtggttggaagnnnnaggttatggcagcatcagattcttgggtgagacggacgtgcgacggctcgatctga

SEQ ID NO: 3361 - DNA, 343 bp, Glycine max
tagcgtcgcgagaggatgttcttactagggctgctgcacttggacgaggagctgccaccactgggttcaagcggttcctagctctaactgaagccgccaaagacaggaaagatgggcctttcaggaagctctttaatccataatgacgagagtgctacaaccccgattttttggccagagcgcatgagcttttagttttctgtttctttttgcttttcttctctttgattctttatgtaagtttagtatcgtgttaatctgatttcactcaatcaactgaaagctgttaatgaagagatctatctacaaatttgcataattctttctgtagctcataagggat

SEQ ID NO: 3362 - DNA, 1194 bp, Glycine max
  misc_feature (53)..(58): n is a, c, g, or t
  misc_feature (610)..(611): n is a, c, g, or t
  misc_feature (1135)..(1137): n is a, c, g, or t
gaaagtgatcaatatgactttgaagaaaagataaattttgctgtttttccatnnnnnnaaggggggccacacaataaccacattgctgcgcttgctatagctttaaaacaagtggctactcctgagtataaggcatacatgcagcaggtgaagaagaatgcccaagctttagcatgtgctttactgagaagaaaatgccgtctagtaactgggggtacagacaaccatttaatactttgggatttaaggcccctgggattgacaggtattgtatgagcatgccatatttttatgatatattgctaattgatttttttatctgtttaatgtctatgtgtccattagactcaactagtttacatgttggctacacattgcattagactcaactagattctttgacattttatgccttcacatttacatatcaagatgggcatatggatttttatagaaagaataggggcttcctaggctttcccccaaaacgtcctaggtgtgaccctgtagcagggcatgcgctttatagagacaaggtgaccaatgtctttttgcccattcttataatgaaatataaagtcaattatatgatcaattcttatctcatcannggaagtttgctacatgcatcgatcaacaccattaggctctaaaaaacattttttttttgggtaaaaccattgatggcaatgtctttttgccatggtatttctcaatattttcgttggtgcttcgtaccctttttaattgattacatttgatccacttttcttagaagcacctcccctgttgtttttctcacgttgaaaccaacttaagtgagtcccattatatttctcctaagttggtgaaacttgatatttctcccatacatttgttctggatatctataatgttagcaaaaccccttagcattgtcatctttactattattttttgaactcttttaggcacttcaccaccaaatattaattttcagtagaacattgctggtgttgtggttgtttggtagacttttgctttgagtttatgcttgaatcctattgttcaagctggacaatcaatgaatttttttttggtatatggtaacaggctctaacactaagcttcattttttttgtgcttgtaggtaaannntatgagaaggtatgtgaaacatgtcatattactttgaataaaattgctattttggcg

SEQ ID NO: 3363 - DNA, 1574 bp, Glycine max
  misc_feature (349)..(349): n is a, c, g, or t
  misc_feature (375)..(376): n is a, c, g, or t
  misc_feature (378)..(378): n is a, c, g, or t
  misc_feature (398)..(398): n is a, c, g, or t
  misc_feature (400)..(400): n is a, c, g, or t
  misc_feature (410)..(416): n is a, c, g, or t
  misc_feature (424)..(425): n is a, c, g, or t
  misc_feature (428)..(430): n is a, c, g, or t
  misc_feature (432)..(432): n is a, c, g, or t
  misc_feature (434)..(434): n is a, c, g, or t
  misc_feature (436)..(439): n is a, c, g, or t
  misc_feature (442)..(448): n is a, c, g, or t
  misc_feature (453)..(455): n is a, c, g, or t
  misc_feature (457)..(460): n is a, c, g, or t
  misc_feature (470)..(476): n is a, c, g, or t
  misc_feature (478)..(481): n is a, c, g, or t
  misc_feature (485)..(493): n is a, c, g, or t
  misc_feature (500)..(502): n is a, c, g, or t
  misc_feature (505)..(513): n is a, c, g, or t
  misc_feature (518)..(523): n is a, c, g, or t
  misc_feature (525)..(533): n is a, c, g, or t
  misc_feature (536)..(554): n is a, c, g, or t
  misc_feature (556)..(561): n is a, c, g, or t
  misc_feature (567)..(575): n is a, c, g, or t
  misc_feature (577)..(577): n is a, c, g, or t
  misc_feature (579)..(622): n is a, c, g, or t
  misc_feature (634)..(638): n is a, c, g, or t
  misc_feature (640)..(642): n is a, c, g, or t
  misc_feature (645)..(645): n is a, c, g, or t
  misc_feature (647)..(659): n is a, c, g, or t
  misc_feature (662)..(666): n is a, c, g, or t
  misc_feature (676)..(683): n is a, c, g, or t
  misc_feature (688)..(705): n is a, c, g, or t
  misc_feature (715)..(719): n is a, c, g, or t
  misc_feature (721)..(727): n is a, c, g, or t
  misc_feature (730)..(736): n is a, c, g, or t
  misc_feature (738)..(746): n is a, c, g, or t
  misc_feature (748)..(751): n is a, c, g, or t
  misc_feature (761)..(763): n is a, c, g, or t
  misc_feature (765)..(766): n is a, c, g, or t
  misc_feature (769)..(784): n is a, c, g, or t
  misc_feature (790)..(791): n is a, c, g, or t
  misc_feature (796)..(806): n is a, c, g, or t
  misc_feature (809)..(812): n is a, c, g, or t
  misc_feature (814)..(824): n is a, c, g, or t
  misc_feature (826)..(842): n is a, c, g, or t
  misc_feature (846)..(863): n is a, c, g, or t
  misc_feature (865)..(869): n is a, c, g, or t
  misc_feature (871)..(875): n is a, c, g, or t
  misc_feature (878)..(879): n is a, c, g, or t
  misc_feature (881)..(883): n is a, c, g, or t
  misc_feature (889)..(901): n is a, c, g, or t
  misc_feature (903)..(915): n is a, c, g, or t
  misc_feature (920)..(922): n is a, c, g, or t
  misc_feature (924)..(929): n is a, c, g, or t
  misc_feature (931)..(931): n is a, c, g, or t
  misc_feature (947)..(957): n is a, c, g, or t
  misc_feature (969)..(970): n is a, c, g, or t
  misc_feature (972)..(973): n is a, c, g, or t
  misc_feature (975)..(989): n is a, c, g, or t
  misc_feature (1000)..(1000): n is a, c, g, or t
  misc_feature (1002)..(1006): n is a, c, g, or t
  misc_feature (1008)..(1016): n is a, c, g, or t
  misc_feature (1020)..(1043): n is a, c, g, or t
  misc_feature (1045)..(1061): n is a, c, g, or t
  misc_feature (1072)..(1076): n is a, c, g, or t
  misc_feature (1078)..(1082): n is a, c, g, or t
  misc_feature (1086)..(1099): n is a, c, g, or t
  misc_feature (1102)..(1105): n is a, c, g, or t
  misc_feature (1110)..(1115): n is a, c, g, or t
  misc_feature (1120)..(1139): n is a, c, g, or t
  misc_feature (1141)..(1141): n is a, c, g, or t
  misc_feature (1144)..(1165): n is a, c, g, or t
  misc_feature (1168)..(1169): n is a, c, g, or t
  misc_feature (1172)..(1180): n is a, c, g, or t
  misc_feature (1185)..(1190): n is a, c, g, or t
  misc_feature (1192)..(1195): n is a, c, g, or t
  misc_feature (1197)..(1211): n is a, c, g, or t
  misc_feature (1215)..(1217): n is a, c, g, or t
  misc_feature (1220)..(1238): n is a, c, g, or t
  misc_feature (1245)..(1245): n is a, c, g, or t
  misc_feature (1248)..(1253): n is a, c, g, or t
  misc_feature (1257)..(1257): n is a, c, g, or t
  misc_feature (1259)..(1274): n is a, c, g, or t
  misc_feature (1276)..(1291): n is a, c, g, or t
  misc_feature (1299)..(1308): n is a, c, g, or t
  misc_feature (1310)..(1319): n is a, c, g, or t
  misc_feature (1321)..(1324): n is a, c, g, or t
  misc_feature (1326)..(1333): n is a, c, g, or t
  misc_feature (1336)..(1348): n is a, c, g, or t
  misc_feature (1352)..(1361): n is a, c, g, or t
  misc_feature (1365)..(1368): n is a, c, g, or t
  misc_feature (1371)..(1377): n is a, c, g, or t
  misc_feature (1380)..(1398): n is a, c, g, or t
  misc_feature (1401)..(1427): n is a, c, g, or t
  misc_feature (1432)..(1441): n is a, c, g, or t
  misc_feature (1449)..(1451): n is a, c, g, or t
  misc_feature (1454)..(1475): n is a, c, g, or t
  misc_feature (1478)..(1481): n is a, c, g, or t
  misc_feature (1484)..(1490): n is a, c, g, or t
  misc_feature (1493)..(1516): n is a, c, g, or t
  misc_feature (1518)..(1518): n is a, c, g, or t
  misc_feature (1523)..(1526): n is a, c, g, or t
  misc_feature (1531)..(1533): n is a, c, g, or t
  misc_feature (1535)..(1536): n is a, c, g, or t
  misc_feature (1542)..(1552): n is a, c, g, or t
  misc_feature (1554)..(1565): n is a, c, g, or t
  misc_feature (1569)..(1571): n is a, c, g, or t
cgcaagagacaaggttcaagggaaagtggtactgtccgacttgcatattactcccacaatgtcaacgatgaatctttgcacgaactaaattacattcataaatgaccactgtttcaatagaattgtcactttttagtgaattatttgtcttctatattgcttggtcatttgtgcttggcaaagaggccaagtgggctctatcaggcctcatgtataaagtcctctaagatttgagagaagtgatttcagatatgaattttggagaaagttaattacatgtgaaatgcagaagtataggcgcgtgtggttgtataagaatggagatatttgtttggaaacctctttcagngtgagagaaccacgtgacgactgcgnnangcactaaggcgcccgtggtntnctacgatgannnnnnntccctcanntcnnncntncnnnnggnnnnnnntccannncnnnncctctcaaannnnnnnannnncccnnnnnnnnngactttnnnaannnnnnnnngtacnnnnnncnnnnnnnnnacnnnnnnnnnnnnnnnnnnncnnnnnnaattannnnnnnnngnannnnnnnnnnnnnnnnnnnnnnnnnnnnnnnnnnnnnnnnnnnntccctttcgttnnnnnannntcncnnnnnnnnnnnnncannnnncacacaatgnnnnnnnnaaacnnnnnnnnnnnnnnnnnntctctccttnnnnncnnnnnnnccnnnnnnncnnnnnnnnncnnnncccctctcgnnntnnccnnnnnnnnnnnnnnnnctgctnncatannnnnnnnnnncannnncnnnnnnnnnnncnnnnnnnnnnnnnnnnnccannnnnnnnnnnnnnnnnncnnnnncnnnnnacnntnnntccctnnnnnnnnnnnnntnnnnnnnnnnnnntcccnnnannnnnncncatccccatctccacnnnnnnnnnnncttcaatccacnncnntnnnnnnnnnnnnnnntccccatccancnnnnntnnnnnnnnncacnnnnnnnnnnnnnnnnnnnnnnnnannnnnnnnnnnnnnnnnacactattcannnnncnnnnnttcnnnnnnnnnnnnnnacnnnntctcnnnnnnctccnnnnnnnnnnnnnnnnnnnncnctnnnnnnnnnnnnnnnnnnnnnnctnnctnnnnnnnnnacccnnnnnncnnnncnnnnnnnnnnnnnnnaccnnntcnnnnnnnnnnnnnnnnnnntccggcncannnnnnccancnnnnnnnnnnnnnnnncnnnnnnnnnnnnnnnnctcttccnnnnnnnnnntnnnnnnnnnncnnnncnnnnnnnnccnnnnnnnnnnnnntccnnnnnnnnnncctnnnnatnnnnnnntcnnnnnnnnnnnnnnnnnnnaannnnnnnnnnnnnnnnnnnnnnnnnnnctctnnnnnnnnnntcctcacnnngtnnnnnnnnnnnnnnnnnnnnnntcnnnnccnnnnnnnccnnnnnnnnnnnnnnnnnnnnnnnntnttccnnnnacttnnntnncttctnnnnnnnnnnntnnnnnnnnnnnnctcnnnctc

SEQ ID NO: 3364 - DNA, 736 bp, Glycine max
cagcatgcatctcggtgttcttgcaactgcttggcatgccatattgactggcaccatgttcactgtgtattacaagcccaggtttgtaccttgttcttgcacatgaatgaatgatttgagggtttcttttttaattgaatccctgcggcaggatttactcatgtacgggaatgttgccaaatttgttttacaggactagtccagcagagtttattgttccctatgatcaatacatggagtctctcaaaaacaattataccattgggatgcggttcaaaatgaggtttgaaggtgaagaggctcccgagcaaaggtatgaatgtgtagtgatttctcaaaaaaaatttagtcgcctatgctaattttcttttcttctctttccattgttgtctacgtaactgagcagtgttgtattattatcaaacatataatttgaatagaataaattctttgacttggcatgataaatctgtaggtttactggtaccattgttggaattgaagatgctgataccaaaaggtggccaaagtccaaatggagaagtcttaaggttgcattctggcttttatgtcactcttgtgtgtctctgttgaattggaaatgttataatggagtttccttgtgtgatgtgttttccaggtgagatgggatgaaacatcaaacataccacgtcctgagagagtttcacaatggaagatagagcctgctcttgctcctcctgctctgaatcctcta

SEQ ID NO: 3365 - DNA, 407 bp, Glycine max
ttgccttgtaattgaaggtgagaaatggtcagcaacaaaatggattcatgtggactcatttgacaaggtggtgggagatggaggggattgcaatgataagcactaaaactgtgagagatgggctacccttggagaatgtactagtaatcccgaatatatggttggatctccaggccttcctggctactgcatgaaaagttgcaaggaatgttagaagtgttactgaatgctttccagattccacatggtatttttgacgttgactcaaatttcaattggttctcagatttttattatgtattttctttttttgtgaattgtattgtattctgtctcattataattagctctcagatagtgttctagtgcatggtcacacttcaagaggtacatttcgtcggataaaa

SEQ ID NO: 3366 - DNA, 444 bp, Glycine max
gggtgtaagataattcaggttcatattaatttgttacaaaatgtgtgtatcaacaacaaaaaaagatctagatttaatagctattgttgttggcggaagtgcaggttcaagcgtgtggatcaatggtaacagaggagcaacctcatgccatgttaataccgatggagtattttctcatgggatatggcttgtacagaccatctaagctgagtgtcagcccaagaagtcccctgagtccctcttgcatttctcctgagctttactctccagagagtatgggtttgaaattgaaaccaataaagacacggatttccgtggagatatagtagtagtagtaggtgaataaagattgccgctctttttgttttgattgttgaacaagtttatatatagttctttgttttgtcaaaaatctgacaagggagggatgtcataaccttgtag

SEQ ID NO: 3367 - DNA, 406 bp, Glycine max
tggttctttgattgctctttctcataaggagaaggaaatcacaaatgctttggaaggagctggtacacaaccaacagagtctgaagttgcttatgaagtttccttgatgtctcagacaaatatgtatagaccaggtattgatgttactcaggctgagcttgttccccatttaaattggaggcgtcaggagaagactgagatggttgggaattggaaggcaaaagtttatgacatgcttcatgtgatggttagtgtgaagtcaaggcgggttccaggtgctatgacagatgaagaactttttgctgtggaggatggagaaagcatgatgaatggggaaaacaatgatgagtatgatgatgtattgactgcagaggaaagaatgcaattagattctgccctgcatatg

SEQ ID NO: 3368 - DNA, 545 bp, Glycine max
atgactggttcgcgcagaggcaatggcgatggcggggaaaatgtgaggaaagcggcgagcgagcagaacccggccactcgcagggtcatacgctcccagttcctccaactcaagaatctcatcaatggtaagactcttcaatttactacatttaatttgtttctctttaacctaccaactcagtacctaatcctaacagagaaaagagatgatttgatgaacacggagtctgacaagttcgacaccatcttggatgagttcgacaagttacacgtccaaggtagctattgtggtactgttgttgttgttgttgttgttgttgtaatattaattaatagctccacacgacatcgacatggacatttgcagttgagaagccgagggagcaagttgcagatgcagaggcactgctggatctcacacgcactctagtgggatctgttaagtcgttggcgaacgagggtgtgaccccttctcaatttgtttcatctttgctcatacgctacgcccatacccaacactctattgattggcacaaacttgga

SEQ ID NO: 3369 - DNA, 323 bp, Glycine max
gggatctgatttccattcagtagccattataaattcacaccgtttgaccttgtggtctcattggtctgtctgataaatttgttatagtactcatgtcaagaaccttactctcgatgttttgtacagttgtatataaattccgtgaacttgatcaatattaaaagttctctcattcagtctttcttggttttaattgtgcataccttggaatgttcattttgattgttcattgatatataaattctcgatgttttgtacagttgtatataaattccgtgaacttgatcaatattaaaagttctctcattcagtcttccgtgaac

SEQ ID NO: 3370 - DNA, 404 bp, Glycine max
tctggtttgaaattgtgaggattaagatcttaaaatgccacatatatttgctgcacatgtagtggactcctccagatactgctcttaggaaaaaggaatcaacaccctgcaaatttgatgtcagaagcaatggttctgccaaaaatgcacataagctgttgggtttgttacttgaagctacacagtacctgttcatttatccctgatcactgaaggagtataaagtaacttaacaaccatttagaggatgctcatcagaaagttcattcatgatttgtcaatttatcagagtaattttgttgtgagtgaatcatcatatgttcaacataaggtaagcagtgtattaccatttgtcagtgacaaataatatagaagtcacaatcaatgaaacaccggagtctgag

SEQ ID NO: 3371 - DNA, 304 bp, Glycine max
agtatcttcgtgttccttgcactaattcctcttctctgcacctccttctcgccagagaaaccctcatatcggcgcatcctcgttttgctcgatgacttcgccatcaaatcctctcactctctcttcttcaactccctcaaatctcgcggcttcgatctccaattccacctcgccgacgaccccaaaattgcgctccagagatacggccagtacctctacgacgccctaattctcttttcccccaccattgaacgtgagttttcaactcttcgccccccattactgttttttttttttttttttt

SEQ ID NO: 3372 - DNA, 769 bp, Glycine max
agatggcttcttacaacaatgctgtaaatgattataacaaactgttgaaatatacattgagtctaaccagagaaagtttagtagatgcttcccttatttacgtggacaccaactctgctctcttggagctctttcaccaccccacattttatggtacaagcaccttcccttggcttgtttagtttagcaatgatcttatgaatgctccttatgaattactgtcatacacatacacccttttagccattattcaccaaaaatattagcactcttacaggattgtctaaagtaatcttaattgttgacgagaaaattaacaattgatatttcgatacatttatgttttgtcatacatgtacgcgtgacggttgattttctcataaatgattgaaattacttatacatgattgtgattatgcacgaaatcaattatattaccaagtgccatatgctgcaagtgctattgttaattattatgaacttgatatttatataccaaccatactgattccacatgcgtagtgctgatttctggtttcaatttgttttcttggagcaggactaaagtatagtaccagaacatgttgtgggtatggaggcggtgtgtacaactttaaccctaaaattttgtgtggccatatgctagcaagtgcttgtgatgaaccccacagctatgtgagctgggatggcatccatttcacggaagcagcgaacaagattgttgcacatgccattctaaatggttctctttttgatccccctttccctc

SEQ ID NO: 3373 - DNA, 349 bp, Glycine max
acgcaccaaaaggctatcttgcagtctatgtcggagagaaattgaagcggtttgtgattcccgtatcatacttgaaccaaccttcattccaggacttgttgagtcaagctgaggaagagtttggatatgatcatcccatgggtggcctcacaattccttgcagtgaagatgtcttccaatgtataacttcttgcttgaattgagcagaaatgtcacagtataggagactgacatagattggaggagacattttgtataataggcgtgttctctaagtgtacagatccccctttctcaagagagaggaaatacaaacataatatgttattctattgattaattgcaatga

SEQ ID NO: 3374 - DNA, 193 bp, Glycine max
cggccttcattctctttttctctctccatttctcatcctcatcatcttattattcctcttccatctctattctccataacacccaccacaccacttgtgaaaaacctcattaatatcacacactgacatgtatctctgagctccaatccaatacaagaccacaccttgtcgtgtcggacgaaccttggtgtct

SEQ ID NO: 3375 - DNA, 435 bp, Glycine max
  misc_feature (354)..(355): n is a, c, g, or t
aatgagctgaccgggaacattccttcagcaatatgcaatgcaagctccctctatatactcaacttggctcataacaacttgacaggccagattctgcaatgcctggcaacatttccttctcttttggcattggatttgcaaatgaacaacctttatggaaacataccttggaacttttctaagggaaatgcattggagactataaagttgaatggcaaccaattggatggaccattaccatggtctttggcccactgcacaaatctggaagttttggacctggcagacaataacataaaggatacatttccccattggctagaaagcctccaggagttacaggtactcagtttnngatcaaatacatagaggatacatttccccattggctagaaagcctccaggagttacaggtactcagtttgcgatcaaata

SEQ ID NO: 3376 - DNA, 358 bp, Glycine max
tgaagttctgcttccagcaatgcgtctgaaggaaatcatcagcctgccttcagccaaggtgtaattgagcaagatatacaagatgaagttaaaccattaaaaatggaggaaattcatcagggaaattgtgcagagagtacttttaagactgaggtagcctcacaaaaaagtagtcagaaacctctttcacataccaagactggacatgtttcagttaataatagttctgactgttgtgagaaagctgaagctgatgtgaagtctgaaattttcgaatgggataataaatttgggaattattctaatagattagtagaaacacgtgaaaaatttagggtgtccactcatggtaacataa

SEQ ID NO: 3377 - DNA, 402 bp, Glycine max
cctctaatggttccacgccaacggaagcgagcaaacctcaatcagcctctccagcatcatcgaacacttcaaagacagggaacgactatgatttttcctccttaacacaaggaatgtttgcaaaacactgattggcctttgcttaacatcccctgctatgtcatataccacagaagattagttaaaagttacagaaaagtgcactcttcttctttcccttgacccgtatacttgggttgtaaaccatatctagagctactgagccagttcagttttcctgttacgggtgattgcttcatttgtatccataggtgtattcacaataaaatttagtgatatttattatttattccttttctttttctcttctatatcttgtgtactgcaactgttcgtttcatg

SEQ ID NO: 3378 - DNA, 696 bp, Glycine max
  misc_feature (633)..(635): n is a, c, g, or t
actgtaagttcactaaaattttgttatgaatgtatttgtaagctcactgtcatgtggatagcatgctagtttatttgactatctgcatacatatgatattttttctttttgggtgtacaatggtggtaatggggtttgtacttaagattccatgcaaactactgaaacgcccactgttaggctggccctagtggtttgaataatgagatctttgattgcctttaaaatttatattcctttatgctttacttttaaatgttaaggcttagctacatgtctgatgactctttagattgaatgcattatactgtaacaaattgttgatccatctttctaagtaataacttattattatgttgttacagttacagcaacagacatataatgcagtcgaagatgctagatcatggatagcaagagctaaagaagcagcaagacatggtaatttttaaactataattatatgatgtttacctaggactactttgtactttggtgatagtgaaacccaagatatattggtaatttttaaaccatcatcagatgatgtttacctactacctaggacttctttgtactttgattataatgacaaccaagatatattggtcatcgcctttttcttttcccatnnnttttgggggggttgctgaacatatatttccagcacttataggaatctgttaattctgatga

SEQ ID NO: 3379 - DNA, 848 bp, Glycine max
  misc_feature (71)..(72): n is a, c, g, or t
ttgccttctttttggtgagtctttcagtgagacatggtcattggttaattgcaaaatctgaagcttctttnnggggtttgattatgattataactcattaactcttatgtttgtgtttcagatttagatgatactttgtatccactaagcactggtcttgcaaaagcatgtggccaaaatattaaaggtgagtgtctctttgccaataatgttcttggtaatgtgtttagtgttttactcttttgttggtggtgctgacacgagtggttcaattgatctagactatatggtggaaaagcttggcatagacaaaagcaaaattgatgacttgtccaacctcctctacaagaactatggaacaactatggctggtttaagggtactatttcatcttttatcttttcatttccttgctcaaaatgggaattcattgttgaattcagaaatctctgatgatttatgattgttttgtttcattgtcaattcaggcaattggatatgactttgaatatgatgaatatcacaggtacatgccttttttttcttattgcttttatctccatttgttagtagtgatgaaattgatttttgaactttggctattacagttatgttcatgggagattaccttatgagaatttgaaaccagacccagttctgaggaaccttttgctgagcctgccctataggaaactggtaagttgtttaaaatcaatagaattgcacaatattctacaaagaaaatttgaaaacaatccaatgagacctcttttttgtcttttacttttatattttcacaaactcagacaaagtccatgctgttaaggcactaagcaagctggatagaa

SEQ ID NO: 3380 - DNA, 248 bp, Glycine max
tgcataaccataaaccatgtcattgcctaccaccactagtggtcactcatctctttactctgcatttacattgccaagaaccactcaaattcacccaaccttgttttctcccaccaccaagttattttcttccaaaagcccctcatattcaggtgtttcccattgtttctcaaacaccctttcgccaaaaccgttgccttttgctgttaaggcttcatctggggttggttcaaaagcatccaaacagg

SEQ ID NO: 3381 - DNA, 370 bp, Glycine max
tgatcttggatattacaaacaagtggttaagagaaggggtttgttccaatcagatgctgaattgcttactagtcctatcacaaggtctattatcgctagtcaacttcagtcaactcaaggattctttgcggaatttgccaagtctatggagaaaatgggacgaattaatgtcaagcttggagctgaaggagagataaggaaacattgtgcacgagttaataactaagaatctctttgataatgaccatctaagtgcattttgtatgtctacttttctgtgtaacttattctatgctaggcctatggtgtcttgatatatgagataccatatgatttgattgtttttccaagtgatgcgagaaagggttgg

SEQ ID NO: 3382 - DNA, 1033 bp, Glycine max
  misc_feature (936)..(937): n is a, c, g, or t
  misc_feature (976)..(976): n is a, c, g, or t
  misc_feature (981)..(981): n is a, c, g, or t
  misc_feature (1013)..(1016): n is a, c, g, or t
  misc_feature (1019)..(1023): n is a, c, g, or t
atcacctagatctttctttctcagctttgcattttgtcacattttctcatggtgttgaattgaacaactgaacacaatttagaatatgccaaaaggcaaaatggcattcctgctttatagatcaccgctctatacaaacgtgataattacttcaatttacatatgactacttgtatgctccggcttggttaaacagtttaatttattcatgcaggaagagggaattttcagaattaatgcagataatagtcaagaggagtctgttagggatcaattaaataggggattggtcccagaagatgttgatatacattgtttggcaggacaaattaaggtatattaaattaacaatgaaaaaaacatagtacattacatgaagaaataccctaattgctgcttactatctatttttttgtgtgagtagaggtgtatccactacatatgataaattgattttgatattcttgtgcttttcaaggcttggtttagggaactgcctactggtgttctggattctttatcaccagagcaagtaatgcaatgccagactgaagaggattgtactgaactggccggccagctacctcacactgaagcttcccttttggactgggctattaatctaatggctgatgttgcccaagaggaagacttgaataagatgaatgcacggaacatcgccatggtttttgcaccaaatatgactcatgtgagttccaattattttttagtgaagaattttattcttatttttctttgggtgcaagtagacatcttggaaatccaattaaaattttactgagtgaagaattttcttctctccttgtttgaaattggtcatgtatataggtaaaccggtaaaagatgtagtgtttccttttgtgtcttgacatattacatggtcatcattgggatttgtgacaatacttttacctnnagtgaagtcctgatagtgccatttttgtccatagagtanaaagntgccaatgtgatacagttgatctatcttatgnnnngtnnnnngttactagaa

SEQ ID NO: 3383 - DNA, 398 bp, Glycine max
gtagcttcctaaatagttatgctcagggtttcaatatgaatccaattggaggttatggagtcaggatggatggaaggtttagtcctcttactagtgctagaagtgggtttaccccatttggctccagtggttatggaatgggagtgaatttggatttaggattgaacccaagctatggagggacttccggttatggtggcaatctgggatacgctcggatgagtcctttcaacgatggcaactctaacagatacaccactcctattggcaatagcgggggcaatgggagaagcgattctcttatgaactcagcttctcggagtgtttggggaaatgggggcctgaacaatgctgtcaatagtccagtcagccctggcgcttacttgggatctggaagt

SEQ ID NO: 3384 - DNA, 413 bp, Glycine max
  misc_feature (347)..(347): n is a, c, g, or t
  misc_feature (354)..(356): n is a, c, g, or t
  misc_feature (361)..(361): n is a, c, g, or t
  misc_feature (387)..(393): n is a, c, g, or t
  misc_feature (397)..(397): n is a, c, g, or t
cttggattggatagtttagattcagtagagatcgtgatggctcttgaggaagagtttgggttcgagattcctgataatgaggcagacaagatcaactccattaaacttgcagtggacttcattgcatctcatcctcaggcaaagtagtggaattcttgtgtttctcttcttttctcttcttctatttcacatgatccatcatacatttttgcttccatattgtaactttgttttctcatccctcataagggtgccacctggggatgtgccatgttcatttggcggctttgttatccagaacttcactttctgagttcctcctatatgctcgtccataataattgtgnataatannngagtntgaaattgcgaggtatgaaattgtgnnnnnnngcanatacctcagcaacaga

SEQ ID NO: 3385 - DNA, 386 bp, Glycine max
aagcaagcttatccaagacatcaatccaaataaaggaaacaggagctgaagcttaatccggagaatttttcgcaatcttcatgtgatatttttatgcctctgctgaacaatagagcattttcctgtggccactcgctctccttgcttccaggcagggtttttgaatgaaggctgtggtgataatgatattactatttgctgcatcgcatttggtatgaataatggcagtttggtataatccactttccttttttgttagacctcttattggaccttagacagacatttttgttgtttgaaatgagtagtcttgtgtagactgtacctgatttgaacatgagtttcctctatatgtcgaaaggggtctttaattgttcttgtgcttg

SEQ ID NO: 3386 - DNA, 1018 bp, Glycine max
  misc_feature (64)..(64): n is a, c, g, or t
  misc_feature (962)..(968): n is a, c, g, or t
  misc_feature (997)..(997): n is a, c, g, or t
cagagagtaagttgctcaccttccatgtttcttttctattaactccatgaaaggtgtactgatntatttgaatatggaaatcatgaaattcttgcagttcactgcaatgataaatacaacccgattggaccttgagaatgagctttccgccatgcgcatcttggatgataatccccagaagccggtagttcggatggcaaatttgtgtgtggtttcttctcatgcggtaagtggtgcacttttttgaactaaattaaagaagagtcatccatcttcccatgttcttgtatattaatcttgtgatggtattattgttcttcaaaatgaagaatcttcgttaaattaatatcataatatgctctattcaaatgttattatcgatagaaaaagatctgttaaaatgcaatttatcctctaccatcacttccaacctttcatctcactggagaactattgcaagataagagttgtaatctaagaagtaagaaataaagatggtcagtgcaggtgtccaaaatgataaattaattatgttgtctaagataaggaataccaaacggcctttttatggctctacatgactatttcctcaatattctatacttatccaactcactccattttttcaaatattaattttaatttttcctataacccttctgtttatgtttgtgaaattgatttcaattgatttatttttacctcttggtgcctatctctttgtaggtgaatggtgttgctcagttacacagtgatatattaaagtcagaattatttgcaaattatgtttcaatatggccaacaaagttccaaaataaaaccaatgggataacacctcgaagatggctccaattttgcaaccctgagctaggcgggataatcaccaagtggttaaaaactgataaatgggtaaccaatcttgacttgttaacaggtcttcgacaggcaagtgcccaaatgtnnnnnnntctgtagtaactgattcctcttaattatnactacagtattctaacattaa

SEQ ID NO: 3387 - DNA, 381 bp, Glycine max
gaatatgtaaacgaggtcataatttatttggaaattttggtttcaactgctcaacagatattgccatctcaagtccttaagagagttttacaggaggtttttgctcacatatcggagaagatagttgggactttagttagtgattctgttaagaggtttaatgtgaatgctattaatggaattgaagtagacatccggctcttagagtcattttctgataatcaggcttcccttttctctgatggggatgttgatgttctgaaagcatcacttgccagctcaaaacaactgattaatttgctgttaagcaatcatccggagaatttcttgaatccagtgatcagggagaggagctacaatactttggaccacaagaaagtg

SEQ ID NO: 3388 - DNA, 361 bp, Glycine max
tctgcagcattgacggatcctggggcaatgctggctgctcttttatgacaatatagaggtgttcattaattattacacatttgtaaacctgatctacacagcctaacccatgtctccctcaaagctagtgaggtgaatagacaaaatcatgatgcaagggctggcggaattaagagtgagcttgtttaccagctgagtgtttgagcagggatttctgggttggtgggcatttttgagattctttctgcacaaagtgattgtcctttaagcaagattttatatcagttgggcgagggttttcagttttctcatatttttccccttcccagtttcactggattgtttgtggtgcacctgatag

SEQ ID NO: 3389 - DNA, 384 bp, Glycine max
cgccccagatccgtcatcatcctcgtcaaggccggctccccagtcgaccacaccatcgccgccctctccgaccacctcgaccccggcgactgcatcatcgacggcggcaacgagtggtacgagaacaccgagcgccgcatgaacctcgtcgccgacaaaggcctcctctacctcggcatgggcgtctccggcggcgaagacggcgcacgccacggcccctccctcatgcccggtgggtcccaccatgcctactccaacgtccaggacatcctccacaaaatcgccgcccaggtcgaggacggcccctgcgtcacctacatcggcgagggaggctctggaaacttcgtcaaaatggtccacaacggaatcgaatacggcgacatg

SEQ ID NO: 3390 - DNA, 413 bp, Glycine max
gcttttctcctttgctggtgctccccgtcctggcaaccccaaatcaatcaggggtcagttaattgatcaatgcagaaggtcaaatgtttgtaagctgttggaatgcgactttggcgaaagcaaatgtcattctcccagcagcataatgcagatgtttcaaagctcacttttctgcttgcaaccccagggtgattcgtacacgcgaagatctgcttttgattcaatgttggctggttgtatacctgttttcttccatcctggctcagcatatacacaatatacttggcatcttcccaagaattacactaagtattctgtcttcattccagaggatgatatccgcaagaggaatatcagtatagaggaaaggcttagtcagatacctcctgagcaggtgaagatcatgagagaaa

SEQ ID NO: 3391 - DNA, 319 bp, Glycine max
tggagccagatttatgcagaggttgactcgattttgcgcgagcttgtgatcactcgtgaggatttggttgagaaggcaaaagggtttgccttcaaaggaatggatgtgtctcagcggattttcactagtagtagaactgtgcttggaagcagtacaaagtttatgttctccattgcgaattccataatctctggagccgcagaggttttcaattttgtgtctcagtcgatggtgtttatttgggttttgtattacctcatcacatcagagagtggtggagtgacagaacaagtgatgtgcatgcttccaatttcgaact

SEQ ID NO: 3392 - DNA, 604 bp, Glycine max
caagcctccaactccaagacaatgcgtcacccttcccactcttccccctccaccttttcactctcagactcgtccttggaagaccactgctttctgtgagtcaatcaatttattacagattaaaaataaaaaataaaaaaaccttttgtcgtctcataattcgattctttcaggtcgtaggcttgctcgcaattttatggcaatggccaccacaagagaggcagccgcagcagaagttgccgccacaactgacctctctattgccgagacgccagagattgtgaagactattcaagaagctgtaaggatcaactaattaatgtatatatcgatctctattgttagttgttacttacacttactgtgttgctgcttacttggctacgtatagtgggacaaagttgaagataaatatgcagtgagttcactggccgttgctggtgtggttgcattggtgggctcagctgggatgatctcagtacgttatttatttactttttaaatgcattatcttatcatcattaagtatgtatagaatactttgttgttaacattaatgattgtcactcataacaggcaattgataggcttcctttaattcctg

SEQ ID NO: 3393 - DNA, 399 bp, Glycine max
tcgttttattactttggggaaaacttgaggcaggccctagctgatgatttgcaccagaaactatcctcaagatagttggaattggatagttacttgctttttactataactgcctcgcaagtaaggggaaggagggttcgatcaaacacacatagtgtgtttttatgagtatgttttagttttgaataatttatgagcttgttggtgttagtaacctggtgtagaagtagaatacatgataaagattggtggtggtggtgtggcgtctaactgtaatggcatagctccagtcttgtggatgtgaatgtgaatgtggagtagtggactactaacattgttctgtattcgtatatgaaatgatatgtttcagactagttttaactctaatgccatatgcca

SEQ ID NO: 3394 - DNA, 350 bp, Glycine max
ctttgaaccctcaaagccccaatgagtttggagtcagtggagcagattatggacatggctacttcacccttgatggaccaaaatatgatgatgggaacaatgaaaatgaccacatgagcaccaacaggcttggaaatttgggattggttaatcaagttcccatgtttgctttgtggaatgaatgaagggaatgttatgttgatgagttgagattacaaaaaacattagcttaggaaaaaaaactaagatcagatggcagaattattgaatgattattatattgtagcttggtatggtaactttttattttatgttgaaagaaaggggatatgtcagtagtgctgattcct

SEQ ID NO: 3395 - DNA, 558 bp, Glycine max
caagacacatgttgaacaatcttggccttcagagttacgaaaagaatttcaagaaaggcttgttaacagacaacactctgcctttactcacagacaggtaggaagatcaattttttttgtcagtttttttcctttctttttcatatatttttgtttaccttgtattttgtttctctatgatgtgtttcagtgctctcagagatgtgaggattcctcctggacctaggcttttgattcttgaccacatccagaggtaggagttctgctttatgtattgtagtatgtaccatatccttcattttccatactcatagatactgaagtctggtttcagggacgcggatttgaaagataagcgaggaagccgaaagtgactgatatgaatagtttgctggcttggaactttgaaagccattgaaaaatggatagtagaaagtttgtgttgcaaatgaattttgtcttttttgtttgttagctctgttccattgttgttgcagtgtacttgataaaatttggttaactaatcagttattttagttgtgccatgacacgtaaatg

SEQ ID NO: 3396 - DNA, 562 bp, Glycine max
tgttgtaagttctatcttacgaccttgaatctttagtaatttttacttttgttattttaaactctaatttcatttttttctttagaattttggagctccatttctcattttatgttctgagaatgatgaccttgtgcgataccaaagtatctatgaatttgctcaacaactacgcaatctcagtggtgatgtcaaccttgtaaatttcagtagctcctctcaccttggttcgtctgagactatatttcaactacattgtgacaaccttgaaccagtttaacctgatattgttattattattaatttgttccaggtcattacaaacaccatccaattcaatatagagctgctgtgagccatttattagagaaggcttcttcaatatattcacaaaaaatgttgcttgaacgagaaagaactggtatggatggtacacaggatgagatatctgagttaatctgtgacctgcagaaggtggcaatcaattcaaataagagccttagaagagttgcagttgggccaaccgaccacttctttttgcctagttcagcaggacattaac

SEQ ID NO: 3397 - DNA, 363 bp, Glycine max
taggacagaggggttggcttcattttaccgtggtgcagtttctaatgtgtttaggagcacaggagcagcagctatcttagtcttgtacgatgaggttaagaaatttatgaactgggggagaatttaacagcaccaacgttcattgatttcattttgacaccggagactcaacttcaatacgtcaacatgttgcaaatcttgaggcttaggataattttgtaaaagcacaaatgagctccattacagttcattagtaaatgtgtctttattggcattccaacgctaaggccattgattttgtggctttgctattactaattttcctttgtatcttttaagacgatggaagatcagaaatcagaa

SEQ ID NO: 3398 - DNA, 1048 bp, Glycine max
  misc_feature (999)..(1002): n is a, c, g, or t
tgaagcttttttcatttttgaatatagattataggaaaataattttaacattttcttttaattgaagattctacttttggaaaaaccttgtaagtggcatgaccaaatttgatggtacagttgacattaaacctaatgagagacatgtatccccgaaagatgacccatttattaatattcacaaaaacacatccctaagagcaaccaatctctttcctcttccaagaactgcacaaacattttccaggctcatcctggtattttcactcgattgtggagtttctggttttcgtattggatttgaggatgctcaaggtagagcagatacatgactggcatgggtggggacagtggcaagactgtttccttttcctttctttggcgcagtggggctttggtgatgtggactatgcacttgcagatcaagttttctgttattttgacatttttttttaatgtgaatgactaaatcatgtacatctgccaagtcaaattggtttacaccacaggttgtgtgcttgatttttctgaatagttttactcagacccattaatgaggttgaactgggccaaactgtccactctggtatttcaagtttagtaactagtaattactatgattgaaacatgtgtatcggcttgttttaacacgtctttgtctgatgcaaattcaatctcattcatgcagatatggcgcatgagtgatttgatctacagaccagaagatgaggttttggccgagctggagaaattcaaatctcatgttgtggcgtgtgcttcaaagactgaaaaatgacatacgtcgtaggcaaaaatgagttatattattattgctgttgtatttaatttaacatttgcggtggatgtttcttggcattttaaaaccattcatgtatggggctggagtagggaaaacctagattaacgtagatctgacgatgatttgtggttagtgttacttaattgatacaattctattttctgtttgaagatcataannnntggttcatgtggctcatttctccaatcactgaacggaacatacatg

SEQ ID NO: 3399 - DNA, 780 bp, Glycine max
tctcctgggctggaagtagtggactagaccgctcatctgcggattatattgggtgattcccttaatctcttaatttttatcttgaaggttaagtcagggcactgatcgctgatgtgctggttgttaacttagatttccaatttattatgatccacatccactatactttgagttgctcaaaatgcatgagagaagtagtatccaggctttttactaattttgtttaatttatcctctaggatgttggccactgttatgaatgctatatttcttcaagcaacaatggaaagtattggcattcctactcgggtgcagactgcatttcgtatgtctgaggttgcagaaccatatattcgcagaagggctgtgaggcatttggaaaaaggaagggttgtcatttttgctgctggaactggtaatccattctttaccacagacactgctgcagcactccgatgtgcagaaagtaagttacatttttattgatgtgatctagaacaagcataccacactaagctctatctgtttatcgttgatggttccgtttatattgttttccctgtaatttcttggcaaaggaggtagattttcgaaatcaatttctctgtttttgctaaatttgttttcacttcagtatacaaggtgaacttttccagcgcctacataactttattccgtcatttattcagttaatgccgaggttgtactcaaagcaacaaacgttgatggagtttttgatgaagacccaaagcgtaatccacaagcacgtcttcatgaaaa

SEQ ID NO: 3400 - DNA, 392 bp, Glycine max
ttgttctcaaaccttatcccttatcctcccaaaaccaaaccatgtctacctccgcagcttctctcgcactcccaaccctcactctccgaactcgacaacctctctgttctccccaatgcttctcctcgtccctctccctcacccctaactccaaacccatttccatttccgccgttttcctcaaaacaacgctgtcgtcgtcgtcgccgttgtcgctgtcgtctcgcttcgttccccatgtctctgtgttggagcaggaggaggacaccttcggcgacggagacggccccagcttctcccgcgaccttaagctctttgtcgggaatctccccttcagtgtcgacagtgcgcggctcgcggagctcttcgagagtgcggggaatgtggaggtg

SEQ ID NO: 3401 - DNA, 616 bp, Glycine max
gttggtgtgttacattagcagatgtctgcagagatcatggtctcctcatgatgaattatgcctttggtggtaacttggaagacaaagcatattccactgatgccttctattttagaacacaagccaaggtaggttcctaaaaacttgcatttgctatgagtttaatttctgctcattgtccgagtaatttatactgtcaaattttaataaaagaattgttagtgtaacttttaagattattgcaaacataaacgaacttgtaatatatggtgatttatgattggatgacacaaagtatatactatttattcttttgctatttctattgcacaatttttgcatggtcactaactttgtttttccatcaatatggttgcaggttgaagagttgctaaaggaatatgaaaatgtttgcaccctaagaatccaattgccagtgtcatctgatctcagcaacccacataacttgatcactatgataacaaggtctgataaagtggccaacattccaaacagcatcactgttttggatgaactcgtaccaatttcaattgagatggccaaaaggaattgcaggggcatttggaacttcacaaaccctggtactgtgacatgc

SEQ ID NO: 3402 - DNA, 801 bp, Glycine max
  misc_feature (375)..(376): n is a, c, g, or t
  misc_feature (389)..(391): n is a, c, g, or t
aattccttacttgtttggaggcttagctgtgatgctggctatcatatctatggcattggtgatccttgtttgctcatacagaaaacgtgattctcagtcatcatcatctgaagttaatgaagacgtgaaatcacaagcaatggccaagaatttagagacaaactcagagcctgaggttcttgtcataatggctggtaatcacaaccccacataccttgcaaaaccaatcacttcttcttcaattttctgcacgtgtggggctcaaccaagtgaaccaaacccttcatcaacctcaacacccgagtgaagactaaccaattatcaacatgccaagttcaacaaaattttgctctacacttttcttccttctccacnnttttcatctttcnnnagtcacattctgtgctcacacaaaaccacaagaatatgaaaattgagaaggaagaaaagtgtagagcaaaattttgttgaacttggcatgttgataattggttagtcttcactcgggtgttgaggttgatgaagggtttggttcacttggttgagccccacacgtgcagaaaattgaagaagtgattggttttgcaaggtatgtggggttgtgatcaccagccattatgacaagaacctcaggttctgagtttgtctctaaattgttggccattgcttgtgatttcacgtcttcattaacttcagatgatgactgagaatcacgttttctgtatgagcaaacaaggatcaccaatgccatagatatgatagccagcatcacagctaagcctccaaacaagtaaggaattg

SEQ ID NO: 3403 - DNA, 378 bp, Glycine max
ttctttccattccctcactttcacacccacaagtcacacccacttggttccttcctccaccccattatttttttctctttttttcatccaaacatgtcctccacacacccaaaaaacccagcaacgacaacaacatccactactctcatcgtgctctcaattatactcctttgttttccgacaaccgcaaaaaccgacaaccctccatgcccttatccgtgttacccaccacccattggaacggttactcccaccactccttcaggtggttccactgttccaccagcaccacctcaacccggattactatatccaccaccttctgggaaaccttctgggaaaaacatggacaaattgccgaaatggaagatgcctttt

SEQ ID NO: 3404 - DNA, 1417 bp, Glycine max
  misc_feature (662)..(666): n is a, c, g, or t
  misc_feature (668)..(671): n is a, c, g, or t
  misc_feature (677)..(680): n is a, c, g, or t
  misc_feature (682)..(682): n is a, c, g, or t
  misc_feature (684)..(697): n is a, c, g, or t
  misc_feature (700)..(710): n is a, c, g, or t
  misc_feature (712)..(712): n is a, c, g, or t
  misc_feature (714)..(714): n is a, c, g, or t
  misc_feature (716)..(733): n is a, c, g, or t
  misc_feature (735)..(742): n is a, c, g, or t
  misc_feature (744)..(754): n is a, c, g, or t
  misc_feature (757)..(772): n is a, c, g, or t
  misc_feature (774)..(785): n is a, c, g, or t
  misc_feature (788)..(788): n is a, c, g, or t
  misc_feature (790)..(798): n is a, c, g, or t
  misc_feature (800)..(800): n is a, c, g, or t
  misc_feature (804)..(808): n is a, c, g, or t
  misc_feature (821)..(827): n is a, c, g, or t
  misc_feature (830)..(833): n is a, c, g, or t
  misc_feature (835)..(835): n is a, c, g, or t
  misc_feature (839)..(857): n is a, c, g, or t
  misc_feature (868)..(870): n is a, c, g, or t
  misc_feature (872)..(875): n is a, c, g, or t
  misc_feature (888)..(901): n is a, c, g, or t
  misc_feature (903)..(910): n is a, c, g, or t
  misc_feature (913)..(922): n is a, c, g, or t
  misc_feature (924)..(933): n is a, c, g, or t
  misc_feature (935)..(936): n is a, c, g, or t
  misc_feature (939)..(944): n is a, c, g, or t
  misc_feature (946)..(962): n is a, c, g, or t
  misc_feature (970)..(989): n is a, c, g, or t
  misc_feature (991)..(991): n is a, c, g, or t
  misc_feature (995)..(1005): n is a, c, g, or t
  misc_feature (1007)..(1009): n is a, c, g, or t
  misc_feature (1011)..(1011): n is a, c, g, or t
  misc_feature (1024)..(1027): n is a, c, g, or t
  misc_feature (1029)..(1033): n is a, c, g, or t
  misc_feature (1037)..(1043): n is a, c, g, or t
  misc_feature (1048)..(1048): n is a, c, g, or t
  misc_feature (1050)..(1071): n is a, c, g, or t
  misc_feature (1073)..(1074): n is a, c, g, or t
  misc_feature (1079)..(1082): n is a, c, g, or t
  misc_feature (1088)..(1088): n is a, c, g, or t
  misc_feature (1090)..(1090): n is a, c, g, or t
  misc_feature (1093)..(1095): n is a, c, g, or t
  misc_feature (1105)..(1109): n is a, c, g, or t
  misc_feature (1114)..(1134): n is a, c, g, or t
  misc_feature (1141)..(1149): n is a, c, g, or t
  misc_feature (1155)..(1160): n is a, c, g, or t
  misc_feature (1163)..(1179): n is a, c, g, or t
  misc_feature (1181)..(1187): n is a, c, g, or t
  misc_feature (1193)..(1193): n is a, c, g, or t
  misc_feature (1196)..(1205): n is a, c, g, or t
  misc_feature (1207)..(1215): n is a, c, g, or t
  misc_feature (1217)..(1217): n is a, c, g, or t
  misc_feature (1220)..(1220): n is a, c, g, or t
  misc_feature (1223)..(1225): n is a, c, g, or t
  misc_feature (1228)..(1238): n is a, c, g, or t
  misc_feature (1241)..(1243): n is a, c, g, or t
  misc_feature (1246)..(1247): n is a, c, g, or t
  misc_feature (1251)..(1256): n is a, c, g, or t
  misc_feature (1264)..(1275): n is a, c, g, or t
  misc_feature (1279)..(1283): n is a, c, g, or t
  misc_feature (1285)..(1290): n is a, c, g, or t
  misc_feature (1293)..(1319): n is a, c, g, or t
  misc_feature (1322)..(1336): n is a, c, g, or t
  misc_feature (1338)..(1352): n is a, c, g, or t
  misc_feature (1355)..(1358): n is a, c, g, or t
  misc_feature (1361)..(1370): n is a, c, g, or t
  misc_feature (1375)..(1384): n is a, c, g, or t
  misc_feature (1386)..(1393): n is a, c, g, or t
  misc_feature (1404)..(1408): n is a, c, g, or t
  misc_feature (1411)..(1412): n is a, c, g, or t
  misc_feature (1414)..(1414): n is a, c, g, or t
taatgtgatttaacagaatgtgaatattatcgaatcatagattgcatttgaaaaaattattagtatttgagctgaccttaagttccagagatatattgggtaagcattattttcaccaattctaatttctctacctgcttttctacaggctccgggatcggctggttaagattatcaccgactacaggactgaaacatcgctcagacatggatgcaatgatatcattaaggtgtttcctcttcccccttccctctggctcttccttaggaggccaaattcttgaatctcattaatttggtactgcaaaatatcccactgacttgctgtcattgaaataggcggactgtgtcaatcttttaattaagtattacaaagaggcaaggcatgggatttctttaggtaatgaagatgagccgcgggttaaaatgagtgatactcgtgcttctcaggtatttgacaaatctccaagtctgagaactgtggagttgaagtcaaagactaggggaggtggaagatgttgtatatgtttcgatccattttctatacagaatgtatcggtcattgttttcttttgctgtcatggttatcacacaacttgtctcatggattcgtcttacactagtagtaaccagaaagaggtccaagccattagggacctttnnnnntnnnntccccnnnncncnnnnnnnnnnnnnntcnnnnnnnnnnncnanannnnnnnnnnnnnnnnnncnnnnnnnncnnnnnnnnnnnatnnnnnnnnnnnnnnnncnnnnnnnnnnnntcncnnnnnnnnncncctnnnnncccaccaatcacnnnnnnnacnnnncncccnnnnnnnnnnnnnnnnnnnccccccccctnnncnnnntccccaccctccnnnnnnnnnnnnnntnnnnnnnnaannnnnnnnnntnnnnnnnnnncnnatnnnnnncnnnnnnnnnnnnnnnnnctcctccnnnnnnnnnnnnnnnnnnnncntacnnnnnnnnnnngnnncnaccaacatccttnnnncnnnnntctnnnnnnnctccnannnnnnnnnnnnnnnnnnnnnnannctctnnnnacctantntcnnnactatccctnnnnnccttnnnnnnnnnnnnnnnnnnnnnctctctnnnnnnnnnaccctnnnnnnatnnnnnnnnnnnnnnnnncnnnnnnncaccanccnnnnnnnnnnannnnnnnnncntcnccnnnccnnnnnnnnnnncannnatnncaannnnnntaatcacnnnnnnnnnnnntcannnnngnnnnnntcnnnnnnnnnnnnnnnnnnnnnnnnnnnccnnnnnnnnnnnnnnncnnnnnnnnnnnnnnntannnngcnnnnnnnnnnaatcnnnnnnnnnncnnnnnnnngacctccttannnnnaanncncat

SEQ ID NO: 3405 - DNA, 301 bp, Glycine max
  misc_feature (30)..(34): n is a, c, g, or t
  misc_feature (251)..(253): n is a, c, g, or t
gtgttattagattgcttattccgcaaatgnnnnngctgttttatttgctgaggagcctttgatttcacaagcatccgagagccctgttttatgggccgagatgcctgctttttcgcttggaaggaattagcttgtttcataagtgtctttggtttagcttgtttacttcgaagtgctctcctcagcggctgatcatcttccatttcatcatctgaattcatatcatcttcttccatgcatttagcttgctnnnttttaggagttctatgcagcagatgagaattattctcagctaagtcat

SEQ ID NO: 3406 - DNA, 987 bp, Glycine max
  misc_feature (921)..(921): n is a, c, g, or t
  misc_feature (966)..(969): n is a, c, g, or t
  misc_feature (980)..(982): n is a, c, g, or t
gcagacaagtccttgtcaaggtcacctcatcctccattcctttttctttcatttcgctacccattcttcatcaatacactccatctatacttggttttgttatattctttcatttactttaggacagtcaaatactgcatagagagcatcattggatctgatcatttcagttttatagatctatatttgcttatgattacctgtttttctgtcctcaaggacttttgagtgttggatgatttatgcaatgtttagttctgaaaacacacgtcatcctaattaataaaacaggatcaaaaccaagatcaattgtgctgatttttcctttactcttcttcaggtccacccagaaggaaaatatgtcgttgatattgacaaaagtattgacattacaaagattactccatccactagagttgcacttcgcaacgacagttatgttcttcacttagttctgccaagtaaagttgatccattggtcaatctgatgaaagttgagaaagttcccgattctacttacgacatgattggtggtttagaccagcaaattaaagaaataaaagaggtatgttgcttgacattctttcggttttggcatttaaaattcgttctgtcaggagttagatattcttacctatccatgcatcactcgtgtgttaccttcctgtatgcatgtatctatcatgtatattttagtgtagcatcatgcattacaaaaatccgtttagtttttgggcctaatgtatgtgattaaatgtacaggtcattgagttaccaatcaaacatcctgagctgtttgaaagtcttggaattgcacacccaaaggtagtgtctgattttggggttgttgataaattttgtcattccatcagcacacttggttgttgatttttctgtttgctgaatctcttgatcacatcnaagggtgtcctgctctatgggccacctggtacaggaaaaacatgnnnnctagggcagtnnncatca

SEQ ID NO: 3407 - DNA, 667 bp, Glycine max
catgctaggttgtgcaggccacccaggaaaacacagtatatgttatccaatccagagaataacctgtgacacattttcttttgtgttagcaatacaactcaataattcataaatccattaaccaatctgccatgaaatttgaaaagggaatgtactgattataacaatagattcattgaatgccattcatatctcatgcaattaaattaagcatacctatgattaatggagggcttgtatgaagtggaataggctagcaaagcatcattcccaaagcacattgagaaagcattggaggaattgcaggacatgaaatccttcaggatttcatgacttagcttaggcttaatgcatgaattcaaagaagctggactgttcagctccttgggtgcattaaccaacttctgcttgaaaattcccaacatctttgcctctctctgagttagcttccaatgtcacctctcttgttttctcttatccaaaaagtgtacacactttctcaaagaaaagcaccaatatcagttaactgcaaaacgaacaacatgaaaaacttattaatttgtgaaaaacgataaatgatcgatcatccattcatatgaacaaaggtaaaaaaaaaaactctaaaattaaaggggggaggaatcataccaaaaatcaccaatccaaa

SEQ ID NO: 3408 - DNA, 268 bp, Glycine max
  misc_feature (20)..(26): n is a, c, g, or t
tgggagggaaatgggcaaannnnnnntgccaaaaacaaaatattttggtgttgaagtttgtacttatattttcctgtgttcatcgtgttgtttttttcaaaaattcgtaggactttaaaagcataggctgagttatgtatttttgtagaatctataagatgtttaaatcgatcgagttgaataaccccctatcatttcaggtgtatgttgtattattgctttgtgaaaaaacgttaaggtcataatgtactccgggctttgatggttt

SEQ ID NO: 3409 - DNA, 360 bp, Glycine max
tacaccgacgaaattgatgagcacttgactgcaataagtgagcgtgactgagttcttgataaggatgtagttgttcaaactttctgatggtagagattatattatgtacttgtttctggaatcatcgaattgatttccttgtgatatttgagtggtgagttacccaagaatgatgttgaagatggtatttgatttcctattacaagtttacttgggaaaatatttcatgtttctaccaatactttttttttattattaaaaaaattgtttacaaaacgaagacgtgtgtataggcataatactgttaaaatttgttgggccttgcgtagggatttgagcttcggtgccggatgttctgtc

SEQ ID NO: 3410 - DNA, 513 bp, Glycine max
  misc_feature (348)..(348): n is a, c, g, or t
  misc_feature (363)..(363): n is a, c, g, or t
  misc_feature (417)..(417): n is a, c, g, or t
  misc_feature (459)..(461): n is a, c, g, or t
  misc_feature (463)..(463): n is a, c, g, or t
  misc_feature (486)..(486): n is a, c, g, or t
caaaatatcatgaattgtacttatatttgtgtttaatactaaagtctataggtctattttgatgaatctgtatgccaatgtacacaggtaatggctgttgacatgtcatatcgcctaggttggattgatgattctctagtgaagagagttggagacattttaaaacaggctaagttaccttcagcccctcctgagaccgtgactgtggacatgtttaaatctgtcatggcagtaagtactgattctcaatacccttttaatgttcagtttgtttttattaaggcttatagttttttttattttttattttggtgtattaggtggataagaaggtagcagatgggttgntaaggcttatccttntaaagggtcctctaggcaattgcgttttcacaggggattatgacagaaaggctntagacgatacgcttcgtgcattctgtaaatcctgatctttgnnntncatgtttctattgcagctttatncaattccttttagtgagtttttgtatg

SEQ ID NO: 3411 - DNA, 434 bp, Glycine max
aattagaccagacagcagcaataccccccttattatcacagaacagtggaagaggatccaactagctgtgttatttgctaagtattggaatatcatatggagtttgaaatgatggataataaaatgagatcaagaaaagatggtggctgcatggagttgaagaagaattatgtttcttttggagttccctttttccttcttttctttcttatgttttggtctttcaggctttcctcttgttttagttcataaaagaaaagaaaaaaaaaggagtctaaaactgagatatataatatgtaaattattttgtggtgtagtacaatcaatgtattcaaatttctggcagtgagaaattggttttattaaattcaggtgttcaattcttagtctgtggtttgtgttgttccttttgagaattaaacatggcaaaggag

SEQ ID NO: 3412 - DNA, 638 bp, Glycine max
  misc_feature (627)..(627): n is a, c, g, or t
  misc_feature (629)..(631): n is a, c, g, or t
ctgagtcttcgccgaaggtggccggcgaggcattcgtatcaatggctggttgatcgagactcggaggcactccatactgaactcttccacattccaagagtgagctgttctcgcatcacacataaccctagctcctctaatttcaattttcgagagttaaactaagagtttttattatgtaggctattgatttggcgtatgagaaatccgagaattttgttttgatgttggttgtgtgtgccttgcaggtgggaacagaaactcgatacgtctcatttaccagaaatggtttttggggaaaacactttgattctaaaacacttgagcagtggaaccaacattcattttaatgcatttgatgctctacgtggctggaaacaggaagccttgccgccagttgaagttcctgcggcggctaaatggaaatttagaaggtgagagctattggcatgtgcactttcgtgtttatgtgtaactcaaaatactgttaattttgtttagatttatttgacatcttttctttctaggaagaaatttttatctagtatggaatttcctggtaattgcttgcgctgtctaaccctcctattgaataggatgtgtaagtaaatgaccatgctgttactntnnnttttttt

SEQ ID NO: 3413 - DNA, 395 bp, Glycine max
ggaagccggagattctgaaaagcggaggaggttgtcttccgccgcctgtgccggtgcctgcgccgccgcaagcgacggcgaagacggattacatgtacttcgacccgtcggattcaatcccgaagctgcacacggactcgagctgttcggagcaggtggtatcgccggaattcgcgagcgaggtgcaaagcgagcccaagtggaacgagtgggagaaaagcctcgaatttccatttaattacgtggatgccactctcaacaacagcttcatggcccaattccagggcaataatcagatgttgtcgccgctgcaggacatgttcatgtactggcccaacaagtccttttgagcacatcatgatggttttaaattacgatccgcaattgctcttaag

SEQ ID NO: 3414 - DNA, 524 bp, Glycine max
tcctgatgttgctccatgggttcagaaataccaacggagccgtgaaacagtctctcagacagattatgaggtaagtttctctatgtatatagctccatccagaacagcaatgaagttcctgaagcttttgtttggtttgaaaattcactttgtgttttctttggctgctttacttttttttataggttgatctgataaccactttcacaaaactgagtaccttgggccaacaaatcaactatgaggcatatacatatcctccaccaaagatcgacattaccaaactcaaattgtaaaagtaaaacatatggtagtaccatattatttttctcctcctcaagacagaccttgaatttcaagttttgacttattttaaaattttctctgtttgttttttaactggaaaccttgagcttctatgtaattattcatgcacatgtagtgagataattaagagtgttcaagaaacgatctaaatttgttacaaaccactaaactgattaatagcgtgtttggagatgctt

SEQ ID NO: 3415 - DNA, 217 bp, Glycine max
tctttcagtcttttatatctaagtgggattagtattaatctaatggttacgcgtgtatttctattttgaatattttgaagtgcttctctctcgtttgtcattagactcctcattatgaatgacattagttgttgacacattaaaatagtcaaatttatcttctcttttgaatgctcgcttttatagggaattctcatttctctacctgtagttgcaa

SEQ ID NO: 3416 - DNA, 381 bp, Glycine max
ttttctgagcaagaatgtctgggcgtggaaagggaggcaagggtttgggaaagggaggagcgaaacgacaccgtaaggtgctgcgcgataacattcagggaatcaccaagcccgcgattcggcgtttggctcgtaggggtggcgtgaagcgtatcagtggtctcatctacgaagagacacgtggcgtgctcaagatctttttggagaacgtgattcgtgacgccgttacctacactgagcatgctaggagaaagaccgttacggcaatggacgtggtttatgctctcaagagacagggaaggaccctctacggatttgggggctaggtttttttattttattgttaggttcttttgttttggaggctaatctggatttgag

SEQ ID NO: 3417 - DNA, 1032 bp, Glycine max
ggggcttctttttaagctggtcaggtgtgttgtttttagtgctcatccaagcaatggctagtttagggttttccagttgataataagttttctttcatttgacaggttcttgcagataggccagatatcattcgagaagattatatgaatgaactgtgcattcttcaagatgatgttccttcatttcccaatcaagtaaaacttaccacatagtatcaactgtttattttttaattctatttatgctaagcatttgccataccattgtcacctggatattataattctgatgtttgacctaaaaatgttctagattgccttcagaatcatagaggaggatctgggtcaaccccttgaagctgttttcagcaaaatctcatcagggacaatagcagctgcaagtttaggtcaagtttacagagctacattacgtgcaactggcgaggatgttgctatcaaggttttgttgttttcaccttgtgttataactgttttcattttcaaatgatctgctaaactattttgcttaatcttctttttgattcttctgaggcattgcctttacgttcataacagtttaatatcctgctgtgatctgatttctttgctaaaagcattgtgttcataacagttttacataattattttgttgggttgattctgtgatatttgtccatactgtcccaaatcagttgatttcattccttttttcttttcctttttcaattgtttttgactctttgtctatcattagtgatatatgaattttgactttttccttctttctagtttctacttgttttgatgttttcctaatcagtgctgtcaaatatggctttaatttatcaatatacttttatagttttatatgattaaagtgctgcaaatgcattgctaaaatataaacaaaggggaaagagtaaagttttagaacaatattaaatccactgctaaagatatactttggtgtacttgcaggttcagaggacagggatagagcccattatttatcgagatcttttcctattccgc

SEQ ID NO: 3418 - DNA, 476 bp, Glycine max
  misc_feature (408)..(409): n is a, c, g, or t
actacatgcaggctcagcaggctcagcagatgtcacaacaacagctaatggcttcgcgctcctcactcttgtactcccaacagcctttctcagtgcttcaacagcagcaaggcatgcacagccaacttggcatgagctccaatggaagtcaaggcctccacatgttgcaaactgaagccactaatgttggaggcaatgcaaccataggaaccggaggaaggtttcccgactttgtacgcattgctagtggcaagcaagatattggaagttctggtgaaggccgaggaggaaactctagtggccattctggtgatggtggtgaaacccttaattacctgaaagctgctggtgatggaaactgaactagccagggagaatggtaaaaaaaatagattactagaaatggtnncggtgagtttgttgatagtgtcgacatgtacttcttgcatcaaaaaaaaactaaatgaaacaagaca

SEQ ID NO: 3419 - DNA, 1336 bp, Glycine max
  misc_feature (817)..(817): n is a, c, g, or t
  misc_feature (819)..(826): n is a, c, g, or t
  misc_feature (828)..(845): n is a, c, g, or t
  misc_feature (850)..(850): n is a, c, g, or t
  misc_feature (854)..(858): n is a, c, g, or t
  misc_feature (861)..(868): n is a, c, g, or t
  misc_feature (871)..(875): n is a, c, g, or t
  misc_feature (878)..(906): n is a, c, g, or t
  misc_feature (909)..(948): n is a, c, g, or t
  misc_feature (955)..(964): n is a, c, g, or t
  misc_feature (970)..(976): n is a, c, g, or t
  misc_feature (979)..(989): n is a, c, g, or t
  misc_feature (999)..(1008): n is a, c, g, or t
  misc_feature (1010)..(1036): n is a, c, g, or t
  misc_feature (1038)..(1044): n is a, c, g, or t
  misc_feature (1046)..(1051): n is a, c, g, or t
  misc_feature (1053)..(1076): n is a, c, g, or t
  misc_feature (1083)..(1084): n is a, c, g, or t
  misc_feature (1086)..(1091): n is a, c, g, or t
  misc_feature (1095)..(1098): n is a, c, g, or t
  misc_feature (1101)..(1108): n is a, c, g, or t
  misc_feature (1110)..(1114): n is a, c, g, or t
  misc_feature (1118)..(1123): n is a, c, g, or t
  misc_feature (1131)..(1133): n is a, c, g, or t
  misc_feature (1139)..(1146): n is a, c, g, or t
  misc_feature (1148)..(1165): n is a, c, g, or t
  misc_feature (1171)..(1177): n is a, c, g, or t
  misc_feature (1179)..(1189): n is a, c, g, or t
  misc_feature (1191)..(1196): n is a, c, g, or t
  misc_feature (1198)..(1199): n is a, c, g, or t
  misc_feature (1202)..(1207): n is a, c, g, or t
  misc_feature (1216)..(1224): n is a, c, g, or t
  misc_feature (1229)..(1238): n is a, c, g, or t
  misc_feature (1241)..(1249): n is a, c, g, or t
  misc_feature (1251)..(1255): n is a, c, g, or t
  misc_feature (1259)..(1270): n is a, c, g, or t
  misc_feature (1272)..(1272): n is a, c, g, or t
  misc_feature (1274)..(1275): n is a, c, g, or t
  misc_feature (1277)..(1278): n is a, c, g, or t
  misc_feature (1282)..(1289): n is a, c, g, or t
  misc_feature (1291)..(1301): n is a, c, g, or t
  misc_feature (1309)..(1330): n is a, c, g, or t
  misc_feature (1332)..(1332): n is a, c, g, or t
tatatttatttgatcatgctctataattataagctttacgttgtgatggtatctagagatggaaatttaaagcccttttaactttgcactttgatttttgtggtgtagatgttgacaatggtatagtgaaggatgtagtcctatggagaagaaagaaaataaatataagcgttcttgttgcggcaacagcggcatgggtgttgatggaagtgtttgaattcaacttcctcactctcatatcatgggtggccatactcggtcttgcttcaatattcctctatgccaatatgcttagacttttgggcaagtgagcacccttctctacatgctcttcttctaatgcagaattttgtctcatggaagattcgtcatcattacttacacatagtaactagcttcttttgttttttgtgttttcccttgtgatgataaattgatacatggtctatatatagcactactctttacttgtgacgcgtgattgaatattattaattttttcttataaactacaaaagtaataattaattctttcttataaattaaaaatcttgtttatacgcaggtggtttagagctatgtaataattgtttccttgtgatttttatgaaatttagggaaccaccgaacttgttggggttggaagtgagtgaaaaaacaacaacgagaatagcacacacagttcgagcatggattgaagaaggaataaggtggttgttccttgtgggcgcagagaaagagtggcccgtgtttgtgggggctgtggctggattgttatcactatcttatttaggaagttgcatggacctcctaacantnnnnnnnnannnnnnnnnnnnnnnnnnccccntccnnnnnccnnnnnnnnccnnnnnaannnnnnnnnnnnnnnnnnnnnnnnnnnnncannnnnnnnnnnnnnnnnnnnnnnnnnnnnnnnnnnnnnnntattacnnnnnnnnnnaatccnnnnnnncannnnnnnnnnncccattttcnnnnnnnnnncnnnnnnnnnnnnnnnnnnnnnnnnnnnannnnnnntnnnnnncnnnnnnnnnnnnnnnnnnnnnnnnatacacnnannnnnnttcnnnnccnnnnnnnncnnnnncccnnnnnncccctttnnncccctnnnnnnnncnnnnnnnnnnnnnnnnnnaacatnnnnnnncnnnnnnnnnnnannnnnntnntcnnnnnncattattannnnnnnnnccatnnnnnnnnnnacnnnnnnnnntnnnnntctnnnnnnnnnnnnantnntnnactnnnnnnnncnnnnnnnnnnntcactacnnnnnnnnnnnnnnnnnnnnnntnatcc

SEQ ID NO: 3420 - DNA, 820 bp, Glycine max
gccatatacataatcaatgtcttctatcaatttataattaagaatgatctgtaacaagtcttcttctacatgctgagcataaactgatagggctcaatgattgcctttttttgagtgggtgaactcaacataaaatatttggaaacagctgatgtgacatgcatatccattcatgcactttaactttatatataccgctgtattttggtgaagtgctccagtttttggatagattaggaaattaaaaaataattagttaggatctcattcttgtttattcattcaacaaggcatagtaatagaattgatccatttgagttgtaagatccaatttagtataatcttgattgacaggtgattgaggctggagccaatgcactggttgctggctctgctgtttttggagctaaagattatgccgaaggtacccgaaaaaatatttttgtgatttgacatatatatatataatatatatattgcaatgtgttgaaattcaatgtgattttgataattttaatgacttcaactcccttgtagctataagaggaatcaaaaccagcaaaagacctgaagtagttgctgtgtgaaatgcctgtgtggttccatattcaccgtacgctccaatgtaagctgtattttttgccccatagaggtttatccattaaattttggcatatcgttttactgattgggtggttgaatataagcaaaattgactgccagtatgagaaacaatcaagtaaaataatggcagacattgcttatgcgccagtttcaaagtcaactatattatataattaagttatgcttgtggctcaat

SEQ ID NO: 3421 - DNA, 1042 bp, Glycine max
  misc_feature (423)..(423): n is a, c, g, or t
  misc_feature (442)..(443): n is a, c, g, or t
  misc_feature (481)..(481): n is a, c, g, or t
  misc_feature (512)..(512): n is a, c, g, or t
  misc_feature (514)..(514): n is a, c, g, or t
  misc_feature (560)..(560): n is a, c, g, or t
  misc_feature (569)..(569): n is a, c, g, or t
  misc_feature (578)..(578): n is a, c, g, or t
  misc_feature (580)..(580): n is a, c, g, or t
  misc_feature (591)..(591): n is a, c, g, or t
  misc_feature (599)..(599): n is a, c, g, or t
  misc_feature (622)..(622): n is a, c, g, or t
  misc_feature (636)..(636): n is a, c, g, or t
  misc_feature (672)..(673): n is a, c, g, or t
  misc_feature (700)..(700): n is a, c, g, or t
  misc_feature (945)..(947): n is a, c, g, or t
  misc_feature (982)..(989): n is a, c, g, or t
cttaaatagattttgcacaaatatataaagagtcccacctttgccggtgagaatccaatcaacttttattcatttaacaaatttataaacttatgtttttcaggatttacatgccatatctggttttagttgtaatggtaatgatcacacatttcagaaaacactgatcccaagttttgaattgctgtttctgtttctagggatacccttgaattggtgagagagttgagtgaaccaccgccaggtacaaaagatttgcacttttcaactcgcttcccacaaaatagtttgggacagttcatggcatgcctttggaagcaacacttgtcttattggagaagtcctgagtacaacttaactcgtttcattttcatgattgtttgtgcaatcatatttggagcagtattctggcagaaagggaanaaaatgtaagtttgttttnntatacttataatttgcacagaaaatgactctttcattntatctggaaaaataaatatgtatgttaaaananactccacaacctctaactcaagacaatgtagatgcaacattttatncaaatatgnccactgttncnctgtctgtctncagcaaantgaatcaggcagaaaaaagttancatatatgaagttnttatagttttgataagttcattcaacagagagaagnngaaatccataaaacagtaatttcagcntcttcattgtgatatccatagatagaaacaagtaaattactttaccaagttccatgaatagcaatatagcatgctttattaatgcattttgaaaacataagtcagcatatattttatctcaaaagcatcttaggcactatcagcataaggcattgttaaactgtgaatttcatgatccagacaacattagtgttaacacgattctagtgtagtgttgaagttgtacagatgaaagtgctgatatnnnccttttctatggttaaagaaacaatcagcaggatnnnnnnnncgtacttggatcaatgtatattgctgtaatattcttgggtctaaattactgtc

SEQ ID NO: 3422 - DNA, 213 bp, Glycine max
aattgtcatcctcagcagttcagtgctctgacccaatgaaagcatctcagttgggttatctcacggtcaaaactggtaaagaaaagggtagaagaaaaaagaggaagagtcttggtgccaaattagcggcactgtctgaagtttcaagcagtcaaagtgggaattctacaccctcatctcctttatcccctactccctctgctacacctaaaa

SEQ ID NO: 3423 - DNA, 339 bp, Glycine max
atcaaattgcttttacaatttataaggacaaaggctcaaagacaatgctccattcacaagatacattcaaaaccatccttgtttctccgatcattaactatttacttgctggctcttgtggcggcttaatgatgcctagttgcccaccatccttcgttgctagagtcgctgctttgatctcattgcagtggttaatgaatttgctcacctcctggtttcacaaaattttaacccaatttagtaaaaaaaaaacaacaatatttcaagataaacacagctagatgaatttgtttgttcatgaaattatctcaggaaacactatagaaagaccatccataa

SEQ ID NO: 3424 - DNA, 1119 bp, Glycine max
  misc_feature (24)..(24): n is a, c, g, or t
  misc_feature (1052)..(1058): n is a, c, g, or t
  misc_feature (1112)..(1114): n is a, c, g, or t
  misc_feature (1116)..(1116): n is a, c, g, or t
tggctcatttcagattctattccnaaatctgaaattacttgatgcctttgatgatgagtatgcgtgagttgttgttcatccggataggttaccatccaacccatatacctttgcatctgtgttgcgtttgtctctttctcagtggaaaaagatggtaaatcctttgtccatgttcttatcctctctattctctaacatgaactaactatgttcacatggaaacttgtcacctctaaatgattctgatgtttcttcctttgaaaataaattttataataactatccgtaaggcaagcatagcataagtatctttttaaggtttctatgatatgcatgtttgagaaatgaaaagacaccatcagtactttctgtgtgcttttattttgtgattgcatctgtttcctcttgaaggcatcatctagcacaaagttatatatattaagttatctgataatttgcagggaaagaagggaatttggcttaagttgcccttagaacaatctgatcttgttccaattgctgtgaaggtaatttaacttctcacaagtctaccaattaagaaataaagaaaataacatgtgcatatgagagatttcagtatgtgtcatgttcattattaagttcacaaaattaaatgaattaacattgcaaaaagaccaataaattcatccacttatctgtctctattcagttaagcctttgtttttactcattgaggagttgttgaccctatgaggtaactcattttggtctcaggaaggcttccaataccaccatgcagagccaggatatgtgatgttaacttactggattcctgccggacctagcatgcttccagcgaatgcatcacatcaagttggagttgggggatttgtcatcaatgacaacaatgaagtatgattgcttctaacgtaattaacataagaaagaagaaacttcatcccaattattaaataagaaagcaggacattctgcacttaggatttgcaaagaacttttttcaagctactaaacgttctgcatttttttatatgatgtcaagacagtttttnnnnnnnatttgaattttgcaagcgctaacatttgtataattttctgttaaaaattcgtannngntgc

SEQ ID NO: 3425 - DNA, 663 bp, Glycine max
  misc_feature (628)..(633): n is a, c, g, or t
  misc_feature (635)..(640): n is a, c, g, or t
  misc_feature (644)..(656): n is a, c, g, or t
cagttgaaatgtgcgttgcaattttgttgttaaatgaaatttcaaacgaaaaaaaaggaagaggcgagtccgctaggccgtgtccgaaaagtgggccatgtcggacaccgcgtctctgtcgtgtccacgtcagaaatgcctccgacacactgaagtggcagtctattggcgtgtctgtgcttcacaggttgccacttttccaaaagatttaagtttgaacccctagtccaaacttatagtaggatctggtttgattattgttattgttgtatgttggggtgtcctttagaagttttaatttttacgccaaggataaatctttttatgaaaggcatgtgttgctctttatgaaatatattgtttttatttttaaagttttatcatttggtggagtctacatgaaattagttattaaatcttatggccctttcactgtaaacaatagtatattttaagtggttgtttacatgctaccgtgacttacctttgactattacttttgcagccaaccttccctttacatacatatagtggtcatacttcacatgtggtgtcccttgatttccacccaaagaaaactgagcttttctgttcttgtgacaataacaatgagattcgcttctggagnnnnnnannnnnntccnnnnnnnnnnnnnaaaaaaa

SEQ ID NO: 3426 - DNA, 839 bp, Glycine max
gacaactcttatgttttctgccactgttccagaagaggtacgtatgtcttcttttttttccttttactttttttactgtatggttgtatgtttcttgtttagaaaagatagaagtaccaaacttattttgttattattgtggcaaaggtccgtcaagtatgtcatattgctttgagaagggatcatgaatttatcaatacagttcaagagggaaccgaggagacacattcacaggtaattgtttataattcatgctaaataactaacaaggtgttttcatgtgtatatgcatacgtgaggtaatgaatatgcattcgcatgtaccagcgtatactgcctttttgtgatatttattcatgggactttggatcatttcaggtctgccagacgcatttagttgccccattggacaagcatttctctttactatatgttcttctgaaggaccacattgcagatgatgttgattacaaggtatgctttctaatctgcaaccagctgtattgacctttttttttgttgtttcacttcaagacacataacatgattaacaaacaaggaaatcatattttggattagtctattgcttgttaaattctaaaactgtgatttgacaacaaaaggttttactttttctatcacatttcacatattttatgaagatatgtaatgtagctattggtttatcaggtccttgttttctgcacaactgctatggtcactagacttgttgctgaacttcttggtgagttgaacttgaatgtgagagaaatccattcaagaaagcctcagagttacagaaccagagtctctgaggaatttcggaagtcaaagggtct

SEQ ID NO: 3427 - DNA, 474 bp, Glycine max
  misc_feature (448)..(448): n is a, c, g, or t
  misc_feature (465)..(465): n is a, c, g, or t
tattttcaaaaaaatgggattcaaaatctcatgttccagttagtatcgagctttcctagggaacaagtacaacaaaatctacaataaagacaattatgtagggggggaaaaagcaggatagaaaggccacaagcctttacgaatcagattactctgcacttgtattcatcatagaggcgggtagaaatatgaagatacagaaaatccgaggaagagcaagccaccaacagtggctactgagcgttgggaaatcttagatgccagcatgcttcctcccactacagccagagaggtacagatggtgtgtcctatagtggccccaactgctactccaattgcatttttgtgggttgccagctgcagaaggaaaattaaaggacataaaaaatgtaggaggaaaaaggctactaatgcagccgacaataaactaagacaaaaccaaatcggnaaagcagaaaatgtgantgatctaca

SEQ ID NO: 3428 - DNA, 361 bp, Glycine max
ttatgtctgtcgtttggagcacagacataggaggataccaagctttttctcttttttgagaaatgagttttggttcaacttggtgcacaaagttggatattgtgttcagtgcgtctacaggttatgatttgtcaaacttattgaaccaacaacttacctacagttgatcacaagtatgaaagcgttccccaaataaattcgtgattaactaaattatctgttaaatgaggtatacttgaatagactcgcgaaccgaaatgttcaacttatgctaccagccgaacacaactcattttcttcattttttcttttcttttaaatgacctatactgtattattgctgtgtgagaagttgttgaag

SEQ ID NO: 3429 - DNA, 369 bp, Glycine max
ttggtcctacgcaaagtgctaaagtttcataagcattcggttactgcccttcacctcacaactgacctgaaacagttattgagtggggattcaggcgggcatttgctttcctggacactgcctgaagagagtctgcgaggttcattaaatcaggggtgagactggtaaaagatggttcgttctgctgacttcagcttttggccagcctttaatttgttgaatcctaacattggcttgagtggatctcaattgttgaaagatggattcatgttcataattcgagagaattgcaaaagaatgctggccagattgaaacagagcaagcaaggttgcaaaagaaaagatgatatcacagcgtatagagggcta

SEQ ID NO: 3430 - DNA, 1087 bp, Glycine max
  misc_feature (49)..(52): n is a, c, g, or t
  misc_feature (54)..(54): n is a, c, g, or t
  misc_feature (1035)..(1038): n is a, c, g, or t
  misc_feature (1051)..(1053): n is a, c, g, or t
tggaaacttgaaagatatcaagcttagctttgttggtcattctattggnnnntncattatcaggacagccttgacaggtatctaagcgcaaagtttttaaggataactactattcacaaaaattaaactagggaaagtaacatgcttattttattttatttaaataattccagagagcgtcatggagccatatctaagatacttacatacatatgtctccatatcgggtccacacttgggttatatgtatagttcaaactctctattcaattcagggttgtggatattgaagaagctcaagggcacacaatgcattcaccaacttaccttcacagatgaccctgatcttgagaatactttcatctacaatctttccaaggtattgaatgcttaatattttgctcttgattataagttgtctgatccctgacccattatctaggtctccttttctgcagtcatgaaaataatgggttttttgggctttgaaaatggagataaattattggataagtggttacagggatgttttgttcaaattcatttgctatatcttaatgaagggaatatagggtcataagtgctgttcaaatgctagtcttactgtttacaggagaagacactggctaacttccagaatgtgcttcttttgtcctcacctcaggtaacctttatatgcttatgatgggaattatcatggtttttaagacctatatttgaacttctagttccattgtttcaaaatatcctgtattcaaatgctggatcatttcctaaagggtgaagattgtaacttatgtatcaaccagagtataataaattagatagaagtctacatggtggaaagcttatattgattagtattcaaggtaatatggatatcatgactatttagtgactctctctgcctttctgcaagggtctattatctttttaaattatttttgttgactcatgataaggggtcctgggcaagtgataggatcttgttatattttcttctgcataacctttaatctggctatactttacggnnnntttattatttcannntatatcataatgcttcccttctcattacatcagg

SEQ ID NO: 3431 - DNA, 805 bp, Glycine max
acttagactcagactcaaaccctacccaaccaatttcacctgcaaggcagttttctccgacgatgccccctttgccgccgcaatcggtgcttgcatgttcacttctttgcttttaccagtctctacttcctccgaagacgacgatgccgactccgccgtcaccacaaccgacgcaaggctcgccgtcatggggattctcagtttcatcccttatttcaattggctcgtatgctattctaagtcctaactcttgaattttaattgctttgttagccacactagctaccagccatcattctcttccaattttgcagacttgggttttcgcctggctcgataccggcaaacgccgttatgctgtctacgcacttgtttatttggctccttatctcaggtacttacttaccttcacaaagtttagatgatgtggtaattctttaactgtttttctttgtttgcctgacataaccttctattctttcatcctgtttgtataaacttctttataagcacatatagaaaatgtaaaagaaaaagggttaatgaatttaacttctctcctaagttaaaatcaactcaaagaagtccaattcattttcacctcttataagtgttatggagaagtttactcaaataggatctttgtgttattcatttgacacatggtggaagaatattttgttactcctatgcaaagcttgacatgtacttgacaatgatatgatattttatttcatcaggtcaaatctatctctgtcgccagaagaaagttggctgcctattgctagcattctgttctgcattg

SEQ ID NO: 3432 - DNA, 595 bp, Glycine max
ttactcctttgttgcttaggtttaacagaagttatataatttctccttggctaatggattgaaaaaatgaaaaaaaaaggtgtattttcctggactctggacaagtttaaaacaacttgtattccaattttcaacttgtttattataagctcctctttttagttgtgttacgtagatactcatactagtgctgagtttcttccccttgtgtgaacaccctgttggctgttgtgaactttgaaatatttttaaaacaacggatcagaactttgactatctagaacttagtcgcacggttatggttttctagatttgcattccaaattttcattgtttagcatatgaatgttttaaactttatcattttgcagaccacctcgtgaacggcgttccaggagcccccggaggagatattgacatgtgtagtgagtaaatgtttgtgttgatgtgtgtgaacccgtaagtgagcggcttggtttctattgctatagctgtggaggatttttctgatacttgtgcttccgtcaggcaaaatacatatttgatgctgacaattctcatctaatacatcctttgttgaatggtataaactttt

SEQ ID NO: 3433 - DNA, 725 bp, Glycine max
cacgtgctatcactgcttctgaaagagttactctgaaaatatttatggtagtagctctaagggtaaatgtataatcggggcatcatgcaattacttggtgccatgtattcctgaaattaccagaatttaggatttgaaacttcattaatttatgattaatgcaatcagtggttttagtcaatttggaaagtcctgtagcatatttttaaaatctcaccatgttgaatctggttagtttcttgtcttagttgcttagacatacatatttggaagattctttcaaatgctcattattcaaatttcttgcacaggtgcgatatcaaagccggaagagattggcagagcagcgcccccgggtgaaagggcagtttgttcgccaagtacaagatgatcatccagtagcagatgtgggtggtggttcctgaaattgttttgtttcaagttaccttcatcattgaattacagtctgacttccaaatctgatttgcctttctcgacaaggattaactgtagggtctagtttgtctggtgaaattatgtttcctcttagcgttgttagtattttcttctggcttgttatattggctgtttcttagaatgtaggattgtaagtattttgtaggtttgttttgaagttttgattttacctcgtgtatatgctttcttgattgaatactaatatagggctactatcgttatataggcagtatgcttgtgtcttgaaa

SEQ ID NO: 3434 - DNA, 370 bp, Glycine max
ttgttcagcagcttacagggtctccctctcagtctcaggatcatcctcaatccaaacctcctcagaatcagaacaattccccaaaacctcaaagtatgaggttgcagaaaattaggcctccccctttgccctatgtgaggcctccattgcacaccaccttgccagcagctagacctgctcactttagacaacaaccatcaccaaaccctaataatatagctgagtcaccaatctctgcctacatgagataccttgaacattcaattacagatcccacttcaaggggtgcccaatttcaaccccatcatcatccagcttcttctgctttgcttcctaaccctcctatgaatcctatgaatactactatgac

SEQ ID NO: 3435 - DNA, 851 bp, Glycine max
gccgtcgatggagttggccaaccctcgaaacgaaactgcttctgcccctcagccacccaaacctgtcaaggtacgtacgaacataataataataatatatatcagagaaaaatacatagtatatcttaaatttatagttataaataaccagaataagaatcagagtttggtagcatatctttgaagcctggtgaggttctgaccttaagtataattcttcttattattattatcatctaaagtttctctaactaatcacttatgcatatactatggcagcgagagagcaaccgcaaaggtccaacgtcaagttctgaacatgaaggacctaaaacaccagatcctaaggttaactattaattttatctttcttccatctcctttttgttttttcaagcaagttactcattttaaaacaaaagggtgacaaacgatgctaacatttgcgctttaaaacgttgtgcacagacactcagaagacttgctcagaatagagaggcagctaggaaaagcaggcttaggaaaaaggtaactaataagtgattccataggaagagataatttttaactcaaccctattgtttttttcactctttcggtaagacttgtcaaaggccttattattaatcagccatgtaccattctgtttgtcctttttctctctctcaggcatatgttcaacaactagagtcgagtaggattaggctgaatcagctggaacaagagctacaacgtgctagaactcaggtaattaaggaattaatcagaatatgctataactggccatgacactgctaaagtttttaacttcaaacaccctgtggtttttactttttacaacttacaagtaa

SEQ ID NO: 3436 - DNA, 368 bp, Glycine max
  misc_feature (309)..(309): n is a, c, g, or t
  misc_feature (322)..(322): n is a, c, g, or t
  misc_feature (356)..(359): n is a, c, g, or t
aagcagaaaaactacaaaggaagcaaaaaccaaacacaatagtgtccgtaaaaaatggttgaatttccaatggcaagtatagaacaatttattctcgtttttttttttcctttgaaatacttcaaatttcattttgtctcggttaattgtgggaaagcaatattactatggtgttggcacattttcatcttgcaattgtggaagcacaagtaggatcatctttgtttgaccaactttctttaattcgacaagcctgcattggtctttcaatttggactacttctgcagcttccttctccaattgcctanaatatcttccaanacgtttctacaccaacctgaagtctaaaatctannnnaaatagaaa

SEQ ID NO: 3437 - DNA, 423 bp, Glycine max
gtttcactcatcagatcaattcggtggtggctcatcagaagcattattggcgaatcatcatcatcaacaaaagctaaggctaccactatggctagatcaccaccaagtcaataatactcaagtacttcaccacactcttgacaacttctcaaccgaaccgagtgctttcacttcaggaacaaactctgtgcctcatgatctagtacaaacaatggacatgtttgggccacagacacagtttgtgaattaccgttacccagaagcatcatttggaggtggcaatgccaacttgtctgtgctaccgccacatggactgaagcaagaacaagaagaaaacaaacaacacttgtcgcatagcggagcctcttctaataacttgtacttgagtaatagtattcagaacccacctcatcatcactacaa

SEQ ID NO: 3438 - DNA, 990 bp, Glycine max
  misc_feature (969)..(971): n is a, c, g, or t
tgctatagtggatgtgctggatactaagaaattaaagcagttattttgtcatatatgaagattttttaacaaaatctcttatgcagagaaatggagcaaagctatttgcagttggaactggtgcatcactggtaatttaacatcttacatgtgtagaaatacatttttcagcttctagttttggtgaactctttaaaatctttcagccgccggacttacttcaggccttacaaatgccatgtatgattgtagacctgtagtatatgaaatgagtgattgcattgcctttccagattggtacaggtgtaactaatgcgttgatcaatgcaagaaaagttgttgataaatcttttgctgctgaggcagaggatgtaccgataatatcgacaagtattgcctatggggtttacatggcagtatccagcaacttaaggtatttttttttttaaataagtgacttctatgatgaaatgatcctcttggattgactgagggagcatttcctgccctctgaccatgatggatccactccccccctcctcccgaattccatgacctagattatctaatagcctaatactatacacaggcattttagtataaaaaggcaacttttctacaatgcttagagattagtcgggttttgtgcaacctcaataatgcatcctagcagtaatgagttcttctttgcatgtataagcagaatctaacaggaaatctttgttttccaccaggtaccaagtactagctggagttattgaacaacggattcttgaacctttgctgcaccagcacaaacttatgctaagcgcaatttgctttgctgttagaactggaaacactttcttgggctcactattgtaagattctaagttgatcttgatatatttgtatatattttgctaaatttggttcttcttcacatcttatcattcgttacatactacatgattcttcccttctgggaannnggtgggtggattatgctcg

SEQ ID NO: 3439 - DNA, 483 bp, Glycine max
ggtgacgatgaacagtgataggaaaattggggttgccttggacttttccaaaggaagcaaaatcgctctgaaatgggctattgacaatcttatcagcaacggtgacactctctacatcgtccacaccaagccttccggaggaagtgaatcaggaaatcttctctggtccaccactggttcacgtaagctccttttttaatttttccctatatcatcaaaatcctttttttttggttttaataatgtggggaaattggaatcttcaaattctgataaccttgggaggggggggaagttctgattcctttgccgaagtttcgggaaaaggaggggaggcgtcactatgaggggaatacggaggttgaggggtggaattggttggaccccgtttcaaggaaaaaaaaggttttaacctaatggggggtggttggtggaatggggttttaaggtttgaattgggtaaaggtggtttttgtggctggt

SEQ ID NO: 3440 - DNA, 420 bp, Glycine max
tctcgataaataaattattttctcttctccaaaattcaactcaataatcccttccctggttcccatcatggacgaattagaagaaaccctactcacccaaatcgactgggaatcgttcctcgacgacatacctgaacttaacgtcgatgattttttgcaggacgacaacgccgttcctgttgttaccgacaatcattcctccccgaacgacgaccccgttttgtccgagatcgagaacatgctcatgacgcaggccgaaaacgacgctgtcgttttgcccgagacgccgtcttcggaggccgggtattacaagctcttcgaggagattctggtggaggagcccaaggaaggacccgtgagcccgccttcaaaaatagagtccgaggaaggctccgacaaagacaagaccgatgatgctat

SEQ ID NO: 3441 - DNA, 211 bp, Glycine max
ctcttcactctcgagctatattttgctttcttagatcccaacaatatggccaaatccactttctttgtctgccttaacctttcattactcttctctctagtcacagccacttactactcaagtttaaccccaacacttttgggttttcgcgaggagcagttcacccacctccacttcttcttccatgatgtcgtgacaggcccaggcccat

SEQ ID NO: 3442 - DNA, 728 bp, Glycine max
cgggtctgggaatgaagttggatcgcagtaatctcaatcttcactacgctgcaaggtattttccttttactctaaaaatcaacttcatgggacccctgaaatacactcttcattggattattaactcacaaacttacctcattcttagtttcttatcttcttaaactggtagcaagatgtgacattgatctaatgtacatataatctttatgggcctgtggcatgtttgcgactctataattgcagtatatcttgctccgtaaatgaaattgggaattttggcggatagtaaagtgccatttatagatgacatattctatgatcacataagctaacattttcatttttacttcagatattcaaaggagattccagatgcatatgaaaggttacttctggatgccattgaaggagaaagaagactcttcattcgtagtgatgaactggatgctgcttggtcactctttacacctgtactgaaggagcttgaagagaagaagataattccagagtactatccttatggtagtaggggtcctgttggtgctcactatcttgcagccagacacaacgtgcgatggggtgaccttgggacagacgtagaccattaaccctcgcattttgttgcacttctgatcggcctaagatgttagctattatgcatgctattttgtggtttcttcttggcatgcagtttcttttctcatcagcagcatggttacttctct

SEQ ID NO: 3443 - DNA, 1094 bp, Glycine max
  misc_feature (18)..(18): n is a, c, g, or t
tcttctgtgaagcaaccnccaccgctgcttgtggcattagggccatttgggttgctccctctaacagaagaaaaggaattgcaagcaaattgcttgatgccgtgaggtaaagtaaattaaatttggcttaacttgccatttctgatgggcaattaaagcccaattcattagggaaatcttcaaagcttgtaaacaactgaaatctcctgtagcatctgtagattaagacattaagattagcttaacagtgaggagtttgaatgagattgtaggtttaaattatgttgcgtgtattattatgcaaagagaatgatgcatagatccaactagtacataggtaatggaacacggctttaggtaaacatcacatctctggaagttttaatactagctgcattggatgagtgctaattggttagtctgtgttttggtttcacaataggaagcatcaaaataatacgtaatactaattatatctctgaaagctttaatactagctgcattgaatgagtgctaattggttagtgtgtgtttggtttcacaatagtaaatgttaagagttgattttgcctcctgtcaaacatataagattgattttgccttaattttgatctgattagaagagataaaagtagattttcattaggttgaaaatttacaagttttacataaaaaaatttcgagaataaaaacatctaaaccctctagtgtcatttcaatttttcaaaattaattttgtgaaatcaattttggaaactctcacctaaatgcaactattcttcaaccagttgctagtttagtgatttgtttatggtctactttaaattggcggcaggaagagtttctgcaaggatcttgagcttgaacgttctcaactagcattctctcagccaacctcagctggaaaggcattggcaacaagttacactggcactggatcattcttggcgtattaaagccaacaaaactattggttactactactatttcgtactgacagataaagccatgtttagattagtgattacttgtattgactgttaattaacaaaaacataagctattattcttgtaaagtataacatttttagccc

SEQ ID NO: 3444 - DNA, 1202 bp, Glycine max
  misc_feature (153)..(153): n is a, c, g, or t
  misc_feature (486)..(487): n is a, c, g, or t
  misc_feature (522)..(525): n is a, c, g, or t
  misc_feature (582)..(582): n is a, c, g, or t
  misc_feature (584)..(587): n is a, c, g, or t
  misc_feature (1146)..(1152): n is a, c, g, or t
  misc_feature (1189)..(1190): n is a, c, g, or t
  misc_feature (1199)..(1199): n is a, c, g, or t
aggaatgaaatatctttcaagtttcaatattgtgcaataaaaaaatttcaagctatcatgaaattggagttgcactatgtaaagaggaattggagcaaaggaaatgttgacgggtcacgagtagaatgaacttttgatgttcatgtgggagangtatataaattgttaatgtgtaagcttttagaatagttagttaatgatgtggcatgagagcctctatgaagtggtcacgaatttgttccttatcgctagtttaactgtgattgttttacttgtctgtgcatgcatgttgtgaccacagtaaaactgaaacgatattatgagatttaatgatctgttcagatagcaagaatgttgtccatgctgcaactcctcacccttctaagcaggctggtaaagcaactgcaaataacaagctgcagtctccgaagtcaggtggagattacagctgcaagccttgcaacaggtgattggagatgtttaganngaagcaagcaattcgaggggagcctcccggaggannnnatatggttttcttcccccgagaggacatcctagaatttcctcaaattcttcaatggntnnnnctaattggaagtccccgaatgtgaagcatctcaaaggctggtcgtagtattgggtaagtgatgcaatggcttctatggacacctctgctatggtcaactctaagatctttccgtaagtcttgcggaaggcttgcatttggaggggttccatcaaccgccctaattccttgatgctggtgctaactggtctttgaccttgacacttgagcttggttcccccatgatgctttactcatcacttctcatattcttggaacagtcctcattgctggctatcatgcattcactgtcactattctattcagaggggaaccccctcactttacccctttttttttacgttgtgtcccacttatttgtttaaggtgattgtgatttcatatagcttatggtcaaatgtgttttagtcatatttgctaagtgtgactggtgatttctatggataagttactgttaatggcattacctggccaaaataaacaccaaatggtaatgggagggagatgtaaactattgtaatagaatcccccctaaataagttgtttaaagaagcttttgnnnnnnncaaggctaaaaaggatgcatacatcctgagttgcagnnagatgatgnaaa

SEQ ID NO: 3445 - DNA, 687 bp, Glycine max
gtagtatattaattagagtgcatttggaagagtttatttgaaacttacttggacttatcttacaacataaatatttgtattagcatttgacttagtttatgaaaataacttacaacttatataaaaactgtttagccttggtttctcttcgattttatacataaccacgatacaacatttattcaataagtgcttaattaaactatttacttaaaacttttgtgattgtagattgatgtggaagacaaccccgatcacagttttcttcctcggggcattgatgccgtggatagatccaccaggagtcctatccttcaagtgggatgtgaacaactcaactgcagtttttttgtatctgctctccttggttttctcttgcagtggtcaggggcattggcattggggtacagagactacattcctcttccaacaccattttttgacacataatgttgttttcttttaatgttgctagctaacatgacactatgaatctatgattgcagggccacttctgctacaacccatgttgttttaggacagtttaaaacatgtgtgattctgttgggagggtatctattatttgagtcagatcctggggttgtgagtattggtggtgctgttgttgctctctctgggatgtcagtttacacgtcattgaattgcaagagcctcaggagcctcatc

SEQ ID NO: 3446 - DNA, 586 bp, Glycine max
agtggcccactcactttgggcccaaacctcctctctatttcaatgctggcatgtttgtgtatgagcccaatttggctacttaccgtgacctccttcaaacagtccaagtcacccagcccacttcctttgctgaacaggtatttaattactgagttaattaatcttatacaatattaatatattataaggtgtaaagagtatatttatgttggattattggattgcaggattttttgaacatgtacttcaaggacaaatataggccaattcctaatgtctacaatcttgtgctggccatgctgtggcgtcaccctgagaacgttgagcttgacaaagttaaagtggttcactactgtgctgctgtgagtgttcaattttaattgaaatgaaactggaatttaaactttggtgtacagtaagatagaaattttaatttggttgaattggtgtgacaggggtctaagccttggaggtacactgggaaggaggagaatatggagagagaagatatcaagatgttagtgaaaaagtggtgggatatatatgaggatgagactttggactacaacaatccactcaatgtgga

SEQ ID NO: 3447 - DNA, 593 bp, Glycine max
aaggccagaggacctgatgttgagctatgtcagtggcgagaaaggaaaagacagatctgatcgggagactgtgaccccatggtttaagtttctttgggaaacttataggacagtgctggaaatattgaggaacaactcaaagctagaagccttatatgctgtaatctttcttcttatgttcttgtacaacttcttgatgctatacatgattcatatgtatttgcttaatgtacagaattatgcttgttcttatcttattctacctattttttattttttttttcaatttcaactgttatatgcttctttggaacatgataatttaaggatgcaaactacttgtaatcttgagcttttaataaactctaatgccatgtgcaaatgacagctcatcaagctttccagttctgaaagcaatataagcggacaacaaagttccgcaaactgtgcgaaatcattaaaaatcatttggctaatcttaataaatatcgtgaccaacgagaccgacctgatctttcagctcctgaaagcttgcaactgtatcttgatacaaaatttgagcagctgaaaattgttactgaacttggactctg

SEQ ID NO: 3448 - DNA, 353 bp, Glycine max
cttcttcccaccgacgggaaacatatcatctcagttagcgaggattcaaatgtatgtatatggaattacactggccaagatagaaatacctccaaagcaaagaaaatttggtcttcagagagttttctctcccacaacgcagccatcgctgtaccttggtgtggcattgaatcaatgccaggaacactcttatccccatcgctaggagaggatgtaaatcagaggtgttctctgccttctcctgattgcttcttcttgagtcgcggatttctgtctgagttgatcccaaaggtttctgcaacatggcccgaggagactcttgtggactcatcgtgtcaaactcaaactgttga

SEQ ID NO: 3449 - DNA, 388 bp, Glycine max
tctttcgcctcaattctgtgtgcaaaagatggaaatcagtagctgcttctgccagtttcaagcttgcctgctctcacattccctcaagggaaccttggtttttaatggttgctcccaaccttaaccaatctgttatctttgactctgctgaaagcacttggaagagactaaatcacccctctcttctgcaagaagaatctaaccaagattgcatgccagttgcggcttccgggggcttgatttgctaccgtaaatcatcaggaaacttcattgtaaccaaccctgtgactggatcttgtagagaactccctccactgcaacttgcctcacaaaaccaaccactcgatgccatcgtgatgagcacaagttccaaagaccaaatctccta

SEQ ID NO: 3450 - DNA, 403 bp, Glycine max
cttctgcagtccactcctctctaaccacagaattcacccatctaactaagtggacaacctgctcaccttctgtgttgtttatgggggatttcccagtcagaagctcaagtagcagcaccccgaagctgtacacatcagatgcatgagttgctttgcgtgtgtctgttacttctggtgcacggtatccggttgctctcattgctggcatgggtattggactcatcaatgttgccaagccaatatcagatatgcatccatatccttgtgagttgaagaagatgtttgaggcctttaggtttccatgaacgagtttccctccatgttgagcgtggatgcaagcaatgcctctggctgcaccaattgcaattctcaagcggctatcccagtctaaagaacttctgcc

SEQ ID NO: 3451 - DNA, 378 bp, Glycine max
  misc_feature (373)..(374): n is a, c, g, or t
gagacagacaaagagacagaagtcatgatttcgatagtgaaagaggaagggaccggcaccgggaaaagagtggaagcagagagagagatgatcatgataaggatagaagcagggatagagacagggacaggagaagacgagccaaataagaacatttcagatgtttcagcagagatttgataccttaatgatttgcaaattggcttgtaagagtcaggaggacagttggcttttcgtcatcacagggatattggcaatgtgaaacctcctgttgggagataggaatgaaacatctgccaggatagtgttactgtggacagtctttggaattgctgagtagtaactggctcttgataccctccataattaaaannaaaa

SEQ ID NO: 3452 - DNA, 723 bp, Glycine max
  misc_feature (46)..(46): n is a, c, g, or t
  misc_feature (89)..(89): n is a, c, g, or t
  misc_feature (207)..(207): n is a, c, g, or t
  misc_feature (715)..(717): n is a, c, g, or t
ccaaggagtttgtctcgttggaccaacttgctggtaagcttcttgntgcatttatcggttatatttatgtgcagattaagggctttacnctaacatatgatctttgacacgtgttaaattgtagaacttggagtccttagctggaaactagatgctgataaccatgaaaatgatccagagctgaaaaagattcgtgaagagcgtggntacacctacatggtttgttatactaatgtctcatcataatggctttgaattaactttccttctactcaatataaatgaatatatgttgagaaatatcaacaatatgcaaaagagtcactataattttaattatgtctaacattgtgcactacttatgcatctttgacattctggctatgcttatatttttaataattcaacccgagtcaccttttctgcaggatgtttgtgaggtctgcccagaaaagttgccaaattatgaacagaaaatcaaaagcttctttgaagagcatcttcacactgatgaggagatccgcttttgtgctgctggaagtggtatgaactaattttctgctttactttgattttcttgccaccttgcctaccatgttaagttgctaaatatatcatgtttgtctttaggctattttgatgttagggatcgcaatgaagcttggattcgtgtgtgggtcaagaaaggaggaatgatcatcttacctgccggaannntcatcg

SEQ ID NO: 3453 - DNA, 395 bp, Glycine max
gggatttgttcgacccatttttgtttggtgaaagtgaaggacttcagggaaacggtgcagtcgcagctaaaaaattgttggcttttgcagagccagtgccagtggaataactataaatgaatcaatgaaaatattcaatattgtacatttttttctcattgagtaatttttttttggtgccacggttgttgcaattattatagccaatagattttcgactgtgaaaatgtacagagtgaaataccttttaagggaagttcgtcttcttcaaactgtcaaatattattattattttgcattactatcaatcaaggctgccttgccccgtttcttgaagggtttacttttattgaattttattatttggtcttcatttgatcccaagtaatgaaggg

SEQ ID NO: 3454 - DNA, 359 bp, Glycine max
ttttcctttaggatcagtattttcctttcatcagttcatgatttctctctgatccttttttctataaactgaactgaattgagtctcaacaacccagttgagtaactaagatggcgcaagtgaggaacaagcaagtgcttctaaaggactatgttaccggttttcccaaagaatccgacatgaatattgtcgaaagtaccataacattgaagcttccacaaggttccaatgatgtcttgctcaaaaatttgtacttgtcttgtgatccgtatatgaggaatctcatgaacaagcccgaaggccctcccaatagtcgtgcttacactcctggctctgtaagtcatgcttttttttttttt

SEQ ID NO: 3455 - DNA, 816 bp, Glycine max
gactgctggaggtcgtttcattggacaagggcgggctgatgacacgatgaatcttggcggaataaaggtatcacatcatacgctatattcatgtttatagctccttctcccagttctactctgattgaagatgaagcttctgaaagctattctgctagataaacatggtgtaagaatcctaaatatttccatgtcaatgtcctgaataaattaataagaaaggaaggtacttccgtacttgtaactgatcatggattcatcagaaattggtaaattcctgtcttgacatccgtggtctgacagttattcttggaattttctgttctgatatgcagacaagttctgtagaaattgagcatgtctgtgatagagccaacaaaggcattttggagacagctgcaatcagtgtttctcctgcaaatggaggcccggaacaactagttatatttgcagttttaaagaaaggatacaattccaatgcagaaactctaaaaaggaaattcagtaaagccattcaaagcaaccttaatcctttgtttaaggtatgaccctttgttcattgtaagcaactacggttttgaattgaatacatcacgaaaagcaataacttaattatttaaagattcacgaaagtctgagtttgaaggaaaattgtaattttatgcaaatattaacctgacttaatgatgaagttactgatttgatgttcacaactcattttgttactttacaggtgagccttgttaaaattgtgcccgactttccccgaacagcttccaacaaattactaaggagagttttgagagatcaaatgag

SEQ ID NO: 3456 - DNA, 847 bp, Glycine max
ggtctgctagcttccgagcttttccattgtacattcatatattttgttccattatatagtagtagtatctctcaatcaatgattaatttgagtttgtggcgtaggcatcaacatcatgaagttagaatcttgatatactatttataatgcagaaaaataggttatgcacttatatcctatgtatgttaaattgatcatttttatgatgataaaagttatatttaaaagtgaaataatttgagatatttaaaattaaaataatttgttatcggagaggataatataataacataattattacacactaacactaatatgtaacctcttcagccacaaatttaatgatgggaaaaaacttattttactaaatttgaagactatatgatcgtgcaaagcttgtcagagttaatatatctaatttatacgtgcatcttgaagctaagggtggatgttaatagttacatgagaaataaagtatatgggttgatatttgtgtaggcagagaaagcaacggcaagaacagaagaggagagggtgatagcccatgagcacgcaaaggcaaaggaagctggagcaaagatggagctgcatgaagctaaagcaaggcatgcagcagagaagctaagcgccaaccaatcacattatggtctccaccatggccacaacaaccctcccttagtaggaacaactcagactcactaccagcaagggcaccagcaccagccacttggggcagttcctatgcctggaaccacttatccatcttatccactaggaggaaaccctaaccctccaaggaacaaacatatataatagatctatctgtgttttgctgtagtacgtctac

SEQ ID NO: 3457 - DNA, 729 bp, Glycine max
ggcaaagttgtcaatagttacagataaacctcaaacgacgaggcatcggattctgtgtatatgttctggcacggattatcaggttttaatcctatttcttcctagtcctttagtttgtttttcctactaaacgcctgaatgtgtctatttggatttgcgttggagtcatgttgaaacaccaattaacgtgattttaggtaaatggtaacatgtttggtctctggttttggctctaaaattgattttgagttgaaacaactttaagagctttttcagttgaataaaattttaatactgatttagagttaaaacaactttaagtactttttcagttgaataaaattttaatactgaattttgctaaattaatggatgtacaacagatgatacttttgaatctcttgcagatgatactttatgacacacctggtgttctacagaaggaaatgcacttgttagactcaatgatgatgaaaaacgttcgcagtgctgcagttaatgctgactgtgtattggttcttgtcgatgcacgtaaaactcctgaaaaagtatggaccttcatcttcctttacaaaattgtttgttctactttctttcttgtttttccaaattgcttcctatctctagattgatggactgttggaagaaggcataggagacctcaaagataagcctcccactctactgattctaaacaagaaggaccttgttaaacctggtgaacttgca

SEQ ID NO: 3458 - DNA, 405 bp, Glycine max
attctgatgggatgtcaacccttctcaagagagacagggtagatagaaaatcagaagaagtgacatttgtaagcactgatagcataaggatgagtggtagtgtcaagttcgaggtgtttgataaagatgttctgctgctttccggtgctttagaattgtgtaataccaatggtgttgttggggaatcaagttataatggacaaaggtggaacatgaactgtgagtcatatataattccaggcaccagcttctttaaggggaaacaattgctgttgccagactcaagtctcccaacaattgaggtctacattgccggctccttctcgagtactccaattatcttgacaaaaaccttgcagctttctcagaaaaagcatacaaagaagggagtattggatgcaattc

SEQ ID NO: 3459 - DNA, 587 bp, Glycine max
tttatggcccctggaccattgacgactccgatgttcgagaggtgttgtttataatttcatttgattttgaaaaatgtttcttagacaacccttgagagagaaaggaagagatgagaaatgagtgattgatgatgtagcgtgataagaagagagaaaagataattgttggttgagtgtaagaaacttttgtacgtggattcatcatcaattagttaattatgctatgctatggcaggtaattttgtacagatcaggattggtaacagctgctgcatcatttgtggtcgctggttctgctgccttttttcccgatactctgaagcagaatgttgatttattgtatgtccttgggtctggtgggttgggtttatcgttgctcttgattcacatatatgtgtctgagatcaagcgcgccctacaagcactatgggggcttggtgttgttggatcggccacaacctacttttgccttgctcaaccagctaataagaatctaatacaatatgttgttgacaacccatcagctgtctggcttgtcggtcctctttttgctgccttgacaggacttgtcttcaaggaaggactca

SEQ ID NO: 3460 - DNA, 151 bp, Glycine max
tggtccagtttgggctaaggctatggccaatattgcagcctttcttcaatcagtcattgcattgcatgtagtaacttctaaacttcaattttagagctactaaatattttatctaatttgtgtcactggcctaataacctctcttctgctt

SEQ ID NO: 3461 - DNA, 350 bp, Glycine max
ttttcccggctagaacatcgacgacatcaacatggcttcgacttcaatcactaccttgtccatctactctcactcccaaccaaagttcctcaatctgcttcaacacccactcattcacacccgcaacaaaagcacatcaattacgtttaagccagcgatagttcgcgccacccttttctctacactcacttgttctcacaccccttccacaccctcttcaaatttaccaccgggaagggctttaaccaagttcctctcagaaaaggtagcatttttcctcattgggtcgtttctcttatcgggttgcttcagcaaaaggcctgcattcgcagaaacagctccttccgtgg

SEQ ID NO: 3462 - DNA, 1639 bp, Glycine max
  misc_feature (150)..(150): n is a, c, g, or t
  misc_feature (164)..(165): n is a, c, g, or t
  misc_feature (570)..(571): n is a, c, g, or t
  misc_feature (584)..(584): n is a, c, g, or t
  misc_feature (741)..(742): n is a, c, g, or t
  misc_feature (744)..(745): n is a, c, g, or t
  misc_feature (847)..(847): n is a, c, g, or t
  misc_feature (910)..(915): n is a, c, g, or t
  misc_feature (918)..(926): n is a, c, g, or t
  misc_feature (928)..(935): n is a, c, g, or t
  misc_feature (937)..(943): n is a, c, g, or t
  misc_feature (946)..(950): n is a, c, g, or t
  misc_feature (954)..(962): n is a, c, g, or t
  misc_feature (964)..(966): n is a, c, g, or t
  misc_feature (971)..(976): n is a, c, g, or t
  misc_feature (978)..(982): n is a, c, g, or t
  misc_feature (984)..(999): n is a, c, g, or t
  misc_feature (1004)..(1010): n is a, c, g, or t
  misc_feature (1015)..(1020): n is a, c, g, or t
  misc_feature (1022)..(1024): n is a, c, g, or t
  misc_feature (1026)..(1030): n is a, c, g, or t
  misc_feature (1034)..(1034): n is a, c, g, or t
  misc_feature (1043)..(1045): n is a, c, g, or t
  misc_feature (1048)..(1050): n is a, c, g, or t
  misc_feature (1054)..(1054): n is a, c, g, or t
  misc_feature (1059)..(1063): n is a, c, g, or t
  misc_feature (1067)..(1068): n is a, c, g, or t
  misc_feature (1070)..(1073): n is a, c, g, or t
  misc_feature (1076)..(1081): n is a, c, g, or t
  misc_feature (1084)..(1085): n is a, c, g, or t
  misc_feature (1092)..(1103): n is a, c, g, or t
  misc_feature (1105)..(1126): n is a, c, g, or t
  misc_feature (1129)..(1147): n is a, c, g, or t
  misc_feature (1149)..(1149): n is a, c, g, or t
  misc_feature (1151)..(1158): n is a, c, g, or t
  misc_feature (1160)..(1169): n is a, c, g, or t
  misc_feature (1171)..(1186): n is a, c, g, or t
  misc_feature (1188)..(1197): n is a, c, g, or t
  misc_feature (1199)..(1200): n is a, c, g, or t
  misc_feature (1202)..(1228): n is a, c, g, or t
  misc_feature (1230)..(1232): n is a, c, g, or t
  misc_feature (1235)..(1237): n is a, c, g, or t
  misc_feature (1241)..(1244): n is a, c, g, or t
  misc_feature (1246)..(1251): n is a, c, g, or t
  misc_feature (1253)..(1255): n is a, c, g, or t
  misc_feature (1257)..(1272): n is a, c, g, or t
  misc_feature (1277)..(1283): n is a, c, g, or t
  misc_feature (1285)..(1313): n is a, c, g, or t
  misc_feature (1316)..(1316): n is a, c, g, or t
  misc_feature (1318)..(1348): n is a, c, g, or t
  misc_feature (1350)..(1359): n is a, c, g, or t
  misc_feature (1361)..(1371): n is a, c, g, or t
  misc_feature (1373)..(1373): n is a, c, g, or t
  misc_feature (1375)..(1397): n is a, c, g, or t
  misc_feature (1399)..(1399): n is a, c, g, or t
  misc_feature (1401)..(1431): n is a, c, g, or t
  misc_feature (1434)..(1449): n is a, c, g, or t
  misc_feature (1451)..(1458): n is a, c, g, or t
  misc_feature (1464)..(1510): n is a, c, g, or t
  misc_feature (1512)..(1560): n is a, c, g, or t
  misc_feature (1562)..(1568): n is a, c, g, or t
  misc_feature (1570)..(1579): n is a, c, g, or t
  misc_feature (1581)..(1598): n is a, c, g, or t
  misc_feature (1601)..(1636): n is a, c, g, or t
aggtgagaacgcataacttgaaaaggcttgcttgctcacgcccccgtttgtagcattttatcaattttgacagacagaatcatctattataacggaaccgaataatgatgtatattctaactctgttatttaggtaacggtgccagtgtnctctttctgctgcnnattgctggtctacatatgaagctggaaagtccttattccaagatttcaatcagcagaaagacactggcaccgttacctaaataacagagttagaatatacatcattattcggttccgttataatagatgattctgtctgtcaaaattgataaaatgctacaaacgggggcgtgagcaagcaagccttttcaagttatgcgttctaaccccaaataatatatacagaaagcatcggattaacctactaatggagaacttgttttcttgtacacattgtcagttttaattatgatttttcccccgccttagcttttttgctagtttcatttagacagaacattattccatggaaacgcctctacgccacatgaaatttttgccttagtttcatgcagctgtaagagnnatgttgctggttnccgttacctaaataacagagttagaatatacatcattattcggttccgttataatagatgattctgtctgtcaaaattgataaaatgctacaaacgggggcgtgagcaagcaagccttttcaagttatgcgttctaaccccaaataatatatacagnngnnatcgaattaacctactaatggagaacttgttttcttgtacacattgtcagttttaattatgatttttcccccgccttagcttttttgctagtttcatttagncagaacattattccatggaaacgcctctacgccacatgaaatttttgccttagtttcatgcannnnnnaannnnnnnnntnnnnnnnntnnnnnnnctnnnnnaacnnnnnnnnntnnnttctnnnnnntnnnnnannnnnnnnnnnnnnnnccccnnnnnnncccgnnnnnntnnnannnnnctcntccctccannnagnnnatcnccccnnnnnaaanntnnnnacnnnnnntcnncctaccnnnnnnnnnnnnannnnnnnnnnnnnnnnnnnnnnttnnnnnnnnnnnnnnnnnnntncnnnnnnnntnnnnnnnnnntnnnnnnnnnnnnnnnnannnnnnnnnncnncnnnnnnnnnnnnnnnnnnnnnnnnnnncnnncannncacnnnncnnnnnntnnnannnnnnnnnnnnnnnnttatnnnnnnnannnnnnnnnnnnnnnnnnnnnnnnnnnnnatntnnnnnnnnnnnnnnnnnnnnnnnnnnnnnnncnnnnnnnnnnannnnnnnnnnncncnnnnnnnnnnnnnnnnnnnnnnncnannnnnnnnnnnnnnnnnnnnnnnnnnnnnnntcnnnnnnnnnnnnnnnncnnnnnnnncatccnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnannnnnnncnnnnnnnnnnannnnnnnnnnnnnnnnnntcnnnnnnnnnnnnnnnnnnnnnnnnnnnnnnnnnnnnacg

SEQ ID NO: 3463 - DNA, 388 bp, Glycine max
gctcgtacgaagcaaacagcaagaaagtccaccggaggaaaagctccaaggaagcagctcgccaccaaggcagcacgcaagtccgctccggcgacgggcggcgtgaagaagccccaccgtttcaggccggggacagtggctctgagggagattcggaagtaccagaagagcacggagcttctcataaggaagcttcctttccagaggctcgtaagggaaatcgctcaagacttcaagaccgatctacgcttccagagcagcgctgtctccgctcttcaggaagccgctgaggcctacctcgttgggctctttgaggataccaacctctgcgctattcatgctaagagggttaccattatgcccaaggacattcagctagctcgtagga

SEQ ID NO: 3464 - DNA, 296 bp, Glycine max
tcattactacacaaaataaaaccccaaataaaatttagtaagatctaagaccaggtgggtccccagcaaatcaaatgcatgatattctcagctttctccatcttcctcttgtcatcgacattagattgcgttgcaataccattgctgcccttactgcaaccacgttccgcccctgaagcttgtcgtttgattcgtttctccggcaacaacgttttcaacgcgctctctgatttgcacatcttcatgttaccaatcccattcatcatcgctcccccctctcttttgttgtttttttt

SEQ ID NO: 3465 - DNA, 553 bp, Glycine max
  misc_feature (378)..(378): n is a, c, g, or t
  misc_feature (387)..(393): n is a, c, g, or t
  misc_feature (407)..(407): n is a, c, g, or t
  misc_feature (427)..(429): n is a, c, g, or t
  misc_feature (448)..(448): n is a, c, g, or t
  misc_feature (469)..(470): n is a, c, g, or t
gggcttattaaatattaataaagattctgtattatcatctcctgcaactgaatccaaagacaaaaatcgtccaataatttcttttgcattgagcagcccaaaagggaatgtctcgaatattgcagatcctaacatggatcaatcagatccttttaacttgagcactcttgaggctgaaataaaaagagaatccattaagtcagatgtcgccttggaggaaaaacccatgcaagagtcaactgatttggcttcctcatcttctgtatctcagccttgcagcagctctattgctgttttggaacctgatggaatatgtataccttctattgatgcatctcttgttccatcttttcgtggcagtcaaagaatagagatgangctgggttnnnnnnnagtaggcttggagntgtcggaggtacctcacttnnntgcgagaagcacttctgcngaaagcactccgagaagaagnntaaatcgtgacaaatgctcccagaagtatgctgttcaatcagattggaaagctcactccaagacctgtggcactagagagtac

SEQ ID NO: 3466 - DNA, 378 bp, Glycine max
ctttcatcactgtattggaacgatgaggatgtggcgggtacctcatcttcgaacaaaaggttcaatttggaattaagtggggacaataataaccatggaagtgttgtgagggatgatcaagagaatggcactgcttcctctattgccactctgcttaatcaactccctcaaaccccttcattgcaccaacaatcaatattggggtcaataggtgatggacttcttagaacaacataccaaataccaggaatgaattggtatgcttagaacaatttcaggtttgttttaattattgatgaacagggagatattgaattactataaagaaggatatatgatatgatcctcgatcagctggtggaaaccctacactattaa

SEQ ID NO: 3467 - DNA, 305 bp, Glycine max
ctcagaggagctatatccaatgttgacttctactctggattaatttataggtaatccattatttctcccagttattctaaccatggaggataaaatatgccccctctctcccccccccccaagaataccatacaaggtttgaacaaatagttttatgcaaccagggccatgggatttccaccagagtatttcactgttttatttgctattcctcgaatggctgggtacttggctcattggagagagtccttggatgatcctgatacaaagattttgagacctcaacaggttactttctttcttta

SEQ ID NO: 3468 - DNA, 360 bp, Glycine max
cgtgcccccggctgtgaatacttttgcggagattgacttgggcgacgcgcttaatcagaacattagacgctgcaaatatgtgaagccaacgccggttcagcggcatgccataccgatatcccttgcggggcgggatttgatggcttgtgcgcagactggttctggaaagactgccgcattctgtttcccaatcatcagtgggattatgagaggccaagcccaagccctccagaggccgcctcctcgcggcgtccgaacagactaccttgttgtcgttgttctctcacctactaaggagttatcgatgataatacatgaagaggctaggaaattttcttaccagactggggttagggtcgt

SEQ ID NO: 3469 - DNA, 724 bp, Glycine max
  misc_feature (56)..(58): n is a, c, g, or t
  misc_feature (610)..(610): n is a, c, g, or t
  misc_feature (651)..(651): n is a, c, g, or t
  misc_feature (688)..(690): n is a, c, g, or t
  misc_feature (706)..(708): n is a, c, g, or t
ttgttgttgctgcttgcagacttccttttccttgatgagctgagctccttatcagnnnttttcctcatgtattccatcaaattgcttcgcaaagtgttgtagttctcacacatctctgtgagcatttcggttaacttcttgttttctgcactcacccgcttcagttcctccgccaaggcacctgctgactgaaatggcagcacatatatatgtatcatcattgatgtagcttataaaaaacaagagaatcattcaaccaaatggtgccacaagcagcaatatcaaatctagaataaaagagtagggttttttattaaagaaaaaaaaaaggaacatgtttttaaagtctaaaggaaccataattttgaatacaaaaacaaaattgaaaaaaccgcttgaaaaaaggaaaattggcaggaaaaactaacctcttgttttacaaaaaatttcttcacctccaaatccaatgaaaaaaaattgttttccacctgctttttctgaaatgaacacacaaaaaaaaaaaattttttttttattcaggacacaaaaaaaaattatttattattctgaggaaaactttccacaaaaaatcttgaacgctatatgaacntttatacttacggaaagttcttcgggaaccctatgaaaatnaaggttgaaatccaaggaagggttaatccatgacaannnatccatgactgccaannnaattccaaatgatgag

SEQ ID NO: 3470 - DNA, 648 bp, Glycine max
  misc_feature (352)..(361): n is a, c, g, or t
  misc_feature (389)..(391): n is a, c, g, or t
  misc_feature (430)..(431): n is a, c, g, or t
  misc_feature (436)..(441): n is a, c, g, or t
  misc_feature (473)..(477): n is a, c, g, or t
  misc_feature (479)..(479): n is a, c, g, or t
  misc_feature (481)..(488): n is a, c, g, or t
  misc_feature (496)..(497): n is a, c, g, or t
  misc_feature (505)..(522): n is a, c, g, or t
  misc_feature (529)..(532): n is a, c, g, or t
  misc_feature (536)..(540): n is a, c, g, or t
  misc_feature (544)..(552): n is a, c, g, or t
  misc_feature (554)..(560): n is a, c, g, or t
  misc_feature (563)..(563): n is a, c, g, or t
  misc_feature (565)..(571): n is a, c, g, or t
  misc_feature (573)..(573): n is a, c, g, or t
  misc_feature (575)..(576): n is a, c, g, or t
  misc_feature (580)..(580): n is a, c, g, or t
  misc_feature (582)..(595): n is a, c, g, or t
  misc_feature (605)..(608): n is a, c, g, or t
  misc_feature (610)..(610): n is a, c, g, or t
  misc_feature (612)..(614): n is a, c, g, or t
  misc_feature (620)..(622): n is a, c, g, or t
  misc_feature (630)..(630): n is a, c, g, or t
  misc_feature (634)..(645): n is a, c, g, or t
ggcggtggcgccgccgggttactacatggcgttcgcagtgaaccagggagtacccagcattgcaaagtggatacacgtgtcataagtcgtaactgtgaagtaacgaagtctctttgatgcattttggaaattgaaattgtatttaaatttatttattttcttttttggggggcaagtgggggattaaaaatttaaaattgagattcttcaattgttaataggaattggggactgggaagtcggtaagtgtgactggtgaattgcaaattcattttttttaagccccacaaccagaaggggaaatgcaaatgatgttttaacgggaatttcgcaatgcatggatgattaaggnnnnnnnnnngaggagtatgctaaacgacgaggggttnnnataatttgcaaggctaacagattagagatcatgctttcnngtttnnnnnnggcaaataaaagaaaatagcgttcctgctccnnnnncncnnnnnnnnggtaaaannttaacaannnnnnnnnnnnnnnnnntaattannnncccnnnnncctnnnnnnnnngnnnnnnncgncnnnnnnngncnntttntnnnnnnnnnnnnnntccccccttnnnncntnnnccatcnnntccacttncacnnnnnnnnnnnncct

SEQ ID NO: 3471 - DNA, 400 bp, Glycine max
ctaacttgcctcttcccccaagacccaagttttctcttttcctcataaccccctctctcccttccaaatttcaatttcctctttcctcccttaggttatggatccattggggaaacgccctgccgccgaggacgattccctaatttccgattgcgagagcggggtttccgctggagacacgccgccgccgttcgtcgaaaacgccgacctcgtccggaccagattcgttcgtggcctcgtcgcgcactgcttcaaacccgaggttctggcagttcgcagaaacgtgtgttcctccgtcatggccctggcgcgtcaacattcctttcacgtcttcgcgcgtgccgtggccgaattgcgcggcggcaatgccaacgtgaagttcgcctggtacggtgcgtcc

SEQ ID NO: 3472 - DNA, 616 bp, Glycine max
cgtgttctcccctgacggccatctcttccaggtcgagtacgccctcgaagccgtccgcaagggcaacgccgccgtcggcgtccgcggcaccgacaatgttgtcctcggcgtcgagaagaaatccaccgccaaactccaagactccaggtactactactcttttcaattcaattccctccgtttcagatccctttccccttcgattactagggattaaccaagaaaactacgtgttataaggagaaggcaaggagggagaggtcaggggttcgaatcctctgctaacgaatactaacaactaacatttgcaatcaaagaagaaaaataacaaaaaacgacgtcgtttcaaatcgaaccctgattttgtgtcgttttcgcaggtcggtgaggaagatagtgaatctggacgaccacattgcgctggcctgcgcggggctgaaggccgacgcacgcgtgctcataaacagggcacgtgtggagtgccagagtcacaggctcaccgtggaggatcccgtcacggttgagtacataacgcggtacattgcggggctccagcagaagtacacgcagagcggcggcgtgaggccctttgggctttcgactctgattgtcgggt

SEQ ID NO: 3473 - DNA, 399 bp, Glycine max
aagttgactcaaactgcagaagattcaagcaaagaaacgtaaaattgtgccttcagtttgtaaatcattgaacctcaagggcaataaaaaggcatcgagtaagaataagattcgacaggtgagatctcgaaacagtaagaatatcccatcaagtatacctcttcgccgttctactaggaaggccaaatcgttgtatatgcatagtcaattgaatgggggacataaaaaaggaaagtcaagtaaaaagaatgtggggcggaaaaagggaaagcaaagtcaaaccaagaaggtgacccctcaaaagtccaaggaagctactgatcaatataagaagttgccagttactactgcacataagaagagaacaagaacctgcaacagttattggcttaatggtct

SEQ ID NO: 3474 - DNA, 514 bp, Glycine max
  misc_feature (503)..(508): n is a, c, g, or t
ctggtgctcctgtgtacctctctgcagtgctcgaatatctcgctgctgaggtttgttttgggtttccgattaggtttagatttgattagtcatcgtgttttttgtcaatctgttttttcttgttttaatttttgttttaagggtctgatttttaattgtgttctgattgacctaatttatttttgaatcaattgttgatgatgtgtgtttttttatttttttaggttttggaattggctgggaatgctgctagggataacaagaagaatcgtattgttcctaggcacattcagcttgctgtgaggaacgatgaggaactgagcaagcttttggggtctgttaccattgccaacggaggtgtcttgccgaacattcaccagactctgcttcccaagaaggctggaaaggggaagggcgaaattggatctgcctctcaagagttttagggtttttgttttacccatttggactatagttttgattttattgcgtttgtaacatannnnnngtttcg

SEQ ID NO: 3475 - DNA, 794 bp, Glycine max
ggttttccttttctaccagtcgaatgagggtgtcacacctcctagccagttcctgagtggtgcgagatttgacaaaccaatcaaatcgaaacaagggtgatgttcgaaatgctgcctttaactcatcccagttcccatagccaagtttgtgcaccatgcatatctgtaaatttatagcaatttttttagaaacccatagaaggatgatggagctagacctagaaaaaaaaattgtaccatgaatctgtcacattcttcgttgtacaacttccctttgttttgcccatactgtatcttcaactctagccacggattcttgtagcggtccaacttctttccaatagccttcatgatctcatctttccgagaaattcttgcctcccccctttcaatgtttttaataattctgtcataatctgcagacaatgattaaaaaatgcaccaattaggcagaaccttgaaacattctaaacagaaactaatttccagaaaaaattaaagcaacaaagccttatcccactaggtgaacatgaacacctacacacatgcatgataaaaagaatcaatacagaaatgtgctgtattttaacccaacacggcataagaatcaatacagaaatgtgctgtatcaatcactcaagttgctgattatatgaaccaagaaaaatgatttttgccgaaagagtactacaaactagcaaatatgaacactcatttggatttggctaagtattttgcttccacactcaaatatagtcacattggctgtaactgtaacataccatttaattcct

SEQ ID NO: 3476 - DNA, 631 bp, Glycine max
gcgttgtcaaactctctggctagtaaaaaggagggaaggtaagcagggttgaaacccaaccttacgttcaatgacattcaattcatttaattgtttaatcctagagttttacccatggttggtcaaatgatgagtgctatattaattttatctttgcatatgttgtgcctgaattgtctgcagattatctgtgacagtcccaagtgtgagcagtaatgcgcttggttatggtgcctttctcggaatttatgccaacctgagatatcaactgttatgtgggtttgatagagcaatgatgacccattttgatgttattggagttgccttgttcttcagcacaacattcaggtaataatttatatggttgaggaagaaagcattttggaagctgttttatgagtgcgtttattctgaatttgaattttgtgcaggatcttgaacgttcaattgggagagacttctaagcgtgcctggcttggagttgaggcagatcccctggctcagtcggatgacctcttgaaagtgtataacaggacttctgagaatgtagaaaagtcatcctcaaaatggtttatatcaaaaaatgcagttgtttctgggcttgggctcttgggcatcaaacaaaggaata

SEQ ID NO: 3477 - DNA, 596 bp, Glycine max
  misc_feature (531)..(532): n is a, c, g, or t
  misc_feature (585)..(587): n is a, c, g, or t
attgtatctgtcatattaccggtccatccccaagagcttggaacgctcaactgctcacaaactcatggtagcaatgttggatggagatgagcggtttattgagcctacaccaaaatcactggaaaatttaaccctgcaatctgttaaggatgcagtgatgaatcaattttttggtgataacatggaggtctgttatcattaatttgttaaattgatagtttttttaccatttcattcaaacactaattttttttttcatgttcttcaggtatgcattgtaggtgactttactgaggaggacattgaatcttgcattcttgattaccttggcacagctcaggccgcaagaaatcacgaaagagagaaagaattcaacccacccttatttcgaccatctccatctgatttgcagtttcaagaagtgagaagctaagcataaattacctttatgcataagttgttttgtgagaacttggcattataatttttagttgcatagtcaaatttgttttttctgtactttcagaattnnaggcaatacatcaatgaactaggcttgtgacatggtcatctacttttgccttnnngcaggtatt

SEQ ID NO: 3478 - DNA, 341 bp, Glycine max
ggggggtgcattcatcaaatggactattgaatatgaaagggttggtgaggaagttgatcttccatttggcttcatcgaatacctcaacaaagggagtagagatgttgatggtcatcttctcaaggcatagctccaaaagttatctagaaattaaataaaaaaaataaagaaataatgggctgggcttgaggataaagtgcttatatttactatcggtgtgatgtttgacgagaaggatgcttatgtgttgatcctttcttttgtgtggaataaacatggatatgtctgtccgtgatgtccttgaaatatgttaaattataccttaaagtgctcaatgtgaa

SEQ ID NO: 3479 - DNA, 412 bp, Glycine max
ttatgaaatctgtccatatctcaaatttggttacatgtcagcaaatggagctattgctgaagtcatgaaggaggaaagtgaagtccacattattgattttcagattaaccagggaattcagtgggtaagcctaatccaagctgttgctggcagacctggagcaccccccaagattagaataacaggttttgatgactccacttcagcttatgccagggaaggaggccttgaaattgttggagcaaggttatcaaggcttgcacaatcatataatgtaccctttgagttccatgctatacgagctgctcccactgaggttgaactcaaagatcttgcacttcaacctggtgaagctattgctgtgaactttgccatgatgttgcaccatgttccagatgaatgtgtggataga

SEQ ID NO: 3480 - DNA, 516 bp, Glycine max
gaagaaacgcgaatgccaggagaactccaattaccacccgggttcagattccaccccactgacgatgagcttgtgaatcactacttgtgtagaaagtgtgctgcacaaaccattgctgttcccatcatcaaagaaatcgatttgtacaagtttgatccatggcagcttccaggtacctttttttcttttctcactctagtctctgtattcttttgccttttttaatttcattagggtcttaattctactacattttttttctctccaccttaaagtcctattatttatgtttttatgtacagagatggctctttacggtgagaaagagtggtactttttctctcctcgagaccgaaaatacccaaacggttcgagaccgaaccgggctgccggaagcgggtactggaaggctaccggagctgacaaaccgatcggaaaaccgaaagcccttggaatcaagaaggccctcgtgttctacgcgggcaaagccccaaagggagtgaagaccaattggat

SEQ ID NO: 3481 - DNA, 310 bp, Glycine max
tattcaaaaatggttgggtgttgagccaatggttggcaagcattctaaaacatcaaaagtggcagatgctcagcctatggttctatgaacttgttattttcgttcctcattgaccaaaagagaatattattccatgcttttctttttcttctttttttaagagaaaaagaaaacaagcttagaaagaccttagataacattgcttgtgcaataaacaatttggcgtatgttcaggtaatctaaattacctgggtgtaatgtaatttcattatgctccaatattatagactttttcattgggccgtgtact

SEQ ID NO: 3482 - DNA, 356 bp, Glycine max
ctgtctttccactcattaccatgtccttgagcttgggttcacaagctacaaaaaacaaattatacattccagtctttgtgataaaaactttctgagaatctagacttgcagttttggatctgcctttgaattgtacatctaaaatgactggccaattaatgtctgttgcagaaggtctcctaataatctctccttgcttacaaactcccatcttggctaaatcaggagtgcaacagattgcccgttgtccaccataagcagaaccacctatatcattacgatcagcagcctcaaaaattatgatgtgtactggcacagaaccgcgtgccttggctgaagctttggttctccggaag

SEQ ID NO: 3483 - DNA, 168 bp, Glycine max
tcctcggcggccgctggagagaatatcacggcagcaacgactggaaagggatgttggatcctctcgacgagaatctccggcgagaggtcgttcgctacggcgaattcgtccaagccgcgtatcaagccttccattcagaccccgccatgtcaacggaggagccgccac

SEQ ID NO: 3484 - DNA, 861 bp, Glycine max
  misc_feature (810)..(814): n is a, c, g, or t
tatataagttctcttatttattattggattgttggttttagggcctccccttttactcccatcacataaatttagacgtataatttcttgaagggatatagattctatgggtgaaatgaatcaaagccttcacccttcacgacatatcaaattgaacttatgtaaggctacagagtactgagtacaacaatatattatatttataggaatgacaatcttacatagttcaagtcaatatttttggactttggttgcctcttagatggttttctgtttgcatagaggataccatttttactttctgttgagagggatttgttttggggggcaggggtgtgaggtggtgggggatgatggataatatatcaatcactttcagttcaattttctaattatggttgatggataatatatcatcttgttcttttatcccatccatttcttttttccttttaaagcttcatgtatttttctctgttaatctcaaatgttcttgtttgtttttatatatgcagacatgcttgcttttggtgatatttgggatcgtgcttctaatcgtcatcattgttcttgctgcttagtcaaaaactctcgattctattatgaatcaaatgctctatatactaagctgcagataagatctccctcgctgatgactacagagtggtgatttaccagatctcacatatgactggaatttgtctcatcaggtttcagtacatggcgtgggaatattaacattagtgtctcgttatttcgttgtgggtatatgttctacttggggctttaaggatgtatcacaacctgccnnnnngtaagttatctttttggttccttaataaaagatatatattaaattgt

SEQ ID NO: 3485 - DNA, 1323 bp, Glycine max
  misc_feature (381)..(387): n is a, c, g, or t
  misc_feature (389)..(397): n is a, c, g, or t
  misc_feature (400)..(402): n is a, c, g, or t
  misc_feature (408)..(408): n is a, c, g, or t
  misc_feature (410)..(434): n is a, c, g, or t
  misc_feature (438)..(443): n is a, c, g, or t
  misc_feature (446)..(450): n is a, c, g, or t
  misc_feature (454)..(467): n is a, c, g, or t
  misc_feature (469)..(472): n is a, c, g, or t
  misc_feature (474)..(474): n is a, c, g, or t
  misc_feature (480)..(482): n is a, c, g, or t
  misc_feature (484)..(489): n is a, c, g, or t
  misc_feature (491)..(494): n is a, c, g, or t
  misc_feature (496)..(499): n is a, c, g, or t
  misc_feature (505)..(510): n is a, c, g, or t
  misc_feature (512)..(519): n is a, c, g, or t
  misc_feature (521)..(522): n is a, c, g, or t
  misc_feature (524)..(524): n is a, c, g, or t
  misc_feature (526)..(532): n is a, c, g, or t
  misc_feature (540)..(546): n is a, c, g, or t
  misc_feature (548)..(550): n is a, c, g, or t
  misc_feature (555)..(562): n is a, c, g, or t
  misc_feature (568)..(596): n is a, c, g, or t
  misc_feature (598)..(602): n is a, c, g, or t
  misc_feature (607)..(611): n is a, c, g, or t
  misc_feature (615)..(619): n is a, c, g, or t
  misc_feature (621)..(638): n is a, c, g, or t
  misc_feature (642)..(657): n is a, c, g, or t
  misc_feature (659)..(668): n is a, c, g, or t
  misc_feature (673)..(683): n is a, c, g, or t
  misc_feature (687)..(693): n is a, c, g, or t
  misc_feature (695)..(696): n is a, c, g, or t
  misc_feature (698)..(704): n is a, c, g, or t
  misc_feature (706)..(713): n is a, c, g, or t
  misc_feature (715)..(721): n is a, c, g, or t
  misc_feature (723)..(735): n is a, c, g, or t
  misc_feature (737)..(737): n is a, c, g, or t
  misc_feature (740)..(741): n is a, c, g, or t
  misc_feature (743)..(750): n is a, c, g, or t
  misc_feature (755)..(759): n is a, c, g, or t
  misc_feature (763)..(767): n is a, c, g, or t
  misc_feature (770)..(776): n is a, c, g, or t
  misc_feature (778)..(779): n is a, c, g, or t
  misc_feature (784)..(786): n is a, c, g, or t
  misc_feature (792)..(802): n is a, c, g, or t
  misc_feature (804)..(805): n is a, c, g, or t
  misc_feature (811)..(824): n is a, c, g, or t
  misc_feature (826)..(836): n is a, c, g, or t
  misc_feature (838)..(842): n is a, c, g, or t
  misc_feature (845)..(851): n is a, c, g, or t
  misc_feature (857)..(858): n is a, c, g, or t
  misc_feature (864)..(880): n is a, c, g, or t
  misc_feature (882)..(888): n is a, c, g, or t
  misc_feature (897)..(907): n is a, c, g, or t
  misc_feature (909)..(911): n is a, c, g, or t
  misc_feature (913)..(918): n is a, c, g, or t
  misc_feature (928)..(936): n is a, c, g, or t
  misc_feature (938)..(943): n is a, c, g, or t
  misc_feature (945)..(955): n is a, c, g, or t
  misc_feature (958)..(959): n is a, c, g, or t
  misc_feature (962)..(962): n is a, c, g, or t
  misc_feature (964)..(966): n is a, c, g, or t
  misc_feature (971)..(976): n is a, c, g, or t
  misc_feature (983)..(985): n is a, c, g, or t
  misc_feature (987)..(987): n is a, c, g, or t
  misc_feature (989)..(994): n is a, c, g, or t
  misc_feature (997)..(1000): n is a, c, g, or t
  misc_feature (1002)..(1002): n is a, c, g, or t
  misc_feature (1004)..(1013): n is a, c, g, or t
  misc_feature (1017)..(1022): n is a, c, g, or t
  misc_feature (1024)..(1026): n is a, c, g, or t
  misc_feature (1028)..(1030): n is a, c, g, or t
  misc_feature (1037)..(1053): n is a, c, g, or t
  misc_feature (1055)..(1062): n is a, c, g, or t
  misc_feature (1064)..(1064): n is a, c, g, or t
  misc_feature (1066)..(1066): n is a, c, g, or t
  misc_feature (1070)..(1073): n is a, c, g, or t
  misc_feature (1075)..(1079): n is a, c, g, or t
  misc_feature (1085)..(1099): n is a, c, g, or t
  misc_feature (1103)..(1103): n is a, c, g, or t
  misc_feature (1107)..(1116): n is a, c, g, or t
  misc_feature (1124)..(1125): n is a, c, g, or t
  misc_feature (1129)..(1136): n is a, c, g, or t
  misc_feature (1138)..(1140): n is a, c, g, or t
  misc_feature (1152)..(1152): n is a, c, g, or t
  misc_feature (1155)..(1155): n is a, c, g, or t
  misc_feature (1160)..(1161): n is a, c, g, or t
  misc_feature (1164)..(1166): n is a, c, g, or t
  misc_feature (1173)..(1218): n is a, c, g, or t
  misc_feature (1220)..(1220): n is a, c, g, or t
  misc_feature (1225)..(1225): n is a, c, g, or t
  misc_feature (1227)..(1234): n is a, c, g, or t
  misc_feature (1238)..(1242): n is a, c, g, or t
  misc_feature (1249)..(1256): n is a, c, g, or t
  misc_feature (1258)..(1260): n is a, c, g, or t
  misc_feature (1264)..(1268): n is a, c, g, or t
  misc_feature (1278)..(1280): n is a, c, g, or t
  misc_feature (1285)..(1290): n is a, c, g, or t
  misc_feature (1293)..(1311): n is a, c, g, or t
  misc_feature (1313)..(1313): n is a, c, g, or t
  misc_feature (1318)..(1318): n is a, c, g, or t
gaggtgttaacttgcattaagtttaattttaaaattgtttttggatcttttgtgtctgatatgtaaagtgtcctttgcatgcctgatctgggggaacttttttgctttgttgtgaagtgttttattgtattttgtactggatatcacctttcaattcgagtcgtatcttgtaaggccaatgttctctagtgtcagagtaatgtcaatgacattagactcatgatgttgtataaggtccatgactggaaatttttctttctgtatgatttgcacagtacaatccatagttctaaattgcggtcgtggctgctatgatgcagattgcagcatgaaattattatatgattgcaccgaatgcaaaacgtcccatcaaagacatannnnnnncnnnnnnnnncannnttccanannnnnnnnnnnnnnnnnnnnnnnnnactnnnnnnacnnnnnaatnnnnnnnnnnnnnnannnnantttacnnnannnnnntnnnntnnnncttttnnnnnnannnnnnnncnncntnnnnnnnccccaatnnnnnnncnnntcaannnnnnnntatttnnnnnnnnnnnnnnnnnnnnnnnnnnnnntnnnnncatcnnnnncaannnnncnnnnnnnnnnnnnnnnnncacnnnnnnnnnnnnnnnncnnnnnnnnnnaatannnnnnnnnnnaatnnnnnnntnncnnnnnnntnnnnnnnncnnnnnnncnnnnnnnnnnnnnantcnntnnnnnnnnattcnnnnntctnnnnnttnnnnnnncnntttcnnnctaacnnnnnnnnnnncnncacccnnnnnnnnnnnnnncnnnnnnnnnnntnnnnnccnnnnnnncactcnncactcnnnnnnnnnnnnnnnnntnnnnnnntaattctcnnnnnnnnnnncnnncnnnnnnaccccctccnnnnnnnnncnnnnnncnnnnnnnnnnnctnncanannnctctnnnnnncttcacnnnantnnnnnnccnnnncncnnnnnnnnnntacnnnnnntnnnannntcttacnnnnnnnnnnnnnnnnnannnnnnnntntncacnnnnannnnnttttannnnnnnnnnnnnnnattntcannnnnnnnnntctttacnntctnnnnnnnntnnnatctctctttcnctnccccnnttnnnctccttnnnnnnnnnnnnnnnnnnnnnnnnnnnnnnnnnnnnnnnnnnnnnncntcacncnnnnnnnntttnnnnncctattnnnnnnnntnnncctnnnnnttccattttnnntaccnnnnnnttnnnnnnnnnnnnnnnnnnnanacttnctaat

SEQ ID NO: 3486 - DNA, 1003 bp, Glycine max
  misc_feature (994)..(1000): n is a, c, g, or t
gaagtaagggtggaaattttctgcatatcttctgcaattaaatttgtctttgttcaattttgaaatttattttttacaaattttgtgtaggcggcttcccatcctcatattgaagtaatggtggaaggaattatattaacctcaccagctttacgtgtgaagccagctcatcctattgttggtgtaagttttgcatttgttagttgtgcataatgtttgaaattaatgtgtttctgatttgttactacagtcctagccatgctcggtacacttgtacttatatcttaagcttgccgtaaaaacaacctccgtttccaattgttatgtcaattctctgtaatatacaaagttatcattggttcatttgatgttggtgaattggaagcagaataaacacaactacagatgttattttactttgtaattatatatactagattttcaagacattcaggctttcaatgcttccatttcctctgcacctactccatcgatttcacaacagtgtcagcagaaatgatgctaagcccggctcgtatttcctttccttatgatcttttgccccaacaatccattctcatactgagactcatacctctctcctttatattttatcaaccatggttttcaaaactacagatcaagagagtatattagcaatagctattattttctcaagattttaatgcctcattgcattatgtttgtaattatagacccttctttgagtgtgtttgatgctttttgtctctattcatgtgttgatgcaggctgtagctccaattttttctctggtagctcctaggttccaattcaaaggagcaaacaaaaggggcattccagtttcgagggatccagcggctttgttggcgaagtactctgatcctttggtctacacaggacctataagggtacgaactggccacgaaatattgcggatatcctcgtacttaatgcgaaacttcaactctgtgactgtgccattcttgtcctnnnnnnnccg

SEQ ID NO: 3487 - DNA, 352 bp, Glycine max
tggtgggaacttcctctcatggaatgagaggtttaatgtgattctcggaacagcgaaggccttggcacacttgcaccattccaacattattcactataacattaagtcaaccaatgtccttcttgatagttacggtgaaccaaaagtaggggactttggcctagcaagactgttgccaatgcttgatcgatacgttttgagcagcaaaattcagagcgcactcggctacatggcgccagagtttgcctgcaagacggtgaaaatcaccgagaaatgcgatgtatatgggtttggtgtcttggtcttggagatcgtcacagggaagaggccagtcgaatacatggaggatgat

SEQ ID NO: 3488 - DNA, 1001 bp, Glycine max
  misc_feature (56)..(60): n is a, c, g, or t
  misc_feature (943)..(948): n is a, c, g, or t
attcgacgccaagcctaataaacctgcaggtaacttcaatttccgattcgatcccnnnnnaacgaaccgttttctttgccttcatcgattaacgttaatcaatcgtcgtatgaaaaatttgatgagtaggtcatgaatctggcgctccattggcttccatgaatatcaaagatctccgcgaaggtgctggatacagcaatgtggatattttcacgtacgaagagcttaggctcgcgacgaagcactttcgtcccgatttcatcttgggagaaggaggcttcggagttgtatataaaggcgtcatagaccatagcgtgaggtcgggttacatgtccactgaagtcgccattaaggaacttaatcgcgaaggatttcaaggagatagagaatggctcgtacgtaactcttacttttccttacttctcttgtagcattcaactcgttttaatgcacagttaattgccattgaacattttaattaatgaggtcgtagcatatttaactgttagtaccataagtacatattgataattgtatgcacacattcatttattattagccactagttaggtaaagttgatcaccattatacatcttaataatctcacgaaactattaaacacgtgtaagacatattaaccattagtgttgcaagtacatattgataattatatagacacgttcatttactcttaactacctgtgagacaaagttaatcaccattagacatttcaaaaatcttgacattattaaccacttgtaagatatattaaaccaatcgtgccataggtacaaattgataattctatacaattacttctatttatttttaaccacttttgaaccatgtttgcatgtggttaagtttgatttggtgtttgaacaatgagaattgactgttagagtggaaaggagtttatgcaagtaaagactggacaggannnnnnttagccgcatggttttgtttactttgcaggcggaagttaactatttaggtcaa

SEQ ID NO: 3489 - DNA, 642 bp, Glycine max
  misc_feature (426)..(432): n is a, c, g, or t
  misc_feature (435)..(435): n is a, c, g, or t
  misc_feature (439)..(445): n is a, c, g, or t
  misc_feature (447)..(451): n is a, c, g, or t
  misc_feature (453)..(453): n is a, c, g, or t
  misc_feature (455)..(458): n is a, c, g, or t
  misc_feature (463)..(468): n is a, c, g, or t
  misc_feature (477)..(479): n is a, c, g, or t
  misc_feature (486)..(487): n is a, c, g, or t
  misc_feature (512)..(513): n is a, c, g, or t
  misc_feature (515)..(516): n is a, c, g, or t
  misc_feature (518)..(518): n is a, c, g, or t
  misc_feature (521)..(532): n is a, c, g, or t
  misc_feature (536)..(537): n is a, c, g, or t
  misc_feature (544)..(546): n is a, c, g, or t
  misc_feature (568)..(571): n is a, c, g, or t
  misc_feature (574)..(579): n is a, c, g, or t
  misc_feature (588)..(592): n is a, c, g, or t
  misc_feature (600)..(607): n is a, c, g, or t
  misc_feature (610)..(616): n is a, c, g, or t
  misc_feature (623)..(624): n is a, c, g, or t
  misc_feature (635)..(637): n is a, c, g, or t
ctatgtgatggaccctgcgaaagcagttgaaatggtagatgagaacaccatctgtgttgcagccattttgggatcaactatgactggagagtttgaggatgtgaagcttctcaatgaacttctcactgaaaagaacaaggagacaggttgggataccccaattcatgtagatgctgccagtggggggtttattgccccatttctatatcctgatttagagtgggacttccgtttgccgttggtgaaaagcatcaatgttagtggccacaagtatggtcttgtctaccctggtgttggttgggttgtatggaggagcaaagatgacttgccagatgaacttgtttttcacataaattatcttggatctgatcagcccactttcacattgaatttctccaaaaagagattaaagtctttacaaatgannnnnnngtnagannnnnnngnnnnngntnnnnccggnnnnnnccctattgnnnttgctgnngagtctaatgctggcggtgacaganntnntnaannnnnnnnnnnngatnnattgccnnntgcaaatgccggtgaaagaatnnnntannnnnntgcacacgnnnnntagaactnnnnnnnnatnnnnnnngtttatnntttgggcatgnnntaaaa

SEQ ID NO: 3490 - DNA, 368 bp, Glycine max
attcagtgagcaggagaatacaggaataaattttgatgcatatgaagacattccagtggagaccagtggtgacaatgtgcccccacctgtgaatacgtttgcagagattgatttgggtgaagcacttaatcagaacataagaaggtgcaaatatgtgaagccaacacctgttcagcggcatgctataccgatatctctagctggacgggatttgatggcttgtgcgcagactggttctggaaagacagctgcattctgcttcccgattatcagtggaatcatgaggggccaacctgtgcagaggccacctcgtggggtgcgtacagtgtatccgcttgcgcttgttctttctccaacgagggagttat

SEQ ID NO: 3491 - DNA, 1015 bp, Glycine max
ggttttggaggcatcaccatcaccatgagagcaaaattgtttgtgttcccaatacgaggcaggaactgttgcttctccagaaccatcgatcactctctctccgcttcccatgcttcctctcaatccccctcaaccctcaaagacttgtggaccaacatcaacgttggtgataaaccccttaacaccaaaactgagctctttgtcgattacatcgccaacaaggtgacatttttcttcttttctcgtgtctttctctttatgggcatctcgtttttactctttggctgttgtgggtcgtagatgaataatgcttggattggcttggagaaggcgccggaggggtctttcaagaacaagattcatgggttagttttgttttgttgtttagtggtgaagttgtttattactgtaatgttcttgatttcgagtttttttttttgcaggttggggttgcggctcttgtcgcgggttaagccctctgagatatttttgaagtctatatcgaaggaaatcactagtgttgaaatcatttatccatcaaggttggtgctggactctttgtttacatggcttgtcaaagggtgctgtttgtttgaagttttacttttattttactaccattgaatgaaatgtgtcctctctctttttgttgatctttttgttgtttgtttgtggttactagatttaaccgatcaagttgccattgttcaactcttgcactttcttgatattcaatgacgataatggagcagtgtgaatgagagattaaattatgtcttctttgcatctagaggcttttccgggtggttttatcttggattttcattttaaatatcatagttatccttgtttgagagaacctattttcttttctgtacttatatatagattttgttgttatgttctctacagaatcatctcatttttgaacatttatggggaacatgatgttaagaagaaaatttagcactatggatagttttgcttttcttttttcaaccttgtatagcaataa

SEQ ID NO: 3492 - DNA, 649 bp, Glycine max
agattctccccttttctggattgtctgagggtacaagatatgatggagaccatggaaaatcaaatctaccacttgctcttattaagcataatgtttcaggccctacttcagttacaaataggaaatctgtgtcgaattcatttcaagctcaccagattatttctttgaatccactacctatgaaaaagcatggttgtgacagagctccaatacgagcttgctctgaggtgatttacacattttctattgttgacctttgccacttccattgatttcatgccctgtttgaccctaacccagtgtcaaatattgtattatcaaattatcaatgcatttgatgtcaaatctaaatctaagtttttctttttgtttctccctgatacattttcttgcaggaggaattcttgagggatgtaatgcagtttttgatacttcgggggcataatcgtctaattccgcctggtggactttctgagttccctgatgccattttgaatgcaaaacgccttgacctgttcaacttgtatagggaggtaggagatttgtatacataaagctaaatgcatactgcatagtagtgtaaaaagtaaaatctgtatctaagacacttaagcatttcaggtggattcagagaggagggttacatgtt

SEQ ID NO: 3493 - DNA, 394 bp, Glycine max
acgtggtgtagtgactatgcgttgtgatatatcaacatgtagttctgctcatatatcacttttggtgtctggtagtgcagacacttgttttaatgatcaggcatgggtgaatttgctgccagtgtttgacattttacatatatgatcttttaaacttttttacttacctatcacttattttgggtatatcctcagcttttggagaatcatattaaaaaagagctgattgagaagagtcaacttgtccaggcatttcctaatcatcaacaaagtaaagcaccttcatccgagcctcgaagatcagcctcagtagcgtgtggatctagtgtgtttgaagtttgtatgcgagttcctgcatgggcttcacaggttaattgttgtttctcaaggtttc

SEQ ID NO: 3494 - DNA, 319 bp, Glycine max
ggttttggagaggagggtgagttggatggaggagttgaggtttgggcctgaaaggttaagttggaagatgtcgacttctttgagggagaattgaggctttgcagggtggaggatgagccatataacaagtattagtagtaggattgtgatgaaaaatgctgagaaagtgaagtagatcttcttgtagttcttgatttttagtccttctttgtcagcacagtgttttggagaggttattgttattttagacatttgtgtgtgagagaaagagggggggagagagagagttgaaagatgaaagaagggatgtttaccacca

SEQ ID NO: 3495 - DNA, 367 bp, Glycine max
acttctcatcctctttctattgaaagcttctcttatagttggttagtgaacctgaagccatcactagaaagcctagatggctccctcagaacttcccttgatgcttctgatgaaacttcttccttcattgaaatggatccaagaatgacaccttctaaaagattcttcagaaactcccaagatttcaaatttgacttcccaatctcgcagtcccctcgcactcttgttgatgctgatgagctcttctccaatggctacctcatgcccctttttgttgaatcattgaagatggaagcatttgaggcctctgatgtcattccaagcctaccttcctcttcacatgtgccaaagagtgtggttcctaata

SEQ ID NO: 3496 - DNA, 364 bp, Glycine max
aagagcacggaacttctgatccggaagctcccgttccagcgattggtccgcgagatcgcgcaggacttcaagaccgaccttcgatttcagagctccgccgtctccgccctccaggaagccgccgaggcctacttggttggtctcttcgaagacaccaatctctgcgctattcacgccaagcgtgtcactatcatgcccaaggatattcaactcgctaggcgtattaggggcgagcgcgcttaaatctaattattgattctctgtatagacgatttcaatttcaagcgttcttagttagaacttttgatttggttttcttgttgttgaggattctgtaatgctgctgtgatgttaacgctttata

SEQ ID NO: 3497 - DNA, 380 bp, Glycine max
  misc_feature (363)..(369): n is a, c, g, or t
tctctgtctccgcaagtaatgtttcatatcgtgttacagtgcttttctttggtggtggtgatgatcgtgaagcccttgcttatggagctcgtatggctgagcaccctggcatcagattgctggttattcgctttgtaggggaaccaatgaatgaaggagagattgtaagagttgatgtgggtgactccactggcaccaaattaatctcacaggacgaggaattcctcgatgaatttaaggcgaaaatagccaatgatgactccatcatctatgaagagaaagtagtaaaagatggtgcagaaacagttgctattatctgtgagttgaatagctgcaatctgtttcttgtgggttcaagatgannnnnnntatatataatt

SEQ ID NO: 3498 - DNA, 1005 bp, Glycine max
  misc_feature (60)..(60): n is a, c, g, or t
catggatccacaccggttcaacttctctcgaaaaaactgaactttcgtccaaaagcaccntgtcttccaataatggtaattcaccatgatgagtcataattactgtctttgttttgaaacacagtaaattagtttacatagctttgttttgtttaggttaatgcatgtactggaaaaatgggaaaggctgtgattaatgcggcggaagctgctggactgaatgttgttcctgtgtcgtttgggtgtgaagaggagtctggacagacttttcagattggtggaaaggagtttctagtgcatggtccttctgacagggagagtgttcttgcatctgtgcttgataagtatccaaatttgattgttgtggattacacaatacccgatgcagtcaatggtatgtaatgaattttgaagcatactttattatatcattggattgaagccacatcttaagcttttttttcatcttatttataatgcaaattatctttgaagatttagtctttaaccgagttgaatgatatgtgatccatgtaaccaacctcaccccactgggacaaggctttgtgttgttgttgttgtggtatttataatgtaaattatgaaatctcactagtggcaaaggaaaggaaaaatcttatgtttcaaattcatacactccagtatcttttatgcttttgttttctgatttatcttaaaatgaaactctatttttttattacacaagtctttacatattaaacataggaattgaggatattgtatatgactgcatagaatgtgtaggctgtacatggccttcttattgaccagtgtacattatgaatttgcaattccagacatgtgttttgattttcatgatagaaacaaaattggaatttttattttatgatctaggattgggagagttttatgcagattgtaatagcattggagatatttatgaatgcatgctcatatgcaggcaatgctgagttatacagtaaggttggggtgcccttcgtg

SEQ ID NO: 3499 - DNA, 369 bp, Glycine max
gagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatagcatgtgtcatctgtttaagcttaattgattttattatgaggatgatatgatataagatttatattcgtatatgtttggttttagaaatacaccagctccagcttgtaattgcttgaaacttccttgttgagagaatatagacattattgtggatggtgatgtggcatatgtggcata

SEQ ID NO: 3500 - DNA, 545 bp, Glycine max
gttagatgtcttctccgtgtttgatatataaaaccttgggcctctactaacactttagagaacataaccttatcaataaatttattgcagcttatgggtataaaccttcctatgaaaatctaaggaatttgtgattcctgcagggaggataagagaaatgctttaagagaaaaaaggagaaaaggtggcaaacaacagaagaacaaaaaatgatcaaagccagtggcaatacatgaggcagttatagcaccgactcgactcgactcgactcgaagatggaagtactggggtggttgcttgtcataggagtgcaccccggaatcagtggcatgccctaatctagggcacatttttgttttgtttttaaggttattatttagccgaggtatattttataacttccatctgcaaaggtgtaaatcagaaagaaaaaatatttctttttcgtggcatcaattatttggggtttattttcttatcattatcttcaatcttcatgtctattgtcttggatgttaattatccttctttccattacacgagct

SEQ ID NO: 3501 - DNA, 258 bp, Glycine max
tgtttttattgggaaagctgctaaattacttattcctttttctccttgtgtcatggtttgaccactgctctatttttatttttcataagcttctgaaccagtgggatgatatttttcactctttgcaatggaaaaatgaaattgataaagaggtaaaatgatgatgatgataacaataataacttctagttttctttcaaagttatgctatttttgttagatgatgtctataatggtttgataaataagatggaccgt

SEQ ID NO: 3502 - DNA, 659 bp, Glycine max
  misc_feature (615)..(615): n is a, c, g, or t
  misc_feature (629)..(630): n is a, c, g, or t
  misc_feature (649)..(651): n is a, c, g, or t
agaggagctcagcctaggaggatggctgtcatcatgttataatctacaaagaagaggattttgttgcccgtgtcaatgaaattacatctggcaatggagttgaagtagtctatgattctgtaggaaaggatacatttgaggtagtacttattctatgctattctacacccaaataaaatttcaaaattagataattggtaattgagtggaaaaataaaattattaggcttaaatagtattttagtccttaaaatatacaaccttggttttagtccctacaaaagcttcttattgattttaatccctaaaaaaaatagcattttttgcctttggtcctcgtttgtttttaaatttttaatccctatattatttggtccatgttgaattagttcttataatatgcttgttatattgactttagtccctaaaatatgacatcaattttattttgcaaggattaattcatcatggataatggaccaaatagtatatttatgggaactagaatcaaataacgagaaccaaaagcaaacactcttatttgtagggactaaaacagaaaatggtatacacaacggagaataaaaagctttttgagccaaaattaatattctntcatgaatggttgnntgatccattggaagtcggnnncttttttt

SEQ ID NO: 3503 - DNA, 674 bp, Glycine max
cctaggtagaaattcagttggcatttatcagtaaaaactaagatactctcatttttcaggaaagtatagcaacagaatttttgaataggattgtgaaatgggtcaaaaacatcaaaatttctgatcccttggaagaaggttgcagactaggccctattgttagtgaaggacaggtatattttctgtttctcatttctgtatatcttatgcatttacgtcctactctctttctaaagtaaagggcaggtatgctttggtatgttcaaatgcccttattcaatattcaaaatgagaatgtgattaatatgatatcatcattaattatgaattatgatcaagcttaatgtagtatggaataatgtataagcttccttagaagaattattggttggctggctatatatatattatgagaaggagtcagagaaggaaccttctcctggttgttgtatatgttcctatgatttagctttctctctgttcttataacttaaaacatcttattgatataagcatatttttcttgaacaaagattatctaatatttatattatatggttcagtatgaaaagatattgaagtttatctcaaatgctaagagtgagggtgcaaccattttgactggtgggtctcgcccagaggtatgattatacatttataatttctttgaaggt

SEQ ID NO: 3504 - DNA, 595 bp, Glycine max
  misc_feature (407)..(411): n is a, c, g, or t
  misc_feature (419)..(419): n is a, c, g, or t
acgcaaagagagctcataagaaatatgcatttgagtcttacatatgccaaagaatgttcagtggctttgagcaggaaaacttctctgtcaaattagacaatactactgcaactaaagagagcttcttccaccagtttctcgctttaagagagatggatcccttggatatgctggggcaaaatccagattccatttttgggaaattttgcaggagcaaatacctggtggtagttcatcccaagatggaggcatcgttctttggaaatttagatcagcgaaattatgtgatgggtggagggcatccaaggactcctttttaccaggcttttcttaaactgaccaagtcaatttggcttttacacaggttggcttattcttttgagccgaatgttaaggtatttcaggannnnnagataganatgcagtgagttcactggccgttgctggtgtggttgcattggtgggctcagctgggatgatctcagtacgttatttatttactttttaaatgcattatcttatcatcattaagtatgtatagaatactttgttgttaacattaatgattgtcactcataacaggcaattgataggc

SEQ ID NO: 3505 - DNA, 614 bp, Glycine max
  misc_feature (369)..(370): n is a, c, g, or t
  misc_feature (376)..(384): n is a, c, g, or t
  misc_feature (478)..(492): n is a, c, g, or t
  misc_feature (494)..(510): n is a, c, g, or t
  misc_feature (513)..(517): n is a, c, g, or t
  misc_feature (524)..(535): n is a, c, g, or t
  misc_feature (537)..(538): n is a, c, g, or t
  misc_feature (540)..(541): n is a, c, g, or t
  misc_feature (544)..(549): n is a, c, g, or t
  misc_feature (551)..(553): n is a, c, g, or t
  misc_feature (559)..(560): n is a, c, g, or t
  misc_feature (566)..(580): n is a, c, g, or t
  misc_feature (584)..(590): n is a, c, g, or t
  misc_feature (600)..(601): n is a, c, g, or t
  misc_feature (603)..(605): n is a, c, g, or t
  misc_feature (608)..(609): n is a, c, g, or t
gtgcgagtccgtgtttttgtgattctctttgccatggctctcgaccagctttcgaatccccccgccgttgacggtgccggtaacggcgcgacgccgtgctccgctgtggacggcggcatcgaggacgggaggccggctgcgaggctgccgcggtggacgcggcaggagattctggtgctgattcagggaaagagcgatgcggagagccggttcagaccgggccgtggaagcggttcggcgtttggttcgagcgaaccgaaatgggcgttggtgtcctcgtactgcaagaagcacggcgtgaaccgggaaccggttcagtgccggaagcgatggagcaacctcgccggcgattacaagaagatcaagganntgggannnnnnnnntcccttcaaatagattgcagactcaaagtcaggaggaggaagtaaagactcggccgagggtcgtcggccattaatattcattataggttctaannnnnnnnnnnnnnncnnnnnnnnnnnnnnnnnttnnnnnagaaagnnnnnnnnnnnncnngnntcnnnnnngnnnaaaccnngagaannnnnnnnnnnnnnntttnnnnnnnaaaaaaagcnngnnngannccccc

SEQ ID NO: 3506 - DNA, 456 bp, Glycine max
cggtgtcatagaccggcgtctgcgaccgatcacggccgcgccactcgtcgacgtcctcatcgaaatcgtcgtcctggcggcgaggctcgggagatggctcgcgatcggattgaatgtcgtcgtagtccatcaagggctctccgtcctcgtcacgatacctgaaacaaaaaatatagtgaatcgatgaaagcaataccctaacgagaaattagtcgcagagaaagagggaaacaaacgcacggattgtcttcgtagcccatggttggtgtgtgttggaaattggaaaaggtgtttgcgaatgaattggtagaaagtgaattagggtttgtgtttgaaagtgaagagagaaaaagaagaatataagaaagaggaaatgtttgaatggacgtacggaaaggggtgacagtttgagagggagggagggtttgtcgaaaacaaaggaggtcgggaagatac

SEQ ID NO: 3507 - DNA, 835 bp, Glycine max
ttttttctggatcattcatttgtatctacagcatcttgatgtaaactttgaaaaaaacaaacaaacgatgtcttaatgcaaagtaaaaaatatcatttgtttacttgataatttttaccttgattacttttattgctctatataagagacactagcttctgttgcattttgctaccaactccggcttgttcagtctttcttggaactttgttactctcacacatgtctcgctccgtgcctttggtttcaaccatttttgtcttgcttctgcttctggtggccactggtaggcctttctttcttgacgctaattaatatctacacttttgggtttcttttattgtgatcttagttagttaacaagctattagctactgttcttacaccttaatttcttcacgtacttgtgtgtaatattttatttttcttgatcaatatttcttgtatgtaatattttagtgtacgaggtttcctaattgtaccatcaagtgtttaatatatatatatatcctgacgctaccatgttaaggttcagttaaattgacttctctcttacatataatttttaatttccaagttacaaaatcgtgtagtgaagacttttttatgataaaaaaatgttgaatattacaaatttaaatgagaaatcttttaaaaaaaagttaagatgggtaaagtttattttaatttatattaaaaatttgtgcgatacctagcttcttcattattttacttttatctctttctgatgatttgttaaagaaaatcaaatttgtggtacatcaacttggtagtgtcaaattgttaataacttgtgttggtttatgactgcagc

SEQ ID NO: 3508 - DNA, 378 bp, Glycine max
tgatggcgacggattggtgagccttgaggaactgaatcgattgcttcagatgacgggcaattcccaatatagcatagaagagttggaatcacttgtggaaaagaaaagtcttggtttcagtgatttcttgttcttttacaactcaatatcggagcagaacaagggagagagcaaaggaagtgagttggagagcgacctggccaagacctttgaggtgtttgacttggacggagatggtttcatcacaagccaagaccttgagtctgtcttgaagaggcttggcttctgggatcaaacacatgccaaggattgcagaaccatgattcgtttctatgacaccaatttcgatggtcgccttgattttcaggaattcaagac

SEQ ID NO: 3509 - DNA, 434 bp, Glycine max
  misc_feature (395)..(425): n is a, c, g, or t
gcagccgcacgaaagttaacagaagcagcattttctcgtgggagtgcagataacattacatgcattgtggtgcgattccaccatgagaaagcagaagtagctaatcctgataaagcagaatcaactagtactcagcatgagtagatgatgtgaaagcacaaaatgcacgtgttggttatattcgcgtcaaattgaatgaattgaggtcagcacgtgcatgatggttcactctgcatggcacaaggcaatttatttattctttagttttcttatgtaagtcactcttgttcgtgtattgggatttttgaatcgtgttcttctctgataactgatttcagtgtgtccgtatatatttcaagttttcctgtttgtagaggcatcaagttggtaaaaannnnnnnnnnnnnnnnnnnnnnnnnnnnnnnggggggggg

SEQ ID NO: 3510 - DNA, 568 bp, Glycine max
  misc_feature (55)..(56): n is a, c, g, or t
agagttgttggatgcgctggctaaaatgttcagttcattcaccattgacaagtgnngatcccaaggcatgaaagacttcatgaacgagagcaaattgattgatcttctcaacggctctgattacgtaccaacctatgaagacaaagatgctgactggatgctcgttggtgacgtaccgtgggagtaagtctggaccattatttctctaagcacacaccacatccttaattattaggaccatttctcgattaaacattactaatttggatatataatttcacagaatgttcgtggaatcatgcaagcgcctgcgtataatgaaaggatctgaggcaatcgggctaggttagtgatcttaattaacaaaaaagctattatcttaattaattaattaattaatgtgcattgaccgtgaggttgttattttttatttacagcaccaagagcagtggaaaagtgcaagaacagaagctagagtcaaatttgtaaattccactttcgacaacaatctgctctatctgttgctcttgggcgtccacggaaagcattaatgctaatttctcgagca

SEQ ID NO: 3511 - DNA, 294 bp, Glycine max
cacaggagagaagcctgccattgcatgatttctttcatgtataaaaagaatgatgaaaacaaccctttgtttgtttgtctgttattctgttaatcagttgctcattgaagaacaccttcactagactttgggttggacttagttatagctagagagtattcacatcatgcgaagtaaatatttgaaatgccggctatggtttgttatctgctactgggtttgtatttagtagtagtccatcattgactgtatacgcatataataaagcagattggaatgttagaaagttctcca

SEQ ID NO: 3512 - DNA, 390 bp, Glycine max
aaattgcaggtgatgtaggggggcacccagatgaaaaatttaacccgaatgctctccctgttgtgaagggcatcacaattaagaatgtttggggagtgaaggttaaccaggcaggtttgatacatggattgagaaattcccccttcactgatgtttgtctgtctgatatcaattttcatggcatggaaggaccaagatctccctcttggaagtgttctgatgtgtttggatttgctcatcaggttagcccttggccatgttctcagctgagcagccaagagcctggatcatgtgctatttagatattttcactctcttcaagtattgtagtaattgagtgcttctttcattgatttcttatacttaaagccattgaatcaccactttaga

SEQ ID NO: 3513 - DNA, 918 bp, Glycine max
  misc_feature (863)..(869): n is a, c, g, or t
acaaaggttggatctaaaagaatgaactagtttctaataaagttgcgaactacagttcaaatcttcactgagagcactagcattcagtggattttaatgtttagattccctgactatgtgcagcttcatgaatgtcctacaagagttatagtgaatttggtaagagaggcattccgtctccttcggcccggtggcacactagctttgacagatttttcggtatacaataccatcattaagatttttcctattttcttttttggtttcatgctcctatcacaaatgctcatattaatatttctgccttctgcagctgaagtcaaaggtccttcaggtattgtgttatcctgttttctgctatattgtttcgtctaattaataaatttggctaaaatatgtttttagagtaaaaattggtattagtctaacttcgatcaattggcccttgaactttaggaaaacagtagttttcttctcgaatcacagatgattttcaccgtgaagagggacaaaaccccattgatttttttgtaaaattcagggaccaaaatgggtcaaaattgaagttcggggactaaaatcaagtttcattgaaagtacaaggaatgcaaacatgcaaacatattttatcctaaatatttccatgcctttttcatttgttgtgctaaacctgtggggattaacaagtattactacatgtacattgttgtcttgtaggaattgtctccggttctttttacattggttaagagcacggaaccctttctggatgagtactacttgactgatatggatgaaacacttagggaagctggttttgtgaacataacatcaattcttacggaccccagacacgtgacaannnnnnnaacagtgcctcaatgaaacatcacatcttcttgagatattttattgtca

SEQ ID NO: 3514 - DNA, 382 bp, Glycine max
ccttcttttacacattcttcaaagttcaagtctatggtatttgaatcaatttgcagttcatattgacattccataagtttgagacagatccaaccaatgtgataatctgtcttgagctccaaacaccttatatattctttttgaaaacttagatgatcacctttcatggcatacacacggcataatagtagatgcgcaaagaataaataatcatcaggaagcacaagttcagaagcctttttggcatgggtgatacaagtcatatgattcccacattgtaaactgatctcagaagcacaaagtagaagttggaagtatctatatcgatacaacatttctgtcctactatacaaatcatttgaaggagcagcatgagttagac

SEQ ID NO: 3515 - DNA, 378 bp, Glycine max
cactgtcaacgttggtggaaaaggaggcggaggcgtaaacgtgcatgcaggccacaagggaaagccagtgcatgtttcagttggctcaaagtctccatttgattacgtctacgccgccacggaaactcaattacacgatgaccccaacgtggcactcttcttcttggaaaaggacttgcattctggaacaaagttggacttgcacttcaccaggagtacatctaatcaagccacgttcttgtcacgccaagttgcggattcgatacccttttcatccaacaaggtggactttatattcaacaagttttctgtcaaacccgggtcagaggaggctcagatcatgaagaatactattagtgagtgtgaagagggtggaaa

SEQ ID NO: 3516 - DNA, 403 bp, Glycine max
acttttgatccgtttgagatgggggatcgaggagaagacgaggatttgcaaatggcgattcgaatgagcatgcagcgtgggacgccggagccgaagcgcagcaagccgcttgacgccgtcgccggggcggtttcggggtcgccagaggagtctccggagtacaagacccggcgacgggagctcatggcggcggcggccgagaagcgtatggcggcagcggcgagggtttcgccttctccgtcaccgtcgccatcaccggtgaaaaagggcggtgaattggggaggagtgaggaagattcgcgtttgaagagtgtgaatttgagtaaggagctttctgcggaagaagctaatcaattgtttggtatggtgtttgggaatgaagtttctaagggcattcttgcac

SEQ ID NO: 3517 - DNA, 511 bp, Glycine max
tttgtctggaaggccttgaaaacatcttgaaggtgggagaagctgataaaaacataggaaatactggtgatgtgaatctatatgcccaaatgattgatgaagctgagggattggagaaaattgagaacctccagagtcatgacaacacagagatttacgaaaaggcggtcaagattcttgagacatactggttggaggaggaagatgagactatgcctccaggggatgcttctcagtcagggttcaactttggtagcagtgacgctcctgctgtgccgtccggtggattcaactttaattagaagatattcatgctctactggggtaacattatatctttggctttgttctagcttctctgtaaaagtttaatggaattaatcaattatgttttggcagtctgcatatgttctatgtttccttcaattgttcaatgattattcagaatttcttcaattgcaggagttttggttggtctatctgtgaagtcctcctttatgacacgacagca

SEQ ID NO: 3518 - DNA, 390 bp, Glycine max
tgcccgattattgggttgatcgaggaaggttttaaggttgagcagaagagaacaaagcgccaagagtgtggcggttcgcacggttatgacaatgcggttttctccatgaggactattttcattggacatggtcctcgatttgctagagggaggaagataccgtcgtttgaaaatgttgagatttataatttgattacttctattctcaagataaagggagcacctaataatggctctgcctcatttgcagagtctgttcttctatctgctgcataagtgatactaagaccgagtttttattggtggacagcattgcagatgttgaactctagcgaacaaaatatttgatcgctaagctgtatgataggtaatgtgctctctaggagtgat

SEQ ID NO: 3519 - DNA, 389 bp, Glycine max
gcagcggcaccggtaagaaggcggagctccgaaagaacaaaaaatcaaagaaaggaacctccggatccgggtcgggcatgtacctgccgccggtgccgctgaaggaaccggtttccggcggcgtgaaggtggagctcgggttcagccagtacagcgagcgattgaacggtcgcattgcgattctaggtctggcggcgctggtgctggtggagctcgcgacggggaagggtgtcattaactaccacacgccggctattattctgattcagatatatttcgtggctgcggttggagctgtctttgttaagtatgagaaggagaagatcagcgtttggccccaaactgattcttcaactaacaaataaagaaatgactttcaactaccagtt

SEQ ID NO: 3520 - DNA, 426 bp, Glycine max
  misc_feature (254)..(254): n is a, c, g, or t
  misc_feature (360)..(360): n is a, c, g, or t
ccctaacatgaacatacgcctgtgtggcatttgcataggtcttagcagagccagtgaggtacttgaggatgtgaattgtactagcatttatggtgggttgcagtaatggtccaagaaccaaaactgggttcactacaaccatgtccacccctttctcttttgctgtgtcccatgctgcttgttcagccacagccttcccatagcaataccaattctgcaatcatcattacccaacacttataatgagttactcnaactatatatttggtaaaaaaaatataaattcttatatactcaactggaaccttgtggttcttgcaatattccacatcactccaacaggactcgtcaaccaccagntccatgctcctactgtggtccatatacacgggaccgatggatgaggcgaacaccacacttttaact

SEQ ID NO: 3521 - DNA, 394 bp, Glycine max
tgacctccttcagatctatacccttctctctctctctctcttctattttcaaattctacatcatgggcacggaggttctacggccacaagattgtttcacccaacgcatcggtgttccaccgcctggcttttcccggcgaagaacctatggtacccaccacaacaacaaaaacaataacgttaacaattatttcaggggtaaccggaagccgacaacccgacccgaacaaagaaaacgggttgtggacaaaaggcccagtttagatgattcgaggttttcgagtttggagatggagaaggtcacgattcttcggaggggggaatcgctcgattcgaagctgaaaacagaggctttgaagaaggaaggtgataatttggtcgtggttgggacaaa

SEQ ID NO: 3522 - DNA, 857 bp, Glycine max
ctacttttgtagttgccatttcaatgaaaccttattttctagtattgagaaataacaatggtagctatgtctgaaactagaaacagggtagctctagaaaatcataaatattaaatagtcactaatcaatagcagcaattcaattccattgttttaaattctctgaaatgaggtttgtttttgaatttttaacaacttgttctggaaacacaagacaaaatttcaccaaaggcatactatcagcttttgctctgcaggtatgtctttctactcgtctgttacgcatccactagaagcaggtgtcacatttttaatatactggatgcagaaaaacaatacatgattaaaaacacttgtacgaaaaaattaccaacaaaaaaatgtaaattatatttcattatataaaaggtgccgatgttgcccattttaatttagagttagaatacaaatacacttttggtcctctaattaaaaattaaaaaatcccaatatttttcagtttatacttaagtccttcatgttgtttcaatcacacccatgcttcgaaggttctttggattttttgtgaatttaattgtgtttgaccacagcaacaccaacttagaacttctaagaatctatattaaagtctaaaagaccaaggacaaatccacccataacatagagaactaaattgtaaaagttaaaaataggaggaccaaagaagtatggaagaaaatgtaacgagaactccataaaattattatgtatactttttttttcttcatgagtttcaagatatgtaccttgtacagagctcctcggttagctttgtatggaggagcagtccactttttcctgcgtgcttccatctcctc

SEQ ID NO: 3523 - DNA, 352 bp, Glycine max
ggtcagacattcccccgcatgtaattcaaaccttagctgaaagtgctaacctggctggtgtcaaggagtgtgtgggaaatgaccggatcaagcagtatacagatgatggaattgttgtgtggagtgggaatgatgatcaatgccatgatgctagatggggttatggggctactggtgtgatatctgttgtaagcaacctggttcctggtttaatgcgagaactcatgtttggcggcgtaaaccctacactaaattctaagcttttgcctctgattgactggcttttccacatgccaaaccccattggtttgaacactgctcttgctcaacttggagttgtcagacccgtttt

SEQ ID NO: 3524 - DNA, 373 bp, Glycine max
gcacaatgctgctgttaattgtccagaaagcaatggttatcgtagctgcttgccatctcaaaacggtggtggccctaaccaaaattgcggtgattacaccaggacttgctaagaaatatattaccagcaggtatttcaattctgatttcaaggttgtcatattattgagattgtcataatctgaagatgcgtgtaataattgttgctgtcggttcatacttgtgttgtggatgtattattgtgtatcacatgtagtcttggttattaaatgttgataagaatagtattccattcgagatggaaaagtttgtgagaaatatattaccagcaggtatttctggaattttgttttctacacagtgaaattccagct

SEQ ID NO: 3525 - DNA, 399 bp, Glycine max
catgtcattaacagggaataaaaagtttctcttacaatttcacttctggtcataacatgaggaactacaatgaagtaggggaaacaatgacaaatttcaaatggttgaaggtaagaacttcctgtacaagatgacaatcacaaagcatgaatagaatggggagcagaaaggaatgctaccagttctccttagcaatttttgacttttcaagtatgaactttccttccttgtacttctgggatgcttcgtaagctctttcatacttccaacccaacacttcacggcaatcaccacaataaacatcagcaacagtgtggaggccagtcaagagatgtctgtcttcttttggccctgtgacaatattcattgcatgagccctgtgacaatattcattgcatg

SEQ ID NO: 3526 - DNA, 309 bp, Glycine max
tgctggcagctcctgatcattgtgcaaccaaattaggccagccacacatttggtacctgataacactttagggtcaataatagtgcctgattccaaggagcaacaacaacaacaacaatctcaaaattctagcatcttctccaaggacacgcagaagctaacagcagcctttggacatatatagcaccaggctttgacacaatgaaatactattttagaagggctccaagggatttatttgtgttcttagtacaggtgtgtgaaacaacagattaattttgctcttgtatatagataaggtctgtaaaa

SEQ ID NO: 3527 - DNA, 739 bp, Glycine max
  misc_feature (54)..(56): n is a, c, g, or t
  misc_feature (345)..(345): n is a, c, g, or t
  misc_feature (352)..(352): n is a, c, g, or t
  misc_feature (360)..(360): n is a, c, g, or t
  misc_feature (364)..(364): n is a, c, g, or t
  misc_feature (367)..(367): n is a, c, g, or t
  misc_feature (370)..(370): n is a, c, g, or t
  misc_feature (372)..(372): n is a, c, g, or t
atattgcatacctttctagtttttataagagtggtaggactaagaactaggacnnntaatagaatgggatacttagcagcaatttagagagattaactcctccgtcctagagcgaaactcctaaatatttcatagcatgcaccagaatgcattattacgtagccttacatcttagcaatgttttactttttttttccctcgtagttcactacttcattttccatgttaaatgaatggttgcagatggttctaccccttccatgaagagctagcaaaccaaaaaacataattttgttccaatttgatatgcactttattatgcctgctcatctctattttttcaanactctanatcaacanttgntgnaangnaaaccttaatttcgtctaccattttcagataaaatgcatccaaagaagtgcacagtgttccctttccacccgtgggatccgaaagataatagaagacatggaattgtattatggattccacactctatcgaagagctaatcaaatcagcagcagaacaaatagaaatttctggcggttcttgtattttatcagaagatgctggtaaaattactgatgtggacatgatcaaggatggtcagaagctgtatttagtccatgaaacacattaggcctccatattatggctctttacaaccatataattaagtgccttgtaatgtgttgtgctttctacaaattagcacgtgatttgatcttgttaaccgt

SEQ ID NO: 3528 - DNA, 364 bp, Glycine max
tgacgccaaggggtgttcacctctgaccaggacttgctcaatgataagaggactaaggggttggtcaatgcatttgcgttgaaccaaacgttgttctttgagaagtttgtggatgctactataaagttgagtcaattggatgtgctcactggaaatcaaggtgaaattcgtggcaagtgcaatgtggtgaatgctaggaagtctttgttgacgtctgtggtggaagaggtggtgcaattggttgatcagttttgaatggagcaaaagtttgtaagttatgtgtagttcttcttgtgtggtgttgtttaattgctaaggatatgggtgtgttctattttggggattgttgtttcctgtttgacaa

SEQ ID NO: 3529 - DNA, 842 bp, Glycine max
gtgggcatgatggtcgagtcctttggctccataggatcccttgcaattaagatttgcgtcatcataaccaatttaggggttcttatcatctatttcattattcttggtacgtaagttcatctcaccttcaattccttctttgtaattaagttaagtttacttgcaactcaatttttacttatttggtaggatttatttttgtatataaatttagatggtccgaaaatgtttttcttttactaggaaattcagggagcagttgaaggaatggtggcatcaaaagtaattaggaaattcaaggaaaggttgatttcatgaactatatagatatttcgaaagtcataatgtttgtacctttatggacttacattttctaactattccctgtctatgacatatataaatttgactgggttcattggctttgttttggaaggagacgtgctctgtggaaatgagtcgaacgatatcgcacacttgggtattctacaagattggtttggcatcaactggttgacctctcgtgcttttgctcttctttttgttgcactcttcataatggttccacttgttatgttacgtcgtgttggtcaatattactactatacccaaatgcacaagcaatttttgttttcttggcaaattaaacgtaacccttcttcatcttaggaacaattggctaattaagcacaatttatatattgtttccaatgttttatatgtacatattcactgaggtatagttctgcaatatcaatcctactagcattggtgtttgttgtaatatgctcatcaatggcgattagtgcattgttgtctggaaaaagtcagacaccgagaat

SEQ ID NO: 3530 - DNA, 930 bp, Glycine max
  misc_feature (878)..(878): n is a, c, g, or t
  misc_feature (911)..(913): n is a, c, g, or t
ggggtgagacggctgatacatccaatgttcagcaaacaatatggcctcgagctgctgcagctgcaggtaggcatatcttgctgatgctaagttgttcaacattcttatagggtacttaaagtgttattgctacagaattctccataactcttagatatgtcttcctacctgctagtggtaattctaaggaaaatgtatcaggcaatgagcaacctactcacttttcctcgtggcctgtgggatagctagcacataggacttaagctgtcatttcctgatactataactgattttgttgcagaaagtaggtagtagaaatttcagtgtccctcttctataaaatgaaaaataggtcctctctttatatataaaaaaggacaactatctaaaaggtaaaatacacaagccatatgaagggctcgtttatggtctctgatgcttgtttcttgatttataccttttcccttgaggatccacaatagatatagccggtgtacatttataaatccatcattcgtttttcttccctttatcaaatttcctttgattatagcatatattttttggggaagggggaagaaggggtgtgattgaaaattgcagactgctgatttcgattatgcaaaattaattactccttgtgtcctacagaacgcttatggagtcagagagattctacctcacaaaatattaccttaatagcattgccccggttgcaaaacttcagatgtctattgaatagacgaggggttccagctgctcctgtcacaaattattatgctagaagggcacctgttggtccagggtcatgttatgaacaataatccttaatgatttatatgttcatgtgtaacctggtatgcaagtaattgatgttncatctactttacctggttgatgagcatagaatnnnttatttgagctcaactc

SEQ ID NO: 3531 - DNA, 404 bp, Glycine max
ttttgacaagaatggtaaatatactcctaagagtggacaatcattgtacagtcagcaccaagagatgtgcagcattcttcagctttctgatgaagtcttggctcacaacattttgtcacgcttgacacccagggatgttgcatccattgggtctgtatgcaggagggtccgtcaattaacaaagaatgagcatgtcaggaagatggtatgtcaaaatgcatggggcaaagaagtgacgggcacattggaactgatgaccaagaagatgggatggggtcgcctgactcgggaacttaccactcttgaagctgtttgttggagaaaactgacagttggaggtgcagtggagccttcacgctgcaatttcagtgcttgtgctgcaggaaaccgacttgtattgtttg

SEQ ID NO: 3532 - DNA, 487 bp, Glycine max
  misc_feature (413)..(414): n is a, c, g, or t
  misc_feature (419)..(419): n is a, c, g, or t
  misc_feature (439)..(439): n is a, c, g, or t
tcatctctttgagaggttaattccttcaatttttgttctagaaaggcacctaaagcatcaactctcagaggcgaaggccttcggaaatacctcatactctcattatcactgcttgtctcttccctcttgccatggattcctatcttttgcttcaaggggggattaaatgacactacattgatcttattgtcattaaccttaataaatctttctccttgaccaacttgtttattttttacaatagaattgttcagggaggaagcattgaagtcccttattttgccacccattccaccagaatggagatttctctgttttgcatcaactgaataaacagaacccgcgccttccagttgtgtgacattagggatccttctttttctctctaatgtccttccatgagacaaggaaannattgnatgtgaaaaaaggattccanatgtcacacaactggaaggcgcggttctgtttattcagttgatgcaaa

SEQ ID NO: 3533 - DNA, 432 bp, Glycine max
ttagaaacccttgaacagattgcagagtgctaaaagggtcccatttgaatcatactcctactgcattcccataatctgcttgcgtactctaaattttgaacatctgtaaatacattccttatttttataaggttggtttttacaaggagaaatgctaggaacacactattttgaacacttcctctcttgttagttgaaatttattgaagatgacaaaattttgttggtcctacatgatgtttaatgatcttttctcttgattttgttgtttttaatggattttaaccaattagagataatgcatttgaaggagtgggatagaaagtgtgttcctagcagtcctctttgacaagatataatgtggcaatgcatttgaaggagtgtgatagaaagtgtgttcctagcactcctctttgacaagatataatgtgg

SEQ ID NO: 3534 - DNA, 661 bp, Glycine max
  misc_feature (386)..(390): n is a, c, g, or t
  misc_feature (394)..(396): n is a, c, g, or t
gtgttctttacatttgaaccaccagcagcagccgtctcttggaagccatcggtgcacgtgctctcatcggtcaaagcagcactcacccacgtttctacgtcactcattgtcatctcaaaattggagggtgttagttgagccatctcagaaatagaccttctgagctcatcaacagagtcagccaactcctccacacagtccttcatcgctgcaacctctcttggcttcaggccttgcctctttgccagcgtcgacatcattgccgaggtcgacttggcagacgcaagggtcacattcagggctgtgcctgtcagaaccacacggtttgtttggatcaagtctgcatgcttcactaaggagctgtagcagagtcttggataggtcgnnnnnccgnnnagtctgaagcttcttctgtaaacatttacagggagtctttggctctgcatttcaagttggtattatttgttggtgtttgcaccagacaggaccggtttttgtttccatgttcaagcccttaggaatactcatatcagtggttttaggtgttctcttcctcggggatgcattctatcttggaaggtgggttgtgtatcttttgtctgattgaacaattgagtttatttcatccaacatgaattcattgttatctttcaatgcagtc

SEQ ID NO: 3535 - DNA, 391 bp, Glycine max
aagaaagcatcccaggaaaagacgctaattcgaagctgaacaaagagaaatttcacaggaaactcatctttgattctgtgaatgagattcttggcgcaaaattcagctcctcccccgagccatggattcaacctaacagtaacagactcaccaagaaaaccttgagtgctcaaaagcttcttaaagaactatgctttgagattgaaaagattcaagccaagaagccagaatgctccttagaagaggaagatgatggtctgaaaaatattctgtgtgaagatgttttgcatggctcagaaagttggacagattttcatggttacttacctggggttgttttggatgttgagagactgatatttaaggacttggtagatgaggttgtgattgg

SEQ ID NO: 3536 - DNA, 518 bp, Glycine max
  misc_feature (490)..(492): n is a, c, g, or t
tctctctctctctaactctcttctaaaacttaccaacacaacaaaatcgagtttccaataaagagttttgttgaaatggaaaacgttccggcggtgtgtaaggaagatgatcagatggatttgcctcccggatttcgattccacccgacggatgaagagctcataagccattacctctacaagaaggtcattgacaccaagttctgcgccagggcaattggagaagtggacctcaacaagtccgagccttgggatttgccatgtaagtgaaaccaaaccaattcgatcaatctacctttcatgtattatattgattttccttgaaaagttaaaattgcaagtttgtgtttagggaaagccaaaatgggagaaaaagagtggtactttttctgtgtgagagacagaaaataccccactggcttgagaaccaacagggccacagaagctgggtactggaaggccacagggaaagacaaagatatatagagannnagagagagagagagagagagtggatg

SEQ ID NO: 3537 - DNA, 351 bp, Glycine max
ttcggttgggtgccccgtggatgggaaggaccccaaggatctgcagcaggaaatttctgatggagatgttgaggttcctcttcattgacgttagtgaaatttcagtgtttttttttatttgtttcgattatgttgtttttgttttcggcaattttggttttttttttacaaggataaaggaaattgagtcatagaaatagtatggtagttaagacttaagagtgctggttggtaaatgatataacattgttggaattttgagtaattttgtgatggagtggtgatttgtaggggttgccaaaccatttgtctaattttaaggttggatcgaaattttgttatttgccgaat

SEQ ID NO: 3538 - DNA, 624 bp, Glycine max
  misc_feature (551)..(553): n is a, c, g, or t
  misc_feature (581)..(583): n is a, c, g, or t
  misc_feature (596)..(596): n is a, c, g, or t
  misc_feature (598)..(602): n is a, c, g, or t
  misc_feature (612)..(614): n is a, c, g, or t
  misc_feature (616)..(617): n is a, c, g, or t
  misc_feature (619)..(621): n is a, c, g, or t
tctgcgtcatctgatggcattatacgagtctgggatgttcgaatggctgctagagagaagccactaactgaacataacacgcggtcaagactgacgtgccttgctggatcatctttgaaatgtaagttgaaaatactaaatagagaactgtaacatctgttctttatttacaatttcccatcaaagtgccctacactgcattttttgtctacatgatagtttgacttaatgtttttcactttagaaaaccaataaattatagatttttttttcaagtaacaaccttgtttattggttcctcacattctcacctaaatacttaaatgattcacaactaaattcacagaaaatcattttatcacagtagttcatgtaattaataattttgttaaaaaatgtgcatttccttactgtgcaccagaaattaaaattgctggcttgtgcttataacgaatattaagtatgaaaatatatctaatctaatgaggttaccttgagcctaagctatgaactttgctgttgtaatatataatcttaacatgtgcttttgnnngtcttcactaaaagggctggggacatcnnnagctttggggaanannnnnctgttagtannntnntnnnact

SEQ ID NO: 3539 - DNA, 373 bp, Glycine max
  misc_feature (365)..(366): n is a, c, g, or t
gccgaagctcaatgacaagagaaagctccttcaaataattgatcctagattggagaatcaatactcagtgagggcagcacaaaaagcatgtagcttggcttattactgtttgagtcaaaatcccaaagcaaggccactaatgagtgatgtggttgagacattggagcccttgcaaagttcaagtgttggtccaggtgaagtctcattatctggatcaaatagtgggagtgctgggccttttgctatgaacaaaatctctgactaccggatgcgccacaagttttcaaacaacgttggtcccggtgctacttgtcggtctccgaacccgaattgctcaccaggtggcccagcaacattacgggtcnnatgataa

SEQ ID NO: 3540 - DNA, 396 bp, Glycine max
agcattaagccaaaaatcgaacgttctgattcaaattccagcatcataactcaatcagaacctgacaattttaatttcagagaaatggacacaataacatcatcagcatgcactacttctagtagtgatttttcatcggtcacggttggtgacagcaaaaatatcaagagtgaagacacagagtctacggaaacaatgcctgtgattgatgagagcttttggtcagaagctgcaattgatgatgaaacccccaccatgtcatcatctcagtctttgacaatctcaaatgagatgcgacttcaatacccttttgctaactatgaggaaactttccagcagggtcatcatgcttatgattcaaactttgatgatggcatggatttctggtatgacata

SEQ ID NO: 3541 - DNA, 733 bp, Glycine max
  misc_feature (688)..(689): n is a, c, g, or t
tggggctcctcagtttcttctttgtctgcttcctgagaggaaaaattctgatctttatggttagttatctgataatttttgtcttttgttcactcttgttttcatgtaattgtttgagtccccttattgattaaaattaactgaacttggtaaggtccatggaagaagaagaatcttgctgagtttggaatcgtgactcagtgtatagctccgaccagggtcaatgaccaatatttgactaatgttctgttgaaaatcaatgctaaggtatgttgtttcttgggttagttttctattttttggaatataaattacaaatcttttttgtgcagatttccaggattcattattgtgcctttcattgaaatttttaatcttttgtagcttggtggcctgaactcaatactaggtgttgagcattctccttctattcctattgtttctagagcaccaaccattattattggcatggatgtgtctcatggttcgccagggcaaacagatattccttcaattgccgcggtaatttattagtgcttgttgtgtttttatatgttgggcatgtgtttcaaactcatgattgtcttagtttgagtatacttcctggttattggaaggaatgttttatgactatctgatagtgtatgctaatacgtaaatatgcaggtggtcagctcccgagaatggnnactaatatcaaagtatagggctagcgtccgtacccagtctccaa

SEQ ID NO: 3542 - DNA, 384 bp, Glycine max
ggccacttcagccagcacccttgtctaaagatccaaatcagttttcggagcaacacagatatttagcaaatgaggaatcccatggtagaatgaatagccagtggaaatcacagcattctcgtaggatgccaaaaaatatgcaggccaatagaccggcagagaaatcccatgggactgatgctgtgatgtgggcacctgttaaacctcagagcaagagtgagatcgtggatgaattgagtgagataagtaaaattgaggcagttaatcctctaaagagtgagcagcaggtgcataatttaaaaaataagagggcagaaatggagaggtatgttccgaaacctgttgcaaaagaaatggctcagcaaggaaacatacaacaggtag

SEQ ID NO: 3543 - DNA, 680 bp, Glycine max
gaagaattggtgcgcaagttcatccccgaaatgattggaaaggagattgagaaggcaacatctagcatctatcctctacagaatgtgttcattcgtaaagttaagatccttaaagctccaaagtttgatcttggaaaactgatggaggtatgtcctttttattgcaaattttcttatacctatgtttattatgtctaatgaatgttacagtgagttcttgatttttgtagctgaatagaaagggtcaatcaatgtggaatttattgagttgtactgtgatatgttgaccattgttcaattaatgaatcatttggaatataagcaattcttcaagaattttcttccattttttttgggtgcaagcacgcagtttaaaacctggttcagtggtgtggtatatgatactttggtttttgatccttgtaggttcatggggattactctgaagatgttggtgccaaggtggacagacctgccgatgaaacattggctgaggaagccactgaagtagttggggcttgatctggctcataatgcatttttgttattttagaattcctgtttctcttacaaatattaattttcagttttgttttaatatttagaaacacatttgttgcaaatctaaatctggatttttgttttgtcaaggttttttggtacaacccaataactaaaca

SEQ ID NO: 3544 - DNA, 407 bp, Glycine max
cctcaaaggggacgcttccaaggccaagaaggtgcttggttggaaacctaaagtggggtttgagcagcttgtgaagatgatggttgaccgggacattgagatggctaagaaagagaaggttcttgttgatgctggctacattgatgctcagcaacaaccttgaatctcatctgcaacttgaggaagagggggttttgctgttttgatcatataatgccgttgacatagtttagtttatgggcaatttatgttgttttcttgttgcaactgttatttcctagatgtgcatttgtcggatttcttcttcttgtaagcccgttgattcattcaattaaaagctatatacatctacgcccattttcttgtagaatctattaagttcttccagttgttctgtttcttccttg

SEQ ID NO: 3545 - DNA, 470 bp, Glycine max
tatgcatatagcttcttcgagaagcaaatcccagtggatgctgttttccaaaaagatgagatgatagatatcgttggagtgactaagggtaaaggttatgaaggtgtcgtaactcggtggggcgtcactcgccttcctcgaaagactcacaggggtctaaggaaggttgcttgtattggtgcctggcaccctgctcgtgtttctttcactgttgccagggccggtcagaatggatatcatcaccgcactgagctgaataaaaagatctacaaggttgccaaggcagatcatgagtcccattcagccatcactgaatttgacaggtacatttgtgttttttgtttctattttaggttatttatatcagagtgcagtatttgatcatcttgtttcctaatgacaggactgagaaggatattactcctatgggtgggttccctcattatggtgtggtgaaggatgattatatt

SEQ ID NO: 3546 - DNA, 372 bp, Glycine max
tctgatgcagtagatgacgaggaagctcccacaacaccattgaaacaagtttctgatgcagtagatgatgaggctggatgtgatgatggtcagatgattgatagcatggagcctgataattgtgaggaacaagctgcaaagaggaggcggcttatgcctctgcctctacggtgcagaagtggcggcattgggacagaatccgatttgtagataacttgatatagataaatatggcatcttcttttacctttggttttgaattatttctaggttttactttatcattatgtgaatagtgtcgttgcttggtagtagttaattctgcgaccaaaactgagaaatatctgcggactttaggtacaattcaaccgg

SEQ ID NO: 3547 - DNA, 390 bp, Glycine max
  misc_feature (367)..(370): n is a, c, g, or t
  misc_feature (374)..(375): n is a, c, g, or t
  misc_feature (379)..(380): n is a, c, g, or t
ttggggagcaaacgcagcgtttcggtgtcctcgaactcgcacaaacacacagcgcattccaaagcttcttttccgattttgtggatcttaacctcggagtattcgaggatagggaatgtttgaatcagagcggggtcaaggccacgcgcggccctcctggagcgtgcggtggtgagaggcctgacggtgttggaaggggaatcagcgcagtggcgcacgtagatggagaaaaaggccatgaggaaaaacgcgactactaatatgattatgattatggctatggaggagttgaactcgttgaggtttgcgtcggagaagtcattgggctgcgcgacggcgatggggattaacgctgacaccagaaggnnnnatannactnngaataggact

SEQ ID NO: 3548 - DNA, 184 bp, Glycine max
tcatttttttcgatcatatcggtgaaaatatttttttgccgagatgggctaatgttttcctggccgaataaatgggaaaatgccagtttcggccgaaacaaaaagtcggttgagctcgcacaaaaaaacctagccgacctacattttaaattttttatgcaacaccaaaacaagaaaacttcct

SEQ ID NO: 3549 - DNA, 544 bp, Glycine max
attgtgagcctcaaagaagaggcgcacttaaacacttgcttcaagcattttatactcttcacctgtgtaagtctcatattttcctttcatttatttatttttgtgtacgttggcttgtttctattcaaaactctctttaaaaatactaataatttaaatcagctaattgtctaacattgcagattttgtttgaaacttttgttatgcaggagttcgggctgattgacaaaaaggagcttgcgccccttcaagagcttatagaaaccattatcccatattaaatgaattgggacctaccttctgtgaaaaatctcatcctaggaagcagcataactaatgtattactactctaaatagaaactgctttttagtactatttgacttcagaaagccgccttgtatttattgtgtggatgtgcttgggaacaacaggatctaagttatccttctaaatagcttacacaaagcatcatatatatgcaatggggcatcataggttaaaaaaaagttaatttgtaatggttcatatatgccaaatgttatc

SEQ ID NO: 3550 - DNA, 1350 bp, Glycine max
  misc_feature (403)..(405): n is a, c, g, or t
  misc_feature (571)..(572): n is a, c, g, or t
  misc_feature (650)..(650): n is a, c, g, or t
  misc_feature (652)..(667): n is a, c, g, or t
  misc_feature (671)..(672): n is a, c, g, or t
  misc_feature (674)..(674): n is a, c, g, or t
  misc_feature (676)..(677): n is a, c, g, or t
  misc_feature (679)..(679): n is a, c, g, or t
  misc_feature (682)..(686): n is a, c, g, or t
  misc_feature (690)..(696): n is a, c, g, or t
  misc_feature (698)..(703): n is a, c, g, or t
  misc_feature (706)..(710): n is a, c, g, or t
  misc_feature (713)..(717): n is a, c, g, or t
  misc_feature (721)..(726): n is a, c, g, or t
  misc_feature (729)..(731): n is a, c, g, or t
  misc_feature (733)..(733): n is a, c, g, or t
  misc_feature (735)..(737): n is a, c, g, or t
  misc_feature (741)..(741): n is a, c, g, or t
  misc_feature (750)..(750): n is a, c, g, or t
  misc_feature (752)..(761): n is a, c, g, or t
  misc_feature (765)..(800): n is a, c, g, or t
  misc_feature (803)..(806): n is a, c, g, or t
  misc_feature (809)..(816): n is a, c, g, or t
  misc_feature (822)..(823): n is a, c, g, or t
  misc_feature (826)..(826): n is a, c, g, or t
  misc_feature (828)..(828): n is a, c, g, or t
  misc_feature (830)..(836): n is a, c, g, or t
  misc_feature (840)..(857): n is a, c, g, or t
  misc_feature (862)..(869): n is a, c, g, or t
  misc_feature (871)..(875): n is a, c, g, or t
  misc_feature (877)..(887): n is a, c, g, or t
  misc_feature (901)..(903): n is a, c, g, or t
  misc_feature (905)..(912): n is a, c, g, or t
  misc_feature (916)..(918): n is a, c, g, or t
  misc_feature (920)..(928): n is a, c, g, or t
  misc_feature (930)..(938): n is a, c, g, or t
  misc_feature (941)..(942): n is a, c, g, or t
  misc_feature (944)..(948): n is a, c, g, or t
  misc_feature (950)..(957): n is a, c, g, or t
  misc_feature (959)..(970): n is a, c, g, or t
  misc_feature (972)..(982): n is a, c, g, or t
  misc_feature (985)..(985): n is a, c, g, or t
  misc_feature (988)..(990): n is a, c, g, or t
  misc_feature (993)..(994): n is a, c, g, or t
  misc_feature (999)..(999): n is a, c, g, or t
  misc_feature (1001)..(1003): n is a, c, g, or t
  misc_feature (1007)..(1014): n is a, c, g, or t
  misc_feature (1018)..(1027): n is a, c, g, or t
  misc_feature (1042)..(1064): n is a, c, g, or t
  misc_feature (1067)..(1073): n is a, c, g, or t
  misc_feature (1075)..(1077): n is a, c, g, or t
  misc_feature (1082)..(1086): n is a, c, g, or t
  misc_feature (1088)..(1088): n is a, c, g, or t
  misc_feature (1096)..(1108): n is a, c, g, or t
  misc_feature (1111)..(1116): n is a, c, g, or t
  misc_feature (1118)..(1119): n is a, c, g, or t
  misc_feature (1121)..(1123): n is a, c, g, or t
  misc_feature (1129)..(1137): n is a, c, g, or t
  misc_feature (1142)..(1161): n is a, c, g, or t
  misc_feature (1166)..(1170): n is a, c, g, or t
  misc_feature (1175)..(1178): n is a, c, g, or t
  misc_feature (1180)..(1188): n is a, c, g, or t
  misc_feature (1192)..(1193): n is a, c, g, or t
  misc_feature (1195)..(1197): n is a, c, g, or t
  misc_feature (1203)..(1203): n is a, c, g, or t
  misc_feature (1205)..(1205): n is a, c, g, or t
  misc_feature (1209)..(1210): n is a, c, g, or t
  misc_feature (1212)..(1212): n is a, c, g, or t
  misc_feature (1216)..(1223): n is a, c, g, or t
  misc_feature (1228)..(1228): n is a, c, g, or t
  misc_feature (1230)..(1249): n is a, c, g, or t
  misc_feature (1251)..(1252): n is a, c, g, or t
  misc_feature (1257)..(1272): n is a, c, g, or t
  misc_feature (1275)..(1279): n is a, c, g, or t
  misc_feature (1283)..(1292): n is a, c, g, or t
  misc_feature (1296)..(1302): n is a, c, g, or t
  misc_feature (1307)..(1328): n is a, c, g, or t
  misc_feature (1331)..(1337): n is a, c, g, or t
  misc_feature (1339)..(1339): n is a, c, g, or t
  misc_feature (1343)..(1346): n is a, c, g, or t
actacttatctgatgaatctgtagccctgtttgcagaccgtcttcctaccagacctaactacattgttggacaaattgtgcatattgaacgccaaattgtgaagatgccgacgcctcggcctgagcacggtggggctgataaatttacccctgacaaggggactgactggttgaccttgaattcaggctcaactccaaacccttacggtctccctgttggctgtgaatatttcctagtgacagtagccatgttacctgataccaccattcattcatcctctccttcctgatcctgcttcatccctggcagattagacgtgatggaagaatttaattgtacataaactacattcaaaatccaaatgctcttttcttatggtcggttaaccatttgtacagctannngatgcaattcttgatatcgagagaaattacgacaagatcaaaataattctataaacattgatgttataatcaaaatcgtgatcgccaactgttttctaaaaccctaagtataatacatgtctttgtaagcaatgaaaagtgtatatagtttgaaatttttcttttnngtggaagaagattgcaagctaggatcagtggatgaaatagctgcagcggtgtaccaaattctggataggattcaacanannnnnnnnnnnnnnnnttanntnannantannnnnccannnnnnncnnnnnnggnnnnnctnnnnnactnnnnnngtnnngntnnntcancgccttttncnnnnnnnnnnctcnnnnnnnnnnnnnnnnnnnnnnnnnnnnnnnnnnnnaannnnttnnnnnnnntttttnnaancntnnnnnnnattnnnnnnnnnnnnnnnnnnatttnnnnnnnncnnnnncnnnnnnnnnnntatttttgtttatnnncnnnnnnnncttnnntnnnnnnnnncnnnnnnnnnccnntnnnnntnnnnnnnntnnnnnnnnnnnncnnnnnnnnnnnttnatnnntannttccncnnntccnnnnnnnntttnnnnnnnnnncttcctatcttcttnnnnnnnnnnnnnnnnnnnnnnnttnnnnnnntnnntctcnnnnnantgctcgtnnnnnnnnnnnnntcnnnnnntnntnnntgcccnnnnnnnnnctttnnnnnnnnnnnnnnnnnnnntatcnnnnnttttnnnntnnnnnnnnntttnncnnncacttncnctcnncnttcnnnnnnnnctccntnnnnnnnnnnnnnnnnnnnncnnatttnnnnnnnnnnnnnnnnccnnnnncatnnnnnnnnnnatcnnnnnnncattnnnnnnnnnnnnnnnnnnnnnnaannnnnnnanatcnnnnctcc

SEQ ID NO: 3551 - DNA, 748 bp, Glycine max
tgcatctgccatgccagctgatccagaggtccttgctaagatcctgctattgttaatgacctttacggaaacttaggttatgtcttctgtgttttgactcttgagagttttttggcttttttgcagatacttcctcaacagctactgaagaagtacattacatatgccaagttgaatatttttccaaggttacaagatgctgatatggataaactgtcacatgtctatgccgaactgcggagggaatcttcagtaataccctgtcataactttttttaccaaactagattgtagttattgtttgtattgaattcactaacaagctgctctaatttccttgtatagcacggacaaggagtccctattgctgtaaggcacattgaatcaatgataaggatgtctgaagcacatgcgagaatgcatctcaggcaacatgttacacaagaggatgtagacatggcaattcgtgttctacttgaatcattcatttcaactcaaaaatttggggtgcagaaggctcttcagaaggtatataaaatattctgaatttgccacaattctgttaaatgctgatattccatggcatcatattttgttacaaattatttttattttgaattttttttttgtatacatactaccattttgctattgtgattccctttaaaattagtggaattggtactggaaaaatatgccctcgggtccttttcctaaacagtgtgcttgctgttgcagagctttagaa

SEQ ID NO: 3552 - DNA, 836 bp, Glycine max
  misc_feature (774)..(774): n is a, c, g, or t
  misc_feature (819)..(821): n is a, c, g, or t
aattgtctgcctttgtaggacactattttcagcttcttcgtattgtgttggtgttaataacgctaaaatgaacgtaataattaacactcaaaaaaccacatgattggaacgtcggaaacattgaatttggaacacctcttacaatcttccctcattgctttcctaaaattcatggttgtacaaagtgggtcaaacttcaaagcatcaaaattaggaacatttaacacaatctaatttatgaaaaaaatccacattattggacttcaatcataatgaaactttaaaaacccacaacatttacacgaaatatatgcttacgaccctataaaaacaccaagttaatttcttcttaaaatgatacaatgaaaattttcaagtatttatcaacatggaaataaaaaactcaatccagttgaggtcaacatctaccaattctgagcacaataatagaaaggattataatggtgagaatcttataatgaagaaacgttaactttggttggtgtaggcatatacttgttagacaattctatccctaacttgtacgtgagatgttgtagagaaagaaaaatgaagcaaatactagaagagaaaatgaggcaaaagtaattcttttaggaattagataatggttgcattttttattgaagaaaagaaaaaggccacgaatgtcattctacaaagttatagatgtgaaaaagacgcaccttctattttcaaatttggacgcatcttagtgatgacttctgccgaatatatgcgaaggttcttcancgcccctgctccaaatacgtacatggggcacatcttggatgatcnnngtggtcttctcctcc

SEQ ID NO: 3553 - DNA, 782 bp, Glycine max
  misc_feature (772)..(776): n is a, c, g, or t
gtgcaattacaaagcagggcatgatgttgaataatatgaaaaccacaagaaaatcttccaagttgtttatgttttttataagacttgttttggaaataattttcaaaacttaatagattttggatcagaattttattattgaatagtattgatttgttttagaaaaatagctttttgtaactaaaatgtgagatgagaatcaaacaaactcttagtgtttttgtgtgtctagctaatctgactgccttgctcaccttagtgttttagctcacaaaaaattggactatagttcttgattgtctctgggtagctgtatttgaacatattgagaaaatgtagttatggtgattgagttggaaaattagcagattttgttagttcctcttcattctgtcttattgacccggtaagtcccatttatttctctagatatttagggaatcaactggtactgcttcagtagacgacacaagttatggagatcctgtacagaaggcagaagcaatggcttttcgtagagcttgtgcacgctttggactggggctccacctttatcatgaagatgcatcataattaaccagcagttctgcttctcagcttcaatgttttgatgatggccatcgttttcttttttgcctatagttatgatcatttgtgatcatattgcaacactagaagggaaatattttgttgtaacctgatggagacctactaagcttcaatcactgtatgcaaggtttgccatattttttatcctttgaacttctccagnnnnnctgcca

SEQ ID NO: 3554 - DNA, 639 bp, Glycine max
ctggtgtgatggttggtatgggccagaaagatgcatatgttggtgatgaagcacagtctaaacgtggtattctgactctcaagtatccgattgagcatggtattgttagcaactgggatgatatggaaaagatttggcatcataccttctataatgagcttcgtgtggccccagaagaacatccagttctgttgacggaggctcctcttaaccctaaggctaaccgtgagaagatgacccaaattatgtttgagacctttaatgcccctgctatgtatgttgctattcaggctgttctttcactgtatgccagtggccgtacgactggtaagatattcttgaacattatttggttttgttaggttcagattgtagtatgagcttatccgtacagtgagagtgtcatcagacagcatgcacctggtttacaatggaatgattctttattgtagaaaattgttttaaaactatcagtgtcgtcatcaaccaggaggtgctcctatattgtctgtttttttttctttctccatttcagttttccaatatgatgatgatctattttcctttttgcaggtattgtgttggattctggggatggtgtcagccacacagtgcctatctacgaaggttatgccctcc

SEQ ID NO: 3555 - DNA, 610 bp, Glycine max
taacaataaacccactgagtcagattaacatcatgcaaacaacttgactcttaatatttttcaatgctggcacatgaacaatatgatagatataccctggagagaaggacgtgtgcaccagcatatttgttgtcccagctgaagatatctggttgatcatcagctcccaaggacttcaccaaattatagtaggaaacagcatttgttgctctgaaaagccatgcagctccccacaacagctcatcctgaaaattaattaagcttattaagacaacacattatattttagtaaatagtcttatgcattgttattttcccctcaacactagaaaacacatagtagaaaatggattttaccttgaaaccggaatatgagcaataaaatgggcaaacagctgatccaagtgaatgactataagaaccttgatactgcaaagcaaagtggtagacctgttgggcagttcttaacaacttgttagagtatgttgggtcaagccttctgaaaacaatagatgcagcagcaagtgcagcagcggtttcagcagccacatcagagccagggttattgggagagacccaatagacagttctgacagtgtccatgtcctct

SEQ ID NO: 3556 - DNA, 825 bp, Glycine max
  misc_feature (781)..(783): n is a, c, g, or t
  misc_feature (813)..(813): n is a, c, g, or t
tcctggctccccgctattaccatttctaataactacatgacccatcatgataaggtcatgttgttgggtcacagcgattcttacacccaggacaaggacatgcaagtcactattgctttcaaccactttggtgaaggccttgttcaaaggatgccaaggtaaatcatcatttttgttttcgatcttaactcatattttataagttaaattaattagtaagtttcaaatcgttggttcaaatgatatcggttattggatttgattttgttatacaaaatttcatatttaagtcttagtaaataaaaatatgtggttggaaagaaacatccatttaaaagtgatgagtcatatttttcctcaaatattagtaatcaaccatactagtgaataattcacaccaagtctttaatgatactcttagttacttgttactttgtggggccagtaacattggttaagtttgagaaagaaaaaaattgtgtcatttttgcaggtgtaggcttgggtatttccatgtggtgaacaatgattatactcactgggaaatgtatgccattggtggaagtgccaatccaaccatcaactgccaaggcaacagatttgttgcacccgatgacagattcagcaaagaggtgagattattcataaaaaaaaaaattaattttgaaaatatcacaagtcatgctatgagattaagtgtaatcttactaaggtatgcaattaatcatcaaaattggtgaacaaataatgtttaggtgacaaaacgtgaagataccccaannngtgagtggcaggattggaattggaggtcanaaggggacttgt

SEQ ID NO: 3557 - DNA, 569 bp, Glycine max
  misc_feature (59)..(63): n is a, c, g, or t
agaaggatatcaagccttttgcctactacttatgtaaattacgattgcatcctagaagnnnnntcatttatcatggtttatttcctgttttccactacctgcttcttttgctctctagattgatatcctagaagaaagacaaaatagtttgttccttctgactctatgtttttaatcatctacttcaacccttttcattagcattatcattatcatttttgaaagagaatgcacacttataattcttaatctgttgttaaaggcggaggagatggctcagacattcagacagagaattgctcaagcagaagctatggctcgtgctgatatgcttagattccagccagaggtatttatttgttgattatttgttcaaaatttcaactcaataaaaatgaagaagcaacataggattaaaggtgactaaaatacaaatggcattaaaaaaagtcacttcttgctgctgctgacaaaatgcattacagattctgaaataacaagatttaaatgattttgatggaccttttttagtggatgacatacaaagatttatatgcatttcagttctg

SEQ ID NO: 3558 - DNA, 346 bp, Glycine max
gataacggcatgtttgagcgtacttgaaaaatttgagcggccatggacgaaaccgccgtaacgacgaagcctgattggctcaacaaccgcgcgaaggtcgccggtgagagaaccgaagaatttttctgtggcggcgacgacgaagaggaatgcgacgacgaggcttgggacatgttgactcggagcttctggcaggcgcagactgtgctggacgagaaccgtgcgctgatcgacgaagtgaacagcaaccacgaatcgaagattcctgacaacatggcgaagaacgttggcctcattactcagatccacggtaacatctccaaggttcgctctatttactccaaat

SEQ ID NO: 3559 - DNA, 1598 bp, Glycine max
  misc_feature (187)..(188): n is a, c, g, or t
  misc_feature (190)..(191): n is a, c, g, or t
  misc_feature (631)..(632): n is a, c, g, or t
  misc_feature (708)..(708): n is a, c, g, or t
  misc_feature (710)..(710): n is a, c, g, or t
  misc_feature (754)..(756): n is a, c, g, or t
  misc_feature (759)..(762): n is a, c, g, or t
  misc_feature (767)..(767): n is a, c, g, or t
  misc_feature (777)..(780): n is a, c, g, or t
  misc_feature (792)..(792): n is a, c, g, or t
  misc_feature (827)..(831): n is a, c, g, or t
  misc_feature (843)..(844): n is a, c, g, or t
  misc_feature (848)..(852): n is a, c, g, or t
  misc_feature (857)..(858): n is a, c, g, or t
  misc_feature (863)..(864): n is a, c, g, or t
  misc_feature (866)..(871): n is a, c, g, or t
  misc_feature (877)..(877): n is a, c, g, or t
  misc_feature (882)..(886): n is a, c, g, or t
  misc_feature (888)..(889): n is a, c, g, or t
  misc_feature (896)..(898): n is a, c, g, or t
  misc_feature (914)..(921): n is a, c, g, or t
  misc_feature (927)..(929): n is a, c, g, or t
  misc_feature (932)..(938): n is a, c, g, or t
  misc_feature (949)..(950): n is a, c, g, or t
  misc_feature (953)..(962): n is a, c, g, or t
  misc_feature (966)..(973): n is a, c, g, or t
  misc_feature (976)..(984): n is a, c, g, or t
  misc_feature (987)..(990): n is a, c, g, or t
  misc_feature (998)..(998): n is a, c, g, or t
  misc_feature (1011)..(1011): n is a, c, g, or t
  misc_feature (1013)..(1022): n is a, c, g, or t
  misc_feature (1025)..(1030): n is a, c, g, or t
  misc_feature (1033)..(1035): n is a, c, g, or t
  misc_feature (1037)..(1041): n is a, c, g, or t
  misc_feature (1047)..(1048): n is a, c, g, or t
  misc_feature (1075)..(1075): n is a, c, g, or t
  misc_feature (1077)..(1077): n is a, c, g, or t
  misc_feature (1079)..(1079): n is a, c, g, or t
  misc_feature (1082)..(1086): n is a, c, g, or t
  misc_feature (1088)..(1090): n is a, c, g, or t
  misc_feature (1101)..(1105): n is a, c, g, or t
  misc_feature (1108)..(1113): n is a, c, g, or t
  misc_feature (1126)..(1127): n is a, c, g, or t
  misc_feature (1131)..(1131): n is a, c, g, or t
  misc_feature (1139)..(1142): n is a, c, g, or t
  misc_feature (1151)..(1153): n is a, c, g, or t
  misc_feature (1161)..(1162): n is a, c, g, or t
  misc_feature (1164)..(1164): n is a, c, g, or t
  misc_feature (1203)..(1206): n is a, c, g, or t
  misc_feature (1209)..(1219): n is a, c, g, or t
  misc_feature (1223)..(1223): n is a, c, g, or t
  misc_feature (1225)..(1225): n is a, c, g, or t
  misc_feature (1229)..(1232): n is a, c, g, or t
  misc_feature (1234)..(1234): n is a, c, g, or t
  misc_feature (1243)..(1257): n is a, c, g, or t
  misc_feature (1260)..(1263): n is a, c, g, or t
  misc_feature (1267)..(1269): n is a, c, g, or t
  misc_feature (1279)..(1279): n is a, c, g, or t
  misc_feature (1284)..(1288): n is a, c, g, or t
  misc_feature (1292)..(1300): n is a, c, g, or t
  misc_feature (1302)..(1302): n is a, c, g, or t
  misc_feature (1309)..(1310): n is a, c, g, or t
  misc_feature (1312)..(1314): n is a, c, g, or t
  misc_feature (1325)..(1330): n is a, c, g, or t
  misc_feature (1332)..(1334): n is a, c, g, or t
  misc_feature (1347)..(1351): n is a, c, g, or t
  misc_feature (1363)..(1364): n is a, c, g, or t
  misc_feature (1366)..(1368): n is a, c, g, or t
  misc_feature (1370)..(1370): n is a, c, g, or t
  misc_feature (1377)..(1381): n is a, c, g, or t
  misc_feature (1383)..(1383): n is a, c, g, or t
  misc_feature (1385)..(1386): n is a, c, g, or t
  misc_feature (1390)..(1396): n is a, c, g, or t
  misc_feature (1399)..(1399): n is a, c, g, or t
  misc_feature (1401)..(1406): n is a, c, g, or t
  misc_feature (1408)..(1410): n is a, c, g, or t
  misc_feature (1412)..(1412): n is a, c, g, or t
  misc_feature (1415)..(1419): n is a, c, g, or t
  misc_feature (1425)..(1433): n is a, c, g, or t
  misc_feature (1436)..(1437): n is a, c, g, or t
  misc_feature (1444)..(1448): n is a, c, g, or t
  misc_feature (1450)..(1451): n is a, c, g, or t
  misc_feature (1454)..(1456): n is a, c, g, or t
  misc_feature (1458)..(1466): n is a, c, g, or t
  misc_feature (1469)..(1474): n is a, c, g, or t
  misc_feature (1481)..(1484): n is a, c, g, or t
  misc_feature (1486)..(1506): n is a, c, g, or t
  misc_feature (1508)..(1508): n is a, c, g, or t
  misc_feature (1510)..(1511): n is a, c, g, or t
  misc_feature (1517)..(1520): n is a, c, g, or t
  misc_feature (1522)..(1524): n is a, c, g, or t
  misc_feature (1527)..(1533): n is a, c, g, or t
  misc_feature (1537)..(1546): n is a, c, g, or t
  misc_feature (1548)..(1552): n is a, c, g, or t
  misc_feature (1554)..(1559): n is a, c, g, or t
  misc_feature (1561)..(1563): n is a, c, g, or t
  misc_feature (1565)..(1567): n is a, c, g, or t
  misc_feature (1570)..(1575): n is a, c, g, or t
  misc_feature (1578)..(1580): n is a, c, g, or t
  misc_feature (1583)..(1588): n is a, c, g, or t
aatagaagaggagcaggaggcatcaccattgccacaatggttaaaggtcgccaaggagaacgtgtaaggtttgcgatcttactgtttcctttcatttgctatgtttatggcatcgcttttaatctgtgggtttagtgtctcctaataataatttgattttcacaaattttagcagttgttggtccanntnnttttcatttttaggtcaatcaagcagcagcaatcagcacatgccacttaaagtgacacaaacattggtcaataggggtctgtctatgatctccacaaaaagcaacaaatccagaaatgatatgttccagagaaggtagtaatgtaatttattatagacttatagtaatgatccattcatataaaaatgtagcagcaaacatcagaaacatgtcaccaacaagtattcattggttgactttcacattttttttatatattaacacttcttccagatctgggagtaatcataaatagctaaaacattcatgtttaatgttatggcagccattaatcacaatgacaacacagttttaacacgggacaaaagaagaaacatctgccatagtaaaaatagttcataaatttagctgatgcaaccctagagaagaggtggataaanngtggtgttgttcaggtccaagtcaaatcaatacccaagcacctccctaatccagattgagaatgtaaactctaagnangaagttgcgtggtactgtgggaagcgcatggcttacatctacannncgnnnntaaanaagaacggannnnactatcgctgcntttggggtaaggtcaccaggcctcatggtaacagnnnnntaaactctaaanncccnnnnnttctnntttcnncnnnnnntttccncctannnnntnnccctcannnccttcccccccccccnnnnnnnntccccnnntcnnnnnnnacttcccctcnnatnnnnnnnnnnaccnnnnnnnnccnnnnnnnnnttnnnncccccacnctttatctcccgncnnnnnnnnnnctnnnnnnccnnntnnnnnccctcnntcctccttttcccctccccctcccccncntnttnnnnncnnnttccctccctnnnnnctnnnnnnccttttttccccnncttncccccccnnnnctcttcctnnncctactanncncttttttttttccttttccccccccttcttccccttttnnnnccnnnnnnnnnnnattntntttnnnncnacccccccnnnnnnnnnnnnnnnccnnnncccnnnccccaacccnccccnnnnnatcnnnnnnnnntnccccccnntnnnttccctccccnnnnnncnnncattttccctccnnnnncccccccccctnnannncnttctctnnnnncncnncccnnnnnnnttncnnnnnntnnncnccnnnnnccctcnnnnnnnnntcnncccctcnnnnntnnctnnncnnnnnnnnnccnnnnnnccccttnnnnannnnnnnnnnnnnnnnnnnnncntnntttttnnnntnnnccnnnnnnnctcnnnnnnnnnntnnnnntnnnnnncnnncnnntannnnnnttnnntannnnnncccccccccc

SEQ ID NO: 3560 - DNA, 416 bp, Glycine max
gatcagggagttcagacgataatggatgttcttctcgtaaacgtgctagaaaagagggtcttggaggtggtggtttttttgatctaaacttgccagcagagtttgtagacagaaattgactttgaaggacaccttattatacgtacaggcgtacaggtctaacaacataaaattgctttgctttgctgcctttggaaggaaggaattaatctttttggatttcataccccatttgctttctcatatctttcttttagccagccatgtctctgctgagataaaagatatgtttccaaggtttcttattcctatgccatctacctttctgtttgaaatcctagcgctgtatatagatagccttggggcatttatttgctagtagttttatgtaaatggctaccttgaggacaactagg

SEQ ID NO: 3561 - DNA, 946 bp, Glycine max
  misc_feature (895)..(895): n is a, c, g, or t
  misc_feature (934)..(934): n is a, c, g, or t
aatgatggtataaaattaagatgcctttggagaaatttctcttttacttgctccttttcttgtctttacctttaccttcaccttcaccaaatctgctcagtgctttttctcacatcctaatcctattgcactaatactgtaaattgagatactaggtaatagaggagtttttgagtttcatctttcatgacttggggaaaggatttgataattgtctcattttttattttgtttggtgagtttatttaatcttatccttgacaacaatcttttttcttggcacagtattttctgtatcaaatcctccgtgggttgaagtacatacattctgccaatgttctgcatagggacttaaaacctagcaaccttctcctgaatgccaactgtgacttaaaaatttgtgattttggactggctcgtgtcacgtctgaaactgattttatgactgaatatgttgttacaagatggtaccgtgcaccagagcttctgttgaactcttctgattacactgcagcaattgatgtatggtctgttggttgtattttcatggaactgatggatcgcaagcctttgtttcctggcagagatcatgtgcatcagttgcgtctacttatggaggtaatttatttagaagtcttcattatttgaagaagttcaagaattattgattcacatttgtttttatggttgaaatgattaacctgccagacttggaactaatgcattattaaagcgaattgaaattctatggcagtgtcattctggagtataattcaggttaagtttcaatatattacgtccatacttgagtaaagtcagacacttaaccaaaatgatgaaattcatgccaaaatttgcacttgctttgctatgttttctttttctaaccttgtgnaatatagttcatctttgatgacagtctgcattgaaatcnaatatataacag

SEQ ID NO: 3562 - DNA, 753 bp, Glycine max
gatttctttcggaagcttcctcaagatgttgataagggtggcaatcccacacattcaatttttgatagatataatgattcatatctaaggcgaattggtaagtcttactattcttagtctcaaacttgtcatattacagctttattctcatagtttgatatggtatgatgtccatcaatatgttcgaaatgcattgaaatacagacgttcacattcactctgtataaacaggaaccacaattttgtcatatgtcaatatggtctgtgctacactgcggaattcaattcccaagtccatcgtctattgtcaagtgcgggaggcaaaacgaagtctacttgatcacttttttaccgagctaggcaaaatggaggtaagaataagtcctcctttccaaagttttactgtatatttttcttttaattttgatcattcaaataagatctaatttgaatgatcatcatatttattcttccttaaaaagtcatgtgtatttatcttttaatctttaatcattcacatgtgatcaaataatatatgtttattaatacaaaaaattaagtgttgactgtctgcataaatcctctttgcagaccaagcgtctgtcatcgttattgaatgaggatcctgcaattatggaacgacgtagtgcgctcgcaaagagactagagttataccggagtgcacaagctgaaatagatgcagttgcttggtctaagtagatatatgtatgtcagatcacgtttatacgagag

SEQ ID NO: 3563 - DNA, 359 bp, Glycine max
aaatttctaacctccttcagatctacaccacccttctctttttttccagtttcataaattctacaccatgggcacggaggttctacggccacaagattgtttcacccaccgcatcggtgttccaccggcggggttttcccggagaagaacctctgggacacacaacaacaattacttcaggggcacgcggaagccggttacccgacccgaacagagaaaacgggttgtggagaaaaggcccagcttcgatgattcgaggttttcgaggttggagatggagaaggtcaccattctccggaggggggagtcgctcgattcgaagctgaaaaccggggctttgaagaaggaaggtgacaatt

SEQ ID NO: 3564 - DNA, 397 bp, Glycine max
tttcaccccctaaattctccatcaaagacacaatccactccttaattccccaaaccaaacacgccgttaactaactcaccaaccctccctcctttacccgagagatcgattctctctgtaagtaaatcttgccgttaactttctcggaaagtcggaatttcccggaaaatggaaggaggtcgccggaggataacactttacgatcaaatgaaagccggcaacagcagccgatactcactcgccagcctcatgctgggcgatgtcgttttcaagaaggtggaagcagaagaagcagaagaagcagaagccgaagccgaagcgagctgtgagctgagccgaagccggactctccaagacatcattcgcgaagaaaaacctagcaacagcagcaacaaca

SEQ ID NO: 3565 - DNA, 546 bp, Glycine max
  misc_feature (495)..(496): n is a, c, g, or t
  misc_feature (513)..(513): n is a, c, g, or t
  misc_feature (532)..(533): n is a, c, g, or t
  misc_feature (538)..(542): n is a, c, g, or t
tacaattctggtgcttctgtctctctggtgagtttcttggacaacaaatcccccttttcccattacataaattccaaaatgcattattagttgcattttgctctctagcctctcttggtccattgggtattctatcctaggtgtcaccaaggcccaaactgcataatgctgtgtcacttagatatttgtttgtttcatctcaggtttccacggatgaaatggatactttagaagaaataagatcttttgttggggatgatgaaaacaaaggcacaaattccattgctgagtttcccctcctcaccaagaatgcagttgaatctttacggtacagggctgaggtaatgtattatttcctttactctagatgaaaaactaaaataggattccattgatgcatcaaatctacgagagcctttttggttgacttggtatatttttcccttcaggattcgaattaattaattctcttatgtgtcaattttttttttcaanntttgtgaccccaaaaangaaaaacattccttttgtnntcttnnnnnttgt

SEQ ID NO: 3566 - DNA, 371 bp, Glycine max
gtcgtgtataaattactgccttcaagtaatgatagttttcaaccaactcttttggagggcattcaaacagttgataacgttgttgatactaggccaattgattatgaggtcttttcacagcccaggtttgattgggatacccctcaaatgtgactcaagctttgatatgcatagcttgctatcctataacgatgtatctgttcccaatcacgtatgtaacagaaaaaaaaattagtggtgagggatagggatggggacaggggtcacgctgggccagggaagagggttcctcttgtaactgatgttcaaaatttgttatacacgcatttatgacatgccaattcttctcttccttttcttgagtaattcca

SEQ ID NO: 3567 - DNA, 368 bp, Glycine max
agcttgttgaatgaggagagaaaaccgcacgctgtggttactccatatccagctcaaggacatgtgaaccctttgtttaaactagcgaagctgcttcatctcagaggctttcacataacctttgttcacactgagtacaactacaagcgtttgctcaagtcaaggggtcctaatgcccttgatggcctaccagattttagatttgagagcatcccagatggtcttccgccattggatgatgataatgttactcagcacgttccctctctctgtgactctatcagaaaaaacttcctcaaacccttttgcaaacttgttcatagacttaaccactcttctgccactgagggtctcatacccccagttac

SEQ ID NO: 3568 - DNA, 258 bp, Glycine max
tgttccttcgctttgtttgcttcagatatttttcttttttacgttttttctgttgcttcatcccaaacagagatatttcggtaaccaaacattttctcttccccaccaaaacagaacaaacacgttcgtctcgtttcgttcccatggcggtctccgtttccgcgtcctccgcgattgcttctttgaactccgaacgctccacgcgcttggcaccctcactcgtctccgcatcttcttccgccaagcaatcctcgctgc

SEQ ID NO: 3569 - DNA, 791 bp, Glycine max
cttgttggattctcgtcgtcattttgttgttaggtaaactgatcaatttcatgatcaaacaaagttactaagtttcgtctaatcttggctgcttatgaatataaatgtgtttctctagatatatacattgacttacatgggttacattatggaatatatatatgttccattaaccatgtttttttttcatgacattggtacaaattatcaatcactaagaatgatgactaatttctagcaaataatcttattcatcattttttgtagggtctctctctctaacgatcattaagaaaaaaagtaaaatatttgaaaactagtacataattaatttcatggagtacaaaattaaaagaaaaataggagttatatatatcgatctggtactggtacatatatattccttatgaagttacaattaattaatgtataataattattgtgtgaacttaattggaacagaatcaagatacgtgaaagcgatgggtgaggttgctgcaatggatgatagtgcggcattgatgaatacatcatcatcaggtgcaaactgggatgcgcattcaaaacacagaagaaacatgggtgtgaatgggagggtgttttgctgctatgataaccatataggaagttgcaatccgggttcagagaaagatgaccattattgtaattacatttgcaaaaaacaccactgctacaaagggggtatatgcaaaattcgtggcaaaaagtttccaaatcatttttgtcattgtttctgctaaatgtattactatcaactacaaataattgtt

SEQ ID NO: 3570 - DNA, 433 bp, Glycine max
cacggagctactcatccggaagcttccgttccagcgcttggtccgcgagatcgcgcaggacttcaagaccgacctccggttccagagctccgccgtctccgcgctccaggaggccgccgaggcttacttggtcggtctcttcgaagacacgaacctctgcgccattcatgccaagcgtgttactatcatgcccaaggacattcagctcgccaggcgcattaggggcgaacgcgcttaaacctaatccctgtccttttgtatagataatttcaagcgttcttagttagattgaattgcggttttctttgagaattctgtaatgttaacgctttaccaatgaaattatcgcttttgttcttcaattgaatttggttctcttcaattttaaagcttgtttatacgatgtagagttctgttgaatgcttgtcaaagc

SEQ ID NO: 3571 - DNA, 392 bp, Glycine max
ctggaagatggactccatctagtgctgacagctcagcgggtcgggctcctggctacggtgtcatcaccaacataatcaacggtggcctcgaatgcggccacggccaggataatcgggtccaagatcggatcggcttctaccgaaggtactgccagatgatgggaataagccccggagacaacttggattgtaacaatcaaaggccatttgcttaagcaaattgctcacatatatcatccatatagagaataaatagtatgtaataaaggatctaccatgatcttacatgtactgggaaacttgtttctaaagaagttccccttatcttgattaaataagaaactttaatattttaccaccttttatgacaaagagttgctgatgaacagaac

SEQ ID NO: 3572 - DNA, 1432 bp, Glycine max
  misc_feature (386)..(393): n is a, c, g, or t
  misc_feature (395)..(407): n is a, c, g, or t
  misc_feature (410)..(410): n is a, c, g, or t
  misc_feature (413)..(414): n is a, c, g, or t
  misc_feature (665)..(679): n is a, c, g, or t
  misc_feature (681)..(685): n is a, c, g, or t
  misc_feature (687)..(692): n is a, c, g, or t
  misc_feature (701)..(706): n is a, c, g, or t
  misc_feature (715)..(727): n is a, c, g, or t
  misc_feature (737)..(745): n is a, c, g, or t
  misc_feature (748)..(757): n is a, c, g, or t
  misc_feature (760)..(761): n is a, c, g, or t
  misc_feature (765)..(765): n is a, c, g, or t
  misc_feature (767)..(772): n is a, c, g, or t
  misc_feature (776)..(779): n is a, c, g, or t
  misc_feature (781)..(788): n is a, c, g, or t
  misc_feature (791)..(793): n is a, c, g, or t
  misc_feature (796)..(798): n is a, c, g, or t
  misc_feature (801)..(807): n is a, c, g, or t
  misc_feature (810)..(861): n is a, c, g, or t
  misc_feature (863)..(868): n is a, c, g, or t
  misc_feature (870)..(885): n is a, c, g, or t
  misc_feature (895)..(901): n is a, c, g, or t
  misc_feature (905)..(908): n is a, c, g, or t
  misc_feature (911)..(914): n is a, c, g, or t
  misc_feature (916)..(919): n is a, c, g, or t
  misc_feature (923)..(926): n is a, c, g, or t
  misc_feature (932)..(936): n is a, c, g, or t
  misc_feature (941)..(946): n is a, c, g, or t
  misc_feature (948)..(948): n is a, c, g, or t
  misc_feature (956)..(961): n is a, c, g, or t
  misc_feature (964)..(981): n is a, c, g, or t
  misc_feature (983)..(991): n is a, c, g, or t
  misc_feature (997)..(999): n is a, c, g, or t
  misc_feature (1001)..(1004): n is a, c, g, or t
  misc_feature (1008)..(1011): n is a, c, g, or t
  misc_feature (1015)..(1034): n is a, c, g, or t
  misc_feature (1038)..(1048): n is a, c, g, or t
  misc_feature (1056)..(1059): n is a, c, g, or t
  misc_feature (1065)..(1070): n is a, c, g, or t
  misc_feature (1072)..(1076): n is a, c, g, or t
  misc_feature (1091)..(1091): n is a, c, g, or t
  misc_feature (1101)..(1101): n is a, c, g, or t
  misc_feature (1104)..(1106): n is a, c, g, or t
  misc_feature (1109)..(1109): n is a, c, g, or t
  misc_feature (1111)..(1116): n is a, c, g, or t
  misc_feature (1121)..(1125): n is a, c, g, or t
  misc_feature (1127)..(1129): n is a, c, g, or t
  misc_feature (1131)..(1131): n is a, c, g, or t
  misc_feature (1137)..(1148): n is a, c, g, or t
  misc_feature (1151)..(1151): n is a, c, g, or t
  misc_feature (1153)..(1155): n is a, c, g, or t
  misc_feature (1158)..(1163): n is a, c, g, or t
  misc_feature (1166)..(1177): n is a, c, g, or t
  misc_feature (1181)..(1195): n is a, c, g, or t
  misc_feature (1201)..(1206): n is a, c, g, or t
  misc_feature (1208)..(1213): n is a, c, g, or t
  misc_feature (1215)..(1220): n is a, c, g, or t
  misc_feature (1222)..(1222): n is a, c, g, or t
  misc_feature (1226)..(1229): n is a, c, g, or t
  misc_feature (1231)..(1231): n is a, c, g, or t
  misc_feature (1233)..(1233): n is a, c, g, or t
  misc_feature (1238)..(1241): n is a, c, g, or t
  misc_feature (1246)..(1251): n is a, c, g, or t
  misc_feature (1256)..(1267): n is a, c, g, or t
  misc_feature (1269)..(1269): n is a, c, g, or t
  misc_feature (1271)..(1306): n is a, c, g, or t
  misc_feature (1309)..(1310): n is a, c, g, or t
  misc_feature (1312)..(1318): n is a, c, g, or t
  misc_feature (1323)..(1323): n is a, c, g, or t
  misc_feature (1325)..(1348): n is a, c, g, or t
  misc_feature (1352)..(1365): n is a, c, g, or t
  misc_feature (1367)..(1367): n is a, c, g, or t
  misc_feature (1370)..(1372): n is a, c, g, or t
  misc_feature (1374)..(1381): n is a, c, g, or t
  misc_feature (1385)..(1392): n is a, c, g, or t
  misc_feature (1395)..(1397): n is a, c, g, or t
  misc_feature (1405)..(1429): n is a, c, g, or t
caaaattccaagagataaatgggtcaatgaaaatgttaaggtggagatatatgaagtcaagggaatccagtcattaaacattgttgtcaggaacatactggatggtggtgtcaactgttctcgacgaattgatcggcatggaaagaccatttcagatctcattctgtgtcagcaagttgtgttgcctccttgattgtgtgatttactaataaggtggcaatgttctcctgaatggaatgaatagagcattgcaaaacttagaatgatagaatttattgaagcttggaagtgctttaattgaagtaggactcatatggggagggaggaatccattttgtgctctttagcctacacattcttatgataataattagcaaaagctgtgnnnnnnnncnnnnnnnnnnnnncantgnntgagcacaaccaccctgctcctactcacagaaactctcttgctggctccacacgtcagaagccattggtacctcaaacagccaccaccactgaagaagactctgacaagagcaagagcctcacaaaacccacttcccctgccacctcaggggcagaagaagaggctccaacaccatcacaaggggaaaagtctgagagcagagaagagaaagaggatgtgatggatgatgaggaagaagatgaatttggtnnnnnnnnnnnnnnngnnnnnannnnnnttaaaagannnnnnttactcaannnnnnnnnnnnngcttctaatnnnnnnnnntannnnnnnnnntcnnggcntnnnnnnattnnnnannnnnnnnacnnngtnnnacnnnnnnnttnnnnnnnnnnnnnnnnnnnnnnnnnnnnnnnnnnnnnnnnnnnnnnnnnnnnannnnnntnnnnnnnnnnnnnnnntggaatctcnnnnnnntgcnnnntannnncnnnnttcnnnntaatcnnnnncccgnnnnnncntacacccnnnnnncannnnnnnnnnnnnnnnnncnnnnnnnnnccccannncnnnncctnnnnccannnnnnnnnnnnnnnnnnnntttnnnnnnnnnnncttttctnnnnttcgannnnnntnnnnnactcgttctctacanaattttttcncannntantnnnnnnttttnnnnntnnntnctcttnnnnnnnnnnnnttntnnnttnnnnnnccnnnnnnnnnnnnggtnnnnnnnnnnnnnnncattannnnnntnnnnnntnnnnnngnttcnnnncncngccannnnttatnnnnnncactnnnnnnnnnnnncntnnnnnnnnnnnnnnnnnnnnnnnnnnnnnnnnnnnntcnntnnnnnnntcttncnnnnnnnnnnnnnnnnnnnnnnnntttnnnnnnnnnnnnnntntannntnnnnnnnntttnnnnnnnnttnnncctcttcnnnnnnnnnnnnnnnnnnnnnnnnntct

SEQ ID NO: 3573 - DNA, 638 bp, Glycine max
ctcaggtggagctatatctaaagagtcaacagatgcacaacattgctgatttgttgaaaggatccaaggaagatgttgaaaaagaatctattgaactgaatatcgaagaactcaaaaccatactctctaaagtggattcccagatgaaatttcttcctgctacagcgcaggtgcatatcatgttaattgcatgtggcattctattgtctgattttgtctcttcagtaatatgacttcaggcttcttaaactgcatatcaggttgcatctcagcaaggcacctacctggccaagtgctttaaccggatggaagagtgtgagaaaaatccagagggtcctatcaggttcaggggagaagggcgccatcgcttcaaaccctttaggtagcatgatcatattagtttactagctttgcttttatgtgctctttactttcacatgatgatgaaatgatcaatgattcaatgtttttcattggttggtcaatgttttctaatttctcataactacatggttgattgttcctcaaggtacaagcatttaggtcaattcgctcctctaggaggagagcaaacagctgcacagcttcctggggattgggtttcaattggacacagctctcaatggttgtggtattct

SEQ ID NO: 3574 - DNA, 1350 bp, Glycine max
  misc_feature (428)..(433): n is a, c, g, or t
  misc_feature (437)..(442): n is a, c, g, or t
  misc_feature (447)..(461): n is a, c, g, or t
  misc_feature (463)..(468): n is a, c, g, or t
  misc_feature (472)..(474): n is a, c, g, or t
  misc_feature (484)..(485): n is a, c, g, or t
  misc_feature (488)..(488): n is a, c, g, or t
  misc_feature (492)..(497): n is a, c, g, or t
  misc_feature (501)..(503): n is a, c, g, or t
  misc_feature (511)..(513): n is a, c, g, or t
  misc_feature (516)..(529): n is a, c, g, or t
  misc_feature (532)..(552): n is a, c, g, or t
  misc_feature (557)..(558): n is a, c, g, or t
  misc_feature (565)..(573): n is a, c, g, or t
  misc_feature (575)..(593): n is a, c, g, or t
  misc_feature (597)..(601): n is a, c, g, or t
  misc_feature (603)..(604): n is a, c, g, or t
  misc_feature (606)..(607): n is a, c, g, or t
  misc_feature (610)..(612): n is a, c, g, or t
  misc_feature (614)..(614): n is a, c, g, or t
  misc_feature (617)..(622): n is a, c, g, or t
  misc_feature (629)..(635): n is a, c, g, or t
  misc_feature (637)..(659): n is a, c, g, or t
  misc_feature (667)..(682): n is a, c, g, or t
  misc_feature (684)..(690): n is a, c, g, or t
  misc_feature (692)..(700): n is a, c, g, or t
  misc_feature (710)..(721): n is a, c, g, or t
  misc_feature (726)..(732): n is a, c, g, or t
  misc_feature (734)..(734): n is a, c, g, or t
  misc_feature (736)..(736): n is a, c, g, or t
  misc_feature (738)..(741): n is a, c, g, or t
  misc_feature (744)..(746): n is a, c, g, or t
  misc_feature (748)..(759): n is a, c, g, or t
  misc_feature (761)..(771): n is a, c, g, or t
  misc_feature (773)..(784): n is a, c, g, or t
  misc_feature (786)..(786): n is a, c, g, or t
  misc_feature (788)..(797): n is a, c, g, or t
  misc_feature (803)..(804): n is a, c, g, or t
  misc_feature (806)..(809): n is a, c, g, or t
  misc_feature (811)..(826): n is a, c, g, or t
  misc_feature (830)..(835): n is a, c, g, or t
  misc_feature (837)..(839): n is a, c, g, or t
  misc_feature (841)..(844): n is a, c, g, or t
  misc_feature (847)..(847): n is a, c, g, or t
  misc_feature (850)..(856): n is a, c, g, or t
  misc_feature (860)..(864): n is a, c, g, or t
  misc_feature (866)..(870): n is a, c, g, or t
  misc_feature (872)..(872): n is a, c, g, or t
  misc_feature (875)..(877): n is a, c, g, or t
  misc_feature (880)..(888): n is a, c, g, or t
  misc_feature (891)..(893): n is a, c, g, or t
  misc_feature (895)..(898): n is a, c, g, or t
  misc_feature (901)..(901): n is a, c, g, or t
  misc_feature (905)..(905): n is a, c, g, or t
  misc_feature (910)..(936): n is a, c, g, or t
  misc_feature (939)..(944): n is a, c, g, or t
  misc_feature (947)..(962): n is a, c, g, or t
  misc_feature (965)..(966): n is a, c, g, or t
  misc_feature (969)..(969): n is a, c, g, or t
  misc_feature (971)..(993): n is a, c, g, or t
  misc_feature (996)..(1000): n is a, c, g, or t
  misc_feature (1004)..(1006): n is a, c, g, or t
  misc_feature (1008)..(1014): n is a, c, g, or t
  misc_feature (1016)..(1016): n is a, c, g, or t
  misc_feature (1020)..(1020): n is a, c, g, or t
  misc_feature (1022)..(1028): n is a, c, g, or t
  misc_feature (1031)..(1035): n is a, c, g, or t
  misc_feature (1042)..(1043): n is a, c, g, or t
  misc_feature (1045)..(1045): n is a, c, g, or t
  misc_feature (1053)..(1060): n is a, c, g, or t
  misc_feature (1062)..(1062): n is a, c, g, or t
  misc_feature (1066)..(1078): n is a, c, g, or t
  misc_feature (1081)..(1082): n is a, c, g, or t
  misc_feature (1084)..(1084): n is a, c, g, or t
  misc_feature (1086)..(1086): n is a, c, g, or t
  misc_feature (1089)..(1105): n is a, c, g, or t
  misc_feature (1107)..(1113): n is a, c, g, or t
  misc_feature (1115)..(1132): n is a, c, g, or t
  misc_feature (1139)..(1143): n is a, c, g, or t
  misc_feature (1146)..(1151): n is a, c, g, or t
  misc_feature (1153)..(1153): n is a, c, g, or t
  misc_feature (1155)..(1155): n is a, c, g, or t
  misc_feature (1157)..(1164): n is a, c, g, or t
  misc_feature (1167)..(1167): n is a, c, g, or t
  misc_feature (1183)..(1192): n is a, c, g, or t
  misc_feature (1198)..(1198): n is a, c, g, or t
  misc_feature (1217)..(1219): n is a, c, g, or t
  misc_feature (1223)..(1239): n is a, c, g, or t
  misc_feature (1245)..(1265): n is a, c, g, or t
  misc_feature (1267)..(1272): n is a, c, g, or t
  misc_feature (1275)..(1275): n is a, c, g, or t
  misc_feature (1277)..(1277): n is a, c, g, or t
  misc_feature (1280)..(1282): n is a, c, g, or t
  misc_feature (1284)..(1298): n is a, c, g, or t
  misc_feature (1302)..(1311): n is a, c, g, or t
  misc_feature (1313)..(1328): n is a, c, g, or t
  misc_feature (1332)..(1332): n is a, c, g, or t
  misc_feature (1334)..(1345): n is a, c, g, or t
gtgtctctcctaataccaaaacgctaccgttttgctcttttatttctctatggattgcaagaagcgagttcgggatgactcggacgagtcagttctggaatcgcccgaggcgaagcgactcagggacgatttactcgagttcttcgacgacgccgacgacgcaccttcctctcaggaccttgactccgtcatgaagagcctgcaggaggagatttccggcgtggcctcagattccggcgagtctcaggcgcagatcgggtaccttctggaggcctccgacgacgagctaggtcttccacccgccggaaactcgtcggcgccggaggagaagaacgtggagaccgagttggtccgagtcgcgtctgactcgtccggaatcggcgagttgtgggagtttgaggaacagataaatttgaggaacagatagnnnnnnttgnnnnnncttcnnnnnnnnnnnnnnncnnnnnnttcnnnttctggctcnnttnttcnnnnnnggtnnnctttcgtnnntcnnnnnnnnnnnnnnctnnnnnnnnnnnnnnnnnnnnnttgcnntgtgctnnnnnnnnntnnnnnnnnnnnnnnnnnnncctnnnnntnngnntcnnntntcnnnnnntgctgcnnnnnnntnnnnnnnnnnnnnnnnnnnnnnnttccctcnnnnnnnnnnnnnnnntnnnnnnncnnnnnnnnntcctcgcttnnnnnnnnnnnnctcgnnnnnnntncncnnnnttnnntnnnnnnnnnnnncnnnnnnnnnnncnnnnnnnnnnnntncnnnnnnnnnnttgccnntnnnngnnnnnnnnnnnnnnnntgcnnnnnngnnncnnnntcnggnnnnnnngtcnnnnngnnnnntnggnnnttnnnnnnnnncgnnncnnnncgngctnctctnnnnnnnnnnnnnnnnnnnnnnnnnnnccnnnnnnctnnnnnnnnnnnnnnnnggnngcntnnnnnnnnnnnnnnnnnnnnnnnctnnnnncctnnngnnnnnnncncctncnnnnnnncgnnnnngtcggcnncngggtctgnnnnnnnntngggnnnnnnnnnnnnnggnncncngtnnnnnnnnnnnnnnnnntnnnnnnncnnnnnnnnnnnnnnnnnncctctcnnnnnccnnnnnncntncnnnnnnnntcncccctctcccccccgnnnnnnnnnnctcccncttctctgtcccctgcccnnnttcnnnnnnnnnnnnnnnnnctgccnnnnnnnnnnnnnnnnnnnnntnnnnnnccntnctnnntnnnnnnnnnnnnnnntttnnnnnnnnnntnnnnnnnnnnnnnnnnctcntnnnnnnnnnnnncgtcc

SEQ ID NO: 3575 - DNA, 376 bp, Glycine max
cctcgctgtgtcgacctaaactccggcaccaatggatgggtgtcaccgccgggctccgtcttctccctcagtgccaaaaatttcttttagaatcgccaaaaatgccccgccgaagactacctcctcctgctggcgagcatggactagctcaaatccaccacaaaactcgaccacgtgctctcacgcgctcacaacaacgtgatgcacgcgctacgaagatctcaatctcaaaccctaggtcgatcgctaaagagctttgtcttcacggtgaacctctagatctcggacagaaaagaccaccacagtgcggtgttctactttgcgatcgatgcaccagatcctctccgaactagttcactcttaaaccggttcgtga

SEQ ID NO: 3576 - DNA, 396 bp, Glycine max
gttatcgttcatgttttaccaaaaggtgatgagcacagccttgtgaagtggactttcttgtatgagaaggtggatcacactgcccctgagccaaccaagtacaaagatttggtggttaaactcaccaagaacgtggaggctcatcttgttgaggctcgttaaaatgatccctaagtggttcacgctaaataaagttgtgatgtgtgtggtgtgttgcatgtggccccttggttaattatcagccattatgtttgctttaaattgccgtgcgtaatatgttgttggttaacttgttaaaaatattggttctcaaccataagttgtgtaatgtgttgttggtttattcaaaatattggccggggatcacagggagggctacatgccttttggtatgtc

SEQ ID NO: 3577 - DNA, 868 bp, Glycine max
tggttggctttgcagtagcaatcactgttgaaattgctactgggaagggactcctagaggtatgatactgttgctttgagtcattatacaatttatcattttcatcgaatgattaattggcttttgccttccttttcttcataaccacccacctgtcagaagttcactttgatattctgactgtaaatctgtaatatgttaatctttctccctcctttactttattgagcttatgacatctactggtaaaataagctcaagtgttttttttaattattattgtcatcattggtaatagcctgatctgagtcacgatcttttaaaatattaagttcataatcaagcatatgggttcacataactttctgatgcatctcaaaactaagtagaatcattttaagttttgagcttaaaagtgattgcaacacactgaaaccaagctttatggagttctgatgctccttactcctatccctcccattctagagattcttatcgatccgctgcaaaagaataacagcattcctttactttgattttgcagaactttggactcacaagtccactgcctacagttgcccttgcagtaacagcacttgtgggtgtcttgacggcagtttttatcttccagtcagcgtcaaaaaattgatcacatattccaactccttgtgtctgttgtaaattctgaagctcagagatttcattttcggagataaaattttatcattcttttctgtaatatttgttttgatgaaaagaattggcaatgaagcctgaaaaatcaaagtaacttcgtgttaaatatggtatgacctcacctttccatgttgccttcatccatgtcaaacgctacctttgtgaattatgt

SEQ ID NO: 3578 - DNA, 541 bp, Glycine max
  misc_feature (299)..(300): n is a, c, g, or t
  misc_feature (303)..(305): n is a, c, g, or t
  misc_feature (325)..(327): n is a, c, g, or t
  misc_feature (329)..(330): n is a, c, g, or t
  misc_feature (335)..(336): n is a, c, g, or t
  misc_feature (338)..(341): n is a, c, g, or t
  misc_feature (345)..(346): n is a, c, g, or t
  misc_feature (354)..(354): n is a, c, g, or t
  misc_feature (359)..(364): n is a, c, g, or t
  misc_feature (376)..(379): n is a, c, g, or t
  misc_feature (381)..(388): n is a, c, g, or t
  misc_feature (392)..(400): n is a, c, g, or t
  misc_feature (402)..(403): n is a, c, g, or t
  misc_feature (406)..(411): n is a, c, g, or t
  misc_feature (414)..(417): n is a, c, g, or t
  misc_feature (421)..(424): n is a, c, g, or t
  misc_feature (426)..(430): n is a, c, g, or t
  misc_feature (436)..(437): n is a, c, g, or t
  misc_feature (439)..(439): n is a, c, g, or t
  misc_feature (443)..(446): n is a, c, g, or t
  misc_feature (456)..(458): n is a, c, g, or t
  misc_feature (469)..(483): n is a, c, g, or t
  misc_feature (486)..(488): n is a, c, g, or t
  misc_feature (490)..(491): n is a, c, g, or t
  misc_feature (497)..(503): n is a, c, g, or t
  misc_feature (506)..(507): n is a, c, g, or t
  misc_feature (533)..(535): n is a, c, g, or t
  misc_feature (537)..(538): n is a, c, g, or t
ccgcatcaattcctcttccatcacatgaagctctcacctccatccttattgatgcctttgaggttggctacagacactttgatactgcttctctgtatgaaagtgaggagtctctaggcaaagctgtggcataggccttagatctaggccttataaagagcagagataaagtattcatcacatcaaagctatggaccactgatgctcaccctgaccttgttgttccaactcttaagactcactgcagaaagtatattatgtttaattactcatttgatccttatattagcacaatcttnnatnnnttatcccttacacctaaaannngnncgttnnannnnctanncatacacnttttnnnnnnttgtgcagaaannnnannnnnnnnattnnnnnnnnntnnagnnnnnnaannnnaaannnntnnnnncatagnncncaannnnaaaaataaannnattttgaaaannnnnnnnnnnnnnnttnnncnnaggtgnnnnnnntgnntaatggatacttccccccaatttctnnnannaat

SEQ ID NO: 3579 - DNA, 465 bp, Glycine max
  misc_feature (382)..(385): n is a, c, g, or t
tgtgatactacctattgaacctcttccttctcgtctaaatgaaattgacttgaaaaccttgcaaataaagtaatctatattgagggtttgaaaaatagttctcaacaaaataaaaatttccatttactcaagaacgcgggtttaaagctggtgggagttggcatactcaaagcgcaatgtaagtttgttccgtttcgttgagagaggatcaaactttgaagttgcttttgatgagggtggatctgagagtttggtttgtggtatattgcttttggggtgtttctaataccgtatatgagacgtacatgttaccttcgtatcacttgtctggtcaatttcgtaaatcttgtgcgcaagttggttacgcggaataagaattgannnnccagacaagtgatacgaaggtaacatgtacgtctcatatacggtattagaaacaccccaaaagcaatataccacaaacca

SEQ ID NO: 3580 - DNA, 263 bp, Glycine max
aaggtaaatttaaacgagaagttaagggagaattggatggagattctagtaggtgagtttgtggcatctgaaaaagatggtggtgagatggatatctctatgtatgaatatgaaggtggcatgtggaagagtgggctagtcatccaaggtgttgtcatcaaaccaaagaactaagtattaaaatagatgtattatgaagtcgatgccataaatgataatttgtattactagtaataaagcttttggattgatgaagtgtgcaa

SEQ ID NO: 3581 - DNA, 673 bp, Glycine max
agttttgataatgcattgacacagataagctccgagtatgatctccattttattctattgaataattactttggttcagttatgtactacagaaattctatggatcagagggagtcactaaccaaagctatttaggaatgagcagttattttgataatttgcatgagcagaatattagaaaatagttttagattatctttttgattgttccttgtcaatctctctctgaagtgagagagagcatgttgagatttagataaaaagttttagttatcttttaattttaccccttggatattttgtttcaattccatgatttatttatttttggtttttgtttgtgatagttttgtggggatcaagcaagtaatgtttggtggatcagaatttgagaattggaatgacagtttgaaatcagaggatgcaggttatggtgttcacaagatctagcagccaattttatagacttatgaggattttgaattgagcgcaatgaagaggaagccatcaaatgtatcactttttcgtaacagttagtattagactgaagaataagcagggttgtaagcatttatcctagttgtatatttttttaacggcaggtactaaagcttatgtcaacttggtggagtgtatttttatttataaaaatgctggttctaagagttgtgca

SEQ ID NO: 3582 - DNA, 405 bp, Glycine max
atgaagaaaagaaggagtagggaagcatatgaggttacaagagatggtgtatgtgtagataagttctaaaactaatagttttataatctgtaaaacccctctgtctgttattttgatctcctttttcatgattgtttattgcaagtagtgttcaaatatgtacttcaaatattgcccttgtattcgaatcttgcaatttggcaaaagtccttgtcgatgatctaggctatgcttgtattttaattgggagacctccagcatctgttcaaaaagtaaaactgaaaaaatctcgattggtgttgagtttgattgtaaactgagttttgtcttaattttgccttgaacctcagcttaaaatgatgttcattgacttaagtttgcaaacttcaattcgagcatacagag

SEQ ID NO: 3583 - DNA, 462 bp, Glycine max
  misc_feature (48)..(52): n is a, c, g, or t
ctttttggaggcctcaagctcagatcggcatgccatatcacgttcttnnnnnaaatttttctgtatctttgtgctactggagaagctcgtgttcttgagctccagaaaattgtagaagaacgtgatatggcatgccgatctgagcttgaggcctccaaaaagcagctctcagttgagtctgcttccctggcatctgcagcgaatgaaattcagttgctcaaggcgcaacttgaattggttgctaattgtgagagcgtgcaatctcaacatgcagaatcagcagacatggagctactaaaccttaagcagaacttgtcagaaactctttctcttgtggacgccttgaaaaaccaagtaagggattgcaaagagtctgaagctcaggcccaagcattggtcaatgaaactacggtgcaacttgaggccgcaaaaggaactgttgagttcctaagggctgaagtt

SEQ ID NO: 3584 - DNA, 381 bp, Glycine max
acatgtcctcagtagattcaatagtaccagttagatcaccgcatcacatgaatattactgtcaggtcttctggtcaaacaagcagccagaccgaagttgacgaacttgaatttttgactatctgcagggatgctggggtggttcacatactgggaaacacagttgtgagggcaaggagggaatcaaggttctacaagaaaatagctgttgattatatatatgcatttcttaggaagatatgcagggaaaattgtgtaatcttcaatgtccctcatgagagtctcttaaatgttggtcagattttctatgtatagcatagccccatatccttgtgattgccattttttttgcaaaatgagctgagtgtagcatatgaacaac

SEQ ID NO: 3585 - DNA, 265 bp, Glycine max
  misc_feature (220)..(221): n is a, c, g, or t
tcgatcatccaacccttttcttgttcttcacaattccaattctctggcgatgtcaacggcggcggcgggcggcgacgtggaggcagggttcgcgaagctccagggtgaggacttcgagtactacatgcagacctactccatcgtccttggccgcaactccaagaagtccacggtcgatgtcgacctctccagcctcggtggcggcatgaacatctcaaanngaattggaattgtgaagaacaggatgaggttttggattgatcgg

SEQ ID NO: 3586 - DNA, 398 bp, Glycine max
attctgagctacacaagatgcactcagattcaggtgagttattgtattctactccttttgagggttacgaacaattaattgaagctgatcatgatgatgatgatcctttttctcaccaatcattcctttggaattggaacttttgatcatcatatcatcactcgctactgcatgtgctgctagaatatgatgactactagttaaaattacttgccccagcctaaatatataataaagcatccttgatcttttgtatatatgatatgtatatggtgttgtctccaagtatataacaataacaaggacaagacaagacacaggctatgtcagaccatatatatattccttaccataattaagtatatgcctagctatatggctagctagtgacctcggtt

SEQ ID NO: 3587 - DNA, 645 bp, Glycine max
  misc_feature (612)..(612): n is a, c, g, or t
catgaagttgttcctatggatcaacaacctgaactgcttcaaaagctgtcagaaggaaacttcaccttgaggattatgtatgagcagtttcagaacttacttaaaatgggtcccatcagccaggttacctcccttattatatttgattattttattattatacactcaaaattttacattccatgcactgaatagatactaattggctgcttggttggttactttgtaatgagaggctgctcaattttttttggtgacaatttctttgttgatttatgtaggtcttttctatgctaccaggatttagtgctgaattaatgccaaaaggccgtgagaaggaaagccaggcaaaaattaaacgttacatgacaatgatggactcgatgacaaatgaaggcaagcatttgattttttggcctttttgagaagatcaactttttgcatgctaaattcattgttcttattgaaatagcgcacctttgcctgctaactttaatgtttaatatgttttcagagttggatagttcaaacccaaagctcatgaatgagtcccgaatgatgcgaatagctcgaggttctggtcgtccagttagggaagtaatggaaatgttngaagagtacaaacgtcttgcaaagatatggagc

SEQ ID NO: 3588 - DNA, 1092 bp, Glycine max
  misc_feature (58)..(58): n is a, c, g, or t
ccctagcacggatatagattccatgcttttatttcttaattctacatactatactttntacatggagtacacacgtatgtgtgtcttcagttcatgtttgtgtttttttacttcagcaacatttgcagccctttcgaccgcagcatttgcatcctccgccatgtccaccgccatgtccccagcctccaccatgtccccagcctccaccgtgtcccccgcttccaccatgtcccccacttccaccatgtcctccacttccaccacttctccaggcatctggccgtgtctttggttcttctgctgcacaggcatagacaaacatttttaaatatatatcgatttggtaatttgtttcgtattctttttttaaaaaagttacatttacgtgcatacctactaagcataataaaattaattaacagtaacacccgcaaaaaatacattatggaaatggggtattgtggtatatatgcattatatataaatttttaaaagtgccaatgtatgccaaaacgcaagcaataatgcaaatcaatttttttttagcatgtcgaatataaatatataatgtcttataccatataatttcaatttggcaataaaattaaaggaggagatatgtcttaaggttatgacatttgaaactaaaactgaatagcataaatttgatatatattaggattttgtttctcggttccaatactgcaaccttggacaatataattgcatgcatgggatatcattcttaggatttttaggagaatttttagatctagagtttggataatttgtaatatattaaaggggcaatcgtattgctacaaatgtagtcgcactcaattagcagacttctataacttgaatgtattgataaatctcaaaataaattcaagcaaataaatcaatacatgagcaaaatatattaaagaagaaagcaattgtgcgggcatggtaactacatagccaccacactaccttagcgactagattagaaaataatttaaatttcaaaactaatgtttgattgttttacttattgagtggggaataggagtagcaagaaagaaagcatgtagaataagtggaagaaca

SEQ ID NO: 3589 - DNA, 436 bp, Glycine max
tctttctctccaccagaagcaccaaaggttcatgcatctgatatttctagcatcaaagcctttgcagaatcaaagggagcctctctgatcccttacacctaccactccatcacagagcaccatgatgatgatgtagcagatgagcttgctgcttccatcccagtcatcgacttgtctctcctcacttcgcatgaccctcaaatccacgccaaagccgtgcaccaactcggcaaggcctgtgcagagtggagtttcttcatggtaattcaaaatcttttcttttccctaatgaatttcactttcaactatcactcacttgcttatcatcagctcacaaatcatggaattcccgagagcctggtggaggagttgatgaaaaagtctcgcgagtttcatgatttgccgatggaagaaaagaaggagtttggtaataaag

SEQ ID NO: 3590 - DNA, 369 bp, Glycine max
tatctcacatagagcttctgaaaatgtgcaaaggtgcagaaggagaaaagcaacatggtttctgcagcagctttctacataaagagagtgcaaccagaagtgctacatgttgtgagctatgtgggttacaggcttcattgtattgccaagctgatgatgcctacttgtgtaaaaaatgcgataaacgggttcatgaagctaattttttggcccttaggcacattaggtgctttctgtgcaacacatgtcagaaccttacgcgaagatatctcattggagcatcactagaggtggttcttccggccaatataaactggaccattagaaatctccttaacaacagaggaatctacagaaagtgttcaagaa

SEQ ID NO: 3591 - DNA, 393 bp, Glycine max
agggagaatgatgctttctgaatttggggatagtcaaactcacaccagcaattccaatttcaattttgttcatactacgacagtgccggggtactttggtgtgctaaataacaactctaacccatatggttctagagaaaatccaagtgatggtccatctttaaaccattctgcttatccttgccctcagaacatagggagaatactaatgggtccttaaaattgtttgtacaacaaaaaactaaataaaatgaaattctgagttccattttgctttttcttttttggcgggtaaagctttaaaagcatagctcctcattttctctttggaaatgctgatagttcttttatgttcatatccttatatgatgagagctgctctttagcagaatt

SEQ ID NO: 3592 - DNA, 334 bp, Glycine max
gaagatatgcctaagtacaaaaaaattctaaagaataatttacaagatccttctattatctgtggtttttcataacaataagctttctttcgaactgggaaccaagaggttggcatcttccttttgccctataaacaaaaatgcgttttttcccgctcattctccattgagtatggtttgcttcaaccttactaacttaagaagagctagcattctccgaagttgtatcatcaatggctaaattggatacctcgtccactacatctgtttcgctttcaccatctactgaagctttaggcgatgcttcgggggtgatgttttcttcaggtttctt

SEQ ID NO: 3593 - DNA, 897 bp, Glycine max
  misc_feature (66)..(66): n is a, c, g, or t
cttctctcatataaagatgcagatattctcgtcttcaacactggccactggtggactcatgataanacttctaaagggtaattacaatcaacttccctttgcagtgattgctatcgatactgtttcattatgtacctgcatgcctgcatacttattcataactgttttgtaagtttcaagattagagaaccatacccttgttatgaacataagctttaaattgcgcatgacaattttcaggcaggactattatcaagaaggtaaccatgtgtattccgaattaaacgttcttgaggcattccgaagagctttaacaacttggagcaggtgggttgatgccaacataaatccatccaagaccacggtcttcttcagaggctattctgcatcccacttcaggtgaagtacaaagaattaatttaatttcaatgtactgatacactatcacctaatcatggattgtcatatatggaaaaaattgttgaattttatagtaattactttaaaagtcataattaggatgatttctaattgattaatagtataaaattatttacaatgacgtcagatgaaaattaaactcttaatacaattgtattggtaatttttatacttgttttggtttcacatcacattactcttcacttcaatttcattacttgcaaattgaaaacacatttcttgagttcccattagaagtctttactgatcactataaacttttgtgtttctattaatgatactgcagtggtggacaatggaattcaggtggtcaatgtgatagtgaaactgatccaattgacaacgagaagtacctaaccgagtatccagataagatgaaggttttggagaaggtgctaaagaatatgaaaacccgtgtgacttaccaaacatcct

SEQ ID NO: 3594 - DNA, 719 bp, Glycine max
tttatctatctatttgttactgttttggacagtttggataataataatacctatagactacatatgtttgattcatggttttatgttgttgctctcatattttaccaaaggtacataatgatggtagatcaatcatgcctactcatggaaggaaggctaccattggggacttttatggtgcgtgaatgtttgactttcaatagaaaagaaaaaaaaaacattttttattttttgaataaaagatgtaattaatttgtggctgccattgctgactattcctctcattgtttatgttatcataaactgaaattttagctgttatattaccatctctccaacggcttcatggtagtttggagaagttggaggttgttaaagaagaaggccagtcaagcatagaaggtccaagttatggcaagaaggtcattgaagaaggtgtgaaactaacggccaatgttgatttgcaaagagaagatgaatgtgggatttgcttagagccttgcaccaaaatggttttacctggttgctgccatgccatgtgtattaaatgctaccgcaagtggtaacaataacaacatttgtttatggtcaacttccaaatttatatgccattaccaatggcttatcttttttgtcacttgttctggacttattcaacttgcaggaacagaaagtcagagtcttgtcctttttgccgtggtagcttgaggagagttaat

SEQ ID NO: 3595 - DNA, 447 bp, Glycine max
  misc_feature (362)..(364): n is a, c, g, or t
ttgatgacatcaaggccaagcttgctcctaagaagacttaattttaagttgagcttaatcatattcaagagagagagcaagattcagtcttttaagtctactttccctatacttttccctataattcttgaagggttatgactcagtatcagtatcacttatggtgttacattttcctcattgatgtggtatcgagtattataatataattgtatcgcggaattatggtacatgttaagagtaatcaaaatttaattctatatactgtagaagctctcaacttttttgtgggtatatatattaatttcttgttttcgtggttcattgattttgtatacactgatcaataaaggttggaccannnacgaagacaagaaattaatatatatacccacaaaaaagttgagagcttctacagtatatagaattaaattttgattactctta

SEQ ID NO: 3596 - DNA, 570 bp, Glycine max
ctgtcttcacagtaccttgcaatggtgttgcttcttaatccctgatctgttattccatcattatatcataaaaatttaatttatttgattcaatcagggatttttcgaatgctaatatgataggagcaaaaggtttaatggggaactcctggcctgatctggacatgctaccatttggatggctaactgatcctggtaatgaggcagggttgctaattttttctttcctatgaatatcacaacccttatacttataatcagttagttatcagcaatgtacttattgaacaacttacttcacttttcatttttcaatttatcattcctctatcttctgccattttgttattttatataaatattttttattttttatttttttatgtgaaaccagaatgctgatccactgaaactgtttgattagaaaactcaagacattttgcaatctcataccatagaaaattgctacaagctgtttgattttagactcatgggacaatggatcctgatactgcattttcaccttttttttaaggttcaaatgaaggtccacataggtatagttacctc

SEQ ID NO: 3597 - DNA, 363 bp, Glycine max
  misc_feature (355)..(360): n is a, c, g, or t
aatgttacctatactagccagtaccattataatgaacacttgtttagcacagcttcaaacattctcagttcagcaagggaatgtgatgaatctgaaacttggttctttcactgtgcctgcaccatccattccagttatcccccttcttttcatgtccatcctgattcccctctatgaatttttctttgttccattcgcaagaaagatcactcaccacccttctggggttacacagcttcaaagagtaggcgttggactagtactttctgctatttcaatgacaatagctgggataatagaagtgaaaagaagggaccaaggaaggaaggacccttcaaggccaattagtctttannnnnnttt

SEQ ID NO: 3598 - DNA, 412 bp, Glycine max
taagaaaacccaataattactaactcttgaaaaatgaagatgggtagtcctagcatgggaggctcaaagagaaggctttcaagcagagggcttggaggagcccttagggagcaaagggcaaggctttacataataagaaggtgtgtggtcatgctcctctgctggcatgactagctagtagtactagttgaggccttcaaagttgaaatccaaagcttgcttccatgactatggaacaagatttggttatcttctcttcctttgttttattcttttcttcttccttcctttgattcatatggtggagtgtatatagctgacggctggtttattgtgggagagatgcaacaattttttgtatggattgctggccttataaatacatatatggcttggctttatgtacatcaga

SEQ ID NO: 3599 - DNA, 676 bp, Glycine max
  misc_feature (356)..(363): n is a, c, g, or t
  misc_feature (369)..(369): n is a, c, g, or t
  misc_feature (371)..(371): n is a, c, g, or t
aagcgcggccacgtcagcgccggccacggccgtattggaaagcaccgcaagcaccccggcggccggggaaatgccggcggcatgcaccaccacaggatcctcttcgacaagtaccacccggggttcttcgggaaggtagggatgaggtactttcataagctccgcaacaaattctactcccccatcgtcaacatcgacaagctatggtctctgataccccaagacgcgaaggacaaagccctaaaatcgaaggacactgcccctctaatcgacgtcactcagcacgggtacttcaaggttctcggaaaaggtgtgctgccccaaaaccagcccattgttgtgaaggccaagcttannnnnnnnaaatcngngtgattacctggattaacgaagtgaaacttcaattctgattagaaaaaacaacactaaaaacacaaggaattatatctaagttttgccataaatacaattctatccattttacattaaatggtaataactttggtgtctactttcaacagctgcagaagctgaatcatctaatgcagaagccaatggagccaggtcagagatgcacacaagttgaagcagcaaacagcatggacagtgaatcagaaaatggaggcaccatgaaatgtgaagctgagggaaagccaagcccatcatgagttattta

SEQ ID NO: 3600 - DNA, 396 bp, Glycine max
  misc_feature (335)..(341): n is a, c, g, or t
  misc_feature (383)..(383): n is a, c, g, or t
  misc_feature (389)..(393): n is a, c, g, or t
ttgaggatgttaggaaaagtctgaaaattaacaagcagcagtttctccagtgttgggaggttttgatctacattggccttaatcctgttgacaagaacacggagaactttgttagtattattttgaaccgtgttaagtatgatatcttagggaaagattctgggacgtctgggaagcagcttattgaagtaccaagtgatgttgatcaggagatgtcatttgtcatgttcagatcagaagccaacgaagctagtagtgtgcaaatggatgacaatcaggctaatcaagaagagcaactccagaggttagttcaggaaagggtgaaaaactcagcnnnnnnnatacccccatgtgaatggaatggctgagctcatttatttccntagtgnnnnngtg

SEQ ID NO: 3601 - DNA, 526 bp, Glycine max
  misc_feature (507)..(508): n is a, c, g, or t
agagagaaagggttttgtgtgtgtcgaagtggatagttccttccttcaattaatctccgatccgaaaccgaatggggattctgtacgcgctggttggtcgtggatcggtggtgctggcggagttcagcggcaccaccaccaacgccagcgcaatcgcgcgtcagatccttgaaaaaatccccggcaacaacgacacgcacgtttcttactctcaggatcgctacatcttccatgttaaacgcaccgatggactcaccgttctctgcatggccgacgacaccgccggaagttcgttttcccgatccgttctattctcttctcttcagctcaattcctaatcgttttaattcctaattttttcgttttttgtttttgaactgatttttctttagggcgaattccttttgcgtttcttgaggatattcatcagaagttcgtgcggacttacggacgcgccgttcactccgctcagccttacgggatgaacgaggagttctctagggtttnnaggagttctctagggttt

SEQ ID NO: 3602 - DNA, 345 bp, Glycine max
gagaccctggttgaagtgctctacaacatcaacgagcagctccaaactgaggacgtagacatccctctcacaaaggttagacctgtcaagaaagttgcacttgttgtgatcaccggcgaccgcggcctctgcggcggtttcaacaacgcaatcataaagaaagccgaggctagaatcagggaattgaaggagcttggcttgcaatttactgtcataagtgttggcaagaagggtaactcttatttcatccgaaggccttatattcctgttgacaagttccttgaaggtggcactcttccaactgctaaggaggctcaggccattgctgatgatgttttctcactg

SEQ ID NO: 3603 - DNA, 392 bp, Glycine max
ttaatagttactggttagttttactcagattatccaagtaaaacttcagtttttgacgagagaacagcggtaaaaacacttgaataattgtatttaagttctttgtaagtgtaaatcttctcccgtgatggttgatgatggggagtttctgttttttgattatgtggttgtatggtgtcagcaagcgtgttgctggttactgaattattattggtaatgcactgaaagtctgaaactatgcagaatgtcacttttaggggaaattgtccgcgacttcgttttgttagtaccatgatttgacattggatataatggatggtagtactattatttttatttttgttctagttttgttggtttgacccactgtggagtctcttggtgagacttga

SEQ ID NO: 3604 - DNA, 410 bp, Glycine max
aaagttttaacatcctcagtcaattgtgatcgaccttcttatgatggttacaactggagaaaatatggtcaaaagcaagtaaaagggagcgagtacccgcgaagttactacaagtgcacacatcctaattgtccagtgaaaaagaaggttgaaagatcatttgatgggaatattgcagaaattgtttataaaggtgaacacaatcattcgaagccacagcttcacaagcgaaactcagcagcagggacacaaggatcaggggttgtgtctgatggaatagttcaagatatgtggagtaatagtcacagtgagaggaatgaaggcaatgaagttagaattgagaacacaggactgtctatgcattcagattattatgtcaaagttccacggcctaatgattctgctctaaa

SEQ ID NO: 3605 - DNA, 408 bp, Glycine max
ctagcctgaagccacctcaatgctttgaaaaggatgtgacaaaatgtgccaaagcctccacactacagctagctgtgttctatggtgcactttacactctagcagtgggaacaggaggaaccaagcccaacatctccaccataggagctgatcaatttgatgattttcaccctaaagagaagttacacaagctatccttcttcaattggtggatgttcagcattttctttgggacactctttgcaaacagtgttctagtttatatccaagataatgtggggtggactcttgggtatgctcttccaactcttggccttttagtatcaatcatgatattcgtggcagggacacccttctataggcacaaagtgcctgcagggagtaccttcactagaatggctagggacg

SEQ ID NO: 3606 - DNA, 239 bp, Glycine max
atgctgggattatctcttccctcttccctacatggtgtatagtgaaaaggtgaaaactaccagcatctatattagagactctaccaacatttcagattatgccctacttctatttggtggtaatcttgtccctagcaaaagtggtgagggcattgacatgcttggaggttaccttcatttctctgcttcaaaaagtgtcatcgagttaataagggtaatgttccctctatcctttccca

SEQ ID NO: 3607 - DNA, 896 bp, Glycine max
  misc_feature (52)..(56): n is a, c, g, or t
  misc_feature (835)..(841): n is a, c, g, or t
  misc_feature (881)..(883): n is a, c, g, or t
ggtgtcgttacatcaccctcgtgatcgtgctgcggtaacactttcccatcannnnnaaaattgagataatctgcattaggttagaattcaatggaagtgtcttgttgctcttggtattagtagtaggtgttattttcatgccttttttgcccctggtgttgactgttggtgttatttctaaaggtcattgttttgtccatgcgtttttggcaagaaagggggagttgactttttttactttctcaatggggagtgtcctttcaaactcagagtagagtttagagggtagattggttttcgtgttgcataaaccaaaatggattataagaatgtagatgaataggtttttattccatcttattgataaagtgtatagatatgaattgactcaattgagacaactatggcttaggttgctgcagcagtaagagctacaggggactacccagaacgggtgggggaacctccgtgtcaggtatagtttttttccccctttaaatgatttgctctatataaattctaaaaaatttcttcttacatttccaattcaatgtggttattaatacttggtgtttctgatgagcagtattatttaaaaactggaacctgtaaatttggtgcatcctgtaaattccaccatccaaaaaatggaggtggatatttaagccaagctccactaaatgtttacggatacccgttacggccggtatgataatgacacttcttgttgctcttcttctgcctcgtgtaattgacagcaaatgatgcaatgttaaaacatgccttttgtttaaacagggtgagaaagaatgctcctactattgaaaacggggcnnnnnnnatttggtatatcttgtaaattccatcatcctcaaccggcnnnacatcatgccagc

SEQ ID NO: 3608 - DNA, 1444 bp, Glycine max
  misc_feature (494)..(507): n is a, c, g, or t
  misc_feature (509)..(509): n is a, c, g, or t
  misc_feature (514)..(517): n is a, c, g, or t
  misc_feature (519)..(524): n is a, c, g, or t
  misc_feature (527)..(533): n is a, c, g, or t
  misc_feature (536)..(553): n is a, c, g, or t
  misc_feature (557)..(571): n is a, c, g, or t
  misc_feature (573)..(573): n is a, c, g, or t
  misc_feature (579)..(583): n is a, c, g, or t
  misc_feature (590)..(592): n is a, c, g, or t
  misc_feature (596)..(603): n is a, c, g, or t
  misc_feature (605)..(622): n is a, c, g, or t
  misc_feature (628)..(634): n is a, c, g, or t
  misc_feature (639)..(642): n is a, c, g, or t
  misc_feature (644)..(650): n is a, c, g, or t
  misc_feature (652)..(657): n is a, c, g, or t
  misc_feature (659)..(695): n is a, c, g, or t
  misc_feature (698)..(698): n is a, c, g, or t
  misc_feature (700)..(713): n is a, c, g, or t
  misc_feature (715)..(715): n is a, c, g, or t
  misc_feature (717)..(717): n is a, c, g, or t
  misc_feature (725)..(732): n is a, c, g, or t
  misc_feature (734)..(735): n is a, c, g, or t
  misc_feature (737)..(738): n is a, c, g, or t
  misc_feature (740)..(745): n is a, c, g, or t
  misc_feature (748)..(753): n is a, c, g, or t
  misc_feature (755)..(756): n is a, c, g, or t
  misc_feature (761)..(761): n is a, c, g, or t
  misc_feature (764)..(788): n is a, c, g, or t
  misc_feature (790)..(797): n is a, c, g, or t
  misc_feature (799)..(802): n is a, c, g, or t
  misc_feature (804)..(805): n is a, c, g, or t
  misc_feature (809)..(817): n is a, c, g, or t
  misc_feature (819)..(820): n is a, c, g, or t
  misc_feature (822)..(827): n is a, c, g, or t
  misc_feature (829)..(829): n is a, c, g, or t
  misc_feature (834)..(834): n is a, c, g, or t
  misc_feature (841)..(848): n is a, c, g, or t
  misc_feature (852)..(862): n is a, c, g, or t
  misc_feature (864)..(866): n is a, c, g, or t
  misc_feature (870)..(873): n is a, c, g, or t
  misc_feature (875)..(880): n is a, c, g, or t
  misc_feature (883)..(885): n is a, c, g, or t
  misc_feature (887)..(889): n is a, c, g, or t
  misc_feature (891)..(891): n is a, c, g, or t
  misc_feature (895)..(900): n is a, c, g, or t
  misc_feature (903)..(906): n is a, c, g, or t
  misc_feature (908)..(911): n is a, c, g, or t
  misc_feature (920)..(953): n is a, c, g, or t
  misc_feature (955)..(961): n is a, c, g, or t
  misc_feature (963)..(963): n is a, c, g, or t
  misc_feature (967)..(967): n is a, c, g, or t
  misc_feature (972)..(977): n is a, c, g, or t
  misc_feature (979)..(995): n is a, c, g, or t
  misc_feature (999)..(1000): n is a, c, g, or t
  misc_feature (1004)..(1008): n is a, c, g, or t
  misc_feature (1012)..(1016): n is a, c, g, or t
  misc_feature (1020)..(1020): n is a, c, g, or t
  misc_feature (1022)..(1027): n is a, c, g, or t
  misc_feature (1031)..(1038): n is a, c, g, or t
  misc_feature (1041)..(1048): n is a, c, g, or t
  misc_feature (1050)..(1058): n is a, c, g, or t
  misc_feature (1061)..(1066): n is a, c, g, or t
  misc_feature (1075)..(1079): n is a, c, g, or t
  misc_feature (1083)..(1084): n is a, c, g, or t
  misc_feature (1087)..(1102): n is a, c, g, or t
  misc_feature (1111)..(1128): n is a, c, g, or t
  misc_feature (1130)..(1130): n is a, c, g, or t
  misc_feature (1137)..(1142): n is a, c, g, or t
  misc_feature (1144)..(1160): n is a, c, g, or t
  misc_feature (1162)..(1167): n is a, c, g, or t
  misc_feature (1173)..(1177): n is a, c, g, or t
  misc_feature (1179)..(1186): n is a, c, g, or t
  misc_feature (1189)..(1205): n is a, c, g, or t
  misc_feature (1207)..(1212): n is a, c, g, or t
  misc_feature (1214)..(1215): n is a, c, g, or t
  misc_feature (1217)..(1237): n is a, c, g, or t
  misc_feature (1240)..(1240): n is a, c, g, or t
  misc_feature (1242)..(1255): n is a, c, g, or t
  misc_feature (1257)..(1258): n is a, c, g, or t
  misc_feature (1260)..(1262): n is a, c, g, or t
  misc_feature (1265)..(1285): n is a, c, g, or t
  misc_feature (1287)..(1293): n is a, c, g, or t
  misc_feature (1296)..(1309): n is a, c, g, or t
  misc_feature (1312)..(1315): n is a, c, g, or t
  misc_feature (1322)..(1323): n is a, c, g, or t
  misc_feature (1325)..(1328): n is a, c, g, or t
  misc_feature (1330)..(1341): n is a, c, g, or t
  misc_feature (1346)..(1355): n is a, c, g, or t
  misc_feature (1357)..(1365): n is a, c, g, or t
  misc_feature (1371)..(1371): n is a, c, g, or t
  misc_feature (1373)..(1383): n is a, c, g, or t
  misc_feature (1385)..(1387): n is a, c, g, or t
  misc_feature (1391)..(1393): n is a, c, g, or t
  misc_feature (1397)..(1409): n is a, c, g, or t
  misc_feature (1411)..(1413): n is a, c, g, or t
  misc_feature (1415)..(1417): n is a, c, g, or t
  misc_feature (1419)..(1421): n is a, c, g, or t
  misc_feature (1424)..(1424): n is a, c, g, or t
  misc_feature (1426)..(1430): n is a, c, g, or t
  misc_feature (1437)..(1438): n is a, c, g, or t
cgtcttgctaaatataaccaggttggtgttgttcattcattacactagttttagttttcattaagcctttttctaaatgttttgagcgctcttggcagctcttgagaattgaggaggagcttggtgctgaagcagtgtacgccggagctaacttccgtacccccgttgaaccctactaaagttttcaagtggaaaaaacctggagatccacacgagtttgagcattgagatttgggtgcgcggtttttggtgtgatatataaggttgatagttggaacattagtcttggtatgataaagaccttgccaataatttgagttctgatttacagagctaggacagttatgtcttaagactttgaaaggtgtttaatgatatttagctttaatacttgaagcctacttacagtttatttccaattttatgggctatccccaaatatttcttactcgttgctaagttatttttattccttgatccgtgatctcaaaacnnnnnnnnnnnnnncntctannnncnnnnnnccnnnnnnntcnnnnnnnnnnnnnnnnnncccnnnnnnnnnnnnnnncnctattnnnnntaaatcnnntcgnnnnnnnncnnnnnnnnnnnnnnnnnntccacnnnnnnntatcnnnncnnnnnnncnnnnnncnnnnnnnnnnnnnnnnnnnnnnnnnnnnnnnnnnnnntancnnnnnnnnnnnnnncntnttcccccnnnnnnnncnncnnannnnnnccnnnnnncnntcctnccnnnnnnnnnnnnnnnnnnnnnnnnncnnnnnnnncnnnntnntctnnnnnnnnntnntnnnnnntnttctntcatatnnnnnnnnctcnnnnnnnnnnncnnncccnnnntnnnnnntcnnntnnncntctnnnnnntcnnnnannnntctcctaannnnnnnnnnnnnnnnnnnnnnnnnnnnnnnnnncnnnnnnntnttantcccnnnnnntnnnnnnnnnnnnnnnnntctnntccnnnnnctcnnnnnactncnnnnnncctnnnnnnnntcnnnnnnnncnnnnnnnnntcnnnnnncacacacannnnntcannaannnnnnnnnnnnnnnnacacacccnnnnnnnnnnnnnnnnnnantcactcnnnnnnannnnnnnnnnnnnnnnntnnnnnnactacnnnnnannnnnnnngtnnnnnnnnnnnnnnnnnannnnnnanncnnnnnnnnnnnnnnnnnnnnnctncnnnnnnnnnnnnnncnntnnnacnnnnnnnnnnnnnnnnnnnnntnnnnnnnctnnnnnnnnnnnnnnttnnnnctccctnncnnnntnnnnnnnnnnnntgctnnnnnnnnnntnnnnnnnnnctctcntnnnnnnnnnnncnnnaccnnnccannnnnnnnnnnnncnnntnnntnnntcncnnnnncttccannctcacc

SEQ ID NO: 3609 - DNA, 356 bp, Glycine max
caataataataataataaataacgaaagattacacggagattgctttcactgaacaaacaggcaaatagcgaataccattacgaattcaatgtaaaagtaataaggtgaattaaataataaatttattaggcgaataaaaatagagctaaaatgatatactactaagcgtcttatacaaactctaaatgaaaaaaaaaaaacccaaaaaaaccccaaaaaaagggaaaaaattttttaaggaaaaaaaaatttttttataaaaccctaggggggggtcccctggacaaaggggggggagggaacaaaaccaataacaaaaaacccgggggggggaaaccctttcaaaagggggggt

SEQ ID NO: 3610 - DNA, 403 bp, Glycine max
tcgccgcagctcaggcagcgaacttcaacatcacaaataactgcacctacacggtgtgggccgctgccgtgcccggcggcggcgcaaggcttaaccctggcgaatcgtggaacatcagcgtgacgaacggcacaacaggaggacgcatctggggtcgaacaaactgcaccttcgacaacgcgggacgcgggaagtgcctcaccggcgactgcgagggtgttctggagtgcaacaaaacaggtacacccccgaacacggtcgttgatttcgcgttgaaccagtataacaacctcgacttctacgacatctccctcgtcgacggtttcaacgttcccctgcaggtgaccccgacctacaactgcagttccgttaaatgcgccgccgacatcatcggagagtgccc

SEQ ID NO: 3611 - DNA, 376 bp, Glycine max
gtatcagcattgcatgttttgcaggaaattagaagtggaagctcaacagttagcatgttttcattcccaccgttgaagataagtggttcagaagaagaaacatggaagaaaatccctgttctggaacaagcagccaagtaacctgctgggttacgttgctgagtaatgtagagggatggctattttcccatctatttttcttctcttaaatcggacgcctctgttatgcacgccttagatactaacacagatgtaagatgctaaatgtaaagatggagttaattttatagaattataggttccatataataaaacctctggattttaaagaagttatgttttgacattttgcggacgcacgtattcagtaagtaaa

SEQ ID NO: 3612 - DNA, 365 bp, Glycine max
agatgctcctcctactagtgcttttgcttattcggcacgaaacaacaacaacgttgctcctccacctcctgttagggtggtgaaggttgaaggtcagagtggtatggagcttcagcttgctcctcctcctggatgggaaaaattaactgctggaggtggagctgttaaaatcaaattggagcctgtagctagctagggtcttaatctcttatcaagggtccagtagttttagtactctgtttaattgttattcatagggtcagattcaatcttcaattgtgtttatggaccacttatacggtctatagtgcttaattaattgggtcttgtcttcattgttcgccttctctcgttgaataaataca

SEQ ID NO: 3613 - DNA, 353 bp, Glycine max
aaaccaatgcatcttatcagggtctacgtgcaaccaaatctgatgtgcacaagaaaatccaaggaggagaaaaaccaaaagaacgcatgacaaaaagaccttcagtagctgccagaaaggctaaagcaaaattgggcaaggagagtgatctaccaaaacaagcagggatgaaacgcaagcttgatagtcgtactccagacagcaccctacgtaataggaaagtaaaaaagaacaggtagcatgtttcttatgtaagggatttgttagctctggttagaatttggctctaatcgttgatagtgaaaatagtttgtcaacactggcatggttttaaggcaatgttctcagcagac

SEQ ID NO: 3614 - DNA, 265 bp, Glycine max
gttgaggaggatggctctcaaaacatctcaaccgttcaagaagcagctgatttaatagagaaactgattcaagacaaaagtggagctagttagttaggaggtgaacaattctagggaaaatccattgagtgagggcacaagtgtaactgaatgaggttaattattcagcccattcactggccctttttttgtgcttacgcgtattctttagcaagctttttttggtgactttgttcaattttctatttgatgcaagaggtcaacc

SEQ ID NO: 3615 - DNA, 739 bp, Glycine max
tgactactgcatagaatgcagatgttggacatcctgctgatgatagcaagaaatctccaggacctgcactgagccagtatcttagagttcccttcttgcattttgatgctgcagttagttgtattagaatgctgtgaagcactgatcgagaaaagggagaggatatctttgctttggaggctgaacttaggaatctgtcaaggtgaacatccaactcatagaggtatctggagaggacaaacaaatataaacaccaaaataagagacaaatgggtttcatatgcaaaaaaatctgaaaattcaaagtaacaagactgttagaaacatactctttttcacatctgtcttgttagtttaaatttatcaaaaattacaatatcatgagagagattcatgaaataaagtgagacctacaaaagcttgcgatttctaataaatttcaaccaataaagagaaaatgttaaaagggtgtgtgttccagagtgcattgctagcatttctcttcaaagtaaaacccaatgctttgttacatacatgcatatcaaagtattgagttgtatagagaaaataaaaaattagcattacctacccatctagaacaatagctgtatcaaacacaccatgccctctgtgaaccatgtgatcatcaatggggattaccatcattgctggatcaagtatgatacctccataaatactagaatacatagctgggtatggtggtttctcccctgaactc

SEQ ID NO: 3616 - DNA, 667 bp, Glycine max
  misc_feature (660)..(662): n is a, c, g, or t
gccaagatttgagagggctcctcctcctcctcctcctcccccccatctaagttaccgtgaaggacggccacgcgattatgacactctatctggctcaaaacgtccttatactgatatagtaagtattatttctaaacatgtattttaatagtattgttttaaatttcatttatttctctttttgctaaatgaaattccttttacttgaatttctcatcaggatgatgttcctcctcggtatgataccagtgctcgccaatcaagatctcgtttaaattatgactatggaggtagtgcttcacagtatggagatgcttatggtgacaggttagtttcttctaaacacaaggtttttgcaatctccttgctccaatcctgttgttctttagtaacttattcctcacattttggtttgtagacttggaagatctagtcttggatatagtggcagcagaaattctatttctagtcaagacttacatggtacatatggcagtcgacaaggcatgagttatggcggaggtggacacatataatctgaatgttatcttaaagttaaacatcagatgttatttgcttagtgcttacatcttagtgtgtttcatgtcaggttctcttggtggtagtgatggtggtatgtactcatcaagttatggtggnnntaaaa

SEQ ID NO: 3617 - DNA, 383 bp, Glycine max
aggctgagatggctcattcttttttttcctctccttatatttcatccgtatatacatgaagcagcgcctggcacactaatgtagtgtttattctcaggtcacaatatatgtttttgactgtcttattaatggtcataaaaaactatcagtgtaaataagtttgttttctgtattttccgatcataaattttcgtccaagggcaggtaatggttgacaagtggggaacttcttcacggtccttccctttttactttctgaaagaatgatgtcgttactttgcaactttatatgatagtaacattttagatttctttagctaagaataataattaaaaaaacctacaaatttcaggttctaataggagaccagaaaccgatgtta

SEQ ID NO: 3618 - DNA, 1068 bp, Glycine max
  misc_feature (1059)..(1060): n is a, c, g, or t
cctcctgccctctgaagtctcccctgagccccagcttcctcctaaagaaagagaaagacgagtgaggcattgtgatttttggtcgtacctgaattatatttagcaaccatgaaagttgttttaatgcttcctttgttatcaaaggttcctatgacaaggcttcggaaacgagttgctacacggctgaaagattcccaaaacacatttgctatgctgactaccttcaatgaagttgatatgtaagttttgttgattgtcaaattgtagcattagattttcatattgctcaagctggatgttttttccccgatgtgtgcatcaaaattcactattactttatttggtgatggttctaatggaacacggttgtctaaatttaattaagttctcaatccatggtctgtcctctacagctatggtacattggagtcattacatttctgtagatttttcttggtctttgtgagatcaacaaacctgttatgcattctctcaaattcactattatgtattctctcccttattgctctgctcttaatgataggactaatttgatgaagctccgttctgattataaggatgcttttgttgaaaagcatggagtcaaattggggcttatgtctggctttgtcaaagtatgttttctaattactgaaatataaactagctgggctttctcctttgatttcctcatactttttatggtctccatgttaggctgctgtcaatgcactccaacatcagccgattgtcaatgcagtcattgatggtgatgatattatatacagagattatatagatatcagcatagctgttggtactccaaaggtttttatcagccacctttatcttttctcttttactttgtttatgtagagaaatcaatcaatcattatactatacttttgatgaaacttagccatttgcgattgacttatgtcaactattgtcatggctatggagctaatttacaagttatctagtatatagtgtctaatttagcaattttttacatggctatgaaaattaaaagcatgcatgttgtatttgaacaaatannaccctcaa

SEQ ID NO: 3619 - DNA, 361 bp, Glycine max
tctgagctttttggagaatcaacagattgtgtatgagaaagagacgttggagaacatacacaagtcagtgatagacagtgcgtatgaagtgatcaagctgaaagggtacacttcatgggccattgggtactctgtggctaacctggcccggtcctttatcaggaaccagaggaagattcaccctgtgtctgttctggctaaaggcttttatgggatcgatggagaagtgttcctgagtttgcctgcaatgattggtagaggagggatactgggtgtgaccaatgtgcacttgaatgaagaggagacacagaggcttagagattcggccaagaccattctcgaagtacagactcagttggga

SEQ ID NO: 3620 - DNA, 401 bp, Glycine max
aactattatctctttggatccaatcccggcataattagtatctgtggagcatttgcggctattgctggtatgtctgtttacacctaccttaatctgaagcagcaatcaaacaagatatttcctcgacaggccacccttctaccaaaatctaaactaagcaaagaaaatggaacttcccaaaattgacattacagtgatgaaaatgtctagcaaaattactaatactgcattatatgagatgataattaaccaatcatttttcccttctgtgatttctagattccaatctgaccattttggatgttgatggtttatgttcaaatacaatatattattaaagccgtactaggatacaatggttctattacacataggcaactgctgctcaagaacaacatgca

SEQ ID NO: 3621 - DNA, 782 bp, Glycine max
  misc_feature (730)..(730): n is a, c, g, or t
  misc_feature (739)..(741): n is a, c, g, or t
  misc_feature (751)..(751): n is a, c, g, or t
  misc_feature (763)..(764): n is a, c, g, or t
  misc_feature (773)..(775): n is a, c, g, or t
gtgatcatcaccaccatgaccatgatcattcccatgaccacaagcatggtacctattattttgcctcgagtcagagctgtttgaatgccattttgttcttgtttgtagcactagtcacaatgcactggttgcttctcaattcattctgttgttgggaataaaaattattgttttgtgtacagaacaccatgatcatcactctcatgatcatagtcacgatcctggtgtttcatctgtcagcatagtttgtgaaggaagcttagaccttgagaaggttagacattgacatatacttaatgctaagtgtatcaatttctcttttccatttggatgcttcgggaatgccttttattccagatgtttatgtacatgtaaaaactaaaaagtcaatgttggcatttgcatactaaaaggctacctttttcaggctaacatgtggcttggcaccttgttgcttgatcgtagagaagacatttataggatgaagggccttctgtctgttcaaggaatgaacgagagatttgtctttcaggtaagtttaaattccttaaaaatttccacgtctcgtctatttattgtttgttattatccatcaatcaggtgaacattttctctcctttgcccacatcgattctgactatcattgtttatgttcagtttcgtagaattaaacatagttttttatgtaacagggagttcatgacatatttcaaggttcacctgaaaggtngtgggggcnnngatgaaccanagggtaaacaannattgtattnnntagggaa

SEQ ID NO: 3622 - DNA, 222 bp, Glycine max
ctaatcttctagcatccttcaagtcctagtttcactgcaaggcttagtactcaactctaagccttacttcaatgaagctgggtatgataagcaggttggaacagccgaaggagagaaaaattcattgtcatacaatgagaatacctttttacttaactgcaagactatgatgtatcttatgaggaaaccccccaaggtgattataaatgacgtttataagat

SEQ ID NO: 3623 - DNA, 767 bp, Glycine max
  misc_feature (762)..(763): n is a, c, g, or t
gtgctgctggtggggaattttttgatgcttgggaaggtaaattgagctagtttaactgccaattagttctttgaaattgagcgtatgcatgtagagatgtgctctccaatagagtttgaaattgggtgtaatgtgaaggaccattttgctttaccttttattattattattattttattttttttacttttgatttccttttttctctgccttttcttcatgtcattgtgtgtgggcattgctgcagtgataaaaggcatatcctgttttgtcaattgatttatcagttttagtgcttatttggatactgatcagatgtgaggaagagaggatcagtagaggttgtggaaatatttcatgatatagattatcttggctcttttttcctgtagagctctcttctgacggtgggactcaaaattcacatcgtgatattgaagctgagttgcgtgaaataaggttgagtctattgatggagatagagaagcggaagcaagttgaagaaacccttgacagcatgcaaagccactgggagagacttgggcaacggttatctcatattggaattgttttgccttcagatcttactgctgagggtgggcagctgagttctgatcctatggaagatgtatgtcagcaactttacattactaggttcatatcaaacactattgggagaggaattgccagggcagaagcagagattgagatggaagctcaattacagtcaaagaactttgagattgctcgactattaaaacnncttc

SEQ ID NO: 3624 - DNA, 394 bp, Glycine max
atgaatgaaattccacgcaaaactccacaaaagccaccttctttgattcaagaaatcaacaccgagttttcaaaatcccattttgttttcccttccttttttcctatataaaccaaccttttaatttccttctgaattaatactccttgatctggtgtgaagatggacactactgactgggaagtcctttcttatgatggcctttctgattttgatgactatgacttgtgcacctcaccaaaattcaagaaagcctctgaagcatcaaggaattttcatccaagggtgcctaaacagattcttcatattccaattcaattggaaccgagaattgggaaggccccagatgaagggtcaatggaagaaaacactaaggatcatcatcgtgttgagg

SEQ ID NO: 3625 - DNA, 326 bp, Glycine max
gtagcgggctcatacgagaaattcatctggggcttcaccctccgctcccaatcccaaaccctaacccctctgttttcttatccttcccacctctcctccatcaaatccgtcgccatctccggtcccgtcgttgcctccggcggcgaggacgacaccatccagctctacgacctcgccgccgccgcctccctcggctccctccacacccactctgccaccgttaccgccctctccttctacgcccctccccacctccccttcccccgcaacctcgtctccgccgacgccgccggcaacgtctccatcttcgacgccgatggcttcgt

SEQ ID NO: 3626 - DNA, 862 bp, Glycine max
ttatcatattccaattccaacagaaccaaattctgctagctagctagtacgtcaaaggaaataaaataatatggcattcagcgggacccaacagaaatgcaaggcttgcgacaaaactgttcacttggtcgaaggtttatctgtcgatggggctgcttatcacaagaattgcttcagatgcagccattgcaatggccttcttgcggtacgttaaggagcatttaatatattatattgaataattttaattactttaaaaaatgtgttattaaaacattagaactagtgcatgtgcccgtacaatacaaatgtatgtttgatttcataaatttgtattgcatccttgagaaatatccttaagagactgcatggagtctgaaatctgaagctttatttctatattttgtggtgtttttcattacagataagcaactactcatccaccgaaggggttttgtactgcaaggtgcactttgagcagcttttcaaggaaactggcgcctaccccaagaaatcccagtcgtgtaagacacttttttttactcttgtacaaaaaaattatcacaacagttgctttgttttgtactatttttgggctaataaatcgtaattttgtttcataattttcaatcagctggaaagcctccactcgagctggtatgtattattctaccgaaacaagacactttttatttatttgcttgagctatatttgttgtcaaaataattaattcagttagtagtaaattttatgtcttcaactagtttcaatattgacatggttttttcatgaattgttttatcaactacagaatagagcaccaagcaaactttctgccttcttctctgggactcaaaaaaa

SEQ ID NO: 3627 - DNA, 405 bp, Glycine max
tttgtgtgcatcacgaaggtgaggttgaaatgaactttgcttttttgaccttttaggaaagttcttttgttgcagtaatcaattttaattagttttaattgacactattacttttattgtcatctttgttagttttattgttgaattgagtgcatatttcctaggaaattctcttacctaacattttttatacagatctatgctcttggctcttgcccttattcttggccttgtgttggttatttgtctacatatttattgactggtcgatgagacatgtcacaattcttgggcttatttgttggtctaataaaaggagtgcttattgaaagatcaagacggagattcggttttatataaataaactaaagatgacatattagtgtgttgatgtctcttcaggaa

SEQ ID NO: 3628 - DNA, 381 bp, Glycine max
tttggagccagagaaagaagagttatctttcaaaactaaatctttctgggatgtggcagtgccctcctattcagaaattcacctcatggaagacaagagcaaacgtgatggcggaagcgagagttcaagtagtaaaactgtgaagccaggtcacattaatgttgtcgctgccggtctcattcttctattgtctgtgttagttggttttctgctattcgccctcaagggttgagggttttgtactgggaatttctcacctccagggacacacattcgcttagtttacaacattttatacttcaaaatgatacaagggcagatatgaaaaagaaaaaaaaaaaaaaaaaaaaaattttttttccctttttggtctttttttgg

SEQ ID NO: 3629 - DNA, 525 bp, Glycine max
  misc_feature (386)..(388): n is a, c, g, or t
  misc_feature (390)..(390): n is a, c, g, or t
  misc_feature (392)..(395): n is a, c, g, or t
  misc_feature (397)..(400): n is a, c, g, or t
  misc_feature (404)..(404): n is a, c, g, or t
  misc_feature (406)..(408): n is a, c, g, or t
tattatccttcttttgcggttcctatggatacagcttcggggattgggggaggttccgatactctgaagaccgtgaagtactctagggttttgactaacgtgggagctccgggaacgtacaaagcttcggtgatgtcgttgggggattcgaatgtgaagactgtggtggaaccgaatacgttgagtttcacggaattgtacgagaagaaggactatacggtgtcgtttacatacacttcgatgccgtctgggacgaccagcttcgcacgtttggaatggacggatgggaagcataaggttggtagtccaattgcgttcagctggacatgatgggctgtggaaaatgtatgacccaaataaaagggcccactcaagtgttgtaggcnnntngnnnnannnntcantnnnatttgagtctaacctcttttccccatgcagttttctcttcatatccacagctaataacatgaatggcctctttgatcagcattgagggatcagcagattcaggaagccctccattct

SEQ ID NO: 3630 - DNA, 860 bp, Glycine max
  misc_feature (39)..(43): n is a, c, g, or t
tatttctgaggcatcaccaaatgagtggcagaacaagcnnnnnactgtaccatccatgaggacgcggactaaggtacacattgtcagccttgtatgaagggaaataatctgagattcctttcatattttaggagcaaagtcaaataatgtaaaagggtaggaaattggtcattttttaagaattatggttaatggtatttttgtaggtaggtaggagtcaagattgtcacattctctaaccaatttttttccttcaaatttcactttcaatttttaatgaagttatagtggtttcttagttgagggatatgctaactttaatattcttgagaaggtgcaaatgcaaggtgttgctgttggtcgtgcgtttgacttgaccacattgagtggctatgatgatctcatagaagaactcgagaaattgtttgagatcagaggagagttgcattcacaagacaaatgggctgttactttcacggatgatgaaaatgacatgatgctcgtgggtgatgatccatggccgtgagtaacatgatttttgttgccaactccactttcaatttcttgtttcattgaaccacaaattaagtttaatttgcaggcactatcaatataaaaatattttactctgtcaagtggtaaaaaataattgcagatatggattttaaggtagttattgtaaaaaataataaatttatcatacatgttaatttatgatcatgggagaatgtaattttttttaatggtcataggggaaactattttctcctatttatttattttctcgtgccacctaacatgcagggagttctgcaacatggtgaagaggattttcattgttcacgggaggactgaagaag

SEQ ID NO: 3631 - DNA, 763 bp, Glycine max
ttatggagatgcagatcatcatcatcctagtataaagtatactccctagtgggatccagacaatggaagaaattaaaccatctttgttctctctttgctgattattactgcgaaacaagtttaaagtcaacaagcataaaccctcgtgcaactgctcagtgctttaccctacaattaacaaagtgaacttgatgttagtgtcttgtattataaacaaaattattggataaattattattttggttctttaatgtataaaaaatataatataacaattatatcatattttataacttaaaagataaattgatctccaaatttaataatttaatgtaaaattaatctttaaaaattatagttttataacaaaaatgatcatctaaaatttgaccgttggatgtaattattgccacatatttatgcattcatgagttaaatctaaattattaatttttcaaagattgaattgtgaacctgtttgaggaccataataattatttattcctagattatttgttaacagaatacatcacattattaacgtatatttatagtaaggaggagagagggtgaatgtgagtgatcttacgtgttgcaatcaatggtgggggatatcttgtagggcaagttgaccccgcatttgctagggagagctgcaagggttgcaaggttgagtccaggcaagctcaaagcagtggttttgaggcacctacacaccccttgacgatctggggtggttttggcttccttgtttatgctccta

SEQ ID NO: 3632 - DNA, 420 bp, Glycine max
cccttttccccaaatctttaatcccccaatcccaccccctcattcccaacatcaggcccgggctccggcccaagcctggcccatccccttccatcctcgccgtccacgccgccgagcccgccaaaaaccccgtcgtcaccgacaagcccaagccccaagcccaacaatctgcatccccggccgcggcccgtgcaaccaaatgggccgtggacagctggaagtccaagaaggccctgcagctgcccgaataccccaaccaggaggatctcgaggccgtcctccgcaccctcgacgccttccctcccatcgtcttcgccggcgaggcccggacactcgaggagcacctcgccgaggccgccatgggaaatgccttcctcctccagggcggagactgtgccgagagcttcaaggagttcaatg

SEQ ID NO: 3633 - DNA, 447 bp, Glycine max
tttgatgctatgacttttttaaatgcaaagaagggattgcccatggaggcagttgttgagcaggttcgtgatggcagtacactccgtatctatttgctcccggagtttcagtttgtccaagtttttgttgctggaattcaggtatgtgccaaattctgttgctattgctatttgctaccatctttattcgcacatgcagctaattgttttacctttaccgcagtctccacaaatgggaaggagagctgcacctgaaagtgttgttgaaccagagttgacatctgatgacaccaacggagatgttcctggggaacctcgagccccacttacatctgcacaaaggcttgcagtttcaacatctgctgctgaaactgcagccgatccttttgcacatgatgctaaatttttcactgagatgcgtgtattgaatcgagaagttcgacttgt

SEQ ID NO: 3634 - DNA, 400 bp, Glycine max
ttatcaacaacgctgcctcctcgtttcttctattttgactttcaaatcgcgtgcacttctactttccttcccttcccttatcgtctctgcaattgtcaatgatcttcagtcttcgctttcccattcgtttttgaactattcctcttttaccttaaaacacacacacacaccaaaaataaaataaaattaaactaaacaaaattgttctagttttgtagtaccttgtaagttattagatcacacacttcgcaccaaaaacaaaacctaatttcttcaattgagcctcgattcttccgctatttgttcaaaggtgagtccaaactcataattcaaggttttgcagcatccaattgttaattgatacattcagctttgataatattctttgtttttttttttt

SEQ ID NO: 3635 - DNA, 477 bp, Glycine max
gcgggtatcttgtcatcaaacttcttcatgtcttcccagggtccatcaccaactccaaccagaataatagaaaggggatatgaactggaagcaaaaaagtagaaaaccaaaaattaatggttgattaagaatctgaatgttttgttttaatctaactgttacaaaatacgagggagtaaaacattagggtgatctctataaatagatgggacctcaaacaatccatataagtaaatttatcacctcgtccaactcaaaaataaaagtcattaggtttggagatccttcttacttatatattgttcaacttatccatattttttcaatgtgatgcactccaacactaacatcatgattagatttctcttaatgttgaggcttacttcctttatgtttgataatttgttttgtttttttagatagttttcattttataacaataaacaattaatctcataagcatcttgggttgcttta

SEQ ID NO: 3636 - DNA, 1008 bp, Glycine max
aagggtccagaaaatgggggtgtagctgcttacattgatgagcgtgcctacactgacatcttcctctccagccgttgtgatttaactgttataggtcaagagttcaccagaaatggttggggatttgtaagtatctctcacatgttctttacaatttacattggttttttttctcttttcttttccttttccttctataagaaataactgtaactacatgttttcccctcaagtatttctggtctgtgtgcattgctgccagattataccaactgctaatgtcaatggactttattactgggtaaacagggataggattgcaatctctgacagaaacataacttgcctgcaaaatttagaacaactgcatatataataagggttttgttaacatgtggcttaggacacattaaaggatgaaaatagcatttatcactcattttaaagaagaaaatattaattatgctttgaatgtctgagatattagataatttatgctttgcatcaaatagtttctaaggcagaggttaccaatacccatataatacttgcatgcaatagaaatgtcaccctagctgttcttttcttactattcaataactcccccttctctttatatcctaatctatttactactcgaatgaattgaattcaacttgttactcttaactgggaaaaagagttgaaggaaattactttttaattttatacattttgagttcaagattgttggttcccatatttggcagcttatggtaatatccttaatttttcttcaggcctttccacgggactcgccattagcagttgacctgtcaactgccatattgcaaatgatagatagtggagatttgcaaaggatccatgacaaatggcttttgagtagcgcttgcttatcacaaggtgcaaagtttgaagtggaaagactccaacttaaaagcttttggggcctctatatgatctgtgggcttgcctgcttgcttgcactcttcatatatcttatacaga

SEQ ID NO: 3637 - DNA, 447 bp, Glycine max
tctcactctcacactcttctaccgcgcttcctttctttcccaactcccaagtcatcaaaccctcgcaaccgcgtcgcagtctctctccaaaccccacgcgctcaatccgccgcgtccgcttctccctccgcctccttccacggcctctgctacgtcgtcggcgacaatatcgacaccgaccagatcattcccgccgagtacctcaccctcgtcccttccaagcccgacgagtacgagaagctcggctcctacgccctcatcggcctccccgccacctacgccacgcgtttcatcgaacccggcgagatcaaaaccaagtacgccatcgtcatcggcggtgccaacttcggttgcggctcctcccgcgagcacgcccccgtcgcgctgggcgcctccggcgccgccgcagtggtcgcggagtcgtacgctaggatcttctttcggaac

SEQ ID NO: 3638 - DNA, 350 bp, Glycine max
gcgagagaaggaatttgagcgtgctttcttcagagagttctggcctgaaaatgtgtaaacgagaatcaaatgatccatattgtgtcagcatttcctcttgcattactttcgttgtactggtgatgatttcagaaattgtgcaaggtggatcttcagggatataggaaattgtgaaaggcgttttgcaaacagaaggaattcgaacacctttatgtgcaaattttcttcacctactatttcgtttagtgggggaaaacctccttaacctgggttccctaaacaatatattatttttgggcaccttggtagaaatactgtagctctgccgtacacatgtaaagccatgaaca

SEQ ID NO: 3639 - DNA, 419 bp, Glycine max
tgcagcagaaaacaatagaggttgtgtatgatgttggtggtggaagaattgggtttggtgctggtggctgcaagtgattaagattaaacatatgctttgggctagttagagaaaaatcaatcttaattggctctaggctttcataattattgttgttccttttattgcaaagtgtacgtaacagtggcaatagaaaaaaaaggaaaacaaaaatgtgggaattaaatataatatagtttgtagcatgaagaagaatggaggggtgaatatatgactctcaagccgtgcgattgcttgcaattgtacatatgtaaggtggaaaaaaaacttaaacttgtccttgttattaattaaatgtttgttgaataaagcgaaattaaaggtcttgctttgggaacatcactatcgtcaccatttgc

SEQ ID NO: 3640 - DNA, 363 bp, Glycine max
atctcaatcccgaaaaccatttcactgatcccctacccctccccctccctccaacaatgttccgacacccttaaaaaatcaaaacctcaaaaaccaaaaaacatcaaaccatgttttccttccctcacaatgtcttcctacccatccttgtctttccaatcattatttgttgctgctccgcctccttgttgggtcggagcaatgcgacgacaatctacgaggtcctgagcgagcacgggctgcccatgggcctgttcccccagggcgtgcgggagttcgcggtgggcgaggacgggctcttctgggtgcgccttgacgaggcctgcaacgccaagttcgagaacgagctgcattacgagcaaa

SEQ ID NO: 3641 - DNA, 392 bp, Glycine max
ggagcagtggttctcctcttcttctttaagctgttcaatcccattcgccacgcccatcttttctctaaatagcaatactagttatgagaacagtgctggttatggaaactggattggacctaccctgcacacattccaatcccatgcaaaaccaagtctctttcaaacgccaatatttggaatggaatgagctcatgcacgaggtgggatgagaatctgtgcatataatgatgaaaggggaagggcaatagtggtgatggtgttttagcatgcaaaagaagcaaggacgaactagtacctttagctgatgcagtatttgaatgagttggactgacaagtcataatttcatgagaagcgtagctatacctagcagcagctgacactgtacaaa

SEQ ID NO: 3642 - DNA, 366 bp, Glycine max
tctcttctcactctaagcattcttcctaagaaattgagaaaaccccaccaactgagaagcctcatagtggccaaatccaatggcagtgactctgctgatgttcctgatcgtttgatttcagcactttgctacttttaccctttctttgatggcatacagtacggaaagtatgtaatcacacagttctaccctgttcaagccattgttcaaccattggttcctgcaataagagttttcaagagcttcccttttaatggattccttgtgtttttgaccctttattttgttgtggtgagaaaccccaatttcagtaagtatgtgaggttcaacactatgcaagccgttgtccttgatgtgctcttgatt

SEQ ID NO: 3643 - DNA, 719 bp, Glycine max
  misc_feature (615)..(618): n is a, c, g, or t
  misc_feature (653)..(658): n is a, c, g, or t
  misc_feature (711)..(712): n is a, c, g, or t
  misc_feature (714)..(715): n is a, c, g, or t
tctgcagccattatatacaataatttcctacatacttgatttatacatccatatattttacaaattcagtaatcttttttaatccaaaaaaagaaaattatgacttttgaggagctctttatcagaaacgtatatacttaggcattaattattcttatactgtattttaattctgtaaacccacgaaataaaccttaattaactgtttaattttctgaaggatgtttgttgagtcatgcaagcgtctgcgaataatgaagggatcagaagcgattgggcttggtatgcatcattatatcttaagcttaattaattacatctagctactttttcttttcactcatggaaatcattgttttgaaaactaatcaataatacatacatgccattaatttgttggctattctaatgtgttggcgcgcatctttttatgtactttcagcgccaagagcaatggaaaaatgcaaaagcagaagctgaagcgggcctaatacaatgttcaatgaaatcccgtaccaaagtggacctatatatatatatatatatatgaagcacttcagcgagactatggagcggagtgttgttagcttgaatgtgtctggtgttttttgtttnnnncgtatatagattcaacttttaattttaaggagccnnnnnngggggcatttgtaatggacaagaagcaataaacttaacctatatagtctggcnngnnatta

SEQ ID NO: 3644 - DNA, 680 bp, Glycine max
  misc_feature (670)..(671): n is a, c, g, or t
catttgtgcagtggcttcaacaagcagatattaaagaagagtatgacctgcttaacttcaaatctctatatttaaaactggaatcattttcttctcttgggattttggttttgacttttgttagtactgtatatcagttacatattgatgtcagagccagatcatataattgtcaaacctatacccaacttagccagagatgggctaggagctgcatttcctttcttttatattgagcctaagaagtatgaaactgtgctaaggaagtacttccctgaggagaagggaccaataaccaatattgatccaattgggaattcacctgttattgttggaaaggtatatgtcaatgagttttctttgataataatgaatactcttgatttcggtacacttttctaattttgtgtggaaaaatgttaggaattcctcaagaagattgctcccacatggatgaatgtttccctggcaatgaagaaggatcctgaaactgataaagcttttggatgggtgcttgaaatgtaattttattgttttccttctctaatccataataccctttcttaaaaacttgactttttaatgtttttcttttgtatcattgatttttaggtatgcttacgctgttgcatctgctcttcatggtgttcgtaaatctgctcttcatggnnttcgtaaaa

SEQ ID NO: 3645 - DNA, 933 bp, Glycine max
  misc_feature (927)..(928): n is a, c, g, or t
gagctcgtgaattgaatccatctttggccaatatggtggataccaaggggaacactgcactgcatatagcaacccggaagggtcgtctacaggtaaaaaaactgctttccttttctgttttctttcttaagaaagtaactgataatgtattgttctatgtcaactgaacttgtgctttttattttagacattagattctagagttcctcatcatccaagactatgaacaacaaaatagatttctttattagctccagaatactaatatactatgtttctgtgatacttcagaaatggtctggttttactaacattgattaacagatagtaattaaaatttaaattggagattatttcaaaggtagatgcttgtctttcttgtgtcctggttagtataagagaaatgaacttcaaagtttaaacttacttattcagcgcctgtggtggctgtgcactgtgtgtcactagtgtcatacatgtgagcataatcaattgatatggtaaactgagggggcaaaaatctaataacttgtacaaactgcttttttttgtttgttacttaagttttacgttgtttttaaattttaataccctcaacaatttgccctggtccttgcttaacttcttctgaattgattagcttcagctgtttgattatgttctgcaaccatagcaagtaaacttaatgcttttgcactaatcttgcaggttgttcagaagttactagattgcagagaaataaacacagatgttatcaacaaatctggagaaactgctttagatactgcagagaaaaatggtcgtttggaaattgccaactttctgcaacatcatggagctcaaagtgccaagtccatcaagtcacctactacaaacacggcccttgagctcaaacaaacagtgagtgacataaaaagtgaggtcatnnccagc

SEQ ID NO: 3646 - DNA, 580 bp, Glycine max
acgtgttacctcatgtgattgcaaaataacatacctattttctgcttaaagtcaaactaacgctagtttatgttgccatgggttctccagatttcactgagaaagaagtgagtatgatgatggaagcaggtgctacagctgttagtcttggacctcatcgtcttcgggttgaaactgccacgatagcacttttggcaactgtcatgttatggtctgactcacagcaaatttcagtctgttgattcctcagtgtaggtaggccagacatgctcaagttttagaaacaataaatatatattttgttttactttacttctctgttagatataatttattataacggatataaactataaagaattaaaggttgtggagatcattgccttttctaattgagagtattcactgtgtctatcaattgataaatccaactgtggcaagagaataattctaagctctttcaatgtgtcgcctggcataaccagcatggattctttatttgcaacttcgggtataaccactggtagtcttattgctaatactttgtttggtgtttggttgtcctgttgaagctgagaga

SEQ ID NO: 3647 - DNA, 596 bp, Glycine max
  misc_feature (563)..(563): n is a, c, g, or t
tgagagccagttgtaacgacacctcccgtgtagttgttgctaaccaaaacgaccccacgccccatccccagtacaaatcaggtctcaacccctcgcccccaatttcctgtcgcctcccccttcttcgctcccacccttcgttgacctcctattctcccctcatcggagctcaaatctccgatcccttcatccatatcgcttcaccgcaactttctcttcatccatcgcaaggttagattcctcactcctctactacttccatttctagggttcctacttcaaccctagttcactcctaatttctcagaatcactccttcttcttcgatggatctaatacgcctgtgtttgtttcagatctagttgaatctcaaccgcgctcctccgattcgaagctccactcactcaaatcctcttcaggtatcgcggctcgttgattttgtttagatttgtttcctcgttcgttccggatttgtgaggttttgagatctgaaccgtttccgcgtgttgttgttacagatctggggggtttgattgcgattctcactctgctgctcggatttntcgtctgagatgtcgatttaccgaaaggcgatc

SEQ ID NO: 3648 - DNA, 326 bp, Glycine max
ctctgcatcagagcatgttggtactgagaatacaatgcacggtggggtacttcctatggatgagaaagcattgtctgggcttcaagcacggatggaaagattgaaaagtggatctcttgaacctctgtaaaggtaaagagaaaaaaattccttactatagtcagagacattattcccattgatgcagtggcatacaagcatgtcgtggtcataattttcaatacgggtgggtatagatgagaaatatgtataataatcaatcgaagctattatcgcctgcaaactatggaactgtgacgttgcagagcgtcggaggattagttgct

SEQ ID NO: 3649 - DNA, 337 bp, Glycine max
catgaggtcgatgatcccctatatctgatgacattgaccatcccacagctttttctgaagccattgcaggttatgtgggatgctaccttgtttggggtgtttaatgaaaacttccccttgtacataaagcatgaagatctgtctgaaattgcacacggtggtcaatgtctcagcatatctgttatacagttgtggattctgtaagtcaatttagattattgttaattacctaatttattgttttaccttcatgcataatttactttgtgttaacaacaataggcatatgactgagacaagtatgcgagccgggaatatcgatatgtatggattcctc

SEQ ID NO: 3650 - DNA, 1288 bp, Glycine max
  misc_feature (398)..(398): n is a, c, g, or t
  misc_feature (406)..(415): n is a, c, g, or t
  misc_feature (428)..(428): n is a, c, g, or t
  misc_feature (430)..(430): n is a, c, g, or t
  misc_feature (437)..(439): n is a, c, g, or t
  misc_feature (441)..(467): n is a, c, g, or t
  misc_feature (472)..(473): n is a, c, g, or t
  misc_feature (481)..(485): n is a, c, g, or t
  misc_feature (487)..(492): n is a, c, g, or t
  misc_feature (496)..(496): n is a, c, g, or t
  misc_feature (502)..(525): n is a, c, g, or t
  misc_feature (530)..(533): n is a, c, g, or t
  misc_feature (535)..(549): n is a, c, g, or t
  misc_feature (551)..(565): n is a, c, g, or t
  misc_feature (567)..(569): n is a, c, g, or t
  misc_feature (573)..(580): n is a, c, g, or t
  misc_feature (582)..(589): n is a, c, g, or t
  misc_feature (592)..(614): n is a, c, g, or t
  misc_feature (616)..(618): n is a, c, g, or t
  misc_feature (620)..(624): n is a, c, g, or t
  misc_feature (626)..(629): n is a, c, g, or t
  misc_feature (631)..(632): n is a, c, g, or t
  misc_feature (636)..(640): n is a, c, g, or t
  misc_feature (642)..(643): n is a, c, g, or t
  misc_feature (646)..(646): n is a, c, g, or t
  misc_feature (651)..(657): n is a, c, g, or t
  misc_feature (661)..(667): n is a, c, g, or t
  misc_feature (672)..(675): n is a, c, g, or t
  misc_feature (678)..(691): n is a, c, g, or t
  misc_feature (698)..(700): n is a, c, g, or t
  misc_feature (702)..(716): n is a, c, g, or t
  misc_feature (721)..(731): n is a, c, g, or t
  misc_feature (734)..(759): n is a, c, g, or t
  misc_feature (761)..(771): n is a, c, g, or t
  misc_feature (773)..(783): n is a, c, g, or t
  misc_feature (785)..(785): n is a, c, g, or t
  misc_feature (787)..(787): n is a, c, g, or t
  misc_feature (791)..(791): n is a, c, g, or t
  misc_feature (793)..(802): n is a, c, g, or t
  misc_feature (804)..(821): n is a, c, g, or t
  misc_feature (823)..(824): n is a, c, g, or t
  misc_feature (828)..(834): n is a, c, g, or t
  misc_feature (836)..(844): n is a, c, g, or t
  misc_feature (850)..(854): n is a, c, g, or t
  misc_feature (859)..(859): n is a, c, g, or t
  misc_feature (861)..(874): n is a, c, g, or t
  misc_feature (877)..(882): n is a, c, g, or t
  misc_feature (884)..(890): n is a, c, g, or t
  misc_feature (892)..(893): n is a, c, g, or t
  misc_feature (896)..(899): n is a, c, g, or t
  misc_feature (901)..(902): n is a, c, g, or t
  misc_feature (906)..(915): n is a, c, g, or t
  misc_feature (922)..(930): n is a, c, g, or t
  misc_feature (935)..(957): n is a, c, g, or t
  misc_feature (965)..(970): n is a, c, g, or t
  misc_feature (972)..(976): n is a, c, g, or t
  misc_feature (978)..(979): n is a, c, g, or t
  misc_feature (987)..(996): n is a, c, g, or t
  misc_feature (1001)..(1005): n is a, c, g, or t
  misc_feature (1007)..(1010): n is a, c, g, or t
  misc_feature (1012)..(1034): n is a, c, g, or t
  misc_feature (1037)..(1040): n is a, c, g, or t
  misc_feature (1043)..(1046): n is a, c, g, or t
  misc_feature (1048)..(1062): n is a, c, g, or t
  misc_feature (1065)..(1090): n is a, c, g, or t
  misc_feature (1092)..(1141): n is a, c, g, or t
  misc_feature (1143)..(1143): n is a, c, g, or t
  misc_feature (1145)..(1147): n is a, c, g, or t
  misc_feature (1150)..(1171): n is a, c, g, or t
  misc_feature (1175)..(1179): n is a, c, g, or t
  misc_feature (1181)..(1183): n is a, c, g, or t
  misc_feature (1187)..(1193): n is a, c, g, or t
  misc_feature (1196)..(1202): n is a, c, g, or t
  misc_feature (1204)..(1207): n is a, c, g, or t
  misc_feature (1210)..(1214): n is a, c, g, or t
  misc_feature (1216)..(1223): n is a, c, g, or t
  misc_feature (1225)..(1233): n is a, c, g, or t
  misc_feature (1235)..(1249): n is a, c, g, or t
  misc_feature (1251)..(1257): n is a, c, g, or t
  misc_feature (1259)..(1264): n is a, c, g, or t
  misc_feature (1266)..(1266): n is a, c, g, or t
  misc_feature (1272)..(1279): n is a, c, g, or t
  misc_feature (1281)..(1284): n is a, c, g, or t
aaagtagattggtcagtaaatggaaatgagttaggtcgattgcagagatcatcatcatttgagcttggaaacaatggggaggagcctgatctatcctgggttcaatcccttgtcaaggaatctccgtccgagataaaagagaagttgacaggttctggccctgttgcatctgctgatggaccgagttcaaatccaaagtcaaatccgcaagttgagtctgttgatcattctgttctaggagcctggcttgagcaaatgcagctggatcagcttgtagtctaatcaaatttgacccattccatcttgtgataggtatttaatttcacaacgtattctttttgtcaatttttttgggtggagcaaggagagggaatgtaatgatactgaagcgaattctnggaaacannnnnnnnnnttacaagagagtncnaccgaannngnnnnnnnnnnnnnnnnnnnnnnnnnnntttannctctagcnnnnncnnnnnnctcnccattnnnnnnnnnnnnnnnnnnnnnnnnaaaannnncnnnnnnnnnnnnnnntnnnnnnnnnnnnnnntnnntccnnnnnnnntnnnnnnnnaannnnnnnnnnnnnnnnnnnnnnnannncnnnnncnnnngnncacnnnnncnnccncttcnnnnnnntccnnnnnnntctcnnnnccnnnnnnnnnnnnnnccttctnnncnnnnnnnnnnnnnnnccacnnnnnnnnnnntcnnnnnnnnnnnnnnnnnnnnnnnnnncnnnnnnnnnnncnnnnnnnnnnnananctcncnnnnnnnnnncnnnnnnnnnnnnnnnnnngnntccnnnnnnnannnnnnnnngtatannnnncaaantnnnnnnnnnnnnnnctnnnnnncnnnnnnnanntcnnnntnntttnnnnnnnnnncatcatnnnnnnnnnatctnnnnnnnnnnnnnnnnnnnnnnnttacattnnnnnntnnnnntnntttaaccnnnnnnnnnncattnnnnnannnncnnnnnnnnnnnnnnnnnnnnnnntcnnnngcnnnncnnnnnnnnnnnnnnnccnnnnnnnnnnnnnnnnnnnnnnnnnnannnnnnnnnnnnnnnnnnnnnnnnnnnnnnnnnnnnnnnnnnnnnnnnnncnannncannnnnnnnnnnnnnnnnnnnnnaccnnnnncnnntctnnnnnnncannnnnnntnnnntcnnnnntnnnnnnnntnnnnnnnnncnnnnnnnnnnnnnnngnnnnnnntnnnnnntnttcacnnnnnnnntnnnnccca

SEQ ID NO: 3651 - DNA, 490 bp, Glycine max
ttattcctagctacgcacgacacagacactggtccacacagccaagaatggtagatccagctactgaattggtgccaccaccatcttcacccaccaattcatccatttcctcctctgatcttgacaccgaggtatcaccttctccaaaatcaaactcatttctcatttttccttcctaaactttcatctttcttctcttctgacttttcaatatcgatagtctacgggatcctttttccatgacagaagcaccacactgggcactcttatgggtgtcagcttcccagctattaccttcagagcctccgacccccatccaaattccgccaccgccaccgccaccgctgctgccggaggccctcgtagggctgcgggctccaagaagaagagggcgatcgcggtggcggagaggcggaggaggtggtggtggctgtgcagggacggtgacgcgaggccggcttcgctcggtgagtttctcgaggtggaacaa

SEQ ID NO: 3652 - DNA, 609 bp, Glycine max
cagctaccttgagagggatgagttaccatgtctttgttgtttatgcttatgctgttgctgctattgttctcattcctgcaccctttatctcccaaaggtacgtggttgagtagttcacttgacttatgatattgatgtctgtctcattatatgctcctgctgcagatcaagagtgcttcctccgctcagtttccccctactacgcaaaattggtcttcttgggctaatagggtgggtacatgcaagaaatgattttgactatcccctgatttaattaacacttctctgaattgcaggtgtgcatctcagatcgtgggatacactggcatcaatttcagttcccccactctctcctcggcaataagcaacttggtgcccgcttttacttttttgcttgccatcattttcaggttcttttttctcaaaatatgagctgggtgttgctaactgctatgttttggaattgtggactactcgtaagtgtcatgatctattttattttaggatggaaaaggtgattgtaagaaatacaagttgccaagccaaggtattgggtaccatagtatcaataaccggagcattcgtagtgaccttctacaaaggaccacc

SEQ ID NO: 3653 - DNA, 346 bp, Glycine max
actgggtgttcgccgaacatgtatcatgctgatggaatgtctatgtgatttcctgagcaactcaggttgtgtttctaatgtaatttcagaagatatcaaggaccgggctaaggcagttgctgaagaatggaaacccagattggatgctcttgacatggatgctagcaatgtgaattccttggaggctcatgcatttttgcaacttctagccagttttggtattgcctctggttttaatgaggaggagttatctaggctaattccaatggtatctcgacgtcgccaaactgctgatttatgtcgttgccttgggttgtcagagaagatgcctggtgtcattgaagtt

SEQ ID NO: 3654 - DNA, 665 bp, Glycine max
agctatggtgctggagatagggtaggacaggatgactgcttcaatgtgggcgtccagggcattgggcccgagattgtcctttggcaggaggtggtcgtggtcggggtggtagttcatttccttcacgtcctaggtttggagctgctggtggacatggggatcgcctgggtggtgaacgtgatcgatacgttgatgatcggtatgatggaggacgttatggagatagggatcgttttgataaccgtgactacaaatatggcagccgcgaccgctatgctggtgacaggtatacaactatacatatgtttgtggttgttattaaattactgctctggtggtgcttttgccatttttctaaaaaaaataaattcttacttcatttaattgataatatggcaattacaaagactctgattgcataaagacttgatctgatgatcacttaatctgatttgcctttgagtagtatgtgttctttcttcataaataaaatggagcagtacctttattggatattccatgagttctatgtatttatcattgtcaccatatttattaatgaaaaactgtgtaggtatccaaccagtggagatcgatttgcaagtgatcgatatggcgctggctcagactacccacaaaatggttatggcaaggaaagagggtat

SEQ ID NO: 3655 - DNA, 850 bp, Glycine max
  misc_feature (806)..(808): n is a, c, g, or t
gtgaccatcgcatacaaccatttcggagagggacttatccagagaatgccacggtaatatttattgtcacttttttgcattgaaacccttttgtttccctttttctccgtgtgtgcgccttgaatgcaaataaatgttaacacaagataggttggtctggactttggagtagtaggctagctacaaccctctttggtgcattaattttgtttttaatctttctcattcagtttaaggaaatcacatatttttgtggaagaattagttttaagggaccaaatggtgtagccattagttgaaaccaacaactggatagggctatattgtcccctccaacaatgaagtgtttcaaatcagatgtggaatattattatgagttaacctaacaaaagattggtcatgaataatgcagttgtagacatggatatttccacgtggtgaacaatgactacactcactgggagatgtatgctattggtggaagtgctaaccccaccatcaacagccagggcaacagatacaatgctcctactaacccttttgccaaggaggtacaatagtacaatcaatcaaccaatccatgtgatgctgtaaatttaatcaccttttagttaagcaagtttcgctaactgactgaaaaaaacaacttggtgctatgttaacaggtgactaagagagtggaaacagcagaaacccaatggaagggttggaattggaggtcagagggagatttgttactgaatggggcctatttcactccatctggtgctggagcctcagccagctatgctagagcctctagcttnnnagcaaaatcttcttccatggttgattccatgacttccaatgc

SEQ ID NO: 3656 - DNA, 860 bp, Glycine max
gatcacatgacatgctttgtgtttagaattttagcatacaatttagctcttgaattaatgtattaacttgtgttgaagtgttgatttgattaaagttttcatgattctacaaattgacaatctgctagcaagtttgttgtgcaatactatctcaagtccttattataagaaacaagtgatagtagttttcaaactagtaatgtatgtgcgccttggttagaatctcaatatctatgtcattaccccaagtgaaatatttgattaatgttgtgaactagtttttaattgatgttttgaactagttttcaactagcgatatttgtgcgccttggttaaaacctcactagctatgtcattactccaagtgcaatgatttaccttatcaagttgtcaatttgtgaataatatagtccatctaaaaggattagtttaccaaattgtatgttgacttgcattgttacacaccattttatgattcatgtaaatgtttgtctttcaatttaggtggcaaggctcactgagaaggtgcttggaagagagaaaaatgagagtcacttggaacaggctgaaaccaacggattgcaggagccgctgcacaagtctttggttgattcagcttctgagggtgaagggtccaaagtgacctttgaggcttgtaaacaggaggacattagttcagccaagagtgacatatttgattcatcagaaagcccacaatacactgatggagttcactctgcacttctagagactggtgattcttcttatgtgttcgaacctgatcgatctgatgtgtctcaggatgaagaagataacttgagcaagacccttctgcctcattacatttttcccaagcttga

SEQ ID NO: 3657 - DNA, 718 bp, Glycine max
ggtttggatctcacttcttgtgtggaggaaagaggagccatgcccttcttgctgctagcattggagggaaagttggtgcttctgttagtcctaaaagagttattgtggcagttgctgctgcaccaaagaagtcatggatccccgctgtaaaaggtggtgggagtttcatagacccagaatggcttgatggctcgtaagttcaaccatctatctattcaatttatctcttgtttctcctttctttcttatattctttgttggaaattcaagtatgagtaattagtctcactcacattagtcaggaaatggctcaatgatagtgtattttaaactgtaacttgtttcttatatataggaccagaagtagtatgtcttaaggttttggataaagaaatagagtttgattttcttgataatcatagtcattacattagccagttaagcctccaagagtgtctatagtgttaagagtttgatggattcattttttgttgaatgttgcaattgtaggctaccaggtgactatggttttgacccactaggactaggaaaggacccggcattcctgaaatggtatagagaagctgaactcattcatgggaggtgggcaatggctgcagttgtaggcatcttcattgggcaggcatggagtggagttccatggtttgaggctggagcagatcctaatgcaattgctcctttctcatttggctctctc

SEQ ID NO: 3658 - DNA, 397 bp, Glycine max
tcgatcgcatcatgcggcaaggaagttgcggatctgaaaacgtggtaggtgaaggcggtggaggagactgtttgaaactgtttggtgtttggttaaaaggggatacgctaacagacaaaagaaacaaccacaaaagaggccgcgaagaccaaatgggcttcggtgggcctcgcctcaaggagtcaaagcccgttgttgactttggagctgtaaatatcatgatgaagagcaacagggtttgcaactgaatgaggctctcacctcgccacgtaatcttttaagcaattaaagaaggaataggataatgattagtgaaaaaagaaaaggctaagcgataattattttgggtaaaagaccaaatgcactagcctatgctttctacacatgttgaggttga

SEQ ID NO: 3659 - DNA, 481 bp, Glycine max
gctgcagccaaagcagccatcagagcacaaaaggaagctgagaagaagcttaaggtgatttctttgtttgttgattcatttctttttctcgttccatggttatacattttccaaaacctgaaaactgcttgtaataggaccgtgagaagaaagcaaagaagaaatcaggtgctgcagctgtggccaaccctgaggatgaaccaaaagatgaagttgtcgaggctacagagccagaaaaggttaacgatgatgtccaagtcctggctccagtgaaggaaaaggtccaaaaggagagtggcatcaggtccaggggccgagcaagaggcccagactcgattccaaaagctattattaagcggaagaagtctaacaattacctgatatgggctgcagctgcggctttgctagtcctcctgttggcagtgcttggatacatctatcttttctgaaaagcttagatgtagaaggagctgtgaaacca

SEQ ID NO: 3660 - DNA, 592 bp, Glycine max
  misc_feature (59)..(59): n is a, c, g, or t
  misc_feature (61)..(61): n is a, c, g, or t
tgcaatttctagatcagatttcaaacttttggtggattctccattatatgaacaattcntngaggtaaggggaaagctttcaactttgttcgaaacaaagcaaaacgctggtattactagtcaaataactgatctgagtcaaaaactagtaaatattatcgaggaaggtcagctatctgtttctcctccattatttgatctacaagctcgctttacttctacaatcgaagattttcagaagcaacttgacttgatggtgaagtatgattgggacttcgatcattacttggaagaagatgttcctgcagcggtgaggtgacatcttattgtgttggaaagctataaatcaatcacttattaatattattaacagtaattaacaatcatatcatccgcaataccttttttttacttgttatttacaggaaactctctggctgcatatcccttataagactttttttgttttacctgtacagatagaatacataatgaaacaaagcatgcctaaagatggaaaattgcttgcaattggacactccatgggtgggatcctgctttactccatgctatgacatactccatgctatca

SEQ ID NO: 3661 - DNA, 365 bp, Glycine max
ctcgaaatgtccgacccggaaaacacacccgcgccccaatcggagcaagactcctcttcgccaccgcccgcccaagaccaacccgtcgccgctgacgccaagctcggccccgccggcgtctccttcagcatatggccccccactcagcgcacgcgcgacgccgtcatcactcgcctcatcgaaaccctatcctccccctccgtcctctccaaacgttacgggacaatgtcccccgacgaggcctccactgccgcccgccagatcgaggaccaggccttttccgtcgccgccagctccgccgcctccgacaacgacgggatcgagatcctccaggtctattccaaggagattagcaaacggaggtt

SEQ ID NO: 3662 - DNA, 376 bp, Glycine max
  misc_feature (336)..(340): n is a, c, g, or t
tcgtcgttgccgccttctaccagttcctagagaatcgccgcatccgcctcaagctcatcggcgccggaaatcccttcccggcagagatcgaggccccgcttctgcgacggaagcttgccggaaaccgcgccaaggtgggcgtgaaggtagccggagcgtttctgttcgggctgagctcggcgatcgggtacttgctgatgttgtcggtgatgtccttcaacggtggggtgtttgtggccgtcgtcgtgggtcttgctgttggttacttcttcttcaggaacgagggcgaagattcccttgtcgttgatacttcgtgtgcctgtgcttaaatactgnnnnnacggcatataatgtttagcagaggccagttggatca

SEQ ID NO: 3663 - DNA, 314 bp, Glycine max
gctgacgtggcaacgacacacgtggtcgtcgtctgcgcggtttgtaaagatgagtttggtgttggggaaggggtgaaggtgttgccgtgttcgcatcgttaccatggggagtgcattgtgccgtggttggggataaggaacacttgtcccgtttgtcgctatgagttccccactgatgatgctgattatgagcggaggaaagcgcagagatctgtaatgtgatgatgatggtgatggggttattattagggtcagttttttgactttcagtaatagggtaatggatgaaaacttgaaaaagtatagattttttt

SEQ ID NO: 3664 - DNA, 586 bp, Glycine max
tagttcatttgaatgcattgaaaaagtacacctatgggaagcatattgttgctcgtgtagagaaacttgttgctgctggaggtaattatttcttgcttgcattaccgctacattctctgaatatgtgcatgaataggagatacacacctgaactaccctgccaattatatgcctttagttgcatactttactgtttacttttgatctgctaaggtattacgttacattacgtgtagtttgccaactgggtcatgtaatttgttgcagagaggagaattgctgctcagtctcctcatcctgcttaggtgggcatagaaagttgtttgtacagctaactgaggctagtgtgagctttctcctctcttttcctgcatccggaggttatgtttattcctatctcaatctgtcgtgatgggtagtggccgattggaaataaaaacactatcggttttaatgaagaactgtacattttgtagtccaaagtttatacatagaagaagaatttaagtgaggcgaggctcagatgtgtaatactcacctgatgcccccctgcagcagaggagataaagcgacaatacgagccttt

SEQ ID NO: 3665 - DNA, 407 bp, Glycine max
gaattatatcaccttacctctgatgttttaaaaatcttcatcatttgctccctctccacccttaaactggacatgctcgattctgtgcttctggcgcttttcttgccgtgcctcggcatgagcgccgttttcatcgtctacatgtgccttctctggtacgccaccaaccaccactccgaccccgcgctaccggccaagcctgtctccgacaccggaatctccccttcccagctcgacaagctccccagaatcaccggaaaggaccttctcatgggaaacgaatgcgccgtctgcctggacgagatcggaacagagcaaccggttcgggtggttcccggttgcaaccacgccttccatttggaatgcgccgacacctggctctccaagcaccctctctgccctctctg

SEQ ID NO: 3666 - DNA, 524 bp, Glycine max
atgtttgctgtctttgtaaagtctcttaattctttgtattttagtgattgcaactcttgctcctaacattcttcattcatttcaggagaaagatgaaaagcttgatggcgatgctgcattgaacaaatttttccgcgaaatatatcaagatgcagatgaggatacaagaagagcaatgaaaaagtcatttgtaagtcctggtcataatatattcaaatttttaattcctccctattgtggcatcttctaatatcttgttaatttatattgagaatgccagcaaattttgtcttcactgcatactgcaatgtatacattgcacctgatctcttttctattttcttgtataggttgagtctaatgggacagttctgtctacaaactggaaagaagtgggaacaaagaaggtagagggaagtcctcctgatggcatggagttgaagaaatgggaatattaagacattttctggatcagtgttgcatatatttttatgtgggattattatacttcgtttacttttttt

SEQ ID NO: 3667 - DNA, 853 bp, Glycine max
  misc_feature (795)..(795): n is a, c, g, or t
ccccttttctcttttcccttttgcattttcactaacagtccttctttctatcttagctctcagaaacttcaataacaatgaaggtcggtgttccaatttggtttcttcataattcttcttagatattcatactttgagactcataattcagagttgtagttttaacatgtgcttttgtctttgatcgtttctgtactaaatggacttgaaaagtgttgtaaagttctaacaagtatttgattttgctgtaacagaaagttgtgttgaaggtggaagtacatgaagacaaaatcaagcaaaaagctatgaaggttgtctctggcatttcaggtattcaattggatttcaatttctaatgtcccttctctctttggcttctcttctttcaatgctctaaccaattgagaaaaaaaaaagggaggtaatcaaaatcaaaatcaacatgaaattgaaaagacaaaggggggaaaaaaataacaagaaaatattgcaataaaggcaaagattcttttctttcactctattcagtggattagatttagattgactgaaactggtttttgtttcaagaaacaaaactttgatttaacatcaatgattgattgatatttagtgatatactaaaattgtatttggaatattgttgcaggggttgagtcagtttctgtggacatgaaagacaagaaattgaccgtaattggggacattgatccagtaaaagtagcagccaagctgaggaagctttgtcacgcagaaatagtttcagttggaccagcaaaagaggaaaagaaggangagcctaaaaaagatgataaaaaggaagatgacaagaaaaaaatccaccaagcgaaat

SEQ ID NO: 3668 - DNA, 1409 bp, Glycine max
  misc_feature (1324)..(1326): n is a, c, g, or t
  misc_feature (1363)..(1363): n is a, c, g, or t
  misc_feature (1365)..(1369): n is a, c, g, or t
ctcatatttttgcatttcttttattcctcatcatcttattaaacccagacatggcaaaggtcatgttcaagtgaacaggccagtggttcaactattggaattgtaaaacaattgcaaataagggtcataggttaagggtctgtttaggaaaaactaaaatattggcactgaaatttttttgtgatgaaaatgatgtgctgaattgaacatgagctccttcaacgtaaatgtgcgcacatgctcacaacctcacacacacatgctatgttgatgagtataactgtataaactctgggagactatgaccccttagttaaaaatcttctcctgtgtgcttttgttctacaatcaagcaaatgcagtgaagctcaccttttgttccaagtcatattcatggtccattggcatgaagctgggtttcactgcacttgcttattcaatatggttttatagtatttaaatccctatagctggcaatattcaagttgtaaccacagtttaaattggaagcatcaaacatgtaatagcacccctagctggttctctaaaatttgtctaacactgttttactggatggctgtgtcttggtctaagcattttaatatatccgtcacctttgctggataagggaccaattcaatgttccagccccagtcctgataatttcattgtcaataagtattgatatgcctcattgtttcagtaagatgtcaatatttctttgttggtgttattcttttaggtacttggcaactgcatcttctgatcatactgtcaaaatatggaatgttgatggttttaccctagaaaaaactcttataggtaattcatgaagtcttgtgattatcaaatgctttctcaattcccacctcatttcccaaaatttcattttccctgactgaggctggctgtgcttcccaggtcaccaacgctgggtgtgggactgtgtcttctccgtggatggcgcctaccttattacaggtactaacttggcaattttcaatatttatccacttagttattgccattcagctaccagatacagaaacaggagagtaacttcgaagtgatgttatgtaaaaaatttacactgtcactccatgatatttttgacagcaaactagtccttgcattatcaattgtgtatttggacgggctgcaattattgtgcttgatagtcatgtaaacagatctgatctttagaatttgttaaatcatcgttccatctatttaagtcacatattgtcgttgcagcttcctctgatacaactgcgaggctctggtctatgtcaactggtgaagatattaaagtttaccaagggcnnnataaagctacaatttgctgtgccctacacgatggggnannnnncgcaacttcctgagataatggtcataagagttatttttct

SEQ ID NO: 3669 - DNA, 406 bp, Glycine max
ctaatgcggcgtgcaagccaacaagaaccacggcgacgatcagcgagagcaagacgttgaggccgacgtgagtggagacgagcgcagcgacagtgagcaaacccaaaacgcagagcacggttctgtcgtcgagggtttggttgaaaacgacgaggaggccgtcgcgagagaagtagaggtagtaccaggcgacgaggacgaggaggaagacgatcatggagacggggtgccagaggaggctgaggaagacgatgaggagcgtgatggcggcgtagttgaagcggaagtggctcaggtttcttcggacccggatcatggcgtcgtcgtaggagtaggggcaggagagggctgagaggtctagaaactcgcgccatggacggggagtcaccaaggaggtagtggtgat

SEQ ID NO: 3670 - DNA, 310 bp, Glycine max
ttatcatacacgtcaaaaggaagattatcactggctctcatagcagtgtaaatcatgataaacaaaatgaccttggaaatattagaagctttgaatcacacagttcaggttatcaaatggtgttcaacttagtctaatactcgtttctctccacgacaaaggaatgacatgccatatccagaccttgatactgccctttcttgaccctttctattctctcctgtcaaaagcatatctttcttttgactctgtttgattgctatagtttctatacgatcttttatctagcttcctatcataatcttctctt

SEQ ID NO: 3671 - DNA, 556 bp, Glycine max
  misc_feature (527)..(527): n is a, c, g, or t
atgaaaggtgtgtttataataaaaacaattctatttgtttctttgtatttttatttaaaaatatagaaaaaggatattaaccttgttctggttattgcagctgcaatgcttgctgcacagagtattcaattaggcacaaatgatgttgttgtggctggtggtatggaaagcatgtctaatgtacccaagtacctggctgaagcaaggtcaatattgcctttaattcgacactctccttaagattagttcttgtgttgaaataaactgattcaatactaaaagttcaggaaaggatcacgccttggacatgattcacttgttgatgggatgttgaaagatggtttgtgggatgtctataaggatgttggcatgggagtgtgtgctgagctatgtgcagataaccatgcattaacaagagacgaccaggtattttaggattaatttctgttcagaaaggtttcggcaggaccattgtaatcaattttttgttgatgtctctgttttcccctcaggataactatgcaatncagagttttgaacgtggaattgctgccca

SEQ ID NO: 3672 - DNA, 348 bp, Glycine max
tcactgcattcatcggtttgtctctcatgtctgtcattaactttgctacagcagagattggggctttacttattgtcccgatttgtctgatggctagaccattgaagcttgatattcaagctaggagttggagaaccttactaagggcctcttgcaatattgctttaggttttattgtgtttcctccagttgcatttgttttactgaaaggtgcatttgaagatttttatggtatgaattttggtgactattggaactgggtggaatccctttgggtttggaacagtgctacttacctctatgtaggtgttgttcacctaccatgctgggcactgtgtattcacattt

SEQ ID NO: 3673 - DNA, 353 bp, Glycine max
gcggacatttagttcaatccttctctgttgctttcctttactggctctactacgtttcatgatttctaaccccctctccaattattaattaaataaaaccctattatatatctcttacatatttttatctgcaaaaaaaaataatctttttttgttcttgttcttgtttagtgtctgggtcctgcgaactccaagtacaagaagggtcaatttttgtttttctgttaacttttgattactatggcttgttcaagtggaacatcttcaggggcgacgtcgtcgatgcttcaaaataactcaggttcggaggaggagctgcaggcactgatggagcagaggaagaggaaagagaa

SEQ ID NO: 3674 - DNA, 1261 bp, Glycine max
  misc_feature (19)..(19): n is a, c, g, or t
cgataatctgtcgcagganacaaaacaaaaggaaaaagatgattagcattctcacccaggtatgtattcctctcctctaacataatcaatttagggttctgttttttgtttcaattcaaaagtatgaaatttaatggtggtggatttgggttgggaaataggaacggcttctgggagcttcattgggagttgtattgacgggagttgttgtgtttgagcaacgcagatacatctacgcttctatttccgattcccaatctcaggtaccacacgctctcggctttccctttctttttcatattattcctctttattcaagttatccgattgcatagatggattcacagatattcgatagaaaaattaaattagcattattattgactctttaatgaatgagtggaccgtggtgtgtcctgcgggtttgggcctaattctgtgattttttttctccttataatttgtcgtgtcgggggagcaaagtatacatcaatgtaatgtaggtaaatgtgcttttaggagaaaactttatttttagtttgctacaattcaaccttttttcttttgtaaaatcatgtttatggtatgtcggtgtgcatttagggagctgaaacattcccttgagcatgcacttagtcactgaaaccaccacgctgcttccattttttttttatgtagttggttatactgccacacttcactgcatgggaaggattcaaaatgagagatggaattgttcaccatgttcatgtatgtctttgtgcatgatgtgaagtttgctggagaataattatatatgatgagatataagaagcagataaataagtttgtttttttaatgaagccgtgtatatgcatcagcattataccatagcatggtttgtttttctaaattgataaagcctcactcacttttacacacccttgcacaataatttgaacattcatgtgttttacaatacttatttcttatacttgcaagaatttccatctaatttaaactcccacatgcacgagttgcaatatacttggaatactgggcattcaatctatcatgtattgtcacccttgacttaaaaccttttattttgatttgacacttaaattctaacctttcggctttcatgctctattaggttaaagaacctatatttgggaagaagtcacgttctgaatttgcacatgtatggaacaaaactgtggatcagacatttggacctttgataaagtctctcagctcacgtggatggtagaaatgtta

SEQ ID NO: 3675 - DNA, 619 bp, Glycine max
  misc_feature (503)..(505): n is a, c, g, or t
ttctctgtgccaaataggcgacgctgacagagagagctcttgaactacttgctttgcctgatgacggcgttcctaaattactccttgatatcggtaatttaaattttaattcaatttaattaatctctctctcgcttttgtcgaaatttaatggcttatgaatgatcgatgtaggttgtggatcgggacttagcggtgagacaatctcggagaatggacaccattggattgggcttgatatttcagcatcaatgcttagtatgtttatgttttgaaatgttggttgctattcctatttattttgaatttttatatattttttgctaattttatttgtttttgttaaacttggaagatgttgcgggggagcgagaggttgagggtgaccttttacttggtgacatgggccagggatatatactattcacctgatttctgcttaatcagtattattgctgttgcaattgatattcctgctcaatgttattgtgttataatttatnnnataaacttataatactcttctgtgtgtgtgttttggtcataatgtttgtgtgcgatgaatgagttattattgacaaaataaaaatgacatccatgctctgcatcttgccttact

SEQ ID NO: 3676 - DNA, 396 bp, Glycine max
ttcttccgttctattgggatttccaacactgacatgcctaaaatcctaattgctagccataatatgttgttcagaagcttgaacaaatgcctcattccacggtatgagatcctaaagagtgtacttcgtgacaaaggggaagttgttagagctttgaaaaatgccccatttagttttacgtatggtgacatgatgaaacgcttggttccaaacattagggttttgagggaatctggtgtgcctcaaggttccatttcttatctgttgatgcattctaggtctctagcttacagggaccattccaaatttgtggaagctgtcaacactgctaaggaatttgggtttaatcctttgagaagaacttttgtcgtgggtgttgaagttcttgccattaag

SEQ ID NO: 3677 - DNA, 465 bp, Glycine max
  misc_feature (450)..(454): n is a, c, g, or t
  misc_feature (457)..(460): n is a, c, g, or t
ccccgggtcctctcattttggtcacatgaagactatcctggtcctgatcttaggattcattttctttggaaaagagggtctcaatctacatgttgttctaggcatgatcatcgcaatagcaggaatggtttggtatggcagtgcttcttccaagccaggggggaaagagcgtcgtagcttttccctccccaaaacacaagattatagttcactacctgtgtcctctgaaccagatacgaaggaatagaaaataatagaaactaattagagaaaaagtgatgaaacttctggtgaactgcatgaaaaaaatcaggtgcccattaggcgagctggttcattttctttataccaggagtgaattcccaattatttatagatcatggttatatcttttcttatgtgttaatgaattgtttgggaaagaaatgagaggaaacagcgttaaggacnnnnnttnnnnttttt

SEQ ID NO: 3678 - DNA, 280 bp, Glycine max
  misc_feature (195)..(195): n is a, c, g, or t
  misc_feature (273)..(273): n is a, c, g, or t
cccctggcaagggccgagcatatcaagcagtacaaatgtccatcttgcagcaacaagagagctcgaccttgacaacatcatggctaggatgggtggtgactataatcttggcaattttatgactactaatttgtttagtaggtcaagtttattagtcttgctgtgaatttcaggtatattgcttctagatgttantacattaggtatatgagctgctgtcgattcatctaccattaggatatttgtttcataagtggacttgaatgttgtttngttatgt

SEQ ID NO: 3679 - DNA, 971 bp, Glycine max
aagcttctgttccttagtactagtttggatttatgctggattatctaaaattacactcaaatactagatcacgtgaagtaaatgttcataaattttttgtttcactttaagaaattgattctgagttgaagcaattttaggtaactttttctgttgaataaaaaaggtttatgttaagttttattattaacttgctttcattaaaaaaaaacctccaaacataaatcttttcacttcaaaatcaattatgcaaaatctacttcattcataatcaattttgcaaatgtttgtcccaacacacttagtgcgtgtttgtacaagcattggcaaattgattttaaattgaattgattttagttaaattgatttgaaagtgatgtgatttatgtttaagtacaacattttagatccatcgtaaaaattactcaaaggtcctttaacttagagtcaattttggacttagaatcaattctgaattcttctttaacaggaaaccaaacacgaaaatttatcaaaaagccattctccaatgtgaaacaaaacttgcacttattcaaacagcttttttacgtttgtttgtcatggataatcatgtgtgattgcttcttttcttttgtgcaggtttcttcactcaatgacttgctggcatgtgacaaagcagtaccctcacagccagtttcatgggaagtgccagaggagctttctgatctatacaccatatacttgaagagtaatccaactcctgagaatttgtctcgtttgcaatatctgttgggtataaatgattccacagctgctgctcttagggagattggagatagattactcaatactactgcggaggaagagaagtttgtattctagtcttgtgataaaatgtttggcattttaggcacactagagaggctgcaagtccccttaattttgccattttttattttccattttgtttaacggtagcagaaaaagaa

SEQ ID NO: 3680 - DNA, 944 bp, Glycine max
  misc_feature (549)..(549): n is a, c, g, or t
  misc_feature (618)..(618): n is a, c, g, or t
  misc_feature (843)..(843): n is a, c, g, or t
  misc_feature (845)..(847): n is a, c, g, or t
  misc_feature (883)..(883): n is a, c, g, or t
gatgaagcaatgtggttagtggtgactctatctttgaatgcccttcaatagctgattcatgcagacaagttgttgcggttggagttaattgtactgctcctagatttattcatggattgatttcatttatcaagaaggtgcaactttcaaataatactctgctctacactatcaaaatgtgctaattggcaatattgttttgaataacttgtgagttggccttctagttgattgtatactgtgcatgaaatgttctttaactagtgtctttaaggtactcgttgctagaagaccttataaactattctcaagtgagaaatgctaataacactaatttgtccgataacagctcactttatgacagaatttaacactccgtttttaaatagcaggcaacaagtaaaccagtacttgtatatcccaacagtggggagacttatatcgctgagagcaaccaatgggtggtgagttctgcttctctctttttacatggcctcagcttgtttttatgttcatgtttaaccaacttcaaatctaattccagttatnataaatgatacttcctcatcaatttaaatgtttgaacctcatttttgcatgttttcaagtccttgttangaatcttttcattgacattctataatttgcaacgtgaatttcgaaatataatctaaatgaagttactaaaaagcaaatcaacatgcacacattctgcatacactgccactttagtggtgtggacagaacactttttttttgttaaaccacaatgtgctataagaattcgtatatataattctagtttagtatcatcaaattgataacttaaaatttgtcttatanannncaagtggggcagcagagcatgattttgtctcctacntagggaagtggcgtgatgctggggcttccctttttggtggctgctgcaggactactcctaa

SEQ ID NO: 3681 - DNA, 377 bp, Glycine max
ggtgttggctatgggggtgctcagtctcgacaagcccaacagcagtaattttggtagatgaatctcttgctggatcttaaacttcaacttgaggatccctggcttttaaaagtcttaaatcatgaggtcacaatgaattcttccagcagcaatggagtggctcaaagatcaatgtcaatacacaatgggactggttgggttgcttgaatcccagtagtttgcagtacccgctttcctagtttataataagtagtatggttgaagagatactagatgctactttctatttagtatttgtttctgcgtgtagctttaatttgcttgcttatgattttagttgatctggatttgtttgttcttgcagcatttaagcaaaa

SEQ ID NO: 3682 - DNA, 406 bp, Glycine max
tggggaccccagttggagattctgtcacacagttccacaggagcgtttctaagccattgtggatggaactctgtgttggagagcctcagctatggggttcctatgattgggtggccactagctgcagaacaaacattcaatctaaagatgttggtggagaaaatgggtgtggctgttgagctcactcaaactgtgaaaactgtgatctctgggaagcaggttaagaaggttatagagatagttatggagcaagaaggaaagggaaaggcgatgaaggagaaggcgactgagattgcagctcgcatgagagaggccataacagaggaaggtaaagaaaaagggtcttctgtgagagcaatggatgatcttgttagaaccattttatcaccctaggctttgtgatttg

SEQ ID NO: 3683 - DNA, 544 bp, Glycine max
  misc_feature (494)..(494): n is a, c, g, or t
  misc_feature (498)..(498): n is a, c, g, or t
  misc_feature (537)..(540): n is a, c, g, or t
cgaccttgggaagattcccttttgttgccggaatggcactattttgcctccgtccatggatcctagcatgtctgcttcgagattccaaatgcaggtcttcaagatgccgccggcgcttaaccgatcccagcttttgcccccgcagaactggaacataagtggcacactcaaccctgactatgaatgtggccctccagtaagagtgagtcctactgaaaatcctgacccatccggcttaccatcaaacaaaactgtgatggccagttggcagattgtgtgcaacataacaacagccaagagaacatcaagtaaatgctgtgtctcgttttcatcttattacaatgattcagttattccgtgcaaaacatgtgcttgtggatgccccaagaacacagagagaacatgtattgcatggaataactgaatcattgtaataagatgaaaacgagacacagcatttacttgatgttgtcttggctgttgttgtgttgttnccancaagctgccaagtggccatcaaatcttttgtttgaagcnnnnccgg

SEQ ID NO: 3684 - DNA, 392 bp, Glycine max
gattggttgaggggttgaggagctctgatgttgatactcagagagaggcaacagcagaactccgccttcttgctaagcacaatatggataatagaattgcgattgcaaactgtggagccattaacttattagttgatttacttcaatcaactgatacaacaatccaagaaaatgctgttactgcacttctaaacttgtcaatcaatgataacaacaaaactgcaattgcaaatgctggtgcaattgaacctctgattcatgtgcttgagactgggagcccagaagccaaggagaattcagctgccactcttttcagcttatcagtgattgaggaaaacaagattttcatagggaggtctggggctattggaccactggtagaattattggga

SEQ ID NO: 3685 - DNA, 647 bp, Glycine max
acttttctttctctcctcttcctcatcttctctctcctcaccccagccctcatttcctcttcccctgtccaagaccctgaatttgtggcccaagaagttaacaggtaaacccacattgatctcttttactcatgccccccactacctaattgtacgacacacatcttaatgcaatgtccttctagttattaaatgtcacactatttgtttgatgtatgagaatcacgcatattgttaaaccaaccgagttaaacttctttggtgcactttggtgcacgttaggtgcataagcatgagacacaataatgaaattaatgtttttttttaatgtatttatttggtgcaggaaaatcaatgcttccgtagctagaaggaatttggggtacttgtcctgtgcgacagggaaccccattgacgattgttggaggtgtgacccgaactgggagaagaaccgccagaggctagcggattgtgcgattggtttcgggaaaaacgccatcggaggaaagaacggaaaaatctacgtggtgaccgattccggcgacgacgatccggtgacaccgaagccgggaaccctccggtacgcagttattcaagacgagcctctctggatcatcttcgcaagagacatggtgatcaagctgaag

SEQ ID NO: 3686 - DNA, 909 bp, Glycine max
  misc_feature (857)..(859): n is a, c, g, or t
aattcacgctgttcccaccacatcctcctttttgtcgacaacaaggtttctttctctctttctttcatcaaaatctatattttttgcttttgctgttttaccccttcaaccaaatcagttaaagcttgcaatttgtttgtcctctgtttgtaattactctaaggatgaattttgtttctcacgatattaacttgtctttgtattctgatgcaagatctattagtttcgttacccccacaaagttgaattgctgaaaattgccgtgaaaatcgtggcaaataacacccttctgagtaggatcctgttatctgtgcgtttatccacagttgaattttttgtttttcattcttatcccagaacttgatactaccataaagtttgattgttatgtatagttctatcccttaaattgtcttgtttgattgctatcgttttctatatgtacttatagcataaaaaatattaaaaaaacatgtactaacatgaattgaatttgtgtaaattttgtatgtccttgcatcgacatgcttgaaattccgttgttgatgttttgaatgaattgggaaattgctagtattttgctaagcaattaattttgggaatatgattgcggcaggtggatgaagctgctcacaaattcgatgagcatgcaccttctttggccaagcaggttgcaagccaagtcacttgtttggttcaggaagtgacacacaaagctgagaaagtagtgagtgaagctcaatctggaggggcacgagcagcagcaaattatgtagccactgagtccaagcaaattgtgctctttggttcagtgaaattgtggactggtctcaaccaatatccaccattccatgcannngctgagatggcagttcccccagctgcacactggtcagaaaaatacaacaa

SEQ ID NO: 3687 - DNA, 336 bp, Glycine max
gcttcacggtcatcgtgtacaacaagtacattctggatcgcaagatgtacaactggccctacccgatctcgctcaccatgatccacatggcgttctgctcctccctcgcgtacattctcgttcgcgtcttgaagctcgttgaaccggtttcgatgtcgcgtgatctctacctcaaatccgttgttccaatcggtgcactctattcactttccctctggttttccaattccgcgtatatatacctctctgtttcgttcattcagatgctcaaggcgcttatgcctgtcgcggtttattcaattggtgttattttcaaaaaagaggcctttaagaacg

SEQ ID NO: 3688 - DNA, 580 bp, Glycine max
tcgctgcaacaagtttctagcagtcctattgtgactaaaagaacagctctttgcagatcacatgaaaaacactatttttcctcgtcaacaaggatcaatagaatacagttgtcaagacatagactggaacatggacatctgaactatagatgtctccacacacagagatcaaccttattcaatgactggttttggttctttaacggaaaacctgttggtttgatctccaagaaatcttctatctcatgtaaatcaacaggagcaaataatactgaagagaaagaaagtattacaacttatgatgataggtaagagaattaaatatagacggcagtccatctgttacaattttttctgctgtttcctaattctgaacctgtaccccttaattaatgtcttttagttgccaatttattgtatgttaaactttcttatccttttgacaatgacttatgattttgtcaccataaaatctgaggattcaaacttacatattagagattgtatcatatgtacagggcacataccaaagatgagaaaaatgatcacactcttgttgttcatggcttggctgatgctt

SEQ ID NO: 3689 - DNA, 674 bp, Glycine max
  misc_feature (21)..(22): n is a, c, g, or t
ggaaggtatgtatatttattnntcatctttctttgtatttaatttctcttcaattctaagtgagatatcattgtaattgtagttaatcaaatcctcaagcacatttttaattctttgcttttgtgaagattcaaggacattttccaggaagtttttgacacccaatggaatcacaagttcaaagctgcagggatatggtcggtagaaatagaatggcttgtcactttaagcaaacctgtatcacaagtagattgctaattcattttctggattcttaggtatgaacaccgtcttatagatgatatggttgcttatgctctcaaaagtgatggaggttatgtatgggcctgcaagaattatgatggtgatgtgcagagtgatttcttagctcaaggtggatatcccatatgctcacaactttcacttagcttttagttattgactgttttgctgcttctgttgatggatgggccacagtttctagaaactcataataatagtttctgttgaacaggatttggttcacttggcttgatgacgtcagtactggtattgcttttctaaccctttgttgtgtttctctttataatgccctttatttgtttctctctgttcttcctttggtcacatctctagcatggatgttcaagaagctaagtttgatgcaggtttgc

SEQ ID NO: 3690 - DNA, 403 bp, Glycine max
caaggtgtgattgaagtactgaactccaacaagatcatttcatatatcatgttaattttgtaaattggctatttgtgatttgtccatacgtgcttgccccaattcatttttctaatgatttgagcatacccgcaactcttagttcttgaatagcacatttatatgtatttttttttcactttattttctgtacgggcaactcaatgctctaagaacttcaaagcattgtactaggaagaagctcgttatactacattatgagtttctcctttgattcctcattttaaaataataataattattataatttattttgtaaattcatttcctatgtagttccagttagttttttttttttggaaaaaattacccgggcccccgaaggaagggtaagggaaaaaaa

SEQ ID NO: 3691 - DNA, 396 bp, Glycine max
aaacaaaaaaaaaacctcacttagatcacatagatcaaacaacaaaacacagagttacctaaattgaacctaccccagtaggttctacaagctcttgatcatggcctcagcatcaggggaggcaccaccaccccaacccacttcaacagaagctgctccagcatcaggctcttcagctccagccatatcagcagcaccaccacaacccggaggatcatcgccggcgcctccgagccgctacgaatcgcaaaagcgtcgagactggaacacgtttctgcagtacctgcagaaccacaagcccccattaacgctggcgcggtgcagtggcgcacacgtcattgagttcttgaagtacttggaccaattcgggaaaaccaaggttcacatcacgggagt

SEQ ID NO: 3692 - DNA, 1012 bp, Glycine max
  misc_feature (949)..(956): n is a, c, g, or t
  misc_feature (981)..(982): n is a, c, g, or t
  misc_feature (988)..(992): n is a, c, g, or t
  misc_feature (995)..(997): n is a, c, g, or t
  misc_feature (1000)..(1000): n is a, c, g, or t
  misc_feature (1004)..(1004): n is a, c, g, or t
  misc_feature (1006)..(1008): n is a, c, g, or t
agagggagcaacaacagaagggagaacatgcctttaccaaaggtgcctactttattgggaagatgatatggagcaaaggctacaaggaactgctccaacttcttaaagatcatgaaaaggaattatctgctcttgaggttgatttatttggcagtggagaggactcaaatgaagttcaaaaagctgcagaaaagttggaactagcagttagagtccacccagctcgtgatcatgctgatgctctatttcatgagtaagttccctactgatatgctcacatcatgttttatttcatttcagttataattgttaaaatgtaccaatggtgcataatttggaaaggaaataaaaagaaaaagggaatctgcattgtaatattcaattggatgttaatggaccaaatattgactctaagatttaagccaataaatcacttattactttagtgtaatttttctgatctatatgaggctcctccataccctttagtttttttatacaatactagtattttgatgataatccccttaggtaaacggaaatatgttaagttataacattttttggtgactgttaagttataacatgaaatattacatattgtgaatattaatttgcaagtttaaaaatcattccggtatttgttagaaactgccaatttttgcatgtcttgtcctacttgctatttgttcacttagatgccagtttgtcactttgtcagctgtgtaattattaagattcacctagtttgagtattgcatggctgtaactgtagcagataatggcttagcatattgacattatgccaacataccagcactcatgattaaggaaatcagctttcttcatctttcaccattcttttcttcaaatatttttgtatagtctttttagttatcctattatctgaattgcaattcctatttgacaacgtactgatgggaacatnnnnnnnnctaacacttcatttcctgctttccnngttacnnnnntgnnnctnaatncnnngcac

SEQ ID NO: 3693 - DNA, 876 bp, Glycine max
tgcaggttttattccttacttttttctctttcttcctgtgggtgtgttagttacagaacctatgtttttgtggcatggatttgatttgtctactgaagcattctgtgcagtacttcaaatattgatctagactctagagatgtctttctacttaaatgattgactatgccgtttctttcttggagagtgatacatgctgttgacagacctgtcactacactcttttaacttggatttagattttttgggtgaaagatttagatttagtgtttcattttattcaatgattatgtgttcaagagattcatccctcaaactcaacattcctgcttcccccctttcaaacacagtttgcatgctttcctgccacatgaacaagcaggctttaagttggttaattgttgaaattgcctcttgcttctttagaatccttttttttatatataaatcattgatcgtgacaggacactcacactgttgcatttctttttgtcacaaatacatattgcagttaacaaacaattaaacgataaagaacgtgtggcagctgcactggaaaactcaaaccttctgaatatggttgatgattgccttgctccatcttatgattgaaggaacttttttcctcctccaaatgcaatgaactatgtaggtgcttttatgcctgtcgtagaagttggtcagctttatctgtgcttatgatatttttggttgctggcatattggtcttgctatttgtggttacctcatgcaattcgttaaataggatacgtagttgaaaatgtgatagttgagtaaggttccaaggttctttgatcattagctaaaagaaaaaaattcagctcatgtttcatagattgaacaatttataccgtg

SEQ ID NO: 3694 - DNA, 459 bp, Glycine max
tgtagcatatcctaaccttgttttctctttcagacattatggaattcattgctaattttgagatgatgtatctttttcaggttactccaaaattttgtaagcagtatgcacgtgtaggagatgtcatcaataaagccttactggagtataaggaagacgtgataaatggttcatttcctgatgctcaccatagtccatacaaaatcagcaaaacagatgcagatgttttctcaactgagttgcaaaggttaggtctagacaaggcagcatctgcagcatctgaagcagttcagaagatggatacaaccaaatcaactagtgaagggaaacaaacaaaataataatatagtatagctagagattcacccttttttcgctcgtaggtcccaatgtgataatttagcatgctacaaaatgaagttacataattaaatagaagttgagcagttgactaatgga

SEQ ID NO: 3695 - DNA, 509 bp, Glycine max
tgattgccagcgggttttagatttcatccaacagatgaagaactcataaatcaatacctcacaaagaaggttgttgacaactgtttctgtgctatagccattggtgaggttgatttgaacaagtgtgagccatgggatttgcctggtgagtctctcattttcttgtgttttgatgaattgaatccttatgttatctttgcttttatggtgaattggtgatatctctcacaatcatatatgtttggtttttgaagggttggctaaaatgggtgaaactgagtggtattttttctgtgtgagggacagaaaattcccaactggtataaggactaatagggccactgatattggttattggaaagccacaggaaaagacaaggagataataatggagaatgcactcattgggatgaaaaaaaccttggttttctacaagggaagagctcctaaaggtgaaaagacaaactgggttatgcatgaatataggttggaagggaaacataatcaac

SEQ ID NO: 3696 - DNA, 680 bp, Glycine max
tctcttgaatggaagattccagtaaaggtatgttgcttcactttccttaaacctgtgatatatatctaagtgaataatactgcagtgagaataatggaataatgccccatccaatgaaactttgtttcttggtttgtgcaggttagaggatttgagacccagatggccaaatggatgggagcttgtgactgcatcataacaaaagtaagttatagcaatttgctctttatgtcctctttcatatgttagcatataggctcattggttctattgaaaaatttcaggctggaccaggtacaattgcagaagcattgatcagagggcttcccataatcctcaatgactacatccccggacaagtgagtgattaacttgttaattgttctcctcattgccattcagtctcttcttttatattttgatacagtattgattcttagctggaatgatggtaactacaggagaagggtaatgtgccttatgtggtaaacaatggagctggcgtcttcactcgtagtcctaaggaaacagcaagaattgtggccgaatggttcaccacaaaatcagatgagaggaaaacaatgtcagagaatgcacttaaactggcacagccagaggccgtgtttgacatcgtgagggacattcatgagcttgctgagcaacgagagccagcaaacttt

SEQ ID NO: 3697 - DNA, 395 bp, Glycine max
gaaccgctttccagtcttttgaggtggtcagcatttcctccgtggactccttctctgggcaaccttgcctgtccgatgcagcagtaatgatggcccgagttatgttggggaacggttacgaacccggaatgggtttaggcaaagacaacggcggcataactagcctgataaatgccaaaggaaatcgtgggaagtatggtttaggctataagcccactcaggcggatatgaagagaagcatcgcgggaaggaagagcggtggtcaaagctcgcggtggagacaagaaagtgaaggaagcccgccctgccacataagtagaagctttataagcgcgggtctgggagacaaaggtcaagtggtcgcgatatacgaagatgatgttccgagtacattg

SEQ ID NO: 3698 - DNA, 406 bp, Glycine max
gtggagaaacccgcagaggaacaacaacaacgaagtgtttcatcgtacagaggagtacggaagaggaagtgggggaagtacgtgtcggaaattaggttacccaacagccgtcaaaggatttggttgggttcctatgacagcgccgagaaggcggcacgcgcgttcgacgctgccatgttctgcttacgtggcagcggcgccaaatttaatttcccgagtgacccacccaacatcgccggcggggggaacatgacctcctcccagattcagatcgcggcggcgcgtttcgccaattcggagccccgaaatgagcgttcggatcaacccgtggagtctttaacttcggatgaggaaacggcatcgtttccggtcatttcggatacggatacatcatctcctcctctca

SEQ ID NO: 3699 - DNA, 431 bp, Glycine max
gttaaggtagttgccaaagttccataactaatacagtttgtcagcatgatgaaacagaggaaactcatgaaaatgaacctcaacaagaaagttctggatcggaacttgagaaggtttctgatcaggcaaaatctacagcagaaacaaatggcagtaagctttcagctgcggccaaacctttcaatccaggaatgttgtccatgtctcaccatttaaattcagcttccttcacaagcatgtatgatacagatgttagtcaaggcatgcacgtggagactgtgcttccccctgctgttgctagggtcccttgtgggcctagatcgcctctgtattatagaaccaactatacttttcgcatgaaacatggttctactaaaggtcaaacctctatcagagaaagaagtggatttgggtctccaagaataatgaag

SEQ ID NO: 3700 - DNA, 617 bp, Glycine max
ggaaatcaagttacttaatgaaaagttgcatggtgaagcaagaagagtgaagtcactggagagggagagtgaccggctccggtcagagatttcattattagaggcaaaggttggtggcttggtgctctcataaagcacagtagtgcactattacataatagaaaactcatgtttttaatattatgtcctcttcatttcttatgtatgtcatgtgttactgttgcttacccaaggtgtccagattttggttttcatttaacagtttgactatctacatgctgtttttccttctatagttgggtcatggtgatttttccgctgctaatacaaaagttctgcggatggtgaatacacttactgtcgataatgaggccaaacaaaccatagaggcactgcaaactgagcttcaaaaaacgaaagagaaattaaaagctgttgaagaattgaagagtcaatcaggtatgaaaccttgttagttacagtggatgtaagggtgtaaatgttatgtttcaaaaagagttggtaataaaggcaagagggattggcggaggagaatggcttgaggcttttgaaaatggttcttcaatttgtagtattagtataaatactgaatggag

SEQ ID NO: 3701 - DNA, 334 bp, Glycine max
cttcgtttcgttgagttgaaaactctttttccacattcttttatttcttgtctcacccgcaccatgcaagtgtgccaactactgtgattggtatggcgacacgtgtcccttttgttttgtgcgcagccaccacttctcccaaccactgccttaaatactgcgtggtggcaccgtcacttcctctaccggtttcttcctcctcattaagccgccactctctctctctttccttttcgtcttctttttcttcttcgttgggtttgttgccacttagtaagaaagagggtgtgaagagagtggggagaagatttggtgttgtggccatggcggagtc

SEQ ID NO: 3702 - DNA, 959 bp, Glycine max
  misc_feature (764)..(790): n is a, c, g, or t
  misc_feature (792)..(819): n is a, c, g, or t
  misc_feature (821)..(839): n is a, c, g, or t
  misc_feature (842)..(858): n is a, c, g, or t
  misc_feature (860)..(876): n is a, c, g, or t
  misc_feature (881)..(883): n is a, c, g, or t
  misc_feature (887)..(902): n is a, c, g, or t
  misc_feature (905)..(908): n is a, c, g, or t
  misc_feature (911)..(933): n is a, c, g, or t
  misc_feature (939)..(942): n is a, c, g, or t
  misc_feature (945)..(947): n is a, c, g, or t
  misc_feature (949)..(954): n is a, c, g, or t
ggctgcatcactactgttattaggaccttttctagattattggttgacaaacaaaagagttgacagatatgactacaacactgcctcgttggtaagttctggataatgaaaaaatatttagggactacatcctttgttctcttttgagataatgagtatatgcatatgtagatttacatgatacgtataaaatagtagatggcttgatatgtttaacgtatatgataagactttcatagaaaggtcaatcagattctcatcaatagtttataagtttgagggggaaaatcaacaaaatttaatgaaacacaaacaaatttgagaagagtccgaattgaagaacttaatttggctgtatactcaagtatttactgctctcaatcaaattgtggataaacatgataaatcatgagaactcttatgtcggttgacattttcttaacatttccattcagtgactggactcatctttgtcttggttttgacagattttcatattcctgtcatgcactattgcaattggcaccaacctaagccaatttatctgcattggcagattcactgctgtttcttttcaagtactgggacatatgaagacaatacttgttttaatcatgggattctttttctttggaaaagagggtctcaatctccaagtggtttttggaatgatcatagcagtggccggaatgatttggtatggcaatgcctcatccaagcctggtggaaaagagcgccggagtcacactcttccctacaaacannnnnnnnnnnnnnnnnnnnnnnnnnncnnnnnnnnnnnnnnnnnnnnnnnnnnnncnnnnnnnnnnnnnnnnnnnccnnnnnnnnnnnnnnnnncnnnnnnnnnnnnnnnnnccccnnncccnnnnnnnnnnnnnnnnccnnnnccnnnnnnnnnnnnnnnnnnnnnnncccccnnnnccnnncnnnnnnccccc

SEQ ID NO: 3703 - DNA, 753 bp, Glycine max
agaccatgagctgttgagggtgggattttctttcaatttccacaggggtgcacaaatcactgtaacggtttcatcaatcaataaaatgctgaagctgcatgcaactgacgaggccgtgccagtaacacctggtatacaaatggttgaagtaacagcacctgcaactgctgaaacctacactgaagttgcggctgctgtgtcatccttttgtgaataccttgcaccgtaagtttcttcttgctttctcaattgcacatttttctatactaagtgcaaatattttactcacctagaacctggagctactagtaaccggcaggtttactatattgtgaacttcatccatatttggctaacgggtcatagattgaataactttgtcttgcttgtttggtattgctcacttatgactgtctaaggtcgtcttaccatcatattagaattagttactggttgtcaatttaggtggataaaattagcaaccctttgagtttgcagaaaaataatcatgcttttagaatgttcgttcacatttatcatttacatatgtaactgtttggtgtgaatttcccaggcttctccacctgtcgaaaccaggcatttcaaccggtgttgttcctacagctgctgcagctgctgcatctctgatgtctgacggtgggggtacaacgttgtagtgggactgtactgttatctttataaatgcacacttgacaataacatgtgaaaatttaacgtaggaacatgtgaagt

SEQ ID NO: 3704 - DNA, 384 bp, Glycine max
  misc_feature (300)..(301): n is a, c, g, or t
  misc_feature (303)..(303): n is a, c, g, or t
  misc_feature (305)..(316): n is a, c, g, or t
  misc_feature (320)..(323): n is a, c, g, or t
  misc_feature (325)..(328): n is a, c, g, or t
ggggacacataaactcatactagcagttccaacttcaagtttgttcatactacctcaactccagtatactttggtgttctaaataacagctcaaatccctatggttctagagacaataggagtgatggtccatctttaaaccgttcctcatatccatgcccacagagcatgggaagaatactaatgggtccatgaagttgattacaccacaaatattaaataaaaaactatgagtaacattttgttttcttttctattataaaatgcggatatatcttttatggtgatatcatctattcnntntnnnnnnnnnnnntaannnngnnnntatgtccaatatcactattccatagttgctgtttagtagagttggtagcagctcca

SEQ ID NO: 3705 - DNA, 1070 bp, Glycine max
  misc_feature (1011)..(1016): n is a, c, g, or t
actgtaatttttttggttattatttatctctctcaaatgcatatgcaatcgcaatcaattgcaaagcatttcggatccagagggagagaccctttgtgacagcctgtatcctctccatcgtctgatagattcttcatttttttttccatttctcgcggcaagatctcacactctgcacctagggttagggttttggttcttgcggcatggcgacttcttcgagttcttcgagctggcgcgagggcatgtcctccgacaacataaagggactgtgcctcgctctctcttctagcttcttcatcggcgccagcttcattgtcaaaaagaagggtttgaagaaggccggtgctagtggaatcagggccggtatcgttcattcttcgccaccgtcgatcacttttttgtttttactttgtattcagttcattttccgtgtttgctttaatttttctagggatctggacgttttttcttttacttctcttggccacgagtttttcaactgtctcaaatctctcaagtttacactcgatgcgttgctttgccggcctttttttttctttgttatatcttctcgtcgcattccacaagacaaatagttgtagaataagcatattaggtctcggcatgaggcggaagggaacatttttgtgttctcgattctcatccttaagattttcaccgaactgtttttttggcaattttaactatccttttcttgtgctccttggtatggaatgatgagagatctatacagtttgtgtgacttgagatcttgctttaaatgttagaaatttggtggataaactgtctgctagtttaattttttctttttgtagcaactcatcagtagggaaatcttttctttgatttattataaattagatggatgcttaactctaatgattcggcctctgattggcttgtttacttatatgggtctcttttctttaatttattttatttaatctacaaaatagttgttgcctaatgttaatagtttttattttnnnnnncattgtctccctgattgatcatgtgcaatagtgactaaccatccaaaattatat

SEQ ID NO: 3706 - DNA, 860 bp, Glycine max
gtactaaatctaaagttggacgaaatgtggatccaaggattcagtttttggatcaaaggtttctctttgctggccttaatatctgtaatttccgctctggaacccgaactgggatcgacccgcgtcgtctttcaggtttttctgtgtgaaaatttgcatcaagtttgatccttttttgttttttgtgttcatttataattgcttggattttcgttgaaatcttgaattgagtttcatgcatgcttagtgtttttagtgttgtagacttgtagctatgatctctatctgtgctgtgctctatttagttcttaagaaatagacaagttcaaactgtggatacccatgttgtggatggagaagatctcagttatatatgttctgggtatgagtggaaactggaatcaagtagctcattaagttaaaaatcccatcttgtctatgttctcaaattgatattattttgttgttgttgttatttgttgcttatggtgtgtatcacttaggttcttgtctttttctttatgcagacaaagtatggagatattgaatttggtttctatccaactgttgcacctaaaactgtggaccacatttataagcttgtgcgacttggaggctataacactaaccatttctttcgggtattgttctctggaaacaaagctagtgagcattgagttttatgaagttggtgggtattgtatagctttgtgagtaagtggttttgaattcaatacctaggtggataagggattcgtggcccaagtagcagatgttacaaatggaagatcagctccaatgaacgaggaacaaagaagggaagctgtaaagactgttgttggtgatttactgagtcaaaa

SEQ ID NO: 3707 - DNA, 398 bp, Glycine max
atcgtcgaatcagattgagatcgagatcgagatctgaaatcagatctaaaatgcatgatatcgagatttgtgctaatggtggctggttatggtgagcgaggtttgcgcgggttaatggtgggttggtctggatcgcatgtgggctgtttatagctatggttgacatagggtagattcgagacttggtcgtgttggagtgaggctatggtgcttgatgggtttgtggcggtgcaagggtttgtggttggtggcagatctaagcagtagttggttagggtggtgctgtagtgaggttgatggtgggtcgtggtggttttgggagatgaaaaagaaaaaggttatggatgaagaggtggaatggtgcaacaccgggtgaaagaggttgaagggaagagtag

SEQ ID NO: 3708 - DNA, 419 bp, Glycine max
catgcttgctcagcttgttgagttaaacaggccacccatccctccaatctacatgcagatatttgagcttctattgtcacctgaaacatggaaaagatcctcaaatgttcctgcacttgtgcgtctgctccaggccttccttcaaaaggcaccgaatgagatcacccaaggggataggctgaccaaagtgcttggaatatttgacacactaatccaagcttcaagcacatctgaacaaggattttatgtgcttaacactgtcattgaaagtcttgagtataatgctattaaaccatatatttctcacatttgggccgcacttttcagagagctccagaaaaggcggacagtaaagctcatcaagtctctcttgatatttatgtctctcttcctgattaagcatggtgctgcaaatgttg

SEQ ID NO: 3709 - DNA, 709 bp, Glycine max
  misc_feature (59)..(62): n is a, c, g, or t
  misc_feature (67)..(67): n is a, c, g, or t
caatctttcagttgttcaccaagctcagtatcaaacgcaccccatattttcccgcttcnnnntttanaaagtccaatccctacgcatacatgcacagctcatcaccaatcaataaaaaaccacgtacgtagcatgtaaagtagaactaataaatagcaaatatattctcatgctattcgatgctcaattacgataaattgttacattactaaggacttttacagttttaaatgccgttgattatgactgatctttacgtgatacataataatttttttaatgtatattaaaaaattaataaaattcaattatgtatcatgtagagatttaataacatcatgatatataatatttaattatgtaataatttttctagaaaaacagtaaccatggagggttttttttatcatgtaacattggtacagagtatcgttagtttataacttatctcaataaccatattgagtttatatttaagaaaaaaaaaactttgacatgattgtattaaaaagaatattattaattgaagatgcagtacgtaccctgaatactttctcgtcgtaggaaccaggagaaacctgaagggctctataacctccatcactgaaagcccaagttctagcaacagttaagccatggctagaagcttgttgcaaaacggcagtgaccttgggccttgtggctgggtcaaatgccatgtacattaacc

SEQ ID NO: 3710 - DNA, 378 bp, Glycine max
tctcatggccactccacagtcccacttccgttttctcgctttctcactctctatcatccatatctctctcttcctctccacaaccgcaacccaacaaccgctcctcgaagaacaagacactcccatcacgcacttccagcgctacctccgcattaacacagcccacccaacccctgactacacctccgcggtctccttcctcaaagcccaggcccaaagcctgggcctcaaaacccaaaccctcgagttcgtccaaggcaagcccgtcctcctcctcacgtggccgggctcaaacccctccctcccctccctccttctcaactcccacctcgactccgtccccgccgagcccgagaaatggctccacaatcccttcta

SEQ ID NO: 3711 - DNA, 847 bp, Glycine max
  misc_feature (43)..(45): n is a, c, g, or t
  misc_feature (224)..(224): n is a, c, g, or t
  misc_feature (289)..(289): n is a, c, g, or t
  misc_feature (433)..(433): n is a, c, g, or t
  misc_feature (436)..(436): n is a, c, g, or t
  misc_feature (471)..(473): n is a, c, g, or t
  misc_feature (482)..(484): n is a, c, g, or t
  misc_feature (500)..(500): n is a, c, g, or t
  misc_feature (508)..(508): n is a, c, g, or t
  misc_feature (517)..(517): n is a, c, g, or t
  misc_feature (536)..(536): n is a, c, g, or t
  misc_feature (541)..(541): n is a, c, g, or t
  misc_feature (559)..(559): n is a, c, g, or t
  misc_feature (584)..(584): n is a, c, g, or t
  misc_feature (604)..(604): n is a, c, g, or t
  misc_feature (617)..(617): n is a, c, g, or t
  misc_feature (666)..(666): n is a, c, g, or t
  misc_feature (678)..(678): n is a, c, g, or t
  misc_feature (697)..(697): n is a, c, g, or t
  misc_feature (700)..(701): n is a, c, g, or t
  misc_feature (738)..(738): n is a, c, g, or t
  misc_feature (741)..(741): n is a, c, g, or t
  misc_feature (747)..(747): n is a, c, g, or t
  misc_feature (749)..(753): n is a, c, g, or t
  misc_feature (755)..(756): n is a, c, g, or t
  misc_feature (759)..(760): n is a, c, g, or t
  misc_feature (762)..(762): n is a, c, g, or t
  misc_feature (765)..(765): n is a, c, g, or t
  misc_feature (768)..(770): n is a, c, g, or t
  misc_feature (775)..(778): n is a, c, g, or t
  misc_feature (780)..(780): n is a, c, g, or t
  misc_feature (782)..(784): n is a, c, g, or t
  misc_feature (789)..(790): n is a, c, g, or t
  misc_feature (793)..(795): n is a, c, g, or t
  misc_feature (798)..(799): n is a, c, g, or t
  misc_feature (838)..(840): n is a, c, g, or t
tgaggttctttcttgttttctctaataatacttttgctacctnnngaaaattgagaagattctgtctctaacatttgtgatatttcttggcatgtagaaaccactcattcttgctctctccaacccaacttcacaatctgagtgcacggctgaagaagcttatacatggagcaaggtaaattttcattatatcataatgcttagcaccagaaacatcatatcgngaggtaaatgttaaagcagataaacaatcaaaactcctgtatttgcagggtaaagcaatctttgntagtggaagcccatttgatcctgttgaatatgaaggaaaagtttttgttcctggacaggttaaatttaatacttgttaagtattttcttattcagcagactcacattcccaaagtataggttgactttttttatattgttttcntantatgcaattcaggccaacaatgcttacatatttcnnnggttttggnnntgggtttgatcatttntggtgcantccgcgtgntgtgatgagatgctcttgngcagncctgtgagtacatgcaanactagagagattagatcattcgagncatgataatagatattgcangaaagaattgctngaattgatattaatgcttgttagtagtgaaggaagcacaaacttgggantaaattacgtgngtgcaaaaatgtataaganaannaatgatgaaaaaattgcatgtccatttgataaaaccnccnacaagncnnnnnannatnntnacnttnnngggtnnnntntnnngatannttnnntgnncctttcattttttgcaacagctgaagctttggctgcacnnngtatcac

SEQ ID NO: 3712 - DNA, 349 bp, Glycine max
tgacgaggtggacggcattgtcgtcctcacaggcctcgcggagcgacacgatgctcgggctctccggcaggtggcgcatgatggcgacctcgcggcgcacgtcctcgacgtccacggctgtccggagcttcctcttcgagatgctcttacacgcgagcagctcgcgcgtgtcgcggtcgatgcagaggtacgtcacgccgaactcgccgcgcccgagctcgcggtccacgaggtaccggtcctcgatgttctctttcggcacgccggcaagcaccgtgatcggggccttctgcttggcggcggcggaggcggagccacctccgccgcgcttgccgtggtcggcgttgga

SEQ ID NO: 3713 - DNA, 326 bp, Glycine max
gagggaggcaagggtttgggaaagggaggagccaagaggcacaggaaggtgcttcgtgacaacatccagggtatcaccaaacccgcaattcggcgtttggctcgcagaggtggtgttaagagaatcagtggtctcatctacgaggagacacgtggcgtcctcaagatattcctcgagaacgttattcgcgacgctgttacctacaccgagcacgctagaagaaagaccgttaccgctatggatgttgtttatgctctcaagaggcagggcaggactctctacggtttcggtggttaatttctagggtttccatcggcgtagcagct

SEQ ID NO: 3714 - DNA, 1141 bp, Glycine max
  misc_feature (33)..(36): n is a, c, g, or t
  misc_feature (1083)..(1088): n is a, c, g, or t
  misc_feature (1113)..(1113): n is a, c, g, or t
  misc_feature (1115)..(1117): n is a, c, g, or t
tttgaccttgcttctgcactttgttattattgnnnnttggcctgccactgcttacctgcttttgttttttggcttcaggggcctgctggccagtcaaatgcatgacacagctaaggctattgtcaccaatctcatttccttgatagataaatatggctttgttcttaatggggctagagcttactacactaacaggaggtactccactccactcgtcttgtgcctgttatgctatgccatttgccaaaacattcatttttatgtcagaataataatacctctaactaatatactactccctctacacttatatagaaaaagtaatttttcatcttcaacttaaatataaataaatttaactaattttgattcttttttattcgtgataataagttccaattaagggtatttttaaaaataatcttattttttttattagagattaaaaaaattaaatgatgtcaactaactttctcaattagaatgaaattaattatttttcttataatatgatttagagggagtagtgtactagtaacatgtaacttttgtcctataataaataagtattgcctgactttggtgtttttgtgtgcttatgatttagttgcatgccctttcatacaacgttattaatgccatttattgaattagactttacgaatatcaatttttttctggttttataatttactaatttttttattttcaaacaacttaacgaattgcttgatttcactctcgtcatcttacctttgatatcatgccacattctcattcatatcagcactctgttccttgtgaaataaaactataaaaggaagttattataaataattattgttcttataaactgaaatggtgactataagctttactatgattttatagccagcctccccttttaagcgccatgatttatgagatatacaatagcacgggtgacgtggaattagttaaaagatctctacctgccttactgaaagaatatgaattttggaattcaggtattgcactacaacttttggcctcaatcactttattaactgtggttggatgatatttgtatatttattttctagnnnnnntaagtggtcaagtctaatggtttgncnnnatattttatcttgtagatatacat

SEQ ID NO: 3715 - DNA, 375 bp, Glycine max
gacttttctggcgactgtactgtagtggacctttacttgataatattccattttattttgcattctttcatattggggagaaaactgaagactaataataaggccttgtttgtttgtgtgtgtgccattgtacgtttaagaggccacgttgttttagattcacatctgagcattattatcatggatgggtggggggggagttcgttgctatttcacaatcttgctcttgacattgaggacagtaatatttctgaaacccccataaccaaaaataatgcacatgtgattgattgtacaaaaacaaaatgtacgtgtgattgataatcatcataaatataagggtgaaaatcagggttacagaccagtgtaatgcac

SEQ ID NO: 3716 - DNA, 405 bp, Glycine max
atggttaattaaagggtgggttaaatcagaagatttatagtcatctttgtgccagtggttttttgagtttgggtaaacctaaatacctaatttatttggcagaagcacgtggtttgtatcaatattcatgatttccaacctttgggatactacctctctatcatgattcaacaagaaaaaagatatgcaacatatatacacaaattgtaggcaacaagagggtgcttgtgtagtagtgaaatggaagctgcttccagagaatctaatccaaccactaagaaggtacgtgatgagaaaaggaaaccaaattgatctcttatggctgcttcacgattacaacagggcactttgcatgtttggcacagtgatcactgacacttccaaggagtgccctcttaaagaata

SEQ ID NO: 3717 - DNA, 776 bp, Glycine max
  misc_feature (770)..(771): n is a, c, g, or t
tctgagatcaacaagtttagtcatcatgaataatacagtaataattaataacgacataaatgaggtaattaatagtagattagcaaacaaactaaagcagccaagataagagacattgatgatcaattgaccatcaagttacatcgatgttcctatctgagcaataataattggcaattgcaatcatataaaagaagatcatttacataatccaaagacacgtgtctacatagatactacggaattaagatttagatttaagaggaattaaaaaggaacagtgcaagacaggatgagttaaaaaaaacatcatacaaccaaaataagtgttaaggaacatcgagttatctgtactgtagccaagactccaagaggaaaaccattggtaaaacaattattaaaacatacatacttggctgaacttgagggcgtgttgttcgccggcgagctggaggttgccgctgacgaagacgagcatggcggcgttgacgcctgagggctgagaatcgacggtggtgatggagtgctggcactgttggaagggaagggaggtgagtttggcgacgatgttgtgggagccctggatcttctgaccctcgaaagagagcatggaaccttcctggtagagattggcgagattgttgcggttggtgtcgaaggtggagtagtagtgctccacgaatgcctttgccaacgcgtctggatccatgtcgcttctcgcttctcgcttcactctcacgcacaccaccaccctctcctctctccataanngcttt

SEQ ID NO: 3718 - DNA, 358 bp, Glycine max
aggtatataccgctaagaagctgcaccatgatttacgggcaagctgctaaaatagttacagaatagtaacattcaattttaattggcaatcatatttgatgtctgcctttgagggtgaaaggataattcaggtctgctatcccgtacaactgatcacagtatcaacagaatttttggattgactctacactcaatatacccaggcttcaagtctgcaaagtgaaaataaatttattttgttactcccagatcttgaatcctattctcattaggtttacacaattttgttagttttttttttccttctggcagtaagtcttgatcattatcatggggcgtaaaaaaaaagtccaataac

SEQ ID NO: 3719 - DNA, 353 bp, Glycine max
atagctatgatgtgtgttaaagaaatggggcccgctaggcctaccatgagggaagtcgttcatatgctctcagagcctcctcactctgctactcacactcacaacctaattaatctctagttaattaagttatttgctcatcgatccagaatcacttcttttcaaaataaattaacacagacgaaaactgtaggaataactttcatctgttgtttgtccgaagtgaaacaacgaatcaaatgtgaactatgtatcaaatgtaagataggttttaattaattttgtaatattggtgtcaactgtcaactgtcaagtaattcgaaggattttccccattgtgcatttatcaagaa

SEQ ID NO: 3720 - DNA, 345 bp, Glycine max
  misc_feature (304)..(310): n is a, c, g, or t
acacaacacatcgtaatacggcattccgttcattgtttctttcaactcaactcaactctctcttaccccccacaaaactagcagcaaaatttgaacaaactaccgaaacaaaaacaaaaccaaagcaaaaaccgttttttttttctgttccctcatcctcatctattggattaactgattaatattattagggtcccttgtaaaaagaagattcttcatccttccacacaccccccacaactactgggagagaaaaaaggaaggaaattttgctattttctgagactcttgattttattttatnnnnnnnttttttctgctctgaagaagaaagatggaaatgat

SEQ ID NO: 3721 - DNA, 390 bp, Glycine max
ttctcccttctctcctcttctcttctcttaataatcgcaaagttttctttttttctttttcatattttcttgttctttctattgttgttctgtgtcggtgtttggatcgaattgtctttgattcgagagctgaacgcagagtggggctccgtttggatctgaatttgagcttaatttttgttgaatttgtagctctgattattcttgttgttaccatcaatagtcggtgagaagactgagtgaggttttgatttttcttttaaaaagattattgttttgatgggggaaggtgaagctgaggggagtgatggcgctcccaagaatgttgtggcaaacgacgtcgttgccaatgcgctgttgccgttcgatgttcccgccaagaagttagcg

SEQ ID NO: 3722 - DNA, 408 bp, Glycine max
  misc_feature (400)..(401): n is a, c, g, or t
gattggacccaagaacttccacatgtttcgttgcgtggcgcgatatggatacaaagatctgcacaagaaagatgaggattttgagaaaaagcttttccacaacctctttgtgtttgtcaagctagagtccatgatggaagggtgctcagattcagatgactacagcttatatgatgagcaaactgagaggtcaacacaaggcctattgaacaataacacaaacacagctgcattgaatatggatccaacagtttcatcagtggattcaattgtatcagtctcatctccattgcacattaatgctactattcaatcctctggtcatgttagcagccacaccgaggtcgatgaagttgagttcttaaacaactgcagggatgctggggtggttcacattctnngaaacac

SEQ ID NO: 3723 - DNA, 510 bp, Glycine max
ttttggcgccaccggggttaagaggttgaagagtattggcatgattgatagcgttcctggaatgaaggctttggatatgaatgctgcagaggatgctattgtgaggctcacgagggagattgtgcccggcatgattgtcaccggcatggaggtggcagaaattgatggctccccaaggatggtatgcagtttctattctaatcttggtcctaattacttaagtatattattattattcacaagatttgtctacataaaacattttcaataatattgttggtgatatatgcagggtccgacgtttggggcgatgatgatatcagggcagaaggcggctcatttggcgttgaaggcgttggggaggaacaatgcaattgatggaacgtgtggagttggaagggaagaaccccagcttattttcgcttctgcagacactgaggaaattgttgatgcttaaacttactttcaaattagctagatatatagcttttcttttcttttctttctgtt

SEQ ID NO: 3724 - DNA, 779 bp, Glycine max
tagccttcttgtccacttttggcaacggccaaactccacaactcaaccttgcaggtcattgtgaccccaacaacaatggctgcactgggttgagcagtgacatcaaaacttgccaagaccttggcatcaaagtgttgctctcccttggtggtggtgctggaagctactccctcagctcagctgatgatgccactcaacttgcaaactacctctggcagaatttccttggaggtcaaaccggtaagagtaacaatacacaaatatctatagattcttcctcaaatatactttttattattaaatgaaatttattaaaaatgactgaatcttgtattaaatattggaaagaggggttaacaagattttgtaatttttcataaatttcaacaataataaagtgttttagaaagagtatattaaatagggtgctgctaataatatcttgtgtgttaaacactactatcaaatattaatatatgttatttttctttattagttttttcacaccaaattatactatatctatcgtatgcatatttttctttcctttcttttcctctctgagtgttgaataacatatatatattagtgtctactaatctttttccatctggtaattcaggatcagggccattaggtaatgttatattggatggcattgactttgacattgaatctggtgggagtgaccattatgatgacctagctagggcattaaatagcttcagctcacaaaggaaggtgtacttgtctgcagccccacagtgcataatccctga

SEQ ID NO: 3725 - DNA, 520 bp, Glycine max
tgtcatcgtcatcatcaagcaacgcctacgacgtgccatgggtagaaaagtaccgtcccagcaaggtcgccgacatcgtcggcaacgaggacgccgtctccaggctccaagtcatcgctcgcgacggcaacatgcccaatctcattttatccgtacgtctctcatttcaccccttaaattaactatttcctctttctcaattttttatcctaatttctaaccctctcattttagggtcctcccggaaccggcaaaaccactagcattctcgccctcgcgcacgagcttctcggaggaccaaattgcaaggaagctgttctcgaactaaacgcttcggatgataggtacgtttttgtaatttctcgattcagttttcaattctggacgatttcctgttaatttatcctttcacttttggttatagaggaattgatgttgtgaggaacaagatcaagatgtttgctcagaagaaagtcacactgaccccggggaggcataaaatagagatactggatgaagc

SEQ ID NO: 3726 - DNA, 399 bp, Glycine max
acgatttcggagaagaccttgtcgcaattcatggcacaggcttcgaggaggtcgaggctgagagcctgaaccacggggctcttgtggttgatctttctcttgatggccttcacgacctcggagccgttgaattggtcgctgttgatcatgctgcagattctgagattcatgccccaattaggttcttccattgtctccagcgtggcctcgtccaccatcttcgactccggcgtcggcgcctgaagcatctccttcacttttccgctcaccattcgccccatctgggccccacccatcttcagcctctcccccagttgagcccacttcaaccgctccatcgcgaaaactaatgaaagaaaaccaacgggaaatgtttttttgttgttgtgtaacgaacct

SEQ ID NO: 3727 - DNA, 352 bp, Glycine max
ggtcttaaaaagctcatcatccagcgctgtgattcattgaagcaggtaccattaggcattgagcacctaacaaaactaaaatcaatagagctttttgatatgcctgaagaatttattacagcactgcgtccaaatggaggtgaggattattggagagtgcaacaagttccagcagtttatatctcctattggagggataggggttgggatgtctactcattagagacattaggagagagagagagtgattccagtgggggtactgcaatcagaagtcttgaaatttgtacgctctggaaggtttaacttttattttctttcttttaacatactacatatgtgagtatgcaag

SEQ ID NO: 3728 - DNA, 580 bp, Glycine max
  misc_feature (149)..(154): n is a, c, g, or t
  misc_feature (172)..(176): n is a, c, g, or t
cgtatagatgatactaggaaactgctatataaaattgagcaatttagataacagactgtctactgaaaacagctcatacacataaagcccataaaaaaataaaaaataaaaatccaccatataaaccagattgtctagcaaactcatcnnnnnnctactattcttaatgtgnnnnntcagagcaacccagattgtgatgcttggaataacgatccaacagttctgtgcttcaattgccaatcatgcaaggctggcttactgcaaaacctcaagactgattggaagagggtggctgttgttaacatcgtattccttgtcttcctcattattgtctactccatagggtgctgtgcattcaggaacaataggagggaaaattggaagggttattctcgttagctaagattactcagtattattactagtgtgtagatgagtttgctagacaatctggtttatatggtggatttttattttttatttttttatgggctttatgtgtatgagctgttttcagtagacagtctgttatctaaattgctcaattttatatagcagtttcctagtatcatctatacga

SEQ ID NO: 3729 - DNA, 398 bp, Glycine max
agcttgccaagaaactcctgagcttactgccacatcattcatttggcaagtgcctaaataatgttggtggtctagacatggctctttctctttatcccgaatgtgcaaacgatgccaacgttacaccaaaatggtgggatcatttacattgtgccatgtctcactacaagtttgttcttgcaattgagaacacttttactgagagctatgtgacagagaagttattctatgccttagactctggtgcagttcctatctattttggtgcaccaaatgtcatggattttgttcctccacattcaataatagatggtagaaaattcaactcattggaagagttggcttcatacgtgaaggcagttgctaatgacccggtagcctatgcagaataccatgca

SEQ ID NO: 3730 - DNA, 1040 bp, Glycine max
  misc_feature (52)..(53): n is a, c, g, or t
  misc_feature (983)..(991): n is a, c, g, or t
  misc_feature (1032)..(1035): n is a, c, g, or t
  misc_feature (1037)..(1037): n is a, c, g, or t
tgtgatcttcatttgaacccccttgatgaggtacttcatgctggcatgctgnntttttttgccattgccaaaactcatagttgacattgctttacgtcccaaaactgaatacagaattttaacctagacccattactcctaggaatgacatttgcaatctttggtgtttgatggtttgttgaatttaaattgagttgggaggtatagatagtttgcatgagttgttagttcacaattgatagattagacctgtaatgacatgctgcatgtgtgctttatgatcatggataaagaaaaataccaagctaagcattattacaggctcacaagtcacaaagcaaagagtcatttactggagatgattattccttttgtagtgattaaacttgacttcaatgtgttggccctttcattttgtcatatctagaggatccttgtttctgttttttcaatggtataaagcagcaatccttatgattcttggtgtattcagtgttgaaacatgcagagtcttatcattatttgcatgcccaaaatctatgaaatgcacttgcgtgagaaaagttctccaaaagttaatatcttatttgagttcctttgttttttaatttcttcaggacactgcaagagatattctgaagaatgctccaggtgtagtggttattgatgatcgtgaatccaatcattttcctactccattggaagtttcaaacaaggatgatgttgctgttggtaggattcgccaggacctatctcaggatgggaaccaagggtaaatctcttccatggcaatatattatcatttttttcttttcaattagcgttgttctttattatgggaatttacataaatgctggatatgcacacaggttggacatctttgtatgtggggatcaaattcgcaagggagctgcacttaacgcaatccagattgctgagatgatgctatgagatctggtttttaaaggatgtggtactgaannnnnnnnnttcttttgaaacagttttgtatcttctagtgtaacaggctnnnnantct

SEQ ID NO: 3731 - DNA, 414 bp, Glycine max
tcgtacctgttgcctcacttgcactctgggtgggcggttgatcaagcaatcctggcagaagaggagcgtctggtcgtgatccgtttcgggcacgactgggacgaaacctgcatgcagatggacgaggtgttggcgtcggtggcggagacgataaagaactttgcggtgatatacctggttgacataacggaggtgccggatttcaacaccatgtacgagctctacgacccttccacggtgatgttcttcttcaggaacaagcacatcatgattgatctgggaaccggtaacaacaacaagatcaactgggctctcaaggacaagcaggagttcatcgacattgttgagaccgtctaccgtggagccaggaagggacgtggtctcgtcatcgctcccaaagattactccaccaag

SEQ ID NO: 3732 - DNA, 392 bp, Glycine max
tcaaatcaaccaaacaaaagaaccccatttaagaaaatatatagaaagaaaaaaaaattgattaaaagattgttctttttattaacaacaacccgtcatagttttaaggccatttaattggttcttattgtgcttgtgtgtgtgctataaatccttcgtggtttttggtgaccctttgggttctatagttagtctaaggtaacccactttgagaattctcataaagttgcatgcttttggattggaaggttgttgcaatggggaaggttgtgttgttgtttctttgcatggtattggtgatggtgcctttggcttgtactgattcaattcagaagcttgaggttcagaagcacttgaaaaacttaaatagacctcctgttaggtccatcaaa

SEQ ID NO: 3733 - DNA, 500 bp, Glycine max
tccaattgaatatcctccatactgcttacacttgcaagacccaaaaccatatacaggccacttatagtaaaaccatatctgtagtagtcaattgcatactccttattcttcaaaatcaaaacatggagatgaaaacttgaaaatgtatcaagcaaattgtgtcctgaattttggaaccagccaaaaatggtaagagacagaaaaaatctagtttagaatcatatagcaaaggtacttaataaactgatactagttgattgtccaacaaactgatataaagacacaacccaaaagccacattacagtgtcatctaagagagatcacaccagttaaactccataatcaatatctcacccaaatctgaaattttgggaaagaaaccaaaaaaaacttgtctgcacataaaatagcacaaaagccaccatcaaagaaaaacaaaatgaaccccatcttgagacacataacttaccagataataaagcaggtggtccaaatgaaa

SEQ ID NO: 3734 - DNA, 505 bp, Glycine max
  misc_feature (471)..(472): n is a, c, g, or t
  misc_feature (493)..(495): n is a, c, g, or t
  misc_feature (497)..(497): n is a, c, g, or t
gctcttgaacccacttcagggacacaatgcatataaatgccttggctcggcacacactcatcaatgctggaggagtgctagagaaaacagttttccctggcaaattcgctctggaaatgtcgtccgttatatacaaaagttgggtattcactgagcaggcactacctgctgatctgctaaagaggtcagttcagttagaaaacgacttgtatttattttagacttttagttcaatctgttagagagaaatatgcgtaacataatattttctaacgcacactcttaaatacactctttattatagactaaaatttattaaaaattaccaaattatgtgagttactaggtttaatcttctcatttaaagagttttcattcatgattgtgtactaacggttaaaaaagtgtgatatgaaaatgtgtttttgcttgttggtattttatctccataaccacacagtaacatactannattctatttcactgaatttcnnngnaatggcag

SEQ ID NO: 3735 - DNA, 521 bp, Glycine max
acatgtaagttgctcccttatgcattgaattaaattttaccgtggtttcgtattaaatctccatgtgcccttaagcatgaacatatattcatatcgtgctttaaaatttaccaggttttactcaggtgctgttgctggagctagagaggcgttattatgtggtgtaccttcattgtcaatatcattaaatcggtacgttgatttttattaattatatccggtttgaattgtattttccagctggagattatgatttagtactgttactaccttattctggtgcaggaagaaggatgaaagtcaagagactgatttcaaggatgcagtagtactctgtttacctttaataaatgctgctatcagggatgttgtaaacggaactttcctcaaaaactgctttctgaatatagaaattcctaaatcacctttaaccagcaaggtatacaaatttaattgtaatttggataataatattgagcattttacttcaatatgagaatcttctaggtttgggctaaaaa

SEQ ID NO: 3736 - DNA, 367 bp, Glycine max
cattggtcaggcatacaatgcagctgtggaagctggatcactccagcttttcaactccacaaaggccggatagacataagccccatgtaatcatttttgcgtcattttatgcataagggatgcctcctatatttttgtcattgttctaggacttgtattctgcccgaattctccaagctggtccactgccaacaatgaaattgtgtaaggaaggattggagtcttgctctttggacatgctcaacttttccaagctgaactaatgcagttatatggaagggaggactattatagttttacaatttttgtgcatcttccagaatgactttttcgagctatgattggagattattactggtttctagta

SEQ ID NO: 3737 - DNA, 348 bp, Glycine max
  misc_feature (308)..(311): n is a, c, g, or t
  misc_feature (313)..(313): n is a, c, g, or t
  misc_feature (315)..(315): n is a, c, g, or t
  misc_feature (317)..(318): n is a, c, g, or t
  misc_feature (321)..(324): n is a, c, g, or t
  misc_feature (326)..(329): n is a, c, g, or t
  misc_feature (331)..(342): n is a, c, g, or t
atggacctcatttttgttcttttattcttgcagtggattcttcatgattggactgataaagactgcataaagatattagagaattgtaaagaagctatttcttcaaataatggcaaaagaggaaaaataatcgtcatagatatggtgatacaagaaaagcaagatgagcataaagttacagaactaaagctcctttgggatgtagccatggcatgtgtattaaatggaaaagagagaaatgaagaagaatggaagaaactcttcatggaagcagggttccaagactacaaaatatctcccttgacggnnnntntntnngcnnnnannnngnnnnnnnnnnnnaaaaaa

SEQ ID NO: 3738 - DNA, 353 bp, Glycine max
attcactttccctttttaacattaaaatgatgaaaactcaggccttactagttctcatgttattggtgaactttgtttttttcatgggctcagaagcccgtccattgagtatcattgagacggaaaaatcagtcactggaggggaagtggtggatttctttgattggttatctcttggagcaatgaaggattctgggccaagtccaggtgtgggtcacaagttcaccaatagtgaaacccttggtgggattaaggactctggtcctagttccggggggccaggtcaccaatttactaacagccagacccttggtggaatcaagaattcgggtcctagccccggaggagagggt

SEQ ID NO: 3739 - DNA, 385 bp, Glycine max
tgagtcaaaatttggttgatgtcaaatattcagacttctgggagtagtagtgtattgtaatggtttagtctggatgctcaacatgaatcagcttcaaacctcaactgcatatattcacaaagcatgtgcaaattttgactgctatttatagcaaaattgctagcaagcttctaattttagggtgttcttgaaggtgttggcttagggcagaattgcagaagcaaggttttgatacatctgcaaagttgtcctaggagcatttctaacttgaataacaaattatgaaatttttttcttctgttccttttgtaatttatgtcattgaaagcaagtaacgacttccgtaagcatgtaaatattgcatttggtagctttagacatctgg

SEQ ID NO: 3740 - DNA, 412 bp, Glycine max
gactcttctaatggcagaagaagcacacaacagcaactccatgaatgccctgccaaaggttctcgttctgggtcccccaacgtgcttcataaccctccaacctctctactctcacaagttccatttcctcaacccccacacctcaagcctttcactgcaacacttcctccaccaccaccaccaccacccttcctccgtctccgccgttctctgcggtgcatcctactccgtcaccgccaacgtcctctgcctcctgcccgcgctccgcctcatcgtcaccaccagcgccggaaccgaccacatcgacctcgccgagtgccgccgccgcggaatccaggtcgccggcgccggagagctgttctccgaggacgtcgccgatatggccgtcgccctgctcgctgacgttatgaga

SEQ ID NO: 3741 - DNA, 1513 bp, Glycine max
  misc_feature (370)..(371): n is a, c, g, or t
  misc_feature (376)..(378): n is a, c, g, or t
  misc_feature (396)..(408): n is a, c, g, or t
  misc_feature (411)..(413): n is a, c, g, or t
  misc_feature (427)..(427): n is a, c, g, or t
  misc_feature (429)..(433): n is a, c, g, or t
  misc_feature (435)..(440): n is a, c, g, or t
  misc_feature (452)..(458): n is a, c, g, or t
  misc_feature (472)..(474): n is a, c, g, or t
  misc_feature (476)..(478): n is a, c, g, or t
  misc_feature (480)..(481): n is a, c, g, or t
  misc_feature (483)..(486): n is a, c, g, or t
  misc_feature (488)..(490): n is a, c, g, or t
  misc_feature (507)..(508): n is a, c, g, or t
  misc_feature (513)..(521): n is a, c, g, or t
  misc_feature (526)..(541): n is a, c, g, or t
  misc_feature (544)..(547): n is a, c, g, or t
  misc_feature (549)..(558): n is a, c, g, or t
  misc_feature (562)..(562): n is a, c, g, or t
  misc_feature (571)..(572): n is a, c, g, or t
  misc_feature (580)..(582): n is a, c, g, or t
  misc_feature (587)..(588): n is a, c, g, or t
  misc_feature (593)..(601): n is a, c, g, or t
  misc_feature (606)..(619): n is a, c, g, or t
  misc_feature (627)..(629): n is a, c, g, or t
  misc_feature (631)..(633): n is a, c, g, or t
  misc_feature (641)..(641): n is a, c, g, or t
  misc_feature (643)..(671): n is a, c, g, or t
  misc_feature (673)..(708): n is a, c, g, or t
  misc_feature (710)..(712): n is a, c, g, or t
  misc_feature (716)..(717): n is a, c, g, or t
  misc_feature (719)..(721): n is a, c, g, or t
  misc_feature (723)..(729): n is a, c, g, or t
  misc_feature (732)..(734): n is a, c, g, or t
  misc_feature (741)..(744): n is a, c, g, or t
  misc_feature (746)..(758): n is a, c, g, or t
  misc_feature (760)..(760): n is a, c, g, or t
  misc_feature (762)..(762): n is a, c, g, or t
  misc_feature (764)..(775): n is a, c, g, or t
  misc_feature (778)..(783): n is a, c, g, or t
  misc_feature (785)..(789): n is a, c, g, or t
  misc_feature (792)..(797): n is a, c, g, or t
  misc_feature (804)..(809): n is a, c, g, or t
  misc_feature (811)..(815): n is a, c, g, or t
  misc_feature (817)..(824): n is a, c, g, or t
  misc_feature (827)..(832): n is a, c, g, or t
  misc_feature (837)..(837): n is a, c, g, or t
  misc_feature (844)..(846): n is a, c, g, or t
  misc_feature (850)..(856): n is a, c, g, or t
  misc_feature (859)..(859): n is a, c, g, or t
  misc_feature (861)..(862): n is a, c, g, or t
  misc_feature (868)..(878): n is a, c, g, or t
  misc_feature (880)..(888): n is a, c, g, or t
  misc_feature (890)..(897): n is a, c, g, or t
  misc_feature (900)..(900): n is a, c, g, or t
  misc_feature (905)..(909): n is a, c, g, or t
  misc_feature (911)..(915): n is a, c, g, or t
  misc_feature (922)..(922): n is a, c, g, or t
  misc_feature (924)..(931): n is a, c, g, or t
  misc_feature (936)..(936): n is a, c, g, or t
  misc_feature (940)..(942): n is a, c, g, or t
  misc_feature (945)..(945): n is a, c, g, or t
  misc_feature (950)..(952): n is a, c, g, or t
  misc_feature (954)..(957): n is a, c, g, or t
  misc_feature (962)..(966): n is a, c, g, or t
  misc_feature (970)..(973): n is a, c, g, or t
  misc_feature (980)..(980): n is a, c, g, or t
  misc_feature (989)..(993): n is a, c, g, or t
  misc_feature (997)..(998): n is a, c, g, or t
  misc_feature (1003)..(1004): n is a, c, g, or t
  misc_feature (1008)..(1011): n is a, c, g, or t
  misc_feature (1013)..(1013): n is a, c, g, or t
  misc_feature (1015)..(1018): n is a, c, g, or t
  misc_feature (1020)..(1028): n is a, c, g, or t
  misc_feature (1035)..(1038): n is a, c, g, or t
  misc_feature (1041)..(1047): n is a, c, g, or t
  misc_feature (1049)..(1059): n is a, c, g, or t
  misc_feature (1063)..(1068): n is a, c, g, or t
  misc_feature (1072)..(1082): n is a, c, g, or t
  misc_feature (1085)..(1093): n is a, c, g, or t
  misc_feature (1096)..(1096): n is a, c, g, or t
  misc_feature (1100)..(1105): n is a, c, g, or t
  misc_feature (1107)..(1109): n is a, c, g, or t
  misc_feature (1112)..(1116): n is a, c, g, or t
  misc_feature (1119)..(1126): n is a, c, g, or t
  misc_feature (1128)..(1128): n is a, c, g, or t
  misc_feature (1138)..(1151): n is a, c, g, or t
  misc_feature (1154)..(1159): n is a, c, g, or t
  misc_feature (1162)..(1172): n is a, c, g, or t
  misc_feature (1176)..(1179): n is a, c, g, or t
  misc_feature (1184)..(1193): n is a, c, g, or t
  misc_feature (1195)..(1199): n is a, c, g, or t
  misc_feature (1202)..(1205): n is a, c, g, or t
  misc_feature (1207)..(1214): n is a, c, g, or t
  misc_feature (1216)..(1216): n is a, c, g, or t
  misc_feature (1220)..(1227): n is a, c, g, or t
  misc_feature (1233)..(1241): n is a, c, g, or t
  misc_feature (1244)..(1247): n is a, c, g, or t
  misc_feature (1251)..(1259): n is a, c, g, or t
  misc_feature (1261)..(1280): n is a, c, g, or t
  misc_feature (1283)..(1316): n is a, c, g, or t
  misc_feature (1318)..(1320): n is a, c, g, or t
  misc_feature (1322)..(1323): n is a, c, g, or t
  misc_feature (1325)..(1327): n is a, c, g, or t
  misc_feature (1330)..(1330): n is a, c, g, or t
  misc_feature (1332)..(1339): n is a, c, g, or t
  misc_feature (1341)..(1349): n is a, c, g, or t
  misc_feature (1351)..(1353): n is a, c, g, or t
  misc_feature (1355)..(1366): n is a, c, g, or t
  misc_feature (1368)..(1379): n is a, c, g, or t
  misc_feature (1382)..(1385): n is a, c, g, or t
  misc_feature (1388)..(1388): n is a, c, g, or t
  misc_feature (1392)..(1393): n is a, c, g, or t
  misc_feature (1396)..(1401): n is a, c, g, or t
  misc_feature (1408)..(1415): n is a, c, g, or t
  misc_feature (1417)..(1419): n is a, c, g, or t
  misc_feature (1421)..(1422): n is a, c, g, or t
  misc_feature (1424)..(1435): n is a, c, g, or t
  misc_feature (1437)..(1439): n is a, c, g, or t
  misc_feature (1441)..(1442): n is a, c, g, or t
  misc_feature (1444)..(1445): n is a, c, g, or t
  misc_feature (1447)..(1449): n is a, c, g, or t
  misc_feature (1452)..(1457): n is a, c, g, or t
  misc_feature (1459)..(1459): n is a, c, g, or t
  misc_feature (1461)..(1500): n is a, c, g, or t
  misc_feature (1504)..(1505): n is a, c, g, or t
tgaggcttgccaaaggcacccctcattccagtctggagcctatcagccccagcacacgaaagcatcttgttgatacgaaggacatggaaggggtgaacccggacccgaaggtggaaggcatcctttcctgcagacttggtcatgtacttgttgcaggcaatacgggcagcctcaagagcctcactggagacattctccttctcccaagagacaaggtgcacacagtaggggaactcatcaacaccctttctcttcatgccaacatcgtagatcctgatcttggggtcagggacaccacggcagtacctggacttggggtatggcttgttcttgatctgccgatagcaaaaaagaagctacctgacgccanncgtcnnnaagctcttcgtatggacnnnnnnnnnnnnnccnnnttgcggaaaaacantnnnnntnnnnnnggaagagagaannnnnnnccccagggattgcnnnannnanngnnnnannnaccaaaacacaaatgtnntacgnnnnnnnnnccttnnnnnnnnnnnnnnnnacnnnnannnnnnnnnncttncaaaagaannagagaaannnccatnncatannnnnnnnntttcnnnnnnnnnnnnnnccccccannntnnnatccattntnnnnnnnnnnnnnnnnnnnnnnnnnnnnnannnnnnnnnnnnnnnnnnnnnnnnnnnnnnnnnnnncnnnccgnncnnngnnnnnnnttnnnctttatnnnnannnnnnnnnnnnncnantnnnnnnnnnnnnttnnnnnntnnnnntcnnnnnnttcctcnnnnnncnnnnncnnnnnnnngcnnnnnnacatncctccannncacnnnnnnnacncnnctactnnnnnnnnnnncnnnnnnnnncnnnnnnnntantcttnnnnncnnnnncatttancnnnnnnnntaganactnnntanctcannncnnnnccccnnnnncccnnnncctttcntcttacaannnnntctnncctcnnctgnnnncncnnnncnnnnnnnnntcccccnnnntcnnnnnnncnnnnnnnnnnngccnnnnnnctcnnnnnnnnnnnctnnnnnnnnntcnctannnnnncnnnttnnnnnccnnnnnnnntncccccctccnnnnnnnnnnnnnnccnnnnnntcnnnnnnnnnnnttannnncttcnnnnnnnnnntnnnnnttnnnntnnnnnnnngntctnnnnnnnncatttnnnnnnnnncannnncaannnnnnnnncnnnnnnnnnnnnnnnnnnnnatnnnnnnnnnnnnnnnnnnnnnnnnnnnnnnnnnnannncnnannnaanannnnnnnncnnnnnnnnnannntnnnnnnnnnnnntnnnnnnnnnnnntcnnnnccnttannacnnnnnntacttcnnnnnnnnannncnngnnnnnnnnnnnnannntnnannannnacnnnnnntncnnnnnnnnnnnnnnnnnnnnnnnnnnnnnnnnnnnnnnnncacnnatcctcct

SEQ ID NO: 3742 - DNA, 607 bp, Glycine max
aatcatcaaagatgactgtaggggcaggaatatctgttgcagatgggaacttgatggtgttggggaacaaagtgctgagccatgtccatgacaaggttcttgttacccctgcatgtggtggtgctttgctcaatggggcattcattggggttcaatcccatcacaagggtagccgcacagtcttcccaattggcaagcttcagtatgtactcttcacttttctcttttcaattcttttcttcttcttcttcttgttagtgaaaaataaaatctttgtaattttgggtgaatgctgtattttttgttgttgcttgtcacaatcaggaagtgcatgcgcatgtactggattacttttgatgtttcttattatgtgtgttggtgcatagttaataatatttattttaggataactgcaattctgatcctaggatgatgtttttttatttattttgtttcagggggttgcgatttatgtgtgttttccggttcaagatgtggtggatgacgcagagaatgggcacttgtggacaagaaatccccattgagacgcagttcttgctcgttgaagcacacaatggctctgatattgaaggaggaggagaccaaa

SEQ ID NO: 3743 - DNA, 975 bp, Glycine max
  misc_feature (46)..(52): n is a, c, g, or t
  misc_feature (882)..(886): n is a, c, g, or t
  misc_feature (895)..(895): n is a, c, g, or t
  misc_feature (898)..(898): n is a, c, g, or t
  misc_feature (901)..(902): n is a, c, g, or t
  misc_feature (904)..(904): n is a, c, g, or t
  misc_feature (916)..(926): n is a, c, g, or t
acccgagcagcccaggaagtccatgcagctgttcgtgactggcttnnnnnnnatgtatcggctgaagtttcatctaaaacgcgaattatttatggaggtacattggcttttgtaactatgcatgctgcatttgttagtgtcagaaatttaagattcagtttaataagattgcaagctttgttcaaagtggtgtaatcttgggatgagaaaacaacttatgcaatctctgctggccttttgcattaaaaagccagctgctattgtgcttcagacttaagattatattctgttttactagtatacttgcatttttctaggtacaggctaagtgaatttacgaaaatgaaactaatttagaagggaattcatgattaacctaaggaaaaatgtattgttacaatataagtgagcagctagtaatttgttgattacactacatgatatgcttggtggccataatcttatccattcacaaacctcttattgatattagattaatagattgaccgtagcattgtcaggtgcaatattctttctgtttaagtttggcattttttaccatttcagaatttaatttttcttcaaatgaaaaattttaatcagccagtacagcgcagcagcattgtagtagatatgctaacattgaagtaatctgtccttcagggtctgtaaatgcgagcaacagtgctgagctcgcgaagcaagaagatattgatggatttcttgttggtggtgcttcattaaaggtacacgatttattcacaacttctttgactagaatgtgcttcattcctagagtttttaaatgaacacgaatgaatgtttactgatgtattgattttttgctgtacagggtcctgagtttgctaccattatcaattnnnnnacatccaanaanttnngncttaattacttnnnnnnnnnnnaagagcgcattaaaaatgtggcaataacatgggtgtattatgagtttta

SEQ ID NO: 3744 - DNA, 573 bp, Glycine max
aagctattgggaagaagttggaccgctacaagaatccttggcttgaattgaagatacaatatggacaaaacaaaggaaagttatacaatgaagaatgtgaccgattcatggtgtgaaatttatttccttttgtttttatttttgcccaaatttatttcttttcgttcatgttcagttccttgtttagtctggtgttttccgaacagaattcttgtgttttctgacttcacttaaaacttgcagatatgtatgattcacaaacttggctatggtaattgggatgagttgaaggcagcttttcgaatgtcgcccttgtttcgatttgattggtttgtcaagtctcgcacaacacaggaaattacaaggaggtgtgacaccctcattcggctggtagagaaggaaaatcaagaatatgatgagagggagaggcaagctcgtaaagagaagaaaattgctgctaaggtttgtattttaacctaaaatatccgacttaaattatgtttatttcaactgttgctttaaccaagtttggcgaacaacagagcatgaccccatcgaagcgttccatgccta

SEQ ID NO: 3745 - DNA, 382 bp, Glycine max
tggtagtacttcaacgactataattttatcagagcgagcacgggaaagggcccaaatgagacaggctgggttggtttcttctacccttagaggtcgtggaagaggcggtgctccccgtggtcgagttggtcgagttaggggagtagtacgccgaccacctccaccacctggcagtgatcaatgaacaacgagttcaccgtctgtgattgatggttaatgaaatgatttgacttggtattgtaaacttctcccttcgtctgaacgatggcattgtagaccagttagtaggcgtaaattggcgaccagttttcgtcaatgtaaatacaattttgcttttcactcatttctccccttacctatctaattttgcctcaattagctt

SEQ ID NO: 3746 - DNA, 406 bp, Glycine max
tatgttgctttggataatctgaaattttaaataagaaaattaaaccgaaaatgtaggcatagctaatagctaattactagtttgactaatttcaatttttcttgccctcttctccaccttcttccaagtaggtcttcttccttctatcagctctagcaatgacacaaatgaggaaaaaacacgtggcataaatcgcgtgaatcttccaatttgtcttcggcggttgcttcaacacaaccctgtgaaacacggtcacgtaataatgcaacccgatggcaaagcccacaaaagtttgggccaggcccaagaacttggagcccagaccagaatcagttgagaacaccaaaacgaggtacatgaggagtagcaaaaggtagagaacgtaagcgagagtttgaagaaccta

SEQ ID NO: 3747 - DNA, 374 bp, Glycine max
aagctatcaagctcccttcgtcttgataagatcgaggaggttttagattacggaaaattacggacaaatgcggctgatgcagctgcaactatggtggtgttgtggttgtggtgactccagaaaccttgatgttgcagccaaaattgcggtcagcttcgtttttttaaaaccttggtgatgtcggtgtgggctacttttcctaattcacactactactgctacttgatattcattcatatgctgccactattctactatcattgctttgcagttgcgtaagacgatgatgatgatagtgttaaaaattgtaatctttaatttattttgcttttttaagttatagtgatttttttgaaaagaacaaatgctcttct

SEQ ID NO: 3748 - DNA, 412 bp, Glycine max
  misc_feature (404)..(405): n is a, c, g, or t
gggaggagttgcctccatagcacccaaatcaggggaagacaaaggtgtctcatcatacaaggtttcctgggtgccagatcccgtcaccggttactacaaaccggaaaacatcaaggaggttgatgttgccgatttgcgtgctacccttctccgcaaaaaattcaacaactaatttcaacaattttaattttttaccaaaccttgggtgattgattcgttatggaattaattttgatactcatatgctctgcccaccttcattatacgattgctatagttttacaagtcagtagaataactattagcagctaataagaattgtaatttcttttaatcttattcattacttcagtttttttttcttttcttttcaattgccttcaatgtgattggatgtgtttctnncttgcac

SEQ ID NO: 3749 - DNA, 760 bp, Glycine max
  misc_feature (671)..(671): n is a, c, g, or t
  misc_feature (710)..(715): n is a, c, g, or t
  misc_feature (751)..(753): n is a, c, g, or t
gtcaatgttgagatcagtttgtcagttaagggtgggagtcacaacccaaaaaccttgcctccatccctcaatcttattctccttttccctctctcacaacactcacactctcactctcacatctttccccagaaccttccgtttccacccaccttcactgcctctttcaccctttgtgcccttcatgcctcccaaagcaacaggtccctcattctctgcaaacccccttaatgcttctttttctgaattttgtttatgattgcattatattatctatcaacactttttttgtaagatggtaaaagaaatttcataaaaagatgtaatttttcattaaaaaaaaaaactgttttttaaactttttttcagcttcgtattgcactggggttagtggtgctctgcaaaccccttaatgcttcttcttgtgaattttgtttctgatagcattagattatgtatcgacactttttttgtaagatggtaaaagaaattcataaaaagatgtagtttttcatttaaaaaaaaatctgttttttcagcttcgtatggcactggggctagtgctgctgctgaaggtgataggccaagggagatattggtgcagcatttgttggtcaaagaagatgaccagaagcttctgttagatattcagcaaagaatctcttcaggtnaatgactctgagggaattctgttctttttctcctaccgnnnnnngggggttaggttttggaagatatttatttatttccnnntttatct

SEQ ID NO: 3750 - DNA, 866 bp, Glycine max
  misc_feature (58)..(62): n is a, c, g, or t
  misc_feature (800)..(808): n is a, c, g, or t
  misc_feature (858)..(859): n is a, c, g, or t
catgtactcagctaccaagagcctttcatctccttcagcacaacaaccaattagattnnnnntctcttgtgcctcactttcccaactccagctgcctctgcctgaccaatcaaaaccattaacaaaaaacttgcattcccggaaccattaacaaaatataatgtgaaaaattacataaaggaaaatccttaaaaaaaaagtgagagaatccaaaactttatcttccagtcaaaccccaaaaatgcacaacagaatccacaaaaattaacaatgtttctctaaaaacaactaaatacttgtcattctcctcctactccttttttttccttgaatttctcaaaaaccaaattgaggactaataaaagttgttcattcctctcaccatgaactgttgagcatcaggccaaaagagtttgaaaaagcgtttcacagcaactaatcgattgttctcaagcttccctctgtaaaccacattgggagctttctcaccactctcaaaaacaatgtaatctgtgctgaactcatttgtggcccttctaagctcaatcaggccatactctttgaatgctggaacctgacactcttgatcaacatcatcaccaccattcccttcggaaaataaaaaacaacaaaaaaaaaaccaaaaaaaaaaaaaacaaactaaaaaccaaaactttctcaaaccaacaccaaaacaagagcaatagaaccatcccccatttagctccaaaccccatcagtgctagattttcacaaaccccaaaaaaaaaagaagaaacatttccattttccacacaacnnnnnnnnngaaacagtgaaaaaaaattccaaaaggtaaaaagagtaaaagggggaccnnatcgggt

SEQ ID NO: 3751 - DNA, 725 bp, Glycine max
  misc_feature (65)..(67): n is a, c, g, or t
  misc_feature (695)..(699): n is a, c, g, or t
  misc_feature (702)..(702): n is a, c, g, or t
aaaatgcagcagtaataatgtacattcagaagcttaagaagctgtggcagccgtcgacttctctnnnttttctttttcaatttctgcccttctctgctcagcatgctgggcaacaccattagcaagagcttgataattgaactcaagcttctgggtaaggttctcaaacctcgatggatccaatgattgtatcactacaggaaaatttactttgtaaggtgggatgtcagataacaaagagaacaatgacgatggcattggtgaacctgaacattttttagcttacctttgattgaatccacaaagaaaacaaaaggatcaacctcatcaattggggactgcaactcttcatcatcactaaagtcatcatctgaatcatcatcatcgtcatcattgggccggaatgacttcgcctatatgcaacaaatgcagaatgaaaataagattctaagatttaaaaataaatgaaaaataaaagccagtaaaccaacaaataatgaatataagatgaaacaaaatacaacaattgtgtttggagcaaggagatataataaaaaaaaactcatttagttcaacttattttggagaaataattgcttgtctttatcaggttcctcaaagaactttagaaaattaaacaattatttctctaaaaacaattgttttcaaacatgtacaaaatttgaatgaatcannnnncanttctaaaaactagaattgaacat

SEQ ID NO: 3752 - DNA, 319 bp, Glycine max
acatcaggccttaaactcattgctttcatggagaaagaaaagtacaaaaaggagagggagtttgacttgttaaggcaaagcctgaggatcatgaatggcaagaagaattcaattcaaacgaaagagaagctcttgaaaagcaaattgggaaaatgaaatgcacaaaaactagttttcatatccaaaattgaacaatgtggttgaatatgtattattgtatactgggatggtttgtatctttcaacagcacatattttccttttactttttccccctcctttttcttcagaaaaaataagcaagccaatacttccagagg

SEQ ID NO: 3753 - DNA, 348 bp, Glycine max
aggactttgccatggagacatgttttaaagagaacagatactaagaagtagtagcaatttttctatggcaactacagtgcatcacaaagttaaatttttctaaagagtgataaactcttgacattgtcattataaaactttctaatgccccattgatattgcactttgtggatttatgtcaaactccctccctattcattttttttaatcttctcaaaagaaaataagttcctaccaataattccgtagttggcctccaaatccattgcattaacttaagattcttcatggcgtgactttccacagagaaaagttgtgtgaaaagaatcttgatagttgcatgccttg

SEQ ID NO: 3754 - DNA, 684 bp, Glycine max
tgagtttcgatggctccgggttgaactatgattctgatgacttgactgagagcaattataataatgtttctgagggtaatactgggaagaatggtggggttagttccaacgcgaacagcaccgtcatcaccggtttggatcaaaaagggaagaagaagggaatgcctgctaagaatttgatggccgaacgacgccgtaggaagaagctcaatgatagactctacatgttgaggtccgttgttcccaagattagcaaagtaagactcttcttttcttttctttcaccctcttgcctaattttgaaatttcagttactatttttcatgttcttggagttaaattaatgtgagattatttgaaaggtttatactttatggtgtgtttggattacattcaaatttctcagaatcaactccaattccacattgaaaaccaaattaataaatagttgcttttactttttcaaattttcaccatgattttgggggttagaatcaatcatagttaattagtgttggtttggtttgggctggaatctggatctgtctctggattctatgacattgtttggtttggtttgatagatggacagggcttcaattcttggggatgcaattgagtatctgaaggagcttctgcaaaggatcaatgatctgcataacgagttggaatcgacaccatggg

SEQ ID NO: 3755 - DNA, 782 bp, Glycine max
caagaacttatgaggatgatatgaaggatcttgaggcattgttgaataagaaatcatttagggagatgcaaaaatctaaaactggtgaggagcttttggacctaattcaccgaccaactgcaaaggagactgctgtagctgctaaggttcaaagtcactgcctactttactaggcttttatctaaaatttcctttgtgattgtcagcttttagtgctattttgtacagtttaatctaatccagcttttctacaatgtattgttcagttcaaaacaaaaggtggttctcaggtgaggcaatactgtgacttactgacaaaagaggattgtcgacgtcaatctggttcctttatagcatgtgaaaaggttagttacaaggacagtattatgctgttttcccatctcttgtgtttcattgctaactcttgcaatgtctgttggtttaaatactatgctgataatgtggttctttatggaatcaaaccatgaatattggtgtttacattttctattagtctttcttggcatgcattaatgttcctttccttggcaggttcattttagacggatcattgcacctcatactgacatcaatttaggagattgttcttttcttgatacctgccgacacatgaaggcatgatttttccctctaacttattttgaaatgattttcattttactaatgtttattcttattttgagttgcgtgttattctttttatcccttgacagacatgcaagtatgtgcactatgagtatgaccctacacctgatgtgtct

SEQ ID NO: 3756 - DNA, 641 bp, Glycine max
agcacatatctgctaatattttaggggggatttgtagaattgaggctggtgtggagacttaataatctcttgtttctgaatggatttattgtacatcatcacaacttcgtaccatctagtacttgtactgtaggatgcaacatggcacagccaatgagcctcacttttgcatattcagatacttttgttttgttagaatctagctatagtagcatgattcgatttgttttgcacaggtgaaagatgaactctatagtcagaggaaagaagttgtgaagataaccggtgatagcatgtgttctctgtgccataagaaaatagggacaagtgtttttgctgtctacccaaatggtagcactctcgtgcactttgtctgtttcagagattctcaaaatatgaaagcagtgggcaaagggtctcaattgaggaagcgattatgaagctgaaatgccataccaattggtggtccagttgtcttgttttagcgtgcttttacccacggtacctgttggtaggtgtggattatgatgaaagtggcaccgtaatttatcttcagaggtctctctttttctttttttgcttttttgcccagtcaattcgtgtgaaaagtgagatttgatatgtgaagagcgtgatgtgta

SEQ ID NO: 3757 - DNA, 1054 bp, Glycine max
  misc_feature (1031)..(1038): n is a, c, g, or t
cagaaggttgcccaaatgcaggtatatatccacattattcatatatatcattttctcaataatatttaattatacatacatttaatatgtaaactatagtctaggcagtacatgagtggatggagatttgggttgaattttcttggtgaatgaatgttcaagttcgaatctgattttccctatgcatatttggatttctttctttctttcttgtctattttgcatgtggtgcctcacaaaataggatagtgttcccttgtccttaaatccaattattattattattttttacttattaattagaccttggctttttggttgtgtacaataataatgtttgtaggtttaaagagatgcggaaaaagttgcagacaaagatggttgaattatctcaagcccggcataaaaagaggccacatctctgttgatgaagaggatatgattataagacttcatcgtcttcttggtaacaggtaatttttatttatttattttgctttttaacttacatgtatttattctactcaacacaagtatcataattcaaaagattttttttttgttttttataattcaaaagatttattgagtattaattagcactattctcactcaactttgaagacagtttataaacataagattataaatatatataaaacaatactatgcttagttaaaagttaaaactctaaaaatttctctaactcagaaagatgagaagagaaaagagataatcagataagtgtgttattataaaacaatgttttagaaatttttagtggaagtaacattagtacaattcttactcatttatgcatacaaaccatactatatatgttatatgatcaacaattgaaattctgatttttgatctttatatagatgggcattgattgcaaagaggctacctggacgaacagacaatgaaatcaagaactactggaacactaatctgtcaaggaagttacagaaacatcctacatcatcagtatcttcacttcaacacaaacgtcatgaaaaagaaaagnnnnnnnnaatgcatgtagcaccc

SEQ ID NO: 3758 - DNA, 365 bp, Glycine max
ggtattgcaacggcagtccatcatttgcttgcaagaattgaagaagaggcttccctttgctgttgatcaggttcatctggggacacgagattttagtgaaatgaccaaatcaaccatctacaccaacctcaacagagagagagggggggaaagaatatttgctaatggctttagttttttatttttgtttgtttgatgtccaactgatgtgttaatgctaaactttagtttcagtagatgatggtgttttttaaaagttgcttcaagcaagtacaactaaaaatcaaatgaaaaagaatgttgatacagtttatctcgtttgcagttagttgagctctattgtcctcttcagtggccctaatata

SEQ ID NO: 3759 - DNA, 747 bp, Glycine max
  misc_feature (575)..(576): n is a, c, g, or t
  misc_feature (695)..(695): n is a, c, g, or t
  misc_feature (699)..(701): n is a, c, g, or t
  misc_feature (733)..(742): n is a, c, g, or t
tcatatcccttccattctacacgctatttccatgttctgtagaaattgtgacattatcctctttttcatgtgtctattactgtatatatagaaatagacatgtatgttgttttggttcaaggattgaagcatgtcgcactaaagcttaaatagttaagctatctagtttcattagtctaatgcgtgaatgagttttatgtctaatacaacaaaacctggggaccaacattcaatatcaatacagaatgttgctacaattgtttctcatgtccttttctttttggttactagttgtatgtcggtatattttgataatcgttatgaacaggttctgaacatcttgggcagttatggaggttctaatgctgcaaggggaaatcttggtctacatcgactaatagaagctctgaaacacatgtgggctgttcgaatgaacttgggtgaccccaactttgtaaacattgatgatactatatccaaaatgctttccccatcttttgcaaaagatattcagcacatgatacttgataacactactttccctccagagtactatatgaacaggtgtgatatanntagtggtaatttgaatgtaaccactccctttttctagataagttgcaaaatcactgggttgttaacgaaaggttattcataaccatgttgggcaggtggagtcaacttagagatcacgngagnnnccatatgtgcattgtggatgctgatagaaatnnnnnnnnnncaaca

SEQ ID NO: 3760 - DNA, 355 bp, Glycine max
tctgggtcatgtgaatccccttatgcaattgtctgaggctctaaccaagcatggctgcaaaatcacatttctgaacacagagttcagccacaaaagagcaaacaacgctggtgctgaactagacaaccttaaggaatcaggaatcaagtttgtgacactcccagatggcttggaacctgaagatgatagaagtgaccatgagaaagtttttttgtctatccaaagcaacatgccttctttgcttccaaagctcatagaagatatcaatgctttggatgctgagaatagcataacttgcatagttgctactatgaatatgtgttgggccttggaagttggacacaaacttggaatc

SEQ ID NO: 3761 - DNA, 716 bp, Glycine max
tcctcaaccttaatcatggagaatattggagaagagtacaagcattactgggagaccaacatgttcctccaaacccaagaacttgacaggtaataataacaagtaaccaataactaatgaattaataatctcaagcatatgttatgttattaatttaactaacatatggtgttttgatttgctatttttggtcatggtagttgggggttggatgaggccttatctgggtactacgattcgagttccccggacggcgctgcttcgtctgcggcatctaagaacattgtttccgagaggaatcggaggaagaagctcaatgaaaggctttttgcgcttagatcggtggtacctaacattagcaaggtaacaaggttgattaattaattaatagctagctaaaactattcatttggtgtgcgcatttataaaaattgaatcgggtaattgagagtagtgctgtataatcatgtaatttggcacctttctcttgttgtgtgtgtgtgtgaggcatatttgcctattttttgggtttgtaatcaataatgatgaatagtggtggtggtgttgtagatggacaaggcttcgattatcaaggatgctattgagtacatccagcacttgcacgagcaagagaagattatccaagctgagataatggaacttgaatctgggatgccaagaaagagtccaagctatggttttgagcaagaacagct

SEQ ID NO: 3762 - DNA, 433 bp, Glycine max
tgcaaggaaatcagccccttctgaagtcatccccatgtcacccgaagatgatccaaaagttcgtgttttttgcattttttgagtttttaagggataattcttgtgaccctttttgtgttttggtgtttagattgaggagcatttgcaacatttacgtggggtgcagccatttggtgagaactctgttggaatgtggtctaagcccacgtttaggcgcaagacgaagatagtgtgcaccattggaccttctaccaatacgagggaaatgatttggaagctggctgaggctggcatgaatgttgctcggttgaatatgtctcatggggaccatgcttctcatcagaaagttattgacttggttaaggaatataatgcttctcatgaagacaatgtgattgcaatcatgcttgacacaaagggtcctgaaattaaa

SEQ ID NO: 3763 - DNA, 781 bp, Glycine max
gcgcatgttcttaaaatttgcaattctttctatctttaatttttctgcatttatatttatcactttgtttattctcctcttggatgtaggtgtaggttacaggtttaagggttttgttttcatttaggtcactaatccgatatcatgaagctcgatacgactagtctcgaatcgtttcccacactgattgcacctcaaaacgacgtcgccggagaactctccgccgctccgttctttgaccttccgaattccaatgacgtgaggactctcaattgaatctcaggattctgaaattgttcgaaaatcaaaggaaaaaaaatagggttgatatttgtttctgaaactgtgggggaatgaaataagaaagttagggtttagtttattatggagaagagttgaagtttgatggttttaactgaactgttgtgtgtgtgtttgtttgtggtgctagttcgatgggttcttgaaagacgctattcagatggtgaagcccgcgaagggtactacaactcttgcttttatatttaaagagggtgttatggtagctgctgattctcgagctagcatgggaggatatatatgtgagtatttgttagattttaatttcatttttcactgttctttgttcctttggctgaggcagagttttttgtttttgtgctaattgctgcaaattaaaatgatgggttttatctatttgcattgtgtttgatcttgaattctgactgttggctgtctccagcgtcgcagtctgtgaagaaaattatcgaaatcaatccgt

SEQ ID NO: 3764 - DNA, 828 bp, Glycine max
ttcttcttctcaagtcttccttatacagtttctgtggcctccctcttcttttttgcttaggaaccttttcttcttcttcacttatggcatcctcctcattgctaatagttaactttttaccttttcctctacttctacccataatctcaaaattctataaaatattttttttttcgtagaaattgaagataatcttaatagatttataataattcgttcaacgtccaattgagctaaacttgctagacaatccgagaaaatatgatcatacaaactagtatatctgccaaagaaaaaagaaatcaaaacagagtcatttttcttttcaaatttaattctgaaaacttttcatatgaagtattaccatttatgactataactcttctaaccaaaaatatcaagacacaattaaattgtactttagtaattagtacttctgatttcaggcttcgattttcattttcagtcatagaaaataaaattgaagcttagatcagtaatcagaataagttgaagacagatttcagaggttgagtaatgagtattgagattgctatccctgaaaaaaaaactaaattgggaaacataggaatttgattattctgcataataaatcaacgaagaaagcttgaactaggtatgttttccaatccaatctaaacacagagttcttcaaaataaatctaaaacatgataataatagaaatcagagaagtcacaagtgaaattaaaaagcaaaatatggagaaatattgaattacatattgttatacaaatccaagctcattgaaaaagaagaaagaaagaaagaagagaaatactgaccac

SEQ ID NO: 3765 - DNA, 707 bp, Glycine max
tcttcgagaaagttattgatgagcacatggaatcagagaagggagaagacaagaccaaggattttgtggatgtcatgttgggctttttaggtactgaagaatctgaataccgcattgaacggtccaatatcaaagctatattgctggtatgagaaatcattatcacatcgttgagtatttttcctattatatattttttaaaattcaagtcagatacttacatagtagttacaattatatggccataggagagaggaaaaggtacgacggcgaaggatcaaatgtcctacattaacattgcatcctaaagtcctaattaacgactttgactgatacaaatttagctactagctcgttggccctttttattgatttttagaacttgctgtcatattatatgctcactcttctttggcacataaaattatttatttattttgcaaaggatatgttggctggttcaatggatacttcagctacagcaattgagtggacactttcagagctactaaaaaatccaagggtgatgaagaaactccaaatggaattggaaactgtggtgggtatgaagaggaaggtgggggaatcggacctggacaagttgaagtatttggagatggttgtaaaggaaagcatgaggctccatccagtggtaccattgctaataccacaccaatccacggaagattgcatagtcggagatttag

SEQ ID NO: 3766 - DNA, 418 bp, Glycine max
  misc_feature (59)..(60): n is a, c, g, or t
  misc_feature (398)..(401): n is a, c, g, or t
  misc_feature (404)..(404): n is a, c, g, or t
  misc_feature (409)..(409): n is a, c, g, or t
  misc_feature (411)..(412): n is a, c, g, or t
cggtggcgtagccgcttctgttgcggctgctgctaggctcaatgaaaatgttaagtaannctttatgttatgtgtcttgataatcatacttttgtttcatgatgtgtggtgttgatgtgttatagtctatagtgtattaataagtgtaagtggtgcaacatcttgtttttctttcttgtactctttgtgagttatattaattactggttttaaggactctacttaaggtgatgtatgtatactatgcgctatatgcatttctgtggttatcagttaataatatgtgctccaatcttgtaatttcttgtttgcaaccattctagatcccaaaatgcttgtcaagaggatttattacgtaacctataatagactataacacatcaacaccacacatcatnnnnaanaagangnnaagaaa

SEQ ID NO: 3767 - DNA, 385 bp, Glycine max
gtgtttttggatgatcttgaggccaaccaatggcactgatgtcataggcatccagaacaacaaatctatattcaggcactggcgagaaatcatagtatgcacggccatcaagagtatggatcttcagtaatgaaagtaacttgctgcgaggaagattgtataggcagtgattgccaatcatatgatacacaggtcctcctgtgaacatctcaaattcatcaacaactttctttacagtatcaagagattgatctttgggacaaaacccatcaacaatatctccaaaattaatcacaaacttgtgcttctgatgagtgttccattctttaactgctctctgcaatatgagaagactgtgtctataataccgtggaacaccaaggaa

SEQ ID NO: 3768 - DNA, 512 bp, Glycine max
  misc_feature (412)..(412): n is a, c, g, or t
  misc_feature (443)..(445): n is a, c, g, or t
  misc_feature (501)..(505): n is a, c, g, or t
  misc_feature (507)..(507): n is a, c, g, or t
taaatccattagggttttctcgttcgctcttcgcacaccacactgatggcgtgcacaatcgacttccgctgtctcgacgagggttttggcggcaaaacctacaagcgcaagagagagcagcagtcgcagcctcagcacgacgccgccgccgatgacgtcatcgacggcgcctctctgatggacaccgacgacgcactcccgccgccggcgaagcgatcggcgctgccatcgtcggagaacccggacaagccggcgttcggtcatccgagctacgacggcgtgatcgccgggagggtgtcggggcggaagtggaagcaagtgcggcagcggagggcgtcggcggcgcaggttagccggaaggggacgacgttcgagcagagggagagggagaaggtgataaagaaggcgtaanatggattcatcaccacagccaataaactcannncaaagtcaattaagaagggtgaaatctttgtgttcccaaaaggtttggtgcactannnnnanaaaag

SEQ ID NO: 3769 - DNA, 1402 bp, Glycine max
  misc_feature (665)..(687): n is a, c, g, or t
  misc_feature (689)..(699): n is a, c, g, or t
  misc_feature (704)..(710): n is a, c, g, or t
  misc_feature (715)..(755): n is a, c, g, or t
  misc_feature (757)..(766): n is a, c, g, or t
  misc_feature (769)..(773): n is a, c, g, or t
  misc_feature (782)..(783): n is a, c, g, or t
  misc_feature (790)..(790): n is a, c, g, or t
  misc_feature (792)..(794): n is a, c, g, or t
  misc_feature (797)..(802): n is a, c, g, or t
  misc_feature (804)..(806): n is a, c, g, or t
  misc_feature (809)..(823): n is a, c, g, or t
  misc_feature (826)..(826): n is a, c, g, or t
  misc_feature (829)..(829): n is a, c, g, or t
  misc_feature (831)..(831): n is a, c, g, or t
  misc_feature (833)..(839): n is a, c, g, or t
  misc_feature (841)..(846): n is a, c, g, or t
  misc_feature (848)..(848): n is a, c, g, or t
  misc_feature (851)..(854): n is a, c, g, or t
  misc_feature (856)..(858): n is a, c, g, or t
  misc_feature (860)..(869): n is a, c, g, or t
  misc_feature (871)..(875): n is a, c, g, or t
  misc_feature (878)..(884): n is a, c, g, or t
  misc_feature (887)..(893): n is a, c, g, or t
  misc_feature (895)..(912): n is a, c, g, or t
  misc_feature (921)..(921): n is a, c, g, or t
  misc_feature (924)..(928): n is a, c, g, or t
  misc_feature (932)..(933): n is a, c, g, or t
  misc_feature (935)..(940): n is a, c, g, or t
  misc_feature (942)..(944): n is a, c, g, or t
  misc_feature (946)..(949): n is a, c, g, or t
  misc_feature (951)..(951): n is a, c, g, or t
  misc_feature (955)..(956): n is a, c, g, or t
  misc_feature (960)..(963): n is a, c, g, or t
  misc_feature (968)..(969): n is a, c, g, or t
  misc_feature (975)..(979): n is a, c, g, or t
  misc_feature (986)..(996): n is a, c, g, or t
  misc_feature (998)..(1007): n is a, c, g, or t
  misc_feature (1009)..(1022): n is a, c, g, or t
  misc_feature (1024)..(1031): n is a, c, g, or t
  misc_feature (1033)..(1044): n is a, c, g, or t
  misc_feature (1057)..(1063): n is a, c, g, or t
  misc_feature (1065)..(1065): n is a, c, g, or t
  misc_feature (1067)..(1068): n is a, c, g, or t
  misc_feature (1070)..(1076): n is a, c, g, or t
  misc_feature (1078)..(1082): n is a, c, g, or t
  misc_feature (1088)..(1093): n is a, c, g, or t
  misc_feature (1096)..(1096): n is a, c, g, or t
  misc_feature (1098)..(1104): n is a, c, g, or t
  misc_feature (1107)..(1110): n is a, c, g, or t
  misc_feature (1119)..(1121): n is a, c, g, or t
  misc_feature (1127)..(1134): n is a, c, g, or t
  misc_feature (1137)..(1142): n is a, c, g, or t
  misc_feature (1146)..(1146): n is a, c, g, or t
  misc_feature (1148)..(1153): n is a, c, g, or t
  misc_feature (1155)..(1155): n is a, c, g, or t
  misc_feature (1157)..(1166): n is a, c, g, or t
  misc_feature (1171)..(1177): n is a, c, g, or t
  misc_feature (1179)..(1188): n is a, c, g, or t
  misc_feature (1194)..(1213): n is a, c, g, or t
  misc_feature (1215)..(1217): n is a, c, g, or t
  misc_feature (1223)..(1226): n is a, c, g, or t
  misc_feature (1228)..(1246): n is a, c, g, or t
  misc_feature (1250)..(1250): n is a, c, g, or t
  misc_feature (1252)..(1253): n is a, c, g, or t
  misc_feature (1257)..(1261): n is a, c, g, or t
  misc_feature (1263)..(1267): n is a, c, g, or t
  misc_feature (1269)..(1271): n is a, c, g, or t
  misc_feature (1273)..(1279): n is a, c, g, or t
  misc_feature (1281)..(1294): n is a, c, g, or t
  misc_feature (1296)..(1296): n is a, c, g, or t
  misc_feature (1298)..(1298): n is a, c, g, or t
  misc_feature (1302)..(1308): n is a, c, g, or t
  misc_feature (1311)..(1312): n is a, c, g, or t
  misc_feature (1315)..(1320): n is a, c, g, or t
  misc_feature (1329)..(1345): n is a, c, g, or t
  misc_feature (1349)..(1373): n is a, c, g, or t
  misc_feature (1375)..(1394): n is a, c, g, or t
  misc_feature (1396)..(1397): n is a, c, g, or t
cgccgagatccgcgatcccggcaagaaaacccgcgtctggctcggcactttcgacaccgccgaggaagccgcgcgcgcctacgacaccgccgcgcgtgagtttcgtggcgccaaggccaagaccaatttcccgacaccctcggaactcatccttaacaacaacaacataaacgctcgtagtcccagccagaccagcaccctcgactcatcctctcccccgccaccgccaccgctagaccttaccctcacccctctctcctccgctgtcttcccggtggcgcgtcctgttctattcttcgacgcattcgcgcgtgcggacaccatggtcgccgtctcgcgccgcgagacctgcggcttcgaacgccccgccgccgatttccgccgcggcgactccgactctgattataaccagtttggccgtttcttggatcttattttgagatttgcatggctctcaaccattgtcacttctatgtcagcaatgcccgactgagcctcactcttttgctcactcatggctgtagaattgtcacagccaccactggcacttgttgagtactgtggaaaggagaagaactcagaaaagaggacatcagatttcgcttctttctctttctgagcaccaagaaattgcagcctctgctcaagctccttaacaaagttgnnnnnnnnnnnnnnnnnnnnnnngnnnnnnnnnnnaaaannnnnnnggaannnnnnnnnnnnnnnnnnnnnnnnnnnnnnnnnnnnnnnnnannnnnnnnnngannnnnaacctcggnngcaccangnnnaannnnnngnnncgnnnnnnnnnnnnnnnaanaancngnnnnnnncnnnnnngnccnnnnannncnnnnnnnnnngnnnnnccnnnnnnnacnnnnnnncnnnnnnnnnnnnnnnnnnccccacacnacnnnnncccnncnnnnnnannnannnngnaccnncccnnnnggaannggcggnnnnnaaaaccnnnnnnnnnnngnnnnnnnnnnannnnnnnnnnnnnnannnnnnnncnnnnnnnnnnnncaccagcccgcannnnnnncncnncnnnnnnncnnnnnaaccannnnnnccncnnnnnnnaannnncccaccccnnnacctannnnnnnnccnnnnnncccnannnnnncncnnnnnnnnnnccaannnnnnncnnnnnnnnnnccaatnnnnnnnnnnnnnnnnnnnnannncctccnnnncnnnnnnnnnnnnnnnnnnngcanannctgnnnnnannnnngnnnannnnnnncnnnnnnnnnnnnnncnanccannnnnnnacnnacnnnnnncattggacnnnnnnnnnnnnnnnnnaacnnnnnnnnnnnnnnnnnnnnnnnnnannnnnnnnnnnnnnnnnnnntnnacgaa

SEQ ID NO: 3770 - DNA, 876 bp, Glycine max
  misc_feature (825)..(826): n is a, c, g, or t
atggcgatgtgcgcatcaaatataaagatcagtcagactttgaaaacattgctcaccaatttggtatatttcaagagtggaaggtaattcaactatttttattcttaacttttaaaaggcaatgcatcatattatgcaatggagagccctgaatttcaatgcctgatttcaatctactgtggcagattatacactggaatagttttagaatgcaactaacctagtctgagtcctggatgaaatttgaaacaaaaagctaggttagaatacgtattagaaggctgtgagtttctgcatcagaaggcaggcatgctatggtagttaattttcccaagtggatcgaaggttaaggattccttagaagttttccatttgtttggtttgttggttgggtaggatggtgaatagtaaatgcagtaatttgaatcaaagcctgaacatacatttgagaatacttttaagctgtgtggcctgtaggagaatatattattgatttcatctgaccatgcatgtagattgtatgtggtgtagctgtgcgtaacgaccctggtctatgtttcccatctactcttatatgcctttttcttcttgtggatagatctaattttgtcctacatttttttctctgcatttgaccatttccaggatggtgtgcccaggacagcatataaaggagtagtcgttttcagatatcaaacctcacgacgtatattccttgttggtccagaatctttgaagctacttcagatcgaagagtcttaatgctggatgaggaagaaaaatattcacaatgtaagagtagttgttttcagatatcaacggaanntgttgcggagttattgatattgaacttaaaagtgacgtacgatagggata

SEQ ID NO: 3771 - DNA, 860 bp, Glycine max
  misc_feature (798)..(798): n is a, c, g, or t
  misc_feature (800)..(801): n is a, c, g, or t
tttaactcaactcctagctcatgatcaacacttcaaggaaagaagaaactaaagcatttgactttatctcggtaagtttggtataaatactttacaagtactttccattggtttaatttctgttaagggtctggtttgaatttactgctttgtgaaatacagattaactagtattcaatttagcaacttgtaattaaatcatttaaactgtgattatctcaaaaaacaagcaatttggtattttacagggctattcatgaaaacaaaggcttgaaacaagaaatttattattaaacatctagaaaccggaagtcagcatgaataatttgccttctagatcatagtatttttttccggtttgcctttttgttgatgagggaagtatattcctgttcatgttaaaattggtttaataaaattacaatgtcacaagtcctcagttggtctccatgctgtgcatggaataggtaattttcaatatttaacatattcaaggtttttttttttaaaagtgtgctttaggcgggaattgattgagatgatataatttgtttagcttttggtgaaatgacatgattacattgtttcgtgcttgtaggaccatatgtcatctgctcgtgattcaaggagaatgatttaaattttctatcttgtgctgttgtggaggatatttacggtgtggaattgatggattgacattaatagatcaaacggtttatagtttccttacctgtgcaaaaagttgatttctcttgccgtgatggagcattataaatgacattctacatgtccatgttnannacaaaataataaaatgagaatacgttttggacatgaagaagagattcaaattggtgcgc

SEQ ID NO: 3772 - DNA, 376 bp, Glycine max
ggctaggaattggagccaccccaatgattagtatacttaaggacatagtgaataacatgaaagccatggaagaggaagaggagaccaacatagaggaaggaacaaatagtgggtttggtaataaatcaccaagagggtcgtccccacacaagaaaaatagctcgagcaacttcaacactaggagggcctacttctattgggtgacaagggagcaagggtcctttgattggttcaaaggggtgatgaatgaggtggctgaagaggatcataagggggtgattgagctccacaactattgcactagtgtctatgaagagggtgatgctcgctcagctcttattgctatgttgcaatctctaaaccatgccaagaatgg

SEQ ID NO: 3773 - DNA, 860 bp, Glycine max
  misc_feature (779)..(781): n is a, c, g, or t
gagctgggatgaaagctgaattttggggtatgaacgcttttctcactcttttggaatcaatttgatttggtttctttgttattggggtgtgtgtgggttgaaagcctgagatcaggtgaagaggaaagataaaattgaatctttgttattttttaagaaaaaaagatgtccaaaaagatgggcttgctgagaataggttctaaaaagagacaaggtgacatcaaaagatcaaaacccagatgtagaaatagcaagtaagaattgattcgaaccttctttaacatggcataaaaaagtatccaatgattcaccctttatcctgcaacaataccagtggatgtatatatgcactgtgtttctgatatttgtttgataccagctttaacagactgttgattgcttgtcacagttagtaatgcatgattcatgcctataataatgaatttactgttgtgagtttattactagtctcctcctgtgtgtgtttacttattgagaatatattgtgttgctgttaatttgcaggaaaatggcaactctagttgaacctcccaacagaattaagccaaagggcaagcattattatacaatatggcaaacattgtttgagattgatacgaagtatgttccaattaaacctataggccgaggagcgtatggcgtggtgtgctcttcgatcaacagggagaccaatgagaaagttgcaattaagaagattggtaatatatttgagaattctattgatgcattgagaactttaagggagctgaagctgcttnnncatattcggcatgagaatgtcattgctttgaaagatgttatgatgccaatccacaaaacaagttttaaggatgtctacc

SEQ ID NO: 3774 - DNA, 1039 bp, Glycine max
  misc_feature (69)..(69): n is a, c, g, or t
tgatgatggctgagcgtgcattcactgacagagatggcctctttggaatgtcatggtataagcattttntaagttgttttcaggggaggtgttaaccaataaccaatgatatgtaaagattacaagcggaggcaactctagattaccagggataaattaaaatgttttgataataagccaaagcaatatcaatcaaaacaaaagaaaaagatggatgaccaataaggtgtagtatgattgacaaataatcatgtcccttaatgtgttaggagtctaatctcaagacacctgtgtattgaagagagcttatgttggaggaaaatttggcaatatattgggagaagtcaatttcttaaatgtatctttatcatgagggattagtctgtagttcacgaccaaaagatttcttagttacaaactgcaccccctccccccggaaatatgttaagagaaatcaatttcataaatggatttttatcataagccattagtttgtagttcatgatctgaaagatctcttacttttaccctccaaagaaaagtcaatttcttaaatgtatctttatcatgagggattagtctctagttcatgattgaaagattacaactacaccccccctccccccccagcttatgtcattttgtgttgatgtaattatctattagaacattttgttaaagttatccaaacatttaataatgaagtctttttccctttaattccatttccctgcatttttcagatttatggaccatcaaaacataatgactacggctctcaatctttccctggaatcgatgatgctgttaaaatggccaaaaatctacatactgcagaatcgtggcatcgtgtacagcacgaagtttggagagtctcaagagtcatcaaacaagcctcgctagttttattcggtctactatcatgaatatcaatttagttgtatatttcgattcatggtaaattatatctccgtaagaaaaaatatgtatatatgtgtgatgattcataaatctcaataactcaagaagagatttagga

SEQ ID NO: 3775 - DNA, 889 bp, Glycine max
agtcctatgataaaggttctgggatgagatgtatagagcacaagatgatttgatcaagtgagagccaaatcctaattttgtgctttttttcaaatttgatgatcttgattactaatgctcatgaactgcttatgaatagggaaatacgcaatcatgacaatgctaagaaagaatggactgacgatgaactgaagaaactatatgaaacccatgaaaggctgctagaccttgtttcattgttttgttatgttccaagaacaaagtatctacctttgggcccaataaggtattgatatttaattgcattctgtattcgaactaattttgcatgttactcatgttgtatctaaagagactagtatgctcttctgcatacaggagagtgcatcagaaggataacttttcaaaatgggctgaggaactttgttttgaattttgagtgttcacattttttgtgattctgatttttttttttttagaattttgtccttaagttcattaggcatttgtaaaaattaagacctaggcgttggtacaagaaaagttttttcatgccatgaaattatcattactgagactcataaatcctgggaattatgattcctaagaatgactaaacttgtttggttgatcataaatattctcatataagtttcctgagaatagaagaataacatagtatttttaccactaacaagtcttattggtgttattctctaaatatgattttcctctgaattttttatagtgccaaactcattgacatctatcgtacacgccacaatattagtgcatctactggtttgagtgatccagctgttgccactggtatatatggccttgtctatgaatcccaaccaccagctgctgagcctgatacacttgatga

SEQ ID NO: 3776 - DNA, 864 bp, Glycine max
  misc_feature (804)..(808): n is a, c, g, or t
  misc_feature (857)..(858): n is a, c, g, or t
ctagtgaagtcaaaagcataaagccaaattaaaaacaccaccaactactgcaactacaaatatcatcagtatctatcagtagtcacaaggatgtttgagttgctgcccagagcaaatgacaatacataagaaaaactaaattggaataaatagagcaattgaaagagagatcaagtaagaaaagccaaaagcaaataaggaagtcaattttcaccatacatacccataataacgatctttaatattttgttgtgacaattctccagtttctggcatctcgtgtctataagggcactcagctcctctggtacattcaccccttatgtagaaactgcaaatatgcgctcggtttcttttgtaatatggtgttgttctttgaagcttcatgatagtatcatttgggcgtactttaccataagaggattcataatctataccagctctagcctgcaccatgcttttattcttggtaaaaagattacaatcaagtaatgaccaaatagaactgagtcaaaacagtgcagatttacaacaaaaaaatgataaagaaaattgaaattttattagttgttgtcaaatgagaaagtgaaaatcagagtttcatggtagaggaattcagcatgtaacaaaaaaataactcccaaaaataaaaaaaaataaaaaacatgtaagccacacaaaaaaagtcactcaactacatacagattgaccttaaacccataactactttttctgatcattaattaggttcaacaatcatcaactacaaatatgacttagcacaaggaaaacataccctgcggnnnnnctcttcagcaaaatactccctattaacatcactcttggaaggcatcatnnaatcaa

SEQ ID NO: 3777 - DNA, 398 bp, Glycine max
ttgttgaggttcacctcgaaaggcttcagattagcgacgttggattgcaagcgatagcgaattattcgagtttggagattttgcatcttgttaagacacctgaatgttctgatattggacttgttgctattgcagacaggtgcaagcttttgaggaagcttcatattgatggatggaaggcgaatcgaattggggacgaaggtttgatagctgttgcaaaaggttgccctaatttgcttgaattagtgctaattggggttaaccctactaaggcgagtttggaaatgttggcgtctaattgccagaatctcgagcggttggctttgtgtggaagtgattcggttggtgatcctgagatatcttgcattgctgcaaagtgtgtggctttgaagaaactg

SEQ ID NO: 3778 - DNA, 341 bp, Glycine max
ttaataggaggtattgactgtctggccaacgtttaatgttgcctctccattggtttgtcttgttttgttccctatcctctgtagcagagcaggaagctgtgtatagtttggactgacttcttaggccttataatcaatcacatgattactgccttgtctgtctcattttcatactctgtaattaaaactagctcaattacatagctggtgcctacctatttccttctactattattatgttagtagcccatactgcttgctttgtgaatgtggtcatattcatttggcctttttgatgtcttctatgaatttctttaatggttttggtcagatgttgcaca

SEQ ID NO: 3779 - DNA, 365 bp, Glycine max
aagaatcctgctgaagtcagaaatgtcatgatggataatgaaaataaacctccaacaaaagatgatgctaaagtggaggaacatcctactcttcatcgaccagtagcacgtgttagtgcatttagtgtttataacactccaggaaggtcaacaatgggatcatgttcaaagatgttcccaaggcagagccctttgatccaatcccccaaaccagacgtaggatcctgcaagttatttgatgatattgattgtgagcccatggttccatcacaatgtggtcatggctgctgcacaggagactcgagggaaagccattcgcatggttcacttctaggtcctgagtttgttgactatttggagtcacc

SEQ ID NO: 3780 - DNA, 763 bp, Glycine max
cgaagctctctcaatcttattttctgattaacactaacaaataacaatgacggatgctgctgaagacgctacacgccgccgtaatgcggtggccgagtaccgcaagaagcttcttcaacacaaggaattggagtccagagtacgatccggttcgttccttcctttgtcatgctaatagcaactacaattcgctcttgtttttcattccgagtactttttattattatcattccgatttattagggttttgtttttgaatttttacgagtttgcctttgaaccgctaattgcagtccgagagaatttgcgtgcctcaaagaaagagttcaacaaaactgaagatgatctgaagtctcttcaaagcgtaggacagatcattggcgaagttcttaggcctctcgacaatgaacgctgtaacgatcctatcccttttcattccgtattttgaatgatatttcgctattcaatttcatagtatatactgtttcatttttaatgtgaaaaatctgtgcctgttgatcctggatgataatgtataatctagtagttgatttagctaatcaataaactatcttctctgttgttttgcttggttgatgtgaacttaagcttacgtcgatgattattaatattttatgtttttgtttctgtttctgttatctctcagtgattgttaaggcaagcagcggacctaggtatgtggttggctgccgcagtaaagtagataaggaaaaactgactgctggtacgagagtcgttcttg

SEQ ID NO: 3781 - DNA, 651 bp, Glycine max
agaagacagattccaatgcttgggcttttttgacgccatttacaccaatgatgtggactgtcacagctgtcttttttctactagtgggagctgttgtttggattttagagcataggctgaatgatgattttaggggacctcccaaacaacaaatggtcacaattttgtggtaaggaaatctggtctttttctccctcctccctttctcaggctctctatattgagcctacccatgttgatgatacatacagtaatcatatcaaccaacggtagggttttcatttttgattcgtttagctctggatatggttgtaacttctatttgttatttatttgacaggtttagtttttcaaccatgttctttgctcacagtaagtaccagttctttgtcttctgtgacatgtatggtccatgtataagtggtggctactttgagtttatcaacttgctcttttctgtactatgtaggggaaaacacagtgagcactctcggtcgctttgtgctgcttatatggttatttgtagttctaataattaactcaagttacacagcaagcttgacatcaatcctcacagtgcaacaactttcttcacctgttaaaggcattgaaagtttaataagtagcaaagagcctattggctacttgcag

SEQ ID NO: 3782 - DNA, 788 bp, Glycine max
  misc_feature (601)..(603): n is a, c, g, or t
  misc_feature (652)..(653): n is a, c, g, or t
  misc_feature (658)..(663): n is a, c, g, or t
  misc_feature (681)..(689): n is a, c, g, or t
  misc_feature (699)..(715): n is a, c, g, or t
  misc_feature (720)..(726): n is a, c, g, or t
  misc_feature (731)..(749): n is a, c, g, or t
  misc_feature (751)..(762): n is a, c, g, or t
  misc_feature (764)..(773): n is a, c, g, or t
  misc_feature (777)..(779): n is a, c, g, or t
  misc_feature (782)..(782): n is a, c, g, or t
  misc_feature (784)..(784): n is a, c, g, or t
gcggcggcggtggagatcgccgaacccggttcaaggccggtttttttcaaagaaccgcgttataggggcgtcagaaaaagaccgtggggccggttcgccgccgaaatcagagatcctttgaagaaagccagggtttggctcggaaccttcgacaccgccgaggaggcggcgcgtgcctatgacacggcggcgagaaccctccgggggccgaaagcaaagaccaatttcccactttctccgccgttctaccaccccgatccgttttccgatcaccggtactttgacggcgctggcgccggcgaagatttccaggatcaccggcgacccacctccagtggtatgagcagcaccgtataatcctaaatattagggttaaatatgttttagtttcttgatatggttcttatcttcttgatgttagcttttagtcccaagaaaaacagtggtcttctttaggtccttcatttatggaaatgtgtatacttcacaaaaagtcatatttgtgtgaattatttaattcttgatattatgatttttaaaaaaaaatctcatgacagggaaaactgtattaatttcagtaattaagtgccaatgatactgnnnttgtaatcaatttaggggatgtgccacgtgtcgatggtcagttggcagnntcaannnnnnttggtgacaaaagcctgnnnnnnnnnttgagctcannnnnnnnnnnnnnnnntccgnnnnnnnccacnnnnnnnnnnnnnnnnnnntnnnnnnnnnnnncnnnnnnnnnncttnnnttncnttcc

SEQ ID NO: 3783 - DNA, 384 bp, Glycine max
  misc_feature (372)..(372): n is a, c, g, or t
  misc_feature (374)..(376): n is a, c, g, or t
gggccgagcaaggaaagggtcatgctcaggaacagtttgttgtgcttggtgagagccacaaggctgggccttttggaactgtcaagggtctcagaaccaatccacctgtcattcctgatgaatctgtgaaccccagattgaccaagatcttgggggaagttgctatttataaagaacttattgttgctctcgctaactctaatgtgaaggagatgttgcagctatggttcaccaacatcaagagggttggcatacctaattatttggttgttgccttagatgataacattgaagagttctgcaaatccaatgatgttcctgtgtatagaagggatcctgatcaaggtgttgatgtggtcggtaagagtggtngnnnccatgctg

SEQ ID NO: 3784 - DNA, 1185 bp, Glycine max
  misc_feature (55)..(58): n is a, c, g, or t
  misc_feature (98)..(98): n is a, c, g, or t
  misc_feature (1132)..(1133): n is a, c, g, or t
  misc_feature (1135)..(1139): n is a, c, g, or t
aggtcaattccgatcatctttcattaactattttctttcattatttatttatttnnnntttttctctaaattcaaattgttatacctaaaatcttcanttcattccaccaacttagacaactgattaggttataggacctatatggtttttgggtttatgttgaaaggattatactatgtatgatataaagctattccttatagtcgtttgtggcgaactgtgagataaaatgtgttctctttatcacgctctgttcttgcgtactcacctataaagtttgattgttattatgttggatttgccagaattggaattaggttaaagcttatttaaacgtaatttgttttctactttgctgcagttggaacaccttccagccatggttacaggtgttttcaccgatgacaataacatgcagttagaggccacaactcaatttcggaagttgctttcaattggttagatatttgtctatggcgttttcgttgtttcttttatggttctgaatttgaaatgatgtttgatgaactccgtttatgccctgccagaacgtagcccaccaattgaggaggttattcaagctggtgtagttccacgctttgttgatttcttgatgagggaagattttccacagctgcaggtttgttatccgccttgttttactttatgtaatcaatatatttatctttgcttatttatagccttgactttgtttgatttttgttgtagtttgaggcagcttgggctttgacaaatatagcttctggaacatctgaaaacactaaggtgataattgatcatggtgctgtcccaatttttgtaaagctacttggttctcccagtgatgatgtccgtgaacaggtacatttcatgtaccttgtcatatatttgtttatcaataaaaattatacacttaaaatgagaacaaattactttttatgttgtttgacccaaaaaagtgtttgtttatgttatatgttgattttggtgttggatgataatctatttgctggtataatggtatgatgtttgtatgtttatttgttaacttttagttgacactatgcatcagaaggatgacagtacctagcagttgcagttatgtttcatttaaagtttaacatttttttnnannnnngtggacaatcaggctgtttgggcattaggaaatgttgctggagatc

SEQ ID NO: 3785 - DNA, 543 bp, Glycine max
gtggttagagggagggtgaggatgcagggaattaaattagggtttacaataatgttggtggttgctggcattgtagcagtgccacgcatctcgggtcaagtatgcaatggtaatttgggtactattcaagaggaatgcgaggagtactataaacccggagggccaactattccgccatctacagaatgctgcaacgctctgagaaatgttgatgtgccctgcatgtgccgacttgctaacaattttcagtcatacttcagcgggggaaaagttgtctataccctcaggcagtgtggaaaagatgttcctcccggaaccacctgcggaggtctctcttttcttcaaaaatgctagtgtgattagggtgttagttaaggaattcaagaaaaatatttttcatctttttatcttctcctatatatatatatatgacttctataataaatactttttatttcaggttaccgtgctccccctgcttctactcaggtgtgaacgtcagcattgaagacgtatgcatacaacttcccttaccctcgggat

SEQ ID NO: 3786 - DNA, 348 bp, Glycine max
ttgttgcaggaatgaccttggtgctctttgtcatgacccctcaaggtgaaggccacaaaattcaaaatgaaaggaaagtgtggtagatgttatggcggtatctctcctgagcttattcttctaatgtttttgttttattttttttaattttatgaataatgttcaagttttcttgaccttgcaagtccaaaaatttaatactcaggtcaagatttcttgtaagttatttataaaaatataataagtagagtttctagaattttagatattcgatgttatcattcccttgtaagcttcatagtttatttatcttctatgtatatgtaatgtttttttttttttcccagg

SEQ ID NO: 3787 - DNA, 460 bp, Glycine max
  misc_feature (359)..(360): n is a, c, g, or t
  misc_feature (377)..(379): n is a, c, g, or t
  misc_feature (382)..(388): n is a, c, g, or t
  misc_feature (398)..(399): n is a, c, g, or t
  misc_feature (410)..(410): n is a, c, g, or t
  misc_feature (414)..(414): n is a, c, g, or t
  misc_feature (420)..(420): n is a, c, g, or t
  misc_feature (431)..(434): n is a, c, g, or t
  misc_feature (436)..(442): n is a, c, g, or t
  misc_feature (445)..(451): n is a, c, g, or t
ccaataccacccatcatcttatggcgtctcttcctcttctcactctagccaccatcaacaagggtcaacaacaccgaaatccctctcttcacaacgcagcctcgtctcagtcccctccctcaaccaccaccaccacctccacaccccgaattccaccgtctaccaccactgcctcacaaccctcaagggtcacacctcctcctacatctcctccttaaccctctccggcaaattcctctacaccggctcctccgaccgcgaaatccgctcctggaaccgcatcccagaaaactcatcaaacaacaataacaatagcaacaccgtactcacgggaaacggtgctgttaagtcgttagacnnctgcttcttgtctgacnnnggnnnnnnntaactacttnnaactattggtnacantggagnagtaagtccannnncnnnnnnngannnnnnnctgcttttt

SEQ ID NO: 3788 - DNA, 365 bp, Glycine max
agatagccttatccatgaatttccaataggaagctgccacgtcagatacaggcaaatatgctgaaaatttccaccaccatttctctcaaaacacacgttaacatatccaacattccaacccatttcatcactcttcacagaaacatcgagcagcagaagaaagaaactacagaaaaaagaaaaaagacatggcttccacttctgcagtttcattggctatgccagtaacttatgccagccagaagagggtactggtgcctagctctgatgcattattcctcaagccactgcctctacgttcttattcttccaaggcaatggcagcatcaaaagtacccaatggaaggtttcaggtgagggcttca

SEQ ID NO: 3789 - DNA, 237 bp, Glycine max
cactcgcacgccgcatccgtggagaacgtgcttaggcttataataatgataatagcatagttgtcgccttttcgttttgcaatacatttcttgtttcttagggttttagtgttattttccagtttgttatgttttgtatagaagatagatatatcaacagcaacagcttcttaccatttgtagtgtgcctaaacggaaatatttgaataattagattcactttggccaattctcttg

SEQ ID NO: 3790 - DNA, 688 bp, Glycine max
  misc_feature (59)..(63): n is a, c, g, or t
  misc_feature (595)..(597): n is a, c, g, or t
  misc_feature (599)..(599): n is a, c, g, or t
  misc_feature (659)..(661): n is a, c, g, or t
  misc_feature (667)..(675): n is a, c, g, or t
tcagagaggggggatgttcataaattcatgttttgctcattgccaaagtgaactacaannnnnatggtttggggatgattctccaagaataaacaataaggtaccaatcttactccttggcagagagacatgatgataaacctgtttatttggtgtgaaattttaactaatttgtcaggggaacatttatattgtgcaaagtgcaacatagtaaccgacttccaatgaccagttaaacatattatgtgtacaataggaaaaggactttacattatgaaggataacagtcaatataagatctttgaagcttgaactatgtgtcaatattgtagtattttgttgtttgatttttcgtcctttgaccaaaatttaaggtttaggcttcaaaaggaggtcgtgtttgaacttttgtcactgcgaatttttagtcagcggtacggttaaaccactctactactatcttttacagactattgccgaagctgttggtgattggtattttagtagaaacttaagcaaggaaatagactgtgcatatccttgtgatgcaacttgtcataatcttataccgtaacctcaggtaatgccttgtatnnnantatgtgctaaatcttttggacgtcttgaaactaaattatcacccaatttgaaatgttgcnnngtaaannnnnnnnntaaactgaatttt

SEQ ID NO: 3791 - DNA, 941 bp, Glycine max
  misc_feature (877)..(878): n is a, c, g, or t
ctgatgacaaaggtatttcattcacattattaaatagttatctcactcaaattcattcattaatcaaaacttaaacttgggaatgaattgttgttaattattatgatgatgcaacaacttcttttttcttgcaggtcttcagacatataatgacgccaagcatttcgccatatctgcaaagataccggagcttagtaacaaggacagaaccctggtggtgcagtattctattaggtttgagcaggacattgaatgcggtggcggttacatcaagcttctttctggttatgtcaatcagaagaagtttggtggtgatactccttacaggtctgtcaatttcccatgtcatgtgcattttccttgtttcactatgatttagaggatatttgctaacttggttaaaaatggaagatgagcatatatagaaatcaagtatatcatatcgagaaatgttagaagcacacttttataatttatcaaaacccgttaaattatgaatgagacttgttatatagagtgggactcacattgtttcatgaatttcaataattttagttaccagaatagaatgtgcataagtttattttagcttatgtgagaagttcaattcatgttactttcttattttctttttctgtaagtgcttatgaagaagtttatccaaacaaggtctaactcctgcatgcacttactatttttatacatctaaatgctggttaacgtttcttaattagtctgtcactgtgctgagtagagtgaactggttggtcttgcttgatgcagtttgatgtttggaccagacttatgtggttcacagacaaagaagctccatcttatactatcataccaggggcagaattacccgattagaaaaganntgcaatgtgaaacggataagttgactcatttctatacatttattctaaggcctgatcctctat

SEQ ID NO: 3792 - DNA, 360 bp, Glycine max
gattcaacgttgttggtcgaaggtaacccttccgagacagttgttttatcaagtttgagtcttttggttggggtgttgaggttagtgagagataagaaacacccaactagtgttttaaccggactcatattactcaaaattgtatgttcacgtgaaccggttagaagctcgattataagcataggagcggtgcctcaattgattcagcttttacccactttgaataacgagtgtttggagatagcacttcatattcttgaggttttgtcaacacttcctgaaggtagattggctttgaaagagtgtccaaatattattcccaatgtggtcaagttgttgatgagagtttcggagagttaa

SEQ ID NO: 3793 - DNA, 383 bp, Glycine max
acttttctcatcagaagggctaataggttaatcgttcaacagattttgtcaggcacctcagagtatatgtatccaatgaatcttagcaccattatggctttggattccaagaactagatcaatcaatcaagggtctctgtccatcattttattaccgcacctcttttgtgtctcacaattatatatagtctacctgttaatttgtcatatatttatatatatatatatatatatgtgtgtgttcaaatttggtttcatataatatatagtaattatctccaatgtgtcagtgaatagtatatatattataatgttggagtggatggatgatggtaagtaccgtcctccttctccttctcttgggcagtacagaagaaagactg

SEQ ID NO: 3794 - DNA, 336 bp, Glycine max
ctgctcctcttgatcgtctgaaggtggtcttacaagttcaaagcgaacgtgcttctatcatgccagcagtaacaaagatatggaagcaagatggtctgttaggattttttcgaggtaatggattgaatgttgtgaaggtatcaccagaaagtgccatcaaattttatgcttttgaaatgctgaaaaaagttattggagaggcccacggcaacaagtcagatattggtactgctgggaggcttgttgcaggtggtacggctggtgcaattgcacaggctgctatctatccaatggatctcattaaaactaggttacagacttgtccctctgaaggtg

SEQ ID NO: 3795 - DNA, 384 bp, Glycine max
gtctcaccacggccctccctctcctccctcccctgctcgctcaaagcacgtcttcctattctgttccctttcactcagtcctctgcgtccggttagttactgttctgttccgattcgttactaattgatgattactaccattgacaatgcagggttcggcgacacacgatttccgtgttcgtcggcgatgagagcggaatgataaaccggattgctggcgtgttcgcgaggagaggatacaacatcgagtcgctcgccgttggcctcaatgaggacagggcgctcttcaccatcgtcgtgtcagggactgataaggtgctgcgccaagtcatggagcagcttcagaagctcgtcaatgtcttaaaggttcaccttttttttttt

SEQ ID NO: 3796 - DNA, 407 bp, Glycine max
gagagccttccatatatagcctcccaaaaaaatgaagagtactacctctttggctctctttctactttgtgccctaacttcatcatatcagccttcagccaccgctgatattgtattcgacaccgaaggcaatcctattcgaaacggcggcacatactatgtgttgccagttataagaggaaagggcggcggaatagaatttgccaaaaccgaaacagaaacatgccctctcactgttgtgcaatctccctttgaggtctcaaagggtctaccactgataatttcatccccatttaaaatccttgacatcaccgaaggacttattttgagcctcagtttcacttatgtacccccctgtgcctcaactccttctcggtggaccgttattctcaagggtctgccagaaa

SEQ ID NO: 3797 - DNA, 601 bp, Glycine max
  misc_feature (537)..(539): n is a, c, g, or t
  misc_feature (587)..(587): n is a, c, g, or t
gcacaagctcgccagcattggttagttgtactagtatattatatgatagatgataaaattattttaaagaaaaaaggatcttgaattaattttattattacaggggcactctgggcctctggaattggagcaacactagtggcttattcatgcaaaaagtctccaatgaagccaagtctcaggcttatccatgctaggtacttaccttaatttctcataaaaccttttaacttaacaataaccattttaaaaaaaaaaaattaagccccgcgtgaagtaataaaaatacttgtatgtgcttgcattgtaaatgtaattaattaatgacttgcttggttctttggttcgtaggatgcatgctcaggctctaactttagcagtgctatccggtgcagctgcttatcattattatgagaaacgtgatgttcagccaaaaccagaggcagattatattattcctgctcccaatgtcacccagatggttgaacatgaacttcaatgtcctttctaaaaattaaaaataaaactgtaggggtnnngttattaagattaggagatattcctatcatcgagtttttgctttgccntagaaagaatataa

SEQ ID NO: 3798 - DNA, 617 bp, Glycine max
tgccctgtattattgtatcaaatgtaatataaaatcatgagttcaattgtaatataaaatcaactaattagaaattacgttaaatgtgtcttttaaggcaaggacaaatccaattataagacaatttttataaaattcttaatataatatatacatgtgtaattgtaaattgctctcataatatgaaaaaggaaatataaaaatttaatgtataacataagtttgtttccacaatatttatatgaatattctcctacgacataaaatttctagattcatcactgctttgaggtcattactattaaatatgaaaaagagtaggcatataaaattaaggagatacatacatatgaacatggaaattgagttcatgggcgacatcgtggggctctgggacataggaatcaagagcaattttatgggcttcatcagcttgggctttgagaaaatcgtcaaactcagcaatgccagcctcaaggcatggaatgacaatggcgaaagtggccaagagggtgaaagcaacctttgttgcacttccaaccattattctttccatgacttgtgctttgtgtttatttttgttggctccaaaccttggctttttttttgcttttttt

SEQ ID NO: 3799 - DNA, 355 bp, Glycine max
atggaaatccattccgtttccatatggagaggcaaagaggattaaaaaatatggctacctatcaaatgccagaaccagttgataatactgggaaatccgaggcatggaaacgaagaagaagaactgaaagtgacaatcacttccagggtcagccaccacctcaaaggaccgttagtaatggagtccggattgctgatcctaactcactcgggatcctaggtgctgggccgtcggacaaacgctttgctagtgagaaaccttataggacacaacctggtggttttccttcaagacaaggcttctcttcaggtataaagtaaccagcttggtgggattagagaggctgattacaaga

SEQ ID NO: 3800 - DNA, 399 bp, Glycine max
tgcaaccggaaggtctgatgcttcatagggcaatcattgtccgccttctgagtgactttgctgtgaagaaggccaccaaagatctgggatactttcttgcagtgaccacactggagaaaataggggaaggaaaggtcagacaacatactggggatgtgctcttccctgtggtttttaatgtcatcaccttcaagtttttcaagggtgagatattagagggtgttgtccacaaggttctgaagcatggagttttcatgagatgtggtccaattgagaatgtctatctctcaaatttgaagatgcctgattaccgatatgttcctggcgaaaacgcatgcttcatgaatgacaaaatgtcaaagattggaaaagatgtcacggtccgcttctcggtgatag

SEQ ID NO: 3801 - DNA, 789 bp, Glycine max
  misc_feature (756)..(779): n is a, c, g, or t
acatgaacttagaagagggccttggactctggaagaggataacttgctctcccaatatatttttaatcatggggaagggcgatggaatttgctggctaaacgttcaggtaacacaacaagttaaatacataaatgaaaggccctgcaattttattttattttattctgattaatttcctttccattttatgaatcaggattaaagagaactgggaaaagttgcagattaaggtggctaaattatctaaagccagatgtaaaacggggaaatttaaccccacaagagcaacttataattcttgaactccactcaaagtggggaaacaggtgcttatcttgtgcatttgattcttgagctccacagggtttatcgtgattcttggtattgtgagaaattgtagacaaatgcggccaatgcagccgcaaaacggtcacaaggactctcaaaaccttgaggccgcggccgaaatcgtgattttttaaaacctgcctcttcaaaatgctggtagaagcaatgattcaaatcttgccactatcaacaaacatgatttccattccaaaatattatcttctctctggattttcatttctttctttaatgactataggtggtcaaaaattgcacaacatttgccaggcagaacagacaatgaaatcaagaactattggagaactaggattcagaaacaagcaagacatttgaaaatttacactgacagcagagagtttcaagaacttgttaggcgtttctggatnnnnnnnnnnnnnnnnnnnnnnnnctccctcccc

SEQ ID NO: 3802 - DNA, 605 bp, Glycine max
  misc_feature (364)..(366): n is a, c, g, or t
  misc_feature (458)..(458): n is a, c, g, or t
  misc_feature (460)..(463): n is a, c, g, or t
  misc_feature (559)..(562): n is a, c, g, or t
  misc_feature (568)..(570): n is a, c, g, or t
  misc_feature (572)..(579): n is a, c, g, or t
  misc_feature (585)..(588): n is a, c, g, or t
  misc_feature (592)..(593): n is a, c, g, or t
  misc_feature (596)..(596): n is a, c, g, or t
  misc_feature (598)..(598): n is a, c, g, or t
aagcaccgcaaaaacatttctacaagtaactaatggctttaaggcctgagaaaacaaagtaaaggagaatgtactaagtactaactcgaacccaaaatgaatacctagataaggcgaaacagaagagagtgagactctcttagatcattgaataaatataatttatacatgaaagctccaaagaggctttgctatcgggaaagctagttggcatgttaaaccaatactgaaactaaaactctagaaaatacaaatcaacttgaagttggttgctttccaagcagttgtgatggccatgaatctgcgggtgtgggatacctggcatgtggtttactgacaacagatgtagatttcggcatgacannngctgcttggaaagcaaccaacttcaagttgatttgtattttctagagttttagtttcagtattggtttaacatgccaactagctttcccgangnnnngctctttggagctttcatgtataaattatatttattcaatgatctaagagagtctctctcttctgtttcccttatctaggtattcattttgggttnnnnttagannntnnnnnnnnctcttnnnnttgnnttntnacgctta

SEQ ID NO: 3803 - DNA, 341 bp, Glycine max
cgagggaggaaaactaagaaagatgagtcccagatggcgtcatcatggaaattcatgcgtccattcaagccatcaacagttggactttccatggatttattatttaggagcaaataatcaatcagtttcttttgattttggcatcctagaatgaggatagtgatgatttaggccttgatacatcttttttgcatttcgaaatggttttcatttattttttttcgtgtcagttcctattttttgtatttcatttggcataaagttgttgtataatctacaacggggatccttacatttgtatatttagaggattaaattctctgctgtacagtttctgggag

SEQ ID NO: 3804 - DNA, 930 bp, Glycine max
  misc_feature (892)..(892): n is a, c, g, or t
  misc_feature (901)..(903): n is a, c, g, or t
  misc_feature (906)..(911): n is a, c, g, or t
  misc_feature (913)..(914): n is a, c, g, or t
  misc_feature (925)..(926): n is a, c, g, or t
agtgggtggaaatgccctgccattcttgattcccttccaatcctttagagtttaaggtagttcacatgagttattaatgttatgcttgccacattcaatttcaaggtctaattcagctttcttttctttgtacatttgtgggcatcaagttggcagtaaaaagaattgtaggaggaaagtggggaccttgcagtggtcaagcttgcatagcaatagactatttgcttgttgagaagaagttctcatatgctctggtattcattacaatcaccagccgctttttatgataaaattttattttgaataaatgattattttggtcctgaatatgtaaactagttataatttagttcctgaaatataattctttgctttagttactgaatgtgaaaaaactgtaacaattacgtcctatcggtgagagtatttttttattaagttataatactcaaagatcaatttgtcatttagttataaacttaaaggatcaatttgtctgtcacactttttacatattcaagactaaattacaattttcattctttcatactaaatagtcatccatttatacacatttgagaaccaaaatgttcatttacccttttacttttctaatagtaagttgttggttctcttctagatagaattactaaagaagatcattagaagattttatggtgaaaatccagtggagtcaaaggtaatttcaagaatattaaacaagcagcactttgaaagattatgcaatcttctcaaagaccctcttgttgcggcttccatcgttcatggtggttcagttgacgaagaaaacttgtaagttctgcctgcagggaaatagaagtggttagttaagtttatttgcttaaatcagccatatctaacaatcttttcnaggttcatnnnagnnnnnncnnattttgttagnncctc

SEQ ID NO: 3805 - DNA, 910 bp, Glycine max
  misc_feature (865)..(865): n is a, c, g, or t
cgtcgctataattccccgtttggatttcgaacagccccattctagacatttctctggttgaagccacaagaaccggcttcaggaggtaatcttatctctctgttatgctcatgggtaaagtattttttggtctatctaaaatatgtgaaattcgaaattggtcccttttcaaaaaaatttcccattttagccattataaattttttaatatgttactgttcatctagtatgttcatccagtattttaacatgcactaccaacaaatttgtttttaaaattgttgtacaaacgcctcagacacagaatttgtgttcaaccctataagcaaattagctaacagagttaacatactgaataaacaataacatgttaaaattttagagaaactaaaatgggataaaaaaatatattggagagatcaattctagatttcttatattttagggagaccaaaaacatattttagcctaagctaatttatatatctcgaactaaattacaattttttttatcataagtttgtgtaaactgggaaaagttttcagtaagagtaagtgcataggacagaggatagtgccatccaaggagtttaattatatttgagtaacctttgtgttttgctcaggctatttgattatattcaaggtaagaataactacaagcagaaaattgagatgacagcgcctgtgatcagtgaagtattacccagtgatggacccttctgtgagtcctcatttgttgtgagcttctatgtgccaaaagagaaccaagcaaacccgcctcctgcgaagggccttcatgttcaaagatggaagactgtattcgcagcaggtagacagtttggtggatttgtcaaagattctngtgttggggaggaagctgcagccttgaaggctagtattgctggaa

SEQ ID NO: 3806 - DNA, 400 bp, Glycine max
aagaagataaacacacaactatattggcaaaccatttaaagctgcaggaaccacaaataaagcaaacagattatttttttttcaattagaaagacaagtataatgtataagactataagttatacttaatgtataagtctttgagcttccggttgtatttgcaatttggttgcactgaggaccactttattttaaggaaataagtttttcatgtttctattcccactaaatcagttaaattcatgatgctgaaatgaaagcacatcaaacacatgcatttttttttcttctaaaaatagacaagtaacatcaagattttatactgtctctacaaaatgaacgtttgaaatccaaaactacaccatttaaacgtaaattctgcttgtcgtaggaggtgata

SEQ ID NO: 3807 - DNA, 761 bp, Glycine max
  misc_feature (46)..(51): n is a, c, g, or t
  misc_feature (722)..(724): n is a, c, g, or t
aaattgtaagtattatttaatgtttcttctccaatatgctggtgannnnnnttgattgctatttctgttgtggtttcctttacacctgtcattttatatatattatgaattggtgtaattttaggtgagttctagacagaacttcattatatttgactaatcatcatttttcccttctaaggtcaagtatttagtattatatcagattggttttatagttaaatgatgagaaggagataacgtacttactactactaaagtcaattgtggtatatgctattattttgtgatgtttgggggatttattcttttttataactgatttttattttcaacttgtaacagtcaataggttctcttcaaaagaaatattcaattggatcttttgaattgctgagtaaaactgctcccattcaagcgctttttcttcttattcttggtccatttgtcgattactacctcagtggcaaattgataaccagctataagatgtcttctggtgccattgtaagttgcttttccccctattgacactagtcttttatatcctgtatgtattatctttaattatacaaatactgttggattattcttttaaattttttctttaatatccgcagttatgcattcttctttcatgctcgctagctgtattttgcaatgtgagccaatacctttgcatcgggcgcttttcagctgtttccttccaggttttaggccannngaaaacagtatgtgttttgacgttgggatggctgcta

SEQ ID NO: 3808 - DNA, 572 bp, Glycine max
  misc_feature (402)..(403): n is a, c, g, or t
  misc_feature (405)..(405): n is a, c, g, or t
  misc_feature (436)..(437): n is a, c, g, or t
  misc_feature (470)..(471): n is a, c, g, or t
  misc_feature (508)..(508): n is a, c, g, or t
  misc_feature (519)..(519): n is a, c, g, or t
  misc_feature (521)..(525): n is a, c, g, or t
  misc_feature (556)..(563): n is a, c, g, or t
ggcggaatcgtgccttctatccctcccttccctcttctacgccaaaaacaataccctttctctctcaattcccaccaagcccctcaacctccatcttccatgctccaactcttcgctctttcccctcaccaccaaaacaacgcgccactcttctctcctcacattcgtggctcagacatcggattgggccaaagaagaagaggaagaagaaacctcgtgggagaaccaaggcgacaccgcgtggggaactgaagaaggtggccacgaagaagggggtttcgctgaaaaagctgaggaagataagatcttcgttgggaacttgcctttcgacatcgacagcgagaatttggcgtcgctcttcgggcaggctggcaccgttgaggttgctgaggttatttaaanntncctcaccgggacttccattttgaaaggatgnnacccagatcgtttagaaccaaccagggagtcanngatgaaaggttggctgaggaaaccactgaagtagtcnggggcttagancnnnnncataatgcatttttgttattttagaatcccnnnnnnnncttacaaat

SEQ ID NO: 3809 - DNA, 906 bp, Glycine max
cgaaggctttctctttggccaaaaattcctactgattttaggtactacccttttctcatggtgaatttaactgtgtattaactctttggagcatgttctcttgtacttcaaccagtcctggcatgccctaaaaaatagtaattataattaaattatgctaaacttatctattagttggaagatttcttgatattttttcttaatattatgcagtgagaaattagaggagttttctacgaaagtgaaatcaatgatggaatatctcttgagatgcatggcgaggtcactgaatttggaagagggtagcttcgtggaccagtttggggaacaaccgttgatgctagcgaggttcaacttctatccactttgttctagacctgatttggttcttggcgtcaaacctcatacagatagatcaggaatcacagtcctgttgcaagacaaagaagtggaaggtcttcaagttttgatagatgacaattggatcaatgtccccacaatgcctgatgctcttgttgtcaaccttggcgatcaaatgcaggtaaactaggttctgtctcaagaaattattctacttgttgatgcttaatcaagattcatcaaactaacagagtgtccacgtcatcgattaagtgacgaagtgactacatcatcacttaatggacttagactaacacaagtatcaaaaacaaaagtttggaaatgccaaataagaaaataaaaaaatattttggaagtagtaaaccgaaaaaatgagtatgaaaaacatatttaagccaactaaaaattactatattttgtacttactttcttgttggtgcatcattaactaaattttgaggcgtaggaagtgttcagttgaagaatgcttgatgaaattggtgattcttgcagatcatgagtaat

SEQ ID NO: 3810 - DNA, 395 bp, Glycine max
cgcctctgctttctcccagggagagccttccgccgagtatttcatcggcgtgaaatcgattaaaatcgacgaaaagacagtgccgttaaacaccactttgttgtccataaacagcaaaggcgttggtggaaccaagattagttccgttaacccttacactgttttggaggattctatcttcaaagcggtgacggaggctttcgtgaaagcttcttctgctaggaacataacgagggtggcttctgtggcgccgtttgaggtgtgcttcagtagggagaacgtgctcgccacgcggttgggggcggcggtgccaactattgagcttgtgctgcagaaccagaagacggtttggaggatttttggagcgaactcgatggttagtgtgagcgatgata

SEQ ID NO: 3811 - DNA, 544 bp, Glycine max
  misc_feature (532)..(536): n is a, c, g, or t
tgctgccaatatatttttctgcaggctgtttccaatggaaaatatatcgattggtgtttggagatgcttgtgaaaaattttgtgccgcctttttacctcttagattctctgagacaggagaacggaattgaaagaaaaaataaagttctgtcacgggtacatgcagcattgaaagaaatagctgatttggtgcctcttgcacccttgcgactatctccaatagttatccagaaaatgccgagtgtcttcagtaaggaaactgtgagttcatacaactttctctggatactttaaatgagtttgatgtatcaatcagcttgatgccaattgtcattatacattttttgcttgtcattttacattcagtatcttagctgttcagtatttccacttgttttttatatatatgtaatgtatgggcattgtttacttttatgttatgcattatgcaggatctgttaagactccatttccttggccttgaattattttatataacagacaatagataccattttttttttttactttnnnnnatgcattt

SEQ ID NO: 3812 - DNA, 764 bp, Glycine max
  misc_feature (402)..(402): n is a, c, g, or t
  misc_feature (419)..(419): n is a, c, g, or t
  misc_feature (445)..(445): n is a, c, g, or t
  misc_feature (493)..(493): n is a, c, g, or t
  misc_feature (507)..(507): n is a, c, g, or t
  misc_feature (510)..(510): n is a, c, g, or t
  misc_feature (515)..(515): n is a, c, g, or t
  misc_feature (548)..(548): n is a, c, g, or t
  misc_feature (556)..(556): n is a, c, g, or t
  misc_feature (562)..(562): n is a, c, g, or t
  misc_feature (583)..(583): n is a, c, g, or t
  misc_feature (601)..(602): n is a, c, g, or t
  misc_feature (613)..(613): n is a, c, g, or t
  misc_feature (653)..(653): n is a, c, g, or t
  misc_feature (708)..(708): n is a, c, g, or t
  misc_feature (753)..(756): n is a, c, g, or t
atttcaaacactaatgttcttgtggatgaaaacttcattgctaaggtggcggatgctgtacttcgcaattttttggggagagttgacattgcaggctcctcttctcaagtggcaacagatgaaatattccttgcatcagagtaatatattgccctaaagctcatgaatgatttgtgttgtcctggctatgcatgcgtttatttttgcacaccatgccttgcagggtgagagagttcagacgattttctgaaaagagcgatgtatacagctttggggtatttttgctggaattgttaagtgggaaagaagcaatagaaccaccatttccggactctaatcaaaatctggttgaatgggtatgtgattattttctagagtttagtttctatgtatgatcacttngtaaccgttaacgacgnccaatcaaaaatcatgttagggatgncttttaagataattaatgttaaagtcaataaaattaaccgatgtactntatactctattttntancatcntagatgcaaggtgacattcacacaatttgattntgggggcncaagtngaaagtgcgtcatatctactnttcatgatgtgctttggnntaatcttgtangtaaagtccatttgctgctatgtgattgattttttgctcnctttttcttctcgataataaaggtgctaagcaatcaagaccgtggcatgatgtcntacatcattgatcggagattggagagtagtttacagctgaaggannnnaagagtac

SEQ ID NO: 3813 - DNA, 422 bp, Glycine max
tgtttattagcttgtttttctctctggtgttgcatttgcttgcaaagcattattacaagccaaaaaccaccctttctcacaaactacccccgggaccaaagaagctacctctgatagggaacctgcatcaactagcaatggctggttcacttccacatcgtactctccgagaccttgcccttaaatacggacctctcatgcatctccaacttggtgaaatttcttccgtggttgtatcctcccccaacatggccaaggagataatgaaaacccatgatcttgcttttgtgcagaggccacaatttcttcctgctcaaattttgacctatgggcaaaatgatattgtttttgctccatatggggattattggagacaaatgaagaaaatatgtgtctcggagcttctaagtgccaagagagtc

SEQ ID NO: 3814 - DNA, 378 bp, Glycine max
gtcccttcatatgtgtaatacaaggcaggcttttgaaaactgttctatccaaatctcagatgcaatgccaaatcttgtggagatgagcattgactattgtaatgatctggttaaattgcccgatgggatgagtaacatcaccccgttgaagaagcttagtatcactaactgtcacaggctatctgcattgccacaagatattgcgaagctggagaatttggaagttctaaggctatgttcttgctctgatttggtagagatgccagattctgttaaagggcttaacaagctaagctgtcttgacatctcagattgtgtaagtctgtccagattaccagacgacattggtgagttgaagaagcttgagaagctctactt

SEQ ID NO: 3815 - DNA, 343 bp, Glycine max
cagaattggtttcagctacaaaggaagggttgaagctagatgatgagactgaggaagagaaaaagaagaaagaggagaagaagaagtcatttgatgaactctgcaaggtcatcaaggacattctgggagacaaagtggagaaggttgttgtctctgacagaattgttgattccccttgctgtttggtgactggtgaatatggatggagtgcaaacatggagaggatcatgaaggcacaggctctgagagacagcagcatgagtggctacatgtctagcaagaagacgatggagatcaaccctgacaatggtatcatggaggagttgaggaagagggctgaagc

SEQ ID NO: 3816 - DNA, 346 bp, Glycine max
catcgggtcattcactgctaacatccatcactcgatttgagacaaaagaggcaaaggtttcagttctgtggagatatatacacaaacatcttgcctgagtgatgtgtctgttattgcttgctgcggctttaaattttgctcctctgcccctcatcaatttgtataattcttgtcatgtgtgaattctttgcctttgattcatcatttttatgctactttatgttcttatttttataaggattaacaaagttttctttctatgatctggcattatcttgaaaaaaggtaatacaagtgtaagattttgtaaaaaaatcagtgtgccaacctggtaacaaacttgtga

SEQ ID NO: 3817 - DNA, 383 bp, Glycine max
tgtcatgttagttcgcctctcctttgagaaacaatgtaggctagcaaaagtagaacaatcatattgaagacattgataaatgtacatgcatttctggtttaagtgctacaaatctttctatatctaatgacccatgataattatttgtatcttttgggggagccaggactgacaatgctataaaaaatcattggaactgctcaatgaagaagaaattggatgcatcacccttagggtgtgacataaaagttgcctcttccggtttctgtgcttctggaataaggcctgaacatgttgtggctaaagtggagggtcaaagtttcaatggaatggtttctcccaagcagagtcactggttgaatcgcagtgttgataacctgcta

SEQ ID NO: 3818 - DNA, 370 bp, Glycine max
tcttctttggttttgttttctattgtagattgtaggtactgcttcaatacatctttcaatcaccgagatcttgaattcttcagtttcaagacaataattgaagttcaaggccattagttccaacaagaaggaaaatggggttcactagtacaagtgaaaaagaagagatgttcatggcggatgcagaaagagcaaaggagctcaaagcttttgatgacacaaaacttggtgtcaaaggacttgttgatgcaggaattaccaagatccctcgcatattctatcatccctctgataatttcaagagggtctcagaatttggccatgaagattacactattccagttatagacctggcaagaattcatgaaga

SEQ ID NO: 3819 - DNA, 394 bp, Glycine max
ttaccaagtatctctatttcaaagctgtggatggaagctatgtgtttaataaaggaaaggttcataaggtgcctgcaaacgacatggagaccttgaagtccctacttatggggctatttgcaaaacactggacacataagtttttcatttatgtgcaaaaatacaatgagagtgatcccaagacccatgaggggttggacttgacaagagtgactactaaagagttaatagcataatatggccttgatgataacactatagacttcattggtcatgctttggcgcttcatagcgatgatcgctacttggctgagctagcactggacattgtgaagagaataaagttatatgcagagtctcttgtacactttcaaggagggtcaccttacataaa

SEQ ID NO: 3820 - DNA, 458 bp, Glycine max
tcattacataaaggtgagaaaaaatcatagcttattaatgtaaccgacactaaaatcattctgtgtagctaagggttgatttttgtaattcaggttgttccatctgttgccatcggctttacagtttatgatagtatgaaatcatacctgagagttccatcaagagatgaagctgcagttgaaaattgaaatggtaaccaacaaaggaataagatggacatcctcaccggaataatataaaatgatccccttcccatttcagcctgctaacaccctagggacttcaaactggcttcttagtctctgtcgatttgactgttatttatacataatggtagtgcattctttcaagttgtacagcgagatggagcttatattccatcttcaaataggatactacatatacttctgtacaccttaccaaggaatgacccctttagattcgggtctcattcata

SEQ ID NO: 3821 - DNA, 405 bp, Glycine max
atgtgcatgatagtgcatgtttgaaaatcaggtggaaaagttcgaagtacttttgcaaaaagattaggacccttaattttgcttttattcgtcggatctgcattagaatgagtgtcataacaatttcaactgcaaaccaaacgtgctcataaaccgtataaacatgtttatatatatatattttggaattttgctatcctaaagtgggccctccttttagagagagaagtaaaagcttgtgtgtgtgtgtgtgtagggtgcctcaccaacttaagattggagctccttcaatcaatcttggtggtgtgtttgatgataatagaaacaagttaactacatatttgtcttgttgtataacatgaatatacaaaaaatgtgttaaccaacttacataggtcaattgag

SEQ ID NO: 3822 - DNA, 584 bp, Glycine max
  misc_feature (562)..(562): n is a, c, g, or t
gaagaagagtgtcgtggctgcgagattatggagaaagatgctcatgtcaggtttctcgagttaatgtactatatgctcccatctccgtacgagtcccaagagatcaaccatctcaccctcgcttactttgtcatctctggacttgacattctcaactcactccacaaagtacacacgatcatcctattcctagtttttgctttacctatgccattactattgttaccatgttccttattcatctgtaatctcatgtttttcttgttctgtttgtgtgatttaaggtcgcgaaggatgctgttatcagttgggttttgtctttccaagctcaccctggtgccaaggctgatctcaatgatggtatgtatgcaaatgcacttgttggctcgatttgatctccaaaatttgatttttgactgacccatttgaagggttttgctgcaggacaattctatggctttcatgggtccaaaacttcgcagtttcctccagatgagaatggggtatggaaaatgtttgaaattttaaagtgctaaacttttttttttctgttgatggagcncttggaggatcgtgatttctct

SEQ ID NO: 3823 - DNA, 530 bp, Glycine max
  misc_feature (326)..(326): n is a, c, g, or t
  misc_feature (475)..(477): n is a, c, g, or t
  misc_feature (490)..(490): n is a, c, g, or t
  misc_feature (507)..(509): n is a, c, g, or t
  misc_feature (523)..(525): n is a, c, g, or t
gcatgagcttattgctgatcctcatctcctgcctgcatcacaaattaattatgaagatggtctagctgtctatgcctacatgaattcaaccaagtaactaactcttcaatcattattaattctcttctttcttaatgttgtgtcttgatagttaacctaataacataaatatattgatcatgtaataggaatccgttaggatatattgatcctcccaagaccaagttgcagataaagcctgctccatccatggcagctttctcctctagagggcccaacatagtcacaccagagatcctcaaggtttacccattcttccattatgngcaactcatgagtcactttcaaataatccattgtaacttgtggctttagattaataatattcacaacatctttttccagcctgatgtcactgctcccggtgtgaacattattgctgcctactcagaaggggttagcccaacaaatatgnnntttgataagcgcnagggttccttttatcannnatgtctggaacatnnnatgtc

SEQ ID NO: 3824 - DNA, 1445 bp, Glycine max
  misc_feature (709)..(727): n is a, c, g, or t
  misc_feature (735)..(738): n is a, c, g, or t
  misc_feature (740)..(742): n is a, c, g, or t
  misc_feature (748)..(754): n is a, c, g, or t
  misc_feature (756)..(760): n is a, c, g, or t
  misc_feature (770)..(772): n is a, c, g, or t
  misc_feature (778)..(779): n is a, c, g, or t
  misc_feature (781)..(783): n is a, c, g, or t
  misc_feature (791)..(802): n is a, c, g, or t
  misc_feature (811)..(814): n is a, c, g, or t
  misc_feature (817)..(826): n is a, c, g, or t
  misc_feature (828)..(829): n is a, c, g, or t
  misc_feature (834)..(836): n is a, c, g, or t
  misc_feature (841)..(850): n is a, c, g, or t
  misc_feature (859)..(859): n is a, c, g, or t
  misc_feature (871)..(876): n is a, c, g, or t
  misc_feature (879)..(884): n is a, c, g, or t
  misc_feature (891)..(894): n is a, c, g, or t
  misc_feature (905)..(911): n is a, c, g, or t
  misc_feature (915)..(917): n is a, c, g, or t
  misc_feature (924)..(927): n is a, c, g, or t
  misc_feature (930)..(930): n is a, c, g, or t
  misc_feature (947)..(951): n is a, c, g, or t
  misc_feature (957)..(957): n is a, c, g, or t
  misc_feature (968)..(975): n is a, c, g, or t
  misc_feature (990)..(993): n is a, c, g, or t
  misc_feature (995)..(1001): n is a, c, g, or t
  misc_feature (1005)..(1010): n is a, c, g, or t
  misc_feature (1016)..(1020): n is a, c, g, or t
  misc_feature (1025)..(1028): n is a, c, g, or t
  misc_feature (1030)..(1031): n is a, c, g, or t
  misc_feature (1034)..(1042): n is a, c, g, or t
  misc_feature (1044)..(1047): n is a, c, g, or t
  misc_feature (1053)..(1065): n is a, c, g, or t
  misc_feature (1067)..(1067): n is a, c, g, or t
  misc_feature (1076)..(1084): n is a, c, g, or t
  misc_feature (1089)..(1090): n is a, c, g, or t
  misc_feature (1092)..(1092): n is a, c, g, or t
  misc_feature (1094)..(1109): n is a, c, g, or t
  misc_feature (1113)..(1116): n is a, c, g, or t
  misc_feature (1118)..(1126): n is a, c, g, or t
  misc_feature (1128)..(1131): n is a, c, g, or t
  misc_feature (1136)..(1140): n is a, c, g, or t
  misc_feature (1142)..(1156): n is a, c, g, or t
  misc_feature (1161)..(1165): n is a, c, g, or t
  misc_feature (1170)..(1177): n is a, c, g, or t
  misc_feature (1179)..(1194): n is a, c, g, or t
  misc_feature (1200)..(1207): n is a, c, g, or t
  misc_feature (1211)..(1212): n is a, c, g, or t
  misc_feature (1215)..(1225): n is a, c, g, or t
  misc_feature (1227)..(1227): n is a, c, g, or t
  misc_feature (1230)..(1239): n is a, c, g, or t
  misc_feature (1242)..(1242): n is a, c, g, or t
  misc_feature (1244)..(1251): n is a, c, g, or t
  misc_feature (1255)..(1264): n is a, c, g, or t
  misc_feature (1272)..(1276): n is a, c, g, or t
  misc_feature (1278)..(1283): n is a, c, g, or t
  misc_feature (1286)..(1305): n is a, c, g, or t
  misc_feature (1310)..(1313): n is a, c, g, or t
  misc_feature (1316)..(1325): n is a, c, g, or t
  misc_feature (1327)..(1327): n is a, c, g, or t
  misc_feature (1329)..(1332): n is a, c, g, or t
  misc_feature (1335)..(1338): n is a, c, g, or t
  misc_feature (1340)..(1343): n is a, c, g, or t
  misc_feature (1346)..(1347): n is a, c, g, or t
  misc_feature (1351)..(1357): n is a, c, g, or t
  misc_feature (1359)..(1361): n is a, c, g, or t
  misc_feature (1371)..(1371): n is a, c, g, or t
  misc_feature (1373)..(1390): n is a, c, g, or t
  misc_feature (1394)..(1406): n is a, c, g, or t
  misc_feature (1408)..(1413): n is a, c, g, or t
  misc_feature (1416)..(1417): n is a, c, g, or t
  misc_feature (1419)..(1420): n is a, c, g, or t
  misc_feature (1422)..(1423): n is a, c, g, or t
  misc_feature (1426)..(1426): n is a, c, g, or t
  misc_feature (1428)..(1430): n is a, c, g, or t
  misc_feature (1432)..(1435): n is a, c, g, or t
  misc_feature (1437)..(1442): n is a, c, g, or t
gctaagagatagcttctggaaaatttggaagctgcccaatctttcttttcttttctttgagtttacattatgatgattcattcaatgagttttgattctgtattttactgatctgcatacctaaattatgtgcatctggaaatttcccttctatgatcatgctgacattttttcccttttttttcaatgtaggttaatgcaagtggtcaattttgtggggttgctgagatgattggacctgttgacttcaataaggacatggacttttggcagcaagataaatggagtgggagcttccctgtaaagtggtacatcataaaagatgtgtcaaatgcaaattttatgcacattatactagagaacaatgagaacaaacctgttactaatagcagagacacacaagaggtatgtatattgtttttcggttccgcagttcctttaccaatgtagatttgacaagtctgcccaacctataaacacttaacattaatttttgagtaagttttacctgatcaagtacattgaacctgtgtgctctatgtaaaactttaaatttatgaaaacatgatgtgttattaaaggggattattgagtaagtatccctgccctcgcgggcttgaatgtgtagaggctttcagattgtcattttgtgacacttctataacttgattgtcttgattgaagcattaccaagtgttttttttttttnnnnnnnnnnnnnnnnnnnatgggggnnnntnnngttttnnnnnnntnnnnnaaattttcannngggggnngnnntttttttnnnnnnnnnnnnttttttaannnnatnnnnnnnnnnannccccnnnccccnnnnnnnnnnaaaaatagnaaaaaaaaaggnnnnnnaannnnnnaaaaaannnnaaaaaaaccannnnnnnaaannnacccttnnnnttnttgtttttttttttttnnnnnaaatcncccaaaaaaannnnnnnngggaaaaaaaaaacnnnncnnnnnnntttnnnnnnactacnnnnnccttnnnncnnctnnnnnnnnncnnnnaatcgnnnnnnnnnnnnncntctattctnnnnnnnnncccanncntnnnnnnnnnnnnnnnnttannnncnnnnnnnnncnnnnccttnnnnncnnnnnnnnnnnnnnnacctnnnnnctacnnnnnnnncnnnnnnnnnnnnnnnntcacannnnnnnntccnnacnnnnnnnnnnntntcnnnnnnnnnnccncnnnnnnnnaccnnnnnnnnnnccccttcnnnnncnnnnnncannnnnnnnnnnnnnnnnnnntctannnntcnnnnnnnnnnanannnnctnnnncnnnnttnncttnnnnnnncnnnacccataccngnnnnnnnnnnnnnnnnnnccgnnnnnnnnnnnnntnnnnnnccnncnncnncanannnannnncnnnnnngaa

SEQ ID NO: 3825 - DNA, 319 bp, Glycine max
tctcctcgactacttcggcgccaagaagctccaccagatcaccaacggcaccgccctcgccgccaccatgtaccaggccaccggcagcgctcccggatccgccggctttgtcaacatcaccgacctccacggcggaaaggtcggcttcggcgccgaaaacaacgacggcacactctcctcaactttcgtcaaatccgtagaagaaatcccttacaacatctcagtaatccagatcagcaaagttcttccctctgccgcagcggaagcccctgcacccgcacccacccaacaaaacctcaccaacattatgtcaaaacac

SEQ ID NO: 3826 - DNA, 438 bp, Glycine max
tgcctagattacctctccaacttttgcactgtaaccagcactaggaccaagcagaaagcaatgcaggtaagaatgaagtatatagagagagagagaggcaatagtgaattctataattaattgtatgattccttgagatatatattatgttgcagacagcagagataaaagtgagaatggactgcgatggttgcgaaagaagagtgagaaatgcagtgagttcaataaaaggagtgaaatctgtggaggtgaacagaaaggagagcagggtggtagtgagaggatatgtggatccaaagaaggtgctgaagagggtaaggagcacagggaaagtaagagctcagttttggccatatgttgaacagcatctggtctaccatccttatgcccccggagtatatgaccgtagagcaccctccggttatgttagaaacgtct

SEQ ID NO: 3827 - DNA, 374 bp, Glycine max
gaagaatgtgccatctattgtaagtggaaatctgaacatgggaaggaaagattttgagcatcaatatggtaatgatccttctgtgggattgtcaatatcccattccatagcagacccttcatcatgtctcaattttggtggcatcagaaaagttaaagttaatcaagtcagagattctgacaactgcatgcctgctgcatccatggggccctcctatagtagggaagataatagtacaatttcagtaggtgctggctacaataagaatgatggcgacaatatttcattgggtcctacttataacaatggaaatgacaacaccattgctatggggagcagaattagtaagactgatgacaatcttctttcaatgg

SEQ ID NO: 3828 - DNA, 608 bp, Glycine max
ctctgatcttgatcaagtccctcctcccggtggcaatcactctctgcgtcgcaggtatctctcctttataataatctcaatttattctcagctgcatcacttataaattattacaagttcttgaagttaaaaaaatcttctattacattgtcatcattattgttataccatattgaaattaaattgaggaaactgaataagctaggtgataacttgacatgatggatggtacattggtattgcaatcttgttgtatgcaggacattgatggggttgagtggtgcggcaacgttggggttgagtttgagtgatgagcaaagtgcaaggggtgcagcaaggcgtccaccacctccaccaccgacggagaagaaggacccgaatgtgagtggtgttcaggctaaagtgttggctagcaagaggagaaaagaagccatgaaagaagaagtggcaaggctaagagagagagggaagcccgttagtaaagaggcacctcctcctcctgctgcacctgaatagtttccacatgtttaacctttctattgtgatcacttacaattggttggtgttattgttgtattactatatcactgttggattgaataagaccg

SEQ ID NO: 3829 - DNA, 339 bp, Glycine max
tcgactcaggttgccacggcgaagcttgtgctgcaagatgggaggctgcaggagttctcgtacccggttaaggtttcgttcctcttgcagaagtatcccgcgtgcttcatatgcaactccgacgaaatggaattcggcgacgtcgtttcggccatcgacgaggaccaagttctgcaacccggtcagctctatttcgcgcttccgttgagccgcttgaggcaccccttgcagccgcacgagatggccgcattggccgtcaaggccagctccgcgctcatgaaaactgccgacaaatgcggctctcgccggaaacagattttgttctctaacgaatatgac

SEQ ID NO: 3830 - DNA, 683 bp, Glycine max
gcaaaggaagcagaggcagcagaagctgatgcggaggctgcacaagcttttgcagatgctacaacaaaatcagcgaaagggagaaaatccccaaagagggtaaaaaaactttttttccccactttttccatacatgatactataatacatctatagaagacgtagatttttttatgccaaggaaatgtgaattttatttttcatataacctagtcatgagggcaagtttctcatattgatcggacatgtgatttggttttatcattttggagacattccatttggcttcttggttttcctttttattttattttattttatccgcaaatgcttgcttgttagttttgttagaaatgttaattaggagaattcaaacccgtgacctctccggctcccttctttcttccccaaccacagggtcaaccttatatctcttggctgcttagtgattccctgctatctctatcaaataatgtagtattctaattttttggcatttttaaatgtgtagatccatgcttgatggaagtttgaagaattagactcgaggagagatgaacggtggaattgagtaggacagccagccagctaaatatcatttgctggtatagtctatagtttgcaatattggaggctcttgtgactatgcaagtttcacctttattaggatatatttttggata

SEQ ID NO: 3831 - DNA, 506 bp, Glycine max
tctgcatctggtgaagctagtgcttcctcaggtaacagaactgaaattggaaccagctacatggctccaccaccaactcagattcaaccaccaaagaaaaaaagaaacctccctggcaatccaggtttttttttcatattcttcctattcaaagtctaaacctcatttgttttggtttggttaaaaaaaatatatgtcatgttttgtgtagtttaatgtgttttcttattttatttttgtttttgactattcagaccctgatgctgaggttatagccttgtcccccaagagtcttcttgccacaaacaggttcatttgtgagatctgcaacaaaggatttcaaagagaccagaaccttcagcttcacagaagagggcacaatttgccatggaagctgaagcaaagaacaagcaaagaggtgaggaagaaggtgtatgtgtgtccagagccaagttgtgtgcatcatgacccatcaagggccctgggggacctaactgggatcaaga

SEQ ID NO: 3832 - DNA, 404 bp, Glycine max
cggagaagcgagccaagaactactcctcgaatgctgtaactgtttggacaagtctttcgttgatgcaggctacaccagttcgcgcaaagtgaactgcattggtgccctcgaactacgacttgttcggagaggaacattccagaagattcttgatcattacctaggactaggaaccgctgttagtcaatacaagacaccaagatgtgttggtcctacaaacaccagagttttgcaaatcttgagtgaaaatgttgtgaacaactatctcagtaccgctttcaattgaataaaatttaggaacaacaatctattataaagttcacttagttttaccactttgtgcagctttctagctagcattcttctctttatttaggccattctcaaccctttcttcgagtcat

SEQ ID NO: 3833 - DNA, 434 bp, Glycine max
ccaactcaactattggcattgaactgaagacaactaggggtagaggtggttatatgaaaaacatcttcatttctgacgcaaaattggaaaatatttacttgggtatcagcatgacgggaagctctggctcccatccagatgacaagtacgatcctaatgcagttccggatgttggtaatgttacttttgagaatgtgattggtacaaatattgctattgctgggaatttttcaggaatagttgattcgcctttcactcctatctgtcttttgaacgcgaccttttcttccagttctgagtcatcatctccttcatggttttgttctgacataatgggaatctccgaggaagtgtttcctgagccatgtcctgatctgcagaacacgtattcaaacttttcctcttgcttttcttccctacatccgtcgtctagt

SEQ ID NO: 3834 - DNA, 701 bp, Glycine max
tgctgcatccaatgttgtcactgagtctaacatggcccatccaagcactatgtctgaaagtttttatggctcatctgatatatcctctggtgaagataaccactatcatgttgtgaggcccttacagagtgacaaatggtctaaaggaaaagatggttatcttgtcactgatttatggggtgcagaagttggtacgtgggtgtttgccactcctacagtttggcttcaacagacagaagagaaaatgtatctctgtgtttatcagcatagaagccttactttgatgcttctgattcctgtatcatccattcctaatggggagcaaggtgtgtcggcagtgaggcagcaagttattgaaaatgttagtcttctagttctatcatagtgaactttttgtttcctaacgaattctgattagcttttgcacatcatatgaactgacacttagcattctagtgcatgcatggtacaattcactgacaggacccctttttgctgttatgtcatgcctaaacatgtccccaggaattactttgtatcacttctattctctctcccttttactgaaattgggaagcatatgaaattgaactgagatgtttagcaaatgtatctttttctctgatcataattttttttggttgaatacatcaggcatcacttaaaatattgaaagttgaagagaaactatcgaaaggatg

SEQ ID NO: 3835 - DNA, 1004 bp, Glycine max
cgtttctcccactgattcacgaaaccctaatttttcgtggttcctcttctggggagcgaagatttagggttagattgagctgaggtggcagatgcagcagcatctcctctgagaaaaaaaatggaaggtggcaagagaattacggtgagccctcgaccttgctgcggccgcagaatcgttgccgcgaagaagagaccgcgtgcgaacgatggcttcgtcaacagcgtcaagaaactacagagacgcgaaatcagctccaagcgtgatcgcgctttcaccatgagcgacgctcaagagagattccggaatattcgcttgcaggtcccatttccccaactttttttttgtttcgctttttaaaagtttgtgtttgaatcctccgaacgtgaatggaatttttggttagggctcagcgtaaaaaaaatctggttggatcgggttagaatgtcgtgtatttgtgttgtgtggtgccttttgccctaattttgaagctgcagttttaaataaattagcataatcttggtaaattttgtgagtttagggcctgctgattattgatggattgaagcattgtatctttgatgcagaatgaccatgtcgactgtgtttaagacaaagtttgtgtttgattttagtaactcttggtgtgtactatatttgtatttgtatttggtgatttgatagatggtaaggactagaacactactctcaccctgccgcttgcttttgttttcgatacctctgcctgaaacaacatgggataattcgactagaaaagtgttgtggcgtttttgtttgtatcaatccccctaggcttgtgtttggtataatattttaaattattgtttctagtggtataacaatcctgcatcacttgttctgttttaaataattgatgttgaagactcttctgtttttgatagtgagatgtgtactttactgtatgtacgtatgcccatttccctgcacttgtgacatgtctgatggttctgttacaggaagaa

SEQ ID NO: 3836 - DNA, 358 bp, Glycine max
  misc_feature (327)..(328): n is a, c, g, or t
cacgtgtacacagagggtttgcatactatccctcttgagagtgaaggaatgaggtattttgtgagcagcgagccagagaattgcaaaaatggtctcaagctacacgttgaggttctgcccaaggctgatgaacgtatcacagagccttccacttctaccctaacagatgaggctgtggcgcccactactccttctggttcaccacgttatgctcacaacactatgttaaagctcacggttatattgtttctcatcataggtcttgcttactgacacctgtcccaaccctatatatgtatttaagacactattttgggatttgggacnntgctatgtagggaccctgctatgtatatgt

SEQ ID NO: 3837 - DNA, 464 bp, Glycine max
catgggtggatgtgcctccaatgcgccattccattgttgttaaccttggtgaccaaattgaggtatgtacctttttctttcaataatggttatgtccctaaagcataacacattacttatagtaattctcattcaacattttggtctaatatcataggtcattaccaatgggagatacaagagtgtggagcatcgtgtgattgcccaaacgaatgggaccagaatgtccgtagcctcattctacaaccctgccagtgatgctcttatctaccctgcaccagcattgttggagcaaaaggcagaggatacagaacaagtgtatccaaaatttgtatttgaggattacatgaagctctatgctacactcaagttccagcctaaggagcccagattcgaagccatgaaggcagtaaactcattttagactatttccaactccatcacaccttaacaggagctaaaac

SEQ ID NO: 3838 - DNA, 611 bp, Glycine max
tgtgaaaaagtatagtcaaactttgaaaaaaaaaatattattttagagagaaaattgaatcaaactattttataatacgaacgaattacatctaaaaatttaatttgtttaaagaaacaaatcaatttactttattaaagcggttcgattaatttggatttttaaaaaaatacaattttacacggtcctaagacaagacagacactgtttgtctttaatttttctagtttgaaataagacataacatagtaaaagacagaaagaaaggtgaacaatgtatagactttatcgttgaagtacttaaaaagactcggaattaattgagtcaaaatttgaaattgaaatcacagaattaaagctggtgaacatcttaaatgaatttaatttagtgagtgaacataataaagtgatgaggaaaatgaaggaattagggatgtgacgatatttgttggggatatttgcagggtccgacgtttggggcgatgatgatatcagggcagaaggcggctcatttggcgttgaaggctttgggtaggaacaatgcaattgatggaacgtgtggagttggaagggaagaaccccagcttattttggcttctgcggacactgag

SEQ ID NO: 3839 - DNA, 365 bp, Glycine max
cgtcgcgattggctaggtataacaagaagcctaccattacttccagggagatccaaacggcggtgcgtttggtcctccctggggagttggccaaacacgctgtctctgaaggtaccaaggccgtcaccaagttcaccagctcttgattggttttgtttcctgtgtttcgattagggttttctgttgaccccgatttgattcgcatttttaaattagggttttattttcctttttgttgcttttgagggtgtagatgtaaaattaaagctttatttttaaataatataaatgccgttttttaatatgccttgttttgaattgtgatccgatcgaaacgtctttttgcgtcttctttggttttctgg

SEQ ID NO: 3840 - DNA, 893 bp, Glycine max
gtcatttttcagatccaaagacgagatcttctacccatcatgatgaagctcgggtacctaaattagggtcacccttctagaggaacaacaacacttgtcactcttccattatacatcagagatttcaggaccgtgtttttcattttggaacggtgggtgaagattttttgtcggtacgggtgagaatttttagcaaatgaatttgttaaagatttctttcgcaatgaatttgttagcttggtgaatttattgcattttattttcatggacatgatgcttactagccttgtaagagttccttaatgtctatgatatgtggtttctcgtgtcactagaatgattcttatatcagagatgaaccagactctcaaacatgcttatgttgatgctgcctagtacctaggttttatttggtacctgcagttgtcatcattttttggtttattggtttctagtgccttataccttgcaacttattgttatgcaggaattgaatcctattaaacctaggcactcacgtcttctgaggagtgtggtgcaacatgaaactataagaatcaattgagcagtgaatacatttcaagtgatgacttttactggcttgtgtttagcggtggatgttgattttatattctattattattttctccttgtttagcctacatctcaactgtctgaactatggtcacctttggaaagccaaggatggaaaccttatgttgaatcaaataagccgagtgagttacattactatcatttgtttactctgttatatgctgttatagctttgagaatagtgtcactttggtatatctacgggctcatttgatctttctatgatccaattaaagctgcattattagagaagttggagggatatatccaggtctttc

SEQ ID NO: 3841 - DNA, 688 bp, Glycine max
gagcatatagtataactgattctactattttagacaaatcaggtgaattgggtagagggggttcaactgcggttacagcaatattgatcaactgttacaagctactagtggccaatattggggattcccgggctgtcttatgtaagaatggcgtagccaaacaactatcggtggatcatgaaccaagcatagaaagtgaagatataaaaaacagaggtggttttgtgtcaaacttcccaggtatgacattttcgaatgtaagataataattttgcattgatcttaatattgcacaatgtcatgggtgcttaattttagctctattagcatatggttcttagcttgttcttatcttcttgataatattagggttaaatatgttttagtttcttgatatggttcttatcttcttgatgttagcttttagtcccaagaaaaacagtggtcttctttaggtccttcatttatggaaatgtgtatacttcacaaaaagtcatatttgtgtgaattatttaattcttgatattatgatttttaaaaaaaaatctcatgacagggaaaactgtattaatttcagtaattaagtgccaatgatactgtttttgtaatcaatttaggggatgtgccacgtgtcgatggtcagttggcagtgtcaagggcatttggtgacaaaagcctgaagatacat

SEQ ID NO: 3842 - DNA, 500 bp, Glycine max
ggtgctgcagctgtgctgatttggcattttctggtcttgttgcttgcttccatttcatgtttacatagaggagcaagcttagctactttcggcaaatgaactcagagacccaaagaaagcgagtgttgtatgttttagaactgagacaaatagtatatatttgtgtttgggatttgtcatcttggttggttgagcattcttgtcaaatgaggtatgtgttttcgaatgttctaattcctttcaatcttcttctaaaccaaaaccccttctcctcaaattaaattcattttcctctcacttttttattataggtaggtgatttattttgacacgcagattcaaactgcatgcaatacacgcgcaagatgttttaaagaccacgccagaaagagaacaaaagaaaaagaaaaaagccttgtttcaaaaaaaattcccaattttcaaggaaaagagaaagagagaaaaaatggattgtagtaacgagttggaaatgcaagaac

SEQ ID NO: 3843 - DNA, 650 bp, Glycine max
ttcatgaagttaatgatttatcggcatcaaagaatgaaaaatatgggtccatgaattcagcaagcaaaacaaattccccacagaagttaaatgaagttgaaaataatcatttatctgaaccctcacaacttccatctccatccccaaatgattcattgaggccatcttccagttctggtagccagtcacctctaggtaaagtttttgtttatatctgtttaatcttatgagtaacagggttgctttatgtcctgtttccctcaatgtactgggttgaagtattccttgaattttccaatcaaacaattctaccatatggatactatcattgctctccctactagaaaggaggacaatgtaaattttcagaagagatagtgaagaaaagcccacagaaataggaggacttaggtcaggagaagaaccttagaaactatttctgaaggtattttaagtgagaagcagcatgactaagcctataatttaaataagcatgtcacttgtatgggttctgcttttgtgtgctaacccccaaatttacttgcttagatactcttccatgctggaaggaatcatcctgacaatctagagtcacttatttatttacttacaatttttctctcatttcttttcaatatatctctaattat

SEQ ID NO: 3844 - DNA, 395 bp, Glycine max
gcaggaggaaaagttgactttaggttcgtgccatttggtgtgggaaggaggagttgccctgggatcatacttgcattgccaatactggggcttgtgattgcaaagttggtgaaaagttttcagatgagtgctccagcggggacaaagattgatgtgagtgaaaaaggagggcaattcagcttgcacattgccaaccactccactgtgttgttccatccaattaagacactatgatctgttaggtcataacaaaacaagcacttagcttctgaaaaagtcttgagagttgagtcttccggtgttgctttcttagatgcatttgtttatctttctatttcaattatatacagtatactgcgtgtaatgtttctccataaggcagtttgaattctgtc

SEQ ID NO: 3845 - DNA, 523 bp, Glycine max
agaaaccgtaggactgtcaaccgtgcatatggtggagttttgtctggaagtgccgtcagggagaggtttgttttactagacttttaacagctatatattataataactcgtatgatttaattgtttgcttacatttatctctggttctataggattatccgagccttcttagttgaagagcaaaagattgtgaagaaggtcttgaagatccagaaggcaaaggaaaagcaggcctcaaaggcttgaatttgaaaaacacaatgagacacatctttttggaggactgttaggtttgagtggttatagtaaatcacaaattttattagagttgttctcatgttaattgtgcttttattatttggcttatttgaactctttctagagcaagtgttaaagttgtcgacaatgccattacgatacagttttgtttgtctcattttcttttgatggtttattggtatcatcttgtttctttatattctaatagaactttgtaattccactcgaattgggtatatctcaa

SEQ ID NO: 3846 - DNA, 924 bp, Glycine max
  misc_feature (905)..(906): n is a, c, g, or t
ggccgttttcacacctggattgaaggttccttggcttcttcacactcacagcgtgccaccatcacgctacactaaggtacgtcctgctctcaccaaactcattttcatcctctatctctattcaattcaaccctgcatttttttcgtcatcatctaggtttgtgctttcggtatcatttcatttaattaagtgatgtatggggctaggtcgaaaattcatctgtttgttgcatagaataaaatataaatttaataattctaaacttcagagactggtacctccaatttattttaaaaccgattacccatattcatggctttctgcgggtgttcttgattcagcagcttgtgtgattttagagtgcaggaacatcctgtatgggttggaaagcagctgagaaactcattaggcactggaaaattctcagaggagataatgtgagtcagccaattcaaacccaccatatctttattaatttcacttttttctttattttataatttttagtctcacagtcacacattttaacaggttatgataacaaggggcaaagataagggtgagaccgggattctaaagcgtgtcattcgctctcaaaatcgtgtcattgtagagagtaaaaacctggtgagagatattatcatcacaatttggtccttctgtttttctaatgccctatcttccttagattatgttttcaattccactgtcaatgtgtcttgcatcagaatattaatcaattgtgacattgagcatgtgattgtgtaaattttcctgataggtttctcactccaatgccttttgtcatcctctttataggtaaagaagcatataaagcaagggcaaggtcatgaagggggcatctttacagtggaagccccactgcatgcctccaatgtgcaannctgacccaggacagagta

SEQ ID NO: 3847 - DNA, 889 bp, Glycine max
  misc_feature (306)..(306): n is a, c, g, or t
  misc_feature (367)..(367): n is a, c, g, or t
  misc_feature (386)..(386): n is a, c, g, or t
  misc_feature (427)..(427): n is a, c, g, or t
  misc_feature (429)..(429): n is a, c, g, or t
  misc_feature (510)..(510): n is a, c, g, or t
  misc_feature (518)..(518): n is a, c, g, or t
  misc_feature (568)..(568): n is a, c, g, or t
  misc_feature (630)..(630): n is a, c, g, or t
  misc_feature (697)..(697): n is a, c, g, or t
  misc_feature (705)..(705): n is a, c, g, or t
  misc_feature (821)..(827): n is a, c, g, or t
  misc_feature (875)..(877): n is a, c, g, or t
  misc_feature (882)..(883): n is a, c, g, or t
ggttggcggtctgtgtattgcattcctaagcggcctgcattcaaggggtctgcgcctatcaacctttcagatcgtctgcatcaagttcttcggtgggctcttgggtctgttgagatttttttcagcagacattgtccaatctggtatggttatggtggtgggttgaaatggttggaacgattttcctacattaactcagttgtatatccctggacttccctcccactgcttgtctactgtactttaccagccatatgccttctgactggaaaatttattgtacctgaggtatgcttatatgtcttntgactggaaaatctatttgtctgtcagtgaagaaatcactttcgtatttttccttgcccanctagggaattaaaacaaangaaaatgtagtatttggattgttgagattaaggctaggatntngctcctctgaagtgtaggtgaactttagagggaatagcgaggggttgttggaaaatctagagtagagtagattttataatntaagcctntgattttataatcaatggttataaagctggattttcccttttgatgtgcnctcaccatacagaaggtaaattcataatgctacatgtgggaaaactagaatgaaaatgattntggagcatctaaatactcgtatctgtgaccttgccatcttgaaactattttggaggttattggcatngcatattnctgcgtcatttgtgttcctgtaattttaaacagctggattttacttcaaataataaaagcgataggcatagacttgttaggttattaacatccaaatttctgtttcaaatgcagannnnnnnctatgccagtattgtgttcatggccctcttcatatccattgcagcaannngcatnntgagag

SEQ ID NO: 3848 - DNA, 479 bp, Glycine max
acaggatgaatccattgttgccttgccaattgatgaactaatagaaaaggctgatggatttgctggtgtatttcctggtatacttcggtgttgtaattgcaatttattgttttgcttattgtttgacatgtaatagatggaataactaactgtagtaattttgtatcgtatgatttttttctgatgtatgttggtttatatatttggtcagagcacaagtatgagatagtgaaacgcttgcaagctaggaaacatatttgtggaatgactggtgatggagtgaacgatgcacctgccctcaagaaggcagacattggtatagctgttgctgatgctactgatgcagctcgcagtgcatctgatattgttctaacagaacctggacttagtgttattattagtgctgttttgacaagccgagcaatcttccagagaatgaaaaattatacagtaagctaatgaattattgttaacatctt

SEQ ID NO: 3849 - DNA, 739 bp, Glycine max
tataaacttttatagttgcatcatgatagtttttcattgaccattagcttctgaaagtttaggggattttttatatatatttcaaatcctttttccgcgattctctgtgaaattcaaccattttatacttttttatttacagaatgccctaatttggattgacaactaacttgccccatctgttttattatgctgtatgtagatttaggtgtgatttctccttaagcacgctcaatagttatttgatgatccagtaaatttgagatttttttgtccaccaggactatttaacccttgtcgaatcattataaacacgtgttgtacttgcgttttttatataacagttagcagttctgagtgaagaagccaaaagtctggaagctgaggcatatagagggagtgaagcaagtgtaggatctccccgtcgagttgcatctcctgtacatcgaggaggttcctctcctggtctgagaaacttgcatgactcgcctgaatcactcggttctaggaatgtagcaagtcctggtagcaggagcagaaaaggatattaaagtgacaccccctctttgggagtaatgctccaagcaatgtaaacgatgatgatggtttacgatggttttgctaaaatgggatgtttaatatgtagaatgtacatggaaatggtgttgcctcagcaaagtttgctagttgaaaatgatgctaaattaagtattatgctagtgagagtctaatagtgtag

SEQ ID NO: 3850 - DNA, 381 bp, Glycine max
ctggtccttcctcaaacccttccttcaggataaggaaaaaaaggttctcatcgttgtcatcccccttcaagtcattgccaacattgctcaggtcgttattgacgagaatgggccctacggccatgactgggctacctggaaacaggtcttcctccttgttgacgtcgtctgttgctgcgctgtgcttttccccattgtctggtccatcaagaacctccgtgaggccgctaggaccgacggcaaggccgctgttaatttgatgaagcttactctcttcaggcactactatgtcgtcgttatctgttacatttacttcaccagggttgtcgtttatgccttggagactattacctcctatcgttattcttggaccagtgtggt

SEQ ID NO: 3851 - DNA, 433 bp, Glycine max
  misc_feature (423)..(424): n is a, c, g, or t
  misc_feature (426)..(429): n is a, c, g, or t
attctccccactctctacaccatctcacagttccaaaccgcaagcaaccctttgcacacgcaagctgggaacagtgatgatggagagtaccctttaaatgtcaccacctcagggaaccaagtgaatgtaacaactggggtggttgatactacagtgtccaatactatctacagtgataaccagcttgcagtgtatcaggtagataaggtacttcttccaatgaagcttttcggcgcaacggcaccggctgcttcaccggcagaggctccggcaccgaccaagccggagaaaaatgtccgggctggggctgctgattctccttcagggtcgtcggacacgtccgctgatgcttcgagtgcagtgagtttgaaaaggcacacagttgaaggtgttacattttcttggttccctgaggtggtgacnntnnnngggt

SEQ ID NO: 3852 - DNA, 398 bp, Glycine max
cggggagccagcagcagaagaaggcgcgtgaggatgaggctgtgacggatgaggaggtggaggagttctgcgccattctccgccgaataaacacggcggtgaagtacttcaagagccacggcgaggacgtggcagcgttggagaaagatatcatgcaggatgtgaaggaggcaaccagaatgagtaatcagaatgagaaggaagaagacgacttgagtttggatctaaatgtcactccccaaacccccacctgagactccgactcagacctcaatattattaccatctttctctcccttccttcgttttctatttaacatagggattttcttatatgtcccctatgaatataaggatgagttcaataaaatgcaccgacaaatcatccttgagtttca

SEQ ID NO: 3853 - DNA, 718 bp, Glycine max
agcgaagacagacagatctgaagtgtgtagagttaaagactgagagagacgaagccagagaaaaccaaaaaccttactctttttcacgcgacgccctagttcatttttcttctccgttctcttctctctctgttcttcactcactctcattcattcaccatgacgaaacaacatgccaattggtctccttacgataacaacggagggtaaggttaccctttctctctctatctctaaaagagtatgtattattcaattttttcattcattcgtttatttgttttttattttcttcgttttttgtagatcatgtgttgcgattgctggagcagattactgcgttatcgccgcagatacgagaatgtccaccggttacaacatcctcactcgcgattactccaaaatctcccaactgtatgttttttcccctaaattattaattctcgccctaaattatcaatttttcgaattttatgattggtgctttgaatttgaggcatttgggtgccgttgatttcatttacttgatctcagcattgcacaagggacacattttttttgtttggtttgtgttgtttaaggatgtaaagttaggcttttttttatttatttattgtttcgcctgacagggctgagaagtgtgtgatggcttcatctggctttcaagctgatgtcaaagctttgcagaaggttttgtctgctaggcatttgatttatc

SEQ ID NO: 3854 - DNA, 645 bp, Glycine max
aggttaggcatcactagtacatcgaaaagtgcaggattcttcacaagctgcggaaggtcagaaaaataaccaatatcattaatttccaaatactaagtatttccaaatgcagttttctcatacatcaagttcaccaatattaccatcatgcagcaattgtcaatgacaacttcctcataagttatctcaggatatttctctgcaacctcacggcaacactagaaataataacaaaaagcattaataataaaattcatgaataaaatttgagaccaaaaatttctaggcatttgtaagtattggtggaccttgaggaaaaggccatcagtcttttgcataatattggctttgtgtatggcagaaaccctctctcttccatgagccttggcatagtgaaaagcatactcagctacccttaaacttgcttgacgtgtaatgattttgagactttctactacacctctcacaacctgaaacccaaaaatgctaaacaaattatattgatcagaattcagatgatagtacgtgcataaattgttgtgaaatttacctgatgttcaagtccactgtactcgccttccgtattttcacgaattgtgattagattgacattatcataccgagttttgtagcctggaagactgt

SEQ ID NO: 3855 - DNA, 430 bp, Glycine max
ctaaaggaactgcatacaccttttttacacatgccaatgctaagtttgctagggatctgattaagattttacaagatgctggtcagactgtgagtcctgcgttgactgcattggttcggtcagctggttctggtcaatttggtaattaaaatttcttttcgacactgaagcctgaggttttcattaggatggtctgtaaacagttcttatcattttgtaggatcagggggaggttttcgctcaagaggacgaggaggctatggaaatcgtggtttaacgtcaggttccaatgccattcctctaggttcgaagcggccctggcattgtctatagttttggtgctgctttgggcaaattcttagttttacaaatgttggggtgttgattttgaacatgcatctatttgaccacaattacacttgaaacagca

SEQ ID NO: 3856 - DNA, 396 bp, Glycine max
cgccaacccttcctcccacgaggtcgtggcctggatcaagcgcctcctccgcgtcgaaaagaccggccactccggcaccctcgaccccaaggtcaccggcaacctcatcgtctgcatcgaccgcgccactcgcctcgtcaagtcccagcagggcgccggcaaggagtacgtctgcatcgcccgcctccactccgccgtccccgacgtctccaaggtcgcccgcgccctcgaaaccctcaccggcgccgtcttccagcgtccccccttgatttccgccgtcaagcgccagctccggattcggaccatctacgaaagtaagctccttgagtatgaccctgataggcacttggttgttttctggatttcctgtgaggctggcacctatgttaggactat

SEQ ID NO: 3857 - DNA, 360 bp, Glycine max
tgcggtggttagaggctgctccaccgttacatcatcctcagtgtcttcttcttcatctccttcttcctctggttttgcctcttcttacttccaccctgaagctgcagtttcttcttcttcttcttcctattctggcttcaacatcttcaagggtgaacaaggaataagccaagttttgtcgctctctgcgtacccctttgaggcaaggagctccattgaggaattgcatgagctttgcaaacctttcttctccaaatctcagcctctaacgttgcaagcctcttcacctttgtcctcactctcttcctattcctctgcgccacccaaatctgtttcaacgcaagagaaacaacaacagag

SEQ ID NO: 3858 - DNA, 386 bp, Glycine max
gagtggctgttccgtttttgtctcaaatggctggtttgattggaggagtggcgttgccagtgacattcgcgtacccatgtttcatgtggcttaagacaaagaagccaaagaagtatagtgccatgtggtggctcaattggttcttggggacattgggagtggctttgagtgccatattggttgcggctagtttatatgtcatcattgatactggtgttaatgtgagctttttcaatcctcagtagtctcacatatagagtgggaaaatgtactaggaaaatgatgttgggaggtaattaattagtaagagaattgctaaggttttctttctttctttttttgagaaattcaaatttgtgaccccactttgtagttctaggttgatt

SEQ ID NO: 3859 - DNA, 637 bp, Glycine max
  misc_feature (604)..(605): n is a, c, g, or t
ggaagggttcatatactacatcactttggaagcaaaagatggtgaaaccaaaaatgtgtatgaaacgaaggtgtgggtgagatcatggttgaactccaaggaggtcctcgaattcaagcccatcagtattaatcctctttcggtgtcggtctagtctttataaggtataaaatacgcttttaatctctgtgctctcaataaatattagtattagttttcatatttttattttgatcaaattaatctttaaacctcagaaaaataacaatggtttcatcattacttttattgtgagcgaggaggaacacattattatctttttttttaattcaagaattaaattaattaaaactaaaatttgaaaactaaaattaagttttattcttttactaaactaccatcaccaaatattctggatattcatatccatagtgtcgttctctgttggaattattaaatgtgttttgtctttctcgtttttttttcaggttacagaaataaatggtcgcaaggtgaaagttgtactaaaatttattttttataaaaaaatcgaaggtagtattaaatatgttatatgtatgtattgtgcggaataaatgcagcnncgtactatatataatggtacatgcggggtagg

SEQ ID NO: 3860 - DNA, 486 bp, Glycine max
ttggcacagcgtgtccatgggtcagactcacacccgcaagcaaaagaaatagctcagtctcattgagaaggagcaattgtggcccaaaatgttcggtgtcccaattggaattgaagagtgagagtgagagcaaaacgaagccgtatccagcagaggcatcgaggaccataatggagttggctaaggtgggcacgctgtgtacgttgacccaagagggtttgccccttggtactggggttcgattcgcggttgaccctgaacatggcactcccttgttctgcttcaattccactgacaacactaacatcccctcttctcttcatgttcaggtgcctcatcttctctctctctctctctctctattctgttaattatatatctattaattccagggatttatttctgtttgtgtttgtttatcagtttgaacaatttggattgcgcactcctcagtgcactattcaaggaacccttaccaaaccacag

SEQ ID NO: 3861 - DNA, 616 bp, Glycine max
ttcctgcttttgctttggaatgtctcccaaatcgcaattcattactttatggggatttgtatggaataactgaagcatcaaccattttccgtggaaccctccgctatgaaggcacggtctatatatgtttctatggtttctcaagccaatatttgacattgattaatacttttctttatagcatgtttaatcttgtggtgtgtttagtataaagggtctatatttattaatctttctgaaacttacttgtaacttgttgtacaggatttagtgagatcatggggacactgtctaggattagcttatttaacaatgaagcccattcgttgctaatgaatggacaaagaccaactttcagaaaattcttatttgaacttctcaaagttgttggtgataatccagatgaactattgataggagagaatgacatcatggagcaaatattaatacaagggcactgcaaagatcaaagaacggcaatggagacagcaaaaacaatcatgtaatgtagaccagttaccccttctcttatacttcatttggaaaattattgtcttaacttgactgtcttttttcatatagtttcttgggacttcttgaccaaactgaaatacct

SEQ ID NO: 3862 - DNA, 934 bp, Glycine max
  misc_feature (386)..(388): n is a, c, g, or t
  misc_feature (393)..(394): n is a, c, g, or t
  misc_feature (396)..(403): n is a, c, g, or t
  misc_feature (406)..(407): n is a, c, g, or t
  misc_feature (604)..(630): n is a, c, g, or t
  misc_feature (633)..(639): n is a, c, g, or t
  misc_feature (647)..(649): n is a, c, g, or t
  misc_feature (653)..(655): n is a, c, g, or t
  misc_feature (657)..(658): n is a, c, g, or t
  misc_feature (660)..(664): n is a, c, g, or t
  misc_feature (667)..(670): n is a, c, g, or t
  misc_feature (672)..(694): n is a, c, g, or t
  misc_feature (696)..(707): n is a, c, g, or t
  misc_feature (710)..(720): n is a, c, g, or t
  misc_feature (722)..(723): n is a, c, g, or t
  misc_feature (726)..(727): n is a, c, g, or t
  misc_feature (730)..(736): n is a, c, g, or t
  misc_feature (738)..(745): n is a, c, g, or t
  misc_feature (747)..(747): n is a, c, g, or t
  misc_feature (749)..(751): n is a, c, g, or t
  misc_feature (753)..(764): n is a, c, g, or t
  misc_feature (774)..(780): n is a, c, g, or t
  misc_feature (788)..(788): n is a, c, g, or t
  misc_feature (790)..(801): n is a, c, g, or t
  misc_feature (803)..(812): n is a, c, g, or t
  misc_feature (814)..(823): n is a, c, g, or t
  misc_feature (825)..(835): n is a, c, g, or t
  misc_feature (837)..(839): n is a, c, g, or t
  misc_feature (851)..(908): n is a, c, g, or t
  misc_feature (910)..(912): n is a, c, g, or t
  misc_feature (917)..(917): n is a, c, g, or t
  misc_feature (919)..(931): n is a, c, g, or t
atagtgaatatctctgaacaagaagcaaatacattctaaatcagtgcatactacatatttcatctcctatcctagtagtgttaaagcttccacgcacatttgttttcccggtataaggagacgccgggtagaaaatgatatgtccatgctactgtaggatttcaagtaatgattctttcaccagtaatccccacaagagcattttccatccttgaaatgatgaaaccttttgttatctctgacaattaattccctccctacaatcctggacatgatcttgatggcattgtgacagtcaccacagactcgaaggttcttgatgattctaagaggtgttcttggtggagtactaataagaccataggcaattgctagacgttcactgnnnaaaanncnnnnnnnnatnntatattttaggatagctgcaattctgatcctaggatgatgtttttttatttattttgtttcagggggttgcgatttatgtgtgttttccggttcaagatgtggtggatgacgcagagaatgggcacttgtggacaagatatccccattgagacgcagttcttgctcgttgaagcacacaatggctctgatattgaannnnnnnnnnnnnnnnnnnnnnnnnnncgnnnnnnnttaggggnnnatcnnnanntnnnnnggnnnncnnnnnnnnnnnnnnnnnnnnnnnannnnnnnnnnnncgnnnnnnnnnnnannctnngannnnnnncnnnnnnnncncnnncnnnnnnnnnnnntttctagcgnnnnnnnagcccccncnnnnnnnnnnnncnnnnnnnnnncnnnnnnnnnntnnnnnnnnnnncnnncaactctcacgnnnnnnnnnnnnnnnnnnnnnnnnnnnnnnnnnnnnnnnnnnnnnnnnnnnnnnnnnncnnngcccntnnnnnnnnnnnnnccc

SEQ ID NO: 3863 - DNA, 408 bp, Glycine max
ttttactacacatttagtcctcatattcattgagggcatttggactgctaatattcatgattgcattcatggaaaattgtggcctgttatgggtgctggttaccacaccattcaccacactacatatcggcacaactacggccactacaccatatggatggattggctatttggaactcttcacaaccccgaggaggacgagggcaaggctatgtgatgaattgcagacttacattggcagtcatttattatcatgtttggattgttgaaatgtgcttacttgcatgtaaagcataaatgtgttagctatatttttctggtgtttcatcacaaggtgatggctctatattagagagacagggttgagggttaaagtggagcttccctgtctctaatcccattgtaaaa

SEQ ID NO: 3864 - DNA, 392 bp, Glycine max
tgcagagtttttacattaatacatccaacgttctcaaccagaaagtaaaaaatgtacatcctcttgcccttttccccttattaaataacacaacttaaaaacaggggggcagtttggccacagacattgaccgtagttcatctcacagtcggcaacattaaaatggaaggaaggaataacctgatacattttcatacccaaaaaatggaaaattttgttgtttggcattgccaagagttcctaaattattaaatttagcaattacaaaaaaaaaagggattaaaaaggaaaacggggtggggggggttaaaaacctggaaattccttaacaatttttccgggcttgggaagggccccccccaaaccccccaccctggaaaaacaatggttcg

SEQ ID NO: 3865 - DNA, 374 bp, Glycine max
tcctcgtggagcgcaacggagaaaccaccgacaccttcaactccgtccagttccggtggaaactggtctccgaacgcgtccccgcgaggttcatccatcaggactccttccactccttttcgaaatccgaggttcggttcttcgagctgagattccacaagaagcatagggacatggtcctctcggagtacctcccgcgcgtgatggaggaagccgaggtggcgcgtgagcagaggaagacgctgaagctcttcacgccggcggacatgaggatggtgggaaggagagggtgcgagatgtggcagggcgtgaatctggaccatcccgccaagttcgagacgctggcgatggatttggagatgaaggagataaaa

SEQ ID NO: 3866 - DNA, 593 bp, Glycine max
aattgcataacaatcatttcccttgttatcaaacagattgattcaagaccatgaagataaaaagataaacctaccacagaaccaccaccaagaaaagagaaagagccaagatgacagaattgatgaacaacagtcgcacctgcagtgtgaacgtagtcctacatatgaagagttttaattaattttctaattctatgcttaaaacataagaaattaataaaaccgaatttatcataaaagaaaagtgactttaattttttagaacttacttccacttcgacatgcccagctaggagagtattgttcgcaaaaatattgttgttaccaatcttgcaatcatgggcaatatgacaagatcccattataaaattggcattaccaataacctgatcatatgatcatggtgagaatatgaaaaggtatatatgtttttgagtctaaaaattctgaggtttttttttctgtaaaaaagttactgaagccaacttcttaccgtcctatcggttgattttgaagatcggtggattgaagtatgttccctaatatcattattgtgtccaacttccaggtaacattcatcctctggctacatg

SEQ ID NO: 3867 - DNA, 366 bp, Glycine max
catttcaccaatcagacaagggtccttctatgtagacataccagagccagaccctgatgatgccaaaatagccaagaccatagaaactgagttccacaaattggagaatcagaagaatggctttaccaactcactaaatggtcttacagttaatggccattgaaagctatgctactaaagctactagtaactgtgttttttggcctctcctgagccacttttatttgttgataactatatgatccctttttgattaggagggttatgcttgtgaggtcaaacttatacccggttattagatgtaatattgtaatgtttacatcaactccatgcaaaattcttcccactcttatacctttatggcca

SEQ ID NO: 3868 - DNA, 379 bp, Glycine max
cgtggtaactcttttcaggtttggggagatggccatgagccatactaaaacaagaatggaagaggcctggacaatcgatgaggttgcattcaatgttcaaggcctttcagtcgattgcttcattcccccagctgatttgagaacagcttctgtcagtgaagcttgcgaacttcctcaggatgaaagagcaaagaactcactagcagtacatcgggccaaagttgttgcgctggagaaatcacataactgcagcattgatagcatgatctggaagatggaaatctaacagacggcagtaggatcaattcaaggcaattgttaatagcagtcactagtttttgactactaacgtttagatgttagattaggggttcagttg

SEQ ID NO: 3869 - DNA, 1106 bp, Glycine max
  misc_feature (1046)..(1052): n is a, c, g, or t
tgttatttctcttcctctttactccatcattcatcaatctatcatatgtgaactttcaaaatggtggttgtggttctgaatgaaaccagattatatgattggcatttatgcaaaagttgaatgatctaatgccgattaaatttccgagctaacccctgtttccgcattttcttcagattgtgttatatgcattgttgcagatgaaggtgaaaaagcagaagaggcacaggaagattttgacgttttacactgcttgcttcggttttcggaagccttacaaggttctatgtgatggcacatttgttcatcaccttcttgtgaatcgaataacccctgctgacacggccattggcaatgtcctcagtgctacgatcaagctctacacaacaaggtccttttttccccctctctatgtgtaaagtagatttattaacattttttccctagctcaacatcgttggtatgaactatgaattgtgatttgttttggataccttttgttttttatttctctttgttaatttgggggttgggtggagatgatgcagatgtgttctagctgagttgaaacgacttggtagctcgtattctgaggctctcgaggcagctcataaacttatagttgcaaggtaattcaccttactgctgggtacatatgctgttaaatggattctttcctcaacttcactagtttcaatactatatacatgaatgatgcctaatcaaataaccagaatcagagtacttagcttgttattgttgatagttcgatactctttgatcagtgtgtatttttgtatatttaaaattctgactgaactggtcatacatgactactttaatgttatttttttatgattttgagcgaaatgttatgttaaaaggctcactaatttgaagcaatgttgtatttttagtcctaataatcagcatctgatagtctttaagtggactacttgtcaggatcattgttgtttgtttattagggttttgagatatttgagcgctggtattgctgtggaaatgatcattaccttgattttacnnnnnnntgcagatgtgagcatgaaaaatgtaagagcgcagatgctgcatcaggaggtgtg

SEQ ID NO: 3870 - DNA, 980 bp, Glycine max
  misc_feature (875)..(877): n is a, c, g, or t
  misc_feature (891)..(895): n is a, c, g, or t
  misc_feature (929)..(938): n is a, c, g, or t
gctcgtactctgaagtctgttcttcacttcttcccctctgtacttgatttctcagaaagggttgttgttttggttattttctctcttttgtaattttcccctttgaatttttattataattgttttatctatcattcttttattcccaattgtaatgatgccacggaggggaagtaatcactggcttgcatttgcattatatattgttttgaaatatttctcttttgaaatactgtgttgcactctgccatttgaaaccttagcttatttttggggtttctgaatactgaattgtgcacacttctctttgggttagtctgctaagctgccattttttatatgcagagtttagggagaaaccttggcaagtagaaaattagaattttaaatggccatgagaggaggaaggaagaatttgaagagggcaacagaggaaaaacatataacccttcaagatggccaaggcatcatgcaggtcgtgtctcttcgaggtgctaatatcattgaggtactgctttacaaagccctaatcttccaaatttgcctttttattttgtgctgaggaaaatgacaaaatcaccaaggtgaaacttacaaactttgatggagaaataaatcaaggaatattctttgaaaagaggaggtaaaattacatattagcaactaggaaaaaatatggtaatttttgacttcttatatagcggttgtaaattctaccccggtatcaaacgaaacaaatggtacttctttaattacttgataagcaaatagattctgatggtattgcagggattgtcaggaaggaaacagaatagaataatatatggtgagaaaaatatagagattgttttaaaatcatggaaaaaggaaaaccnnnccagatgtgaatcnnnnnaaaattaatctattatgtaaacatccctttcctnnnnnnnnnnggagtgtgtatttcttatgtgtatataggttcttatttatgt

SEQ ID NO: 3871 - DNA, 1058 bp, Glycine max
tgttctcgtgttgttcgtctggattgggttgggttggcttcaggggtttgaatgccatctggggtttctttctcaggctatcaagctccaaagctgacccctttctctcagttcttacttcttcttcttcttcttctgttcttctctttctctctctagaactataatggtagaagacgtgtgtttcctctacaaggtacttcctttctacctccttattgctcctttttactgtcaaaatttttgctcttttacacaatgtgcttcttctcttgcttcccttatttgtcaattattctaacctgcttctctatgtactgttttgctgaaacgttttaactttctaccatatttgggggtttctctatctcttttttaaaaattatttttgagtttttgttggcactttatcctcaaattctggtgctttaacttgagtgaacaaggggaagaagaaatagtcacgcgggttcgaagaaaaatttgtttgaattcctgaaaagagttattgacactgatatgggtttaaagaggaacactttagcaccccccaagaaaaagaggaaaactttaagctcctttgcacgtttctgggttattatctgaattcgggtgctcattattcctcgttgtatatgtttattgatgattataaccaaatgtgtgcatctgttgtgttaaggacttgcctcgctggaattttgtttgtacatgcctcactgagattaatgctttacgcttctaaattttttcatatatttggtattatattgagcaccaatttgataatttcctgtgcttcttttaccattttatgttcttctgggatttggggaggggaggctccataaatttacctattcgacacccttcgcagtgatttaagttatcccattattcacattctagtaactttttcctcatatgtggttgcaggaaattcttgttatgaagcctccaaagagatcaccaatgttgttaaggatggcagtcgtaatattttcaatggtttgtggcgtttttatcttctctgtgtgtctaatgcagataagcaccca

SEQ ID NO: 3872 - DNA, 446 bp, Glycine max
agcatctcctgaaggttgatagcgaatatagtttcgttcaccactcctccagatgcctgcgttctctctttggtctcttcctccttcagatctgcctcagtaaccgacttcgtatgggaaaggttcctcccctccgattatcaggctatcatttcccaatcttccaagccctccactctcaccaattactcttccaagaaggacctctacctccacctatgccataaccccctcctcatagacgctggtaaaaaggtattacaaataaaatcattttttctctcaataattatacacgtatatctttcattaattggaaaattaattaatcaccagagctttgcactcgataaactgaacggcaaaatatgctacatgctctcagcccgaagtctctcaattgtttggggagacactcccaggtattggagatggacttctgttcc

SEQ ID NO: 3873 - DNA, 355 bp, Glycine max
ttgctgcaatgatttttagtaatgaatttaattacggaagatattagaacccttttcttataacctttatttgaagaaggtacatgattcaatcgctgatttgatttatatttgtcattcttttgtaatcttcttgttcctcgtactgattagctggcaaatgaaaatgcttgcttcaaattgtggttaaagctgctgctgtttactatggttttctagactagcgtttcacatgatttctttggagatcttaagctagctagataaaatgtgtatattttattagtgatgtaactcttacggaatttgaattgcagagctgaaatggataatgattgctttaacaatgctgggt

SEQ ID NO: 3874 - DNA, 393 bp, Glycine max
cgtttgagggatgaatttgatgttgaagtaccaatttattttcgtggtggggaagatggctctgttactgcgtatgcacgaatttctcgtcaggtttacaacaaggttgaggactattataagttcaggaatgcggttaatcaacttgtgcaagatgggtttacttgtgctcttctttcggcttgaaattggggtagcctatgctctgctcttagttttaattaactcctcaataacatattcgtccattttatatgtgggatactatttgcaaatgttgagtttgcactttgctgattgcgctattttgcccggtctgttgaaaatttcattgtctatatatccaagtatttgagtggacatttgttgtttaacattttcactactcgtttc

SEQ ID NO: 3875 - DNA, 1245 bp, Glycine max
  misc_feature (1190)..(1192): n is a, c, g, or t
  misc_feature (1225)..(1228): n is a, c, g, or t
  misc_feature (1239)..(1241): n is a, c, g, or t
cttatcttatgggaaatggtgactggaactataccatatgaggatatgactcccatccaggctgcttttgccgtagtaaataaggtatgtttcttcgcaattaagtcatatgaattgtaatgtgaatgtcacaatctactaatatttgttgcattattcttcattgtctgtaacaatactcgttgtaaagttgcattgctttctgtgcactctgcattgaaatcttgtcaataataggaaaaggtctacagccccatttatccgcccaaacctctctgaatgactggcatacaagagtaatgcaaactggacatgggttccattaatgatacagttcgcttgaagatagacaatacatgctccattaactaatatgttttgcaatctttgaatgtattttataaaagcgactgttactctcagatgtagcagttgaaaccttttatgttgtaaatggaaggacattttttcctttttgcaatgcttcatccacttatatcatgatttaactactcttttcaattttcatccattttttcatcattttttctttctttcttaaagcttttatttcaatatgttgagtgatgattgccaaaggaggtatcattatcctggctgaggaaatcaatcatattgccactgaataattgctaatgagtttatagcccgtctgatgagtactatatattttatagctaaaccaaatgtatttttgagatgtggctaaaatccttggcaagatacctcctttgctttgaaaacaatggtgaaatatagagattattttcatccattcttgacatgtatgaccaacttattaaaaaagaggaaaaaaaattgatgtagcatgcattagtttatatgtcattattacatatgtctctgtttcatcaagtgatgtagcatagtagttgataagattaccaagaatggagctaaattgaattcttaggatcatcatgtattggataattgtggaaaatattttgctagctaaatgacactgtttacctatgcaattctaatacttttgtgatgctgtattcagaatgcaaggccagttattccttcagactgtccacctgcaatgcgagctttaatcgagcaatgttggtctttgcatccggacaagaggcccgagttctggcaggttgttaaggtattagaacaatttgaatcttcgcttnnncatgatggaactctgactctggtggaaaatccnnnngccaagatcannngaaa

SEQ ID NO: 3876 - DNA, 1146 bp, Glycine max
  misc_feature (6)..(6): n is a, c, g, or t
  misc_feature (55)..(62): n is a, c, g, or t
  misc_feature (839)..(839): n is a, c, g, or t
  misc_feature (1060)..(1060): n is a, c, g, or t
  misc_feature (1062)..(1062): n is a, c, g, or t
  misc_feature (1097)..(1105): n is a, c, g, or t
aggagnattgccatgcagttggctcttctctgacaaagctttcacatgcaaaagnnnnnnnnttgcttgtgatgtttgtgaacctcatgatgtgcagagactggctaacttcgctgtcaaagaacttggtcatattgacatttgggtaagtgttgtggttgttgtcgttgaacatcatcggattttataaataaaaccagagaagtgcatacggaatctaaactaagagggaacataataataaaacctgtacatgaacactgactattgaagctaatagttgtaaactatcagtttttgcagctgtaaaacttgactatcaatcaaaatctcatgtatttatattcatcttgtcactttccaatgttatgaagaaatagaaatatattcagataaaaaaattctgtagtcattttttatggtatttacattttagtatgcgtaattaaaagctaataaattaggtgtctgtctacatgcaataatttgatgaagataagccttggagaaaaggagctgttgtgctaattgagtgactctactaatatgcttgttatcccttcagtgaaagttaagttttccattgcagaatgcagttttatgtttctggttctaatctttttgtttttgcatttttatattaaaactattcaacagataaacaatgccggaacaaataaaggttttagaccattgcttcagtttagtgacgaagatattaaacaggtatatgttatgagtaatttcttatttattttgctaaaacaaaatgttgtttaagtttaatagtcctctatcagtcttgactcttgagactgagatgtaaaagttttgttccnaaattatcaattttttgtctttaacctcatcttgaaaaattgattggtctataattgttgtagattgtctcaacaaatttggttggatctatcctctgcactcgagaagccatgcgtgttatgagaaaccaagccattgcaggtcacatatttaatatggatggtgcgggttctggaggctctagcacacctttgactgctgtgtgagtagaatgtagttngntctatgggaggattctgatgattccactaagctannnnnnnnncttctaaagtcatggtgggtggtggttgctaatgatgctta

SEQ ID NO: 3877 - DNA, 392 bp, Glycine max
ggttcggatttcacggtcaccgccgggatgaaacccgacgagaaactctccggtgaggatgcatcgagagatgggacccaccctgcgtttattgcatcgcgaagaacaccgtaaagaagcatgtcttctgaatcgtcttccttaagaggaagttctccccaatcgttactcaagcaagggtacaacctgctgaaacaggagctccgagagtacgctggagtgttacccgaactaacattcggggctccgaatttgtgctcctcggagtcgccaagtaagtggcggcgaatggagtccaaaagggccaaatcggactcatagctactttgtccgtacatttcgtggtatgtttcttcttcttaatgtttgtgtcgtgtttggagaagagaatg

SEQ ID NO: 3878 - DNA, 635 bp, Glycine max
  misc_feature (628)..(628): n is a, c, g, or t
aaacaaaggaggctatttaattggcacctacaaccagctcacatggatttccgatttttttcactgggaaacttgtggtctgtcgtaaacagtttggccactgaggaacaatcacatgccattttggatcttattgaggccaaatggtcagatttggtggcagagatgccattcaagatttgttatcctgctcttgatggtcaggagtggcagataatcacaggcagtgatcctaagaacacgtactgtatctaatttgccgtgtttatgtttttctgttatcttattatatttttcatcaaatgatttttttatttaattattttttggcaggccttggtcctaccataatgcaggctcctggccaacactgctctggcaggttagttacagtggcaaattttggtacacttaaatctctcgagtcgaagctgttcttatttataaaatttggtttctctaaagcgagtaatttactttagagagcaaaataattaatatcagttattaatgagaaaatcaatggttgatattacatgcacgtgtagttatgcataacaaataatgcacgtgatgatataccaatgattaagtttacttttacttgcgtacatattctttcatctanacattta

SEQ ID NO: 3879 - DNA, 379 bp, Glycine max
tttggattagacctgtgtgaccagtcaccgctaaattttacagagcgtcgtggtttggatgatgttagttttgagagtaacgagacaaggctaactcctctccctgttcatgagtggggtaagtaagttttgtttttaaggttcaagggtaaacaggttttaacttctgatgaatataaccgtcccgtgggttaaaatgcaaatgttatgtgatgatgttttgtatattcacgtctccattgcatattattgtatagtttgtagtgtaaggtagctgattttggttatgatacgaatgatccctagcttaggtatgattacactgtaaaattataccatttcttcttttggcagaggtgactaaatgcaaattctgtcg

SEQ ID NO: 3880 - DNA, 397 bp, Glycine max
cttcttcttctcatgcgatcatcactacatatgatgtgtttgtcagcttccgcggtgaagacacgcgcaacaacttcactgcttttctctttgatgctctctttgaaaatggcatccatgccttcaaagatgatacacatcttcagaaaggcgaatccatagcacccgagctgctactggccattcaggggtctcgccttttcgttgtggtcttctcaaagaactatgcttcctcaacttggtgcttgcgtgaacttgcacacatctgcaactgcactattgaagcatcctcgagtcgtgttcttccaattttctatgatgttgatccatcagaggtgcggaaacagagtggttattatgggattgcctttgcagaacacgaagaaagattcagaag

SEQ ID NO: 3881 - DNA, 399 bp, Glycine max
cacgccctgaccttgaagacgatgagaaccaacaagaccaagacaacaaccttaacgatcacgaagggcttgacctaattacaccaaatccaggtcctggtgatgttgttggtcgcaggccaagaggaagacccccaggttcaaagaacaagccaaaaccaccagttatcatcacaagagagagtgcaaacacccttagggctcacatccttgaagttagtactggttgtgacgtctttgaatcggtcgctacctatgcaaggaagcggcaaagagggatatgtgtcctcagtgggagtggcaccgtgaccaacgtgacattgaggcagccggccgcggctggtgccgtcgtcacgctgcacggaaggtttgagatcctctctttgtcaggatcattcc

SEQ ID NO: 3882 - DNA, 705 bp, Glycine max
  misc_feature (428)..(433): n is a, c, g, or t
  misc_feature (435)..(435): n is a, c, g, or t
  misc_feature (439)..(440): n is a, c, g, or t
  misc_feature (445)..(447): n is a, c, g, or t
  misc_feature (462)..(467): n is a, c, g, or t
  misc_feature (476)..(480): n is a, c, g, or t
  misc_feature (491)..(497): n is a, c, g, or t
  misc_feature (499)..(503): n is a, c, g, or t
  misc_feature (522)..(526): n is a, c, g, or t
  misc_feature (533)..(537): n is a, c, g, or t
  misc_feature (541)..(547): n is a, c, g, or t
  misc_feature (556)..(563): n is a, c, g, or t
  misc_feature (565)..(565): n is a, c, g, or t
  misc_feature (570)..(572): n is a, c, g, or t
  misc_feature (584)..(585): n is a, c, g, or t
  misc_feature (593)..(606): n is a, c, g, or t
  misc_feature (608)..(610): n is a, c, g, or t
  misc_feature (616)..(616): n is a, c, g, or t
  misc_feature (618)..(620): n is a, c, g, or t
  misc_feature (623)..(625): n is a, c, g, or t
  misc_feature (634)..(640): n is a, c, g, or t
  misc_feature (644)..(649): n is a, c, g, or t
  misc_feature (653)..(655): n is a, c, g, or t
  misc_feature (668)..(668): n is a, c, g, or t
  misc_feature (670)..(670): n is a, c, g, or t
  misc_feature (672)..(674): n is a, c, g, or t
  misc_feature (687)..(693): n is a, c, g, or t
  misc_feature (699)..(700): n is a, c, g, or t
gtcggcatacacactgtcattgactgcgccactggccgtcccgaggagcccatcaaaaccgtaactaacctatcacacacacttgattacttctttctttgctacgtacattatcactcacttatcacatacatttcaggttgactgggaaggcaaagtggctcttatacaatgtgccaaggcaatgggaattcagaaatatgtcttctactccatccataactgtgacaaacatcccgaggttcccctcatggagatcaagttttgcactgagaagttcctccgagactctggcctcaatcacgtcattatccgcttatgcggtttcatgcagggccttatcggtcagtatgcagttcccatcctagaagaaaaatctgtttggggtactgatgcccccacccgaattgcttacatggatactaatnnnnnngngggnnggacnnncgaccccaccaaacnnnnnnccttttccnnnnncaagaatgctnnnnnnncnnnnnttcttatgagtttgcaccnnnnntttacgnnnnncctnnnnnnntcattcccnnnnnnnngnaatannnaaatggtcacannagaaggcnnnnnnnnnnnnnngnnnaaaaanannnctnnncgcacacannnnnnngggnnnnnncccnnnggggggccccccncngnnnaaaaaaaatttannnnnnnaaaaannccccc

SEQ ID NO: 3883 - DNA, 335 bp, Glycine max
tatatggtggagtttctgctgctgatggttgccttggacaagatatggttcaccccccttgggaaattcatggacgagagggacgcggcgatcagggagaagctgagcagcgtgaaggacacgtcggaggaggtgaagcagctggaggagaaggccaatgctgtcatggcggcttctcgagcggagatagcggcggcgctgaacaccatgaagaaggagacgcaggctgaggtggagcaaaagattgctgaggggaggaagaaagtcgaggctgagctgcaggaggctctgtctgccttggagaatcaaaaggaagaaaccatcaagtccctaaa

SEQ ID NO: 3884 - DNA, 269 bp, Glycine max
ttacatgaagttttatcagattccgtactatgatggacaatccacggctccaccgaataatgttcaggaaagcttggtcggggatctctggagttttgattaacgaggaatatatcaaaggatgttcttttcatgcatgtgtttgtttcttcgtcaatgctgtgaaagcttctgctgactaatatctttgcgttttagcagggatggacaaaaatgtaaattgggtgcttcggtagaaatggtctcatgattttccgactttttttttt

SEQ ID NO: 3885 - DNA, 250 bp, Glycine max
cttgttgattcgggtgtgcataagggggcgttggggcttatgctgaactctgtcgttttggcattgatgtcgttgacggtggaaccgttgggtcgtttcgttgggggagttaagtggctatggggaatcgtaaacgtaattctcgccgtttgcatggcaatgacggtggttatcacaagggctgcagaacatgaacggaaaaacggcgtttctgctgttgggcatccctcagttggtgtgcaagtggctg

SEQ ID NO: 3886 - DNA, 377 bp, Glycine max
cattgatctttccaaaaagacctttttccgtattcgattgaattatgtatttgcgatggcttacaatgttgttgctataccagttgctgccggggttttctttccttggttggggatcaagctgccaccatgggttgctggtgcatgcatggctctgtcgtctgtaagcgttgtatgctcttctttgcttttgagaagatatagaaaacccaaacttactacaatacttgaaatagttgtaatttaacgagaattgaaacagaataacttgagggtgcaaataaatttgacccttgtaattccaattttgtgcatttttcctttatatccgctgcacccattggggtgcaattgtaattgtagctgccgattcattg

SEQ ID NO: 3887 - DNA, 344 bp, Glycine max
gcacatgaaatgaaaatgcaaccataataacctccatttttctccctacaacccacaaaacaaaaaccaccattaacccatttctccaaaaacttgagatcttttgtgtcaaacaaccacaagtcccgcgtcgaacaaataaaagcaaacaaaagggtatataaagatagagcgattgagtccaattaaaaaaaaaatgagagacatagtttcttgtttcagtgagaacgcagtgaacgtttctcactcttcaatctcgtgttcttcctattcacacaacgcgtgcatctctccctcctccattgttgtaccctccacccaaaactcaatctccagcgtctaca

SEQ ID NO: 3888 - DNA, 441 bp, Glycine max
tgagattaacattgctgtccagacaactgagcaaaattacaccaactacatgtttcgagaagctctcaagactggcttttatgatcttcaggctgctagggatgagtatagattctcatgtggggctggaggttgcaatcgtgacttggtgtggcgttttatggatgtgcagacacgtcttatagcacccatctgcccacattatgcagaatttatttggagagagcttttgaagaaggatggttttgtggtaaatgcaggctggccgacagctgatgctcctgatctcacactgaagagtgccaataaatatttgcaggactcaattgttttgatgaggaagttgcttcagaagcaactttcaggctcaaagaaaggtaataagaaaggtcctccagctgcatcactgacagatagcaaggtgacaggcttgatatatga

SEQ ID NO: 3889 - DNA, 922 bp, Glycine max
tctgatggggtagctgataatatgtctgaggtaattcctccccctctgcatgtacataccaactttttgtgcttttcaatttaattgaatcaaagtacggataattaattagaattaagtagattaatagtaggaactcattgaataaatttaaaatgatggaacatttcaaacatcactagtgtgcattttaaaaaaataataatcatattttggtcaagttttaagctgtccaacactgcataaactcatagtttctcccctgccccttttaatttttttcaaccgtgaaattattggtacttagacacatgaaatagctctaccagaacttactgataaccatatagtaaaaacgaatttgaatagaattattgagaattaagcaacatatattatatgttttaaccatggctaagggattgattattttgcccagtaaaatccttctgtttctccatggtgtgtaatatatataattttttcccctggcatcctcattactctagttagagaaacattttctctttttccttgaatcattatattcatatatctaattgtagggtcaataaaaactaactacatactgattgtgggatcttatattgtgcaggttagtgagtccgaattatgttgcatctgctttgagcaggtgtgcacaattgaagttcagaactgtggccaccagatgtgtgcacaatgcacactagccctgtgttgccacaacaagcccaaccctgccactgcctgtcttactccaccagtttgtccattttgtcggagcacgataacaagactcgttgttgtgaagacagaatgccacgatgaaactgatcaagacagtgctgatatcaactgttccaagctgagcaagtcatcaaggaaactcagacacttgaatgacagtggtagcagcagc

SEQ ID NO: 3890 - DNA, 969 bp, Glycine max
ggaggatttgcggttttgacacttcttcagctctgtgttgatagtgtcataaacagagggtttcttgttagggagggtgggattcctcctctcgttgctctttctcaaactgggagtgttcgagctaagcacaaggttagtcaaactcaaatcaaacctctctattcgatcatactaacaaacttcaattcaatctttgtattaaatggattgttggtttcatgttcagtcatcccaaatcatatcattatggtattcagataataacatgactgttaacctaaatttaggggaatgttcacttgtttgattttaagttgacaaattgattctgggtcagagttgattttgagttgaagcaactagttttattgtattacataattttttttcctgagatttgctactagcttgcttttagaattaaaaaaatccatacataaatggttttgcttcaaaattaattctaatcaaaatgaattttattcagaatcatttttcaaaatgctcatccaggctatggaaaaaaataatgtttttgaaagtaatagtaattttgagctctcccaactgaaatctaaacatacactcagatacatactaaagtactagtttgatttagtcttttcttaagcattactaggcattgcatgtaagtatgttttaattgtatttggggatttatggtcatgttcaaaaatggaactagatgttaacgcttctggcttgcttgtttgttttgcaggctgaaacacttcttcgatatttgagggaatcaagacaagaggcagcatctacttcaagttcttagacaagtgattacattgctacttgggaagttggtaattatacaatgtaattggttgttgtatatatagtgtttttgatggtttgtacagtgtggttaagatagttggaattggaaccgtgtttattgaagttagaagaagctagcgatctatagactga

SEQ ID NO: 3891 - DNA, 994 bp, Glycine max
  misc_feature (939)..(940): n is a, c, g, or t
taaaagctaaggtcagattgaagcctcctttttctcttggatgatttttcttcatgacgaacacatttgtgaagccacccatttatagcctccagatagcatttctgagctccaatccacttggtaaagcttgatgatagaaattggagttcattttcaagataggaagtaatctgtctacgtaattctgaatgcatggtgattctagcatggctgttgttatatgctgccgacattatctgaaactgaagtttgtggcattcatgcatcacttcccacatccgattcaacctgacatcaaagcataacagaaacagatgaaatacaaaagctagaagctcatagcaatcaacataagttgaggtgtgaaccatccatccctctgactatgaaaacatatgttgcatactaatccaagatcaaaaaactagcattcaaaggttgatcgcagaacatcagtgagtcacaatagaaagccatcaatcttgcataatcaattactaaaagttaactcttaacactataatttggaaaactgtcaattgcatttgacgataatgttactcctaatttagacaaaaggtttttgatgcctagactcttctggtagaaaactgtaggtttcagatgcagaaacaataaatttcagcaaggttgttatagaacaaaagcaaaacaatgaatttcagcaactgagcttttttattattgactatttctttgttgttcaataaatttataaccttcagtggaaattattttaccaaataaagaacttaatcaattttagcaagttctaccaaaaataaacttcctgacaaataaactttcttcattggaatttcctaattgcacttcttgatgcaccttttatcccattcttgtatattatgaattactatcaaggcggtatacattggcatgaaatagatacttaannaaaatagcaaaactgacaggagcatacccttcaatcaactcctcaagttgtggc

SEQ ID NO: 3892 - DNA, 977 bp, Glycine max
gacagagcatcagcagcacagcgaagaaccgcttcccgttccgtcactctctgccgctgaagaaaacaaagcaacaacgaagcttcgaaagaagaaagaagacgacgtcgtttccgataaccgcttcaagctccgcaacggaagagaggtctctactctctctctctctctctcttcgcttttcggtttccttcttcgattctatcattatttggcgttttcaggtttttgaagaaaaagcgtacctcgtaggcgttgagcgcaagaacgatgttcaggatttcggcatcgaagagtctctgagcgaattgtcgcagttagttgacactgctggattattggttgttggctctacttaccagaagtaactaattctcttaaacgtgcttttctaattactctgccttcaatttgcaatatggcctagttaaaaagaaaaaaaaaacagttatgctatagtttcatttaattattatctctattgctcttgatttggtgaaaacttggcatcacgtagaatgtagatgtatggaagtggaatgtctgatttcgagtttcaccagagtgattgattctcttgctatctcttgtcattcacttgaatgccgctggctatgtgttgttgctgtctttgattgcttatatttttttttcattcttctcttggtgttaatagaactaaaagttatttgtgcgttccaccccttacatcccaaaaatggggtgtataatgatattttttgtaatacaacaatgcatatccatgtttttccttattttcattttaataatactgagaattaacccatgtcgtacccctttgatgggggataatagaccatggctgcttccaattaatgtacagctttttcccttgggggccagggaaggtttttggacctgctgtggctgtgggtctattgtaggcagccttactctgtgtttgctaaagtacatatagattgatatttcttctt

SEQ ID NO: 3893 - DNA, 381 bp, Glycine max
cgcgtaagttccggtacgattgcttgtacgtgtgcgagtggccagggtgcgtgcacaaggaggagaagcgcaagtactgcctcttcagaggggttttcaagaacttcaggcgaactatggtttggaggactattcaggatgggaagaagaggaagatggatctgccttgcgccttctgcgcgtgtgagttcacgtgggatctgcactcttccttttgcttgaggcctggctttggcttccatgacgatggggagcctatggttagggcttatgtttgtgagaatggacatgtctctggtgcctggaccgatcttcccatctacacttgaacatcaacttatgcaggttctattcaggctacacaaagaactactcacggac

SEQ ID NO: 3894 - DNA, 1132 bp, Glycine max
  misc_feature (39)..(42): n is a, c, g, or t
  misc_feature (45)..(45): n is a, c, g, or t
  misc_feature (705)..(705): n is a, c, g, or t
  misc_feature (871)..(872): n is a, c, g, or t
  misc_feature (884)..(884): n is a, c, g, or t
  misc_feature (889)..(889): n is a, c, g, or t
  misc_feature (892)..(893): n is a, c, g, or t
  misc_feature (902)..(902): n is a, c, g, or t
  misc_feature (913)..(914): n is a, c, g, or t
  misc_feature (920)..(920): n is a, c, g, or t
  misc_feature (925)..(925): n is a, c, g, or t
  misc_feature (934)..(935): n is a, c, g, or t
  misc_feature (951)..(951): n is a, c, g, or t
  misc_feature (954)..(956): n is a, c, g, or t
  misc_feature (958)..(958): n is a, c, g, or t
  misc_feature (989)..(989): n is a, c, g, or t
  misc_feature (991)..(996): n is a, c, g, or t
  misc_feature (1002)..(1002): n is a, c, g, or t
  misc_feature (1006)..(1006): n is a, c, g, or t
  misc_feature (1009)..(1009): n is a, c, g, or t
  misc_feature (1036)..(1036): n is a, c, g, or t
  misc_feature (1040)..(1041): n is a, c, g, or t
  misc_feature (1052)..(1054): n is a, c, g, or t
  misc_feature (1094)..(1096): n is a, c, g, or t
  misc_feature (1109)..(1117): n is a, c, g, or t
  misc_feature (1119)..(1120): n is a, c, g, or t
  misc_feature (1122)..(1129): n is a, c, g, or t
aagagaagaagaagaacgttctaaagccaatccattttnnnnttnaaagatcgtgatcgcaatggcgctctccgccgtgaggcatcggcgctcggagccgtcggatccgtcaccatcagaaccgtacacgaagctggacaagcccgagaaagcggaggagaaagacgaaggcttggggtgggtttttccgtttgtggctcttggattattgaggtacatgagtgccacctccaacatcatccacgattgcgacgaggtcttcaattactgggagccccttcatttccttctctacaaaactggcttccagacatgggaatacaggttctgttctgtttttctctcttttttgttttttgttgttgttggggttcagtttggggaagatgggtcaagggagaagagaaaaagttttgatttttattatttggggtgtgtttgagtaaacagtttagttaaatgcttatcgaataagttattaactattatatgtttacataaacttctgtataagcagttataagaaaagaaaataagtatgtaaaatgaattgagcttctttaataagctaaaatcaactcacgcaggtcagttatgggagaagtgagaagaaagaatatctgtaaaagttaaatgtttaagttgatatattaaattaagaaagaagttaaattcgtttttccttttttttcctcatataagtgnttatggagaggtttatcccagcaaagccaatgtataaattgtttctagagggaatggagttaaactgttttcatttaagttttaaaaagtttttgtaagctatggcgggaaatttattgaaataagctgaaaacagtttatactttatagacaagtcacaagttannagggtatgctgncaaanatnnaagtaagtngttagtaatgnngtaagntaagngcaaattannagtaaataaattattncannngnagaattcgcagtttgtagatggcaggaaaanannnnnntgtgangatnccntaattaggttttatgtttagcgcgcangaanngagaaaaaaannnaagaagaaaagttcattagtttcagttcaggtcatggtannncaaatgacaagtnnnnnnnnncnngnnnnnnnnccc

SEQ ID NO: 3895 - DNA, 665 bp, Glycine max
agaagtgctgatggtatggatactgatggtgacacacctagcaaaaaacagcgtctgagtagatcactgtcacggtccaggtcagtgtcacgcccaccacatgaagttgtgcctggagaaggcttcaaggattctgctcaaaaggtcaaggcaatcaaacttgcaaagaaatctgtcaagaagagaaacaaggatgcccgtcgtggagaagctgatagagtcatacctaatctgaagcccaagcacttgttttctgggaagcgttccaatggaaaaactgagagacgctaggacaggtatgtgcttttccaatgcagcttgccttatttatattgtagctagtctgcacaccaaatatttcactaatttgctcatataggaagccgttgaatgctgttttttgtcactaatgactactctcagctttattgattagtagttgatttttcttgttagacttttgaaatttacctagtgagttatacatgttttgtggtttcagaagatggttttcagtattcacaactcactggtgtctgtaaattgttttctctgcaggggatgctgtttaatgcattttagaggacacctgttggcatttttcagggctgccaaaaaaaattgttatttaatgtaagtgttttgttggagtttaaggttctgtg

SEQ ID NO: 3896 - DNA, 438 bp, Glycine max
tataccggatctggatgacgtgaaggaggcatcaccgttttttaacttactagatgttaagataaaggatttaaactggagctttgttggaagcattttcagacaatgatgtcatacttgattgcagaaactcgacctgtcaaaactgcttatataacaaatgtagatctagatctgttcaattcagacaaagttctagaattttttgaactataaacatagatacaattgtattagacagaatcttggtttcacacaatgagatcagttattctgtctttctggcttcaataattgactctgaaggatgacaaaaataatatcacaaccactccacaacgttcattccctcctgcatcttcactccatctaattgtctttgtccggtacatttccagttaatggtcttaattcggctctctcggcttaatcattaga

SEQ ID NO: 3897 - DNA, 401 bp, Glycine max
ctttcttgtgatccgaggagaacgaagagtcgttcctgagaagctcgtcgctatgggttctctccctgtgcccgcatttccatccaaacactgccttgacgagagcagccacattgacgaagccaccctctcggcgctattcaagtcgcagcagagccacctgaacttcttcttcgaccacatcgaccactcccaaaccctagccttcacgcgcgcgctcctcaatgccgccggcaccgtcttcttcaccggcgtcggaaaatccggcttcgtcgcgcacaagatctcgcagacgctcgtctctctgggcgttcgctccgcgttcctctcgccggtggacgctctccacggcgacattggaatcctcaccaatcgcgatgtgctcatcctcctccagcaag

SEQ ID NO: 3898 - DNA, 554 bp, Glycine max
gttgcatggcgctgttcctcctctacgagtcggcgtcgggttacgcgctcttggtggcgcacggcctcgacgaaatcgggcacactacggaggccgttcggaactccgtttccgacctcaacaggttcggcaaggtcgtcaagcttcgctccttcaaccccttcacctccgccctcgacgctctcaaacagtgcaacgccgtttccgaaggtgaaatagttacactctctctccccttcgcttgttattgcttattagtcgaattgtggaagcccaatttgtaaataataggaaatccccggttatataagtagtctctatagtattgaatattcatcaatttagtctctaagtttatatatattttattattgtttcaatacttggaggactacgaagcatgatttctaatacttgggggattacttatataatgtatgtactttaggagagacaataatactttaaggatgaaattaatggtttattcctaagttgaaagaccatgggtgatgaactgatcatgtatgggatgataaacttgtttttttttt

SEQ ID NO: 3899 - DNA, 490 bp, Glycine max
ctatctttttttgttaagtaaaacaatcatagagtaaactacaaaaatctagcgatgtaatagattctaatgtggttgacataattggtattttattacttattctctaagacactaataatattagtaacgacaacagcaataaaatcactccaaggcaagcttgtttagatgcactttcacaatcaaggatacaaaggaggatacattgataaatcgctgaagcttgataagttattactgcaaagttatgcaaagaaaccacgttaacagtagaacttcacattaaatttatatatgtttaacctccaaataggaaatgtaactagcaaaacttacccaaaagccacagcaggtgtagtgtcttcccagttctgaccaagacaatgctaataaccttccttgtcgtaaaatttatctgacttgatatatttagagtccgaggagatatcatcctcacagataacaagggattctgaaggatcatatc

SEQ ID NO: 3900 - DNA, 861 bp, Glycine max
acttgaaactatgttgaaagaattcaagcaattaaaagaagagtatccagacagaattctcattgcttctatcatggaggagtacaataaggctgcatgggaggagcttatcgatagagttgagcaaactggagttgtaagatgtgtttcatggttgagtttgtgacatttagcattttcccaacttgaattttctgatggctgacctctctgatatactcttaggatgcatttgaaataaatttctcatgtcctcacggtatgccagaacgcaaaatgggtgctgctgttgggcaagattgtgctcttctggaagaggtttgtggatggataaacgctaaagccacaattcctgtttgggctaagatgactcccaacataactgatatttcacaggttggctttgtgccttgtctttttataatactctaaccatattctaatgtttaagaagtggaaacttgttaagttatcaaatttatggattgtcactgaaattttgtagtctttgtttgtggaatagttgatccattgcgccatgcaaatgcggttgtaagaattttttatggacttgtacttgtcacttagaactggaaaaaatgtgtttgtttagctttatgcatgcgtgcaaactattttctaaagccaatctttcttgccctttatatgtgaaatgtcttggtgaactttttttatgccagtttcagtttagttagtaaatgtgtattgcccagtctctttgacaattaccatgttagtaactttgttgatgcttctgcttatagccagcaaggattgctctaagttcaggatgtgagggagtatctgccataaatacaatcatgagcgtcatgggatcac

SEQ ID NO: 3901 - DNA, 550 bp, Glycine max
  misc_feature (541)..(541): n is a, c, g, or t
cgaggtgttgttttggcagcaagaaagggcctctcatttgtattaacctttgaatcagagagagaccgaaattcagccattatggttgccaggaaatatgctcttgattgcaatgtatgcacccctttaccttgttatctactgattcatatgttgactttctttgtctcattctttagatatgttacaagtttgctttaaaagctctgcatgcatttccttgctgaaatggatcccttcatgcaaattaaaaactggtattttgttttttaaatgacaggtcgtgcttgccgggccagatgatctagtgtaggagcaaaaattaactgactgagcttttccaacaaacgtgagatttatcagattcttggtgtgagtatacgtgtgtgcttgttttgttaaagaaagatatgatttcatctgtgattgggtttttcactaattgagttgcattgttttaggcatggtttttttatttgcctaatcatgttgtaccaaactcaactttttttttataattattatttcatttgttcattgnggctaattt

SEQ ID NO: 3902 - DNA, 218 bp, Glycine max
acaagtcagaatctgcagttagagggtgcagattcaacactcgccctcatatgggtgctatagttattttgatgacatttaaaagtgggagcatgtatttgtccttgtatttcccaactgcaaagattatgttttgaagatagtgttttaaatttttcgtttacttagctgtcggatttgttgtgattagttcgtttgctccactctctcctctttca

SEQ ID NO: 3903 - DNA, 669 bp, Glycine max
ttttcttggtgctcagaaagagaaagaagcgaaatctgatgtcctcttttctgagttcttctcctttccacagtactcaacaagtgccagtggtggctgtgacaattctacagccatgagtgagcaaaagagtgaggctcagtcgggcattgctgacatagaagtgacaatggttgagagccatgcaaatctcaaaataagatccaagaaacggccaaagcagctcttgaaaattgtctccagtttgcatggcatgcgtctcacaatcttgcacctaaatgttaccacaacaggggaaattgtcctctattctcttagcgttaaggtttgtgttaccttaactttctcttgttcttttctttccccatatacattaaggttttaaattgtggtcgagttgcctttacaattttgatgcaattcttgatatcgtgagaaattacgacaagatcaaaataattctataaacattgatgttataatcaaaatcgtgatcgccaactgttttctaaaacctaagtataatacatgtctttgtaagcaatgaaaagtgtatatagtttgaaatttttcttttaggtggaagaagattgcaagctaggatcagtggatgaaatagctgcagcggtgtaccaaattctggataggattcaacaagagacaatctcg

SEQ ID NO: 3904 - DNA, 660 bp, Glycine max
  misc_feature (421)..(423): n is a, c, g, or t
  misc_feature (560)..(560): n is a, c, g, or t
  misc_feature (592)..(592): n is a, c, g, or t
  misc_feature (594)..(597): n is a, c, g, or t
  misc_feature (610)..(610): n is a, c, g, or t
  misc_feature (613)..(616): n is a, c, g, or t
  misc_feature (622)..(622): n is a, c, g, or t
  misc_feature (650)..(653): n is a, c, g, or t
tgatttgattgaggctgcaggctcccaaatgatgtggtacttgaaaattttgaatcctgcataggaagttgattatgaaaatcatctctattgagattagagcctgaaggcaattgactagctgggttcccctgagggagatgctttggagagaaaggttctgtaagcatgaaaattagtgaatgatcctgcattggagggtatgcttgatcctgaaattcagaattctgagaaccagttggtaacccagacttcatggaagtctgagaaacaaagtcagttcttgaatgcaattgactctgattgaattcagaagaaatatatgattttacaactcctgagtttaaactggaattatacaccgctcttggtggtgggcctggtggcggtggtggtggcagtggcaaggatgtccaagagnnnccggtgtataattccagtttaaactcaggagttgtaaaatcatatatttcttctgaattcaatcagagtcaattgcattcaagaactgactttgtttctcagacttccatgaagtctgggttaccaactggttctcntaattctgaatttcaggatcaagcacaccctngnnnnatcattcctaatnttnnnncttacngaacctttctctccaaagcatctccccnnnngggaacc

SEQ ID NO: 3905 - DNA, 369 bp, Glycine max
tgatggcagcattattatttatctgatttctgataagaaggagttcttacctaaattaagcagctataattggctggttgttgttctaaatgttggaggtgaaagcttatgtcacaatccaaatatacttcagattgaaaacttagaggagtttccattgaccatatgccacttaaataaaagatcaattggaaccaatgctgtgactgtgagttatacaatgaagccttctcgtgtcgaagattttgcaaagaggggtgcatttcctttgtgtcctactcaaaatgggttgatgtttgtgcctctcgcatccaagctgcctttatcatctcaattaaagggtgttgacatagttctccacaaaaaagg

SEQ ID NO: 3906 - DNA, 380 bp, Glycine max
agggttagacttagagcacgtgcaggaacggaacggcacgtggcgcgtgccggtgagggagaatcaggtgctgcgcttggacatggatagcatgaggacgcgagtgcatcaactggaacgcgagtgttcctctatgaagagagtcatcgccaagtttgacaagtccgacggcggcgccgccggtggttggagggcgtcgctgggccggaaattcggttgcaagtttaagactcaggtttgtgattcgcacgagtcaacggctgttgatacccgcaaaggacgccatcaccagcagcagcagccgcagcagcagcagcatccccatcatgtatagtcaccatgctaaacttcctcccctcacgtgagaatcattgttggag

SEQ ID NO: 3907 - DNA, 384 bp, Glycine max
ctacacccattctcttctctctctctctctcccgtcctccatctctcaccttctcaatctcttcaccaccaccatcatcatcattatcttctccaatctctataacctcgaaatccctcaaaacctctccctcaaaccaaatgaaatgacccttttgtgagaacattttttcccccttaagaaaaggtcaaaggctgcaactttttcttaaccaatctcacatttttttatttttcaacgtattttggccaggtttggttttctgggttgtcttggaattcaaaaaagattccaactttgaagatgggtaggggtggaaccgccgcggcggcggcggaggtcgccgaacccggtttaaggccggtttatttcaaagaacagaaa

SEQ ID NO: 3908 - DNA, 417 bp, Glycine max
ttgacggtgggaacatgggtgtcccagtgggcggagataataagaatggaagagggtctcgtcggaaactgctccttccacgaattgaagaagttccacgcagggattgaatcatctacggcaagagttggtgctccatgggacaagtagaatgtctccttcaatctcaaccccatatttctctcttcaatattcgaagaatcaccactttctatgatcttttcttctctccttgccacagaataatttgaaaaactgtaacaaaatctgaagatcttattcatagaagactataagacattaatcaataagctatttaaagattgaataaggtggttgtggagggttattcaacagagaaaaaaatggggttgagattgaaggagacattctacttgtcccatggagcaccaactc

SEQ ID NO: 3909 - DNA, 832 bp, Glycine max
tgctttttggcttcatgacttccatcctactaggttacggtgagtactaccaccatttattttcgtttctttaactatagttagtactataaaatcaaatgtgaactttgattacagatattggagtgatgagtggagcagcactgtacatacaaagagatctcaaggtatcggacgtgcaaatcgaaatcctgaacggtatcataaacctctactctcccgtcggttctttcatcgccggcagaacctccgactggataggtcgccgttacaccatcgtcctcgccggcgccatcttcttcgtcggagccatcctcatgggattctcccccaactatgcctttctcatgtttggccgcttcttcgccggcgtcggcatcggcttcgccttcctcatcgcccccgtctacacctccgaaatctcccccagctcctctcgcggcttcctcacttccttgcctgaggtactcttctctaatctcatccactcatccactcatccactcatcctatccatatttttcttatccctaacaatcaaacaaatgtataaggagacaccaacaattctcttgttccaagtctcaccgtgctatatatatgcttccaacatatactttttattagctattttgattcaatttttttttccttcaaattcatcacttttacatcgttaatacacttaaaataatatagttaaaaaaaaacaaatataatattcatttatatattttatttaattaaaatatttgcttttaaatattatccgtgatattcatctcattccaatctaaatggataaatttttccatttatttattatgcaaat

SEQ ID NO: 3910 - DNA, 338 bp, Glycine max
gaagtctaagttcccttttcatagatcagaaattcatcatcaggttcattacttttcacacattgcacccctaggtgcaacctttaaggaacccaaggggtttggacctaccccaaggaaaatgaagaagagcaagaagatgaaaaaggactatggagaagatgaagatgaagaagaagaagaagaagatgaagatgaagaagaagagccagacaggggagttattcctgaagtagtgaccaacagaatgatgaacaggatggcagtgtctgtagggattccactgggtgttgggcttttgtttttcccattattttactatctcaaggttgggttga

SEQ ID NO: 3911 - DNA, 539 bp, Glycine max
ttgatgcagaagtactgaattccatggcagttacaaatgagcatttccagactgcccttggaacaagcaacccatcagctttacgtgaaactgttagtatttttgttatattttgaaatcattagttgatgaggctttccttctgtggtctaatttcttattaattgtctgtgttgacaggttgttgaagtgcctaatgtcagctgggatgacattggaggcctcgaaaatgtcaagcgtgaactgcaagaggtaataaatatttccttatattcaattacatcttgcttatttctatatcaatttatctgttacttttttgtttgtttgaactcagactgtacaatatccagttgagcacccagaaaagtttgagaagtttggtatgtctccatcaaaaggagtactcttctatggtcctccgggatgtgggaaaactttgttagccaaagcaattgctaatgaatgtcaagctaacttcatcagtgtgaaaggtccagaactgcttacaatgtggtttggtgaaagagtgggaaaaa

SEQ ID NO: 3912 - DNA, 451 bp, Glycine max
tttaggtatggtgaattctaaaatggattattttggtgtatctagatctttctaattggtccgtggacatgacatttcattcttttgatagtgggactggagcgggaatggatgttgttgtttccagtgtcaaggcctatattgctgcactaaacaagatgtcgggtttcaaggaatcctctcaatctgctgaaaaaatttcaatttcttcattgaagatttgagaattgtgtggtgcttctttggtaacaattgtttgtgttaaaccacgaagaggaagacaatgttgcagcagcatccttgcctctcgcagttctccatattaagggttgtccctgtattttgaccggaatatatttgcaacctgtaatttattgattcacccaagtagcctttgcaaagaatgtaacttaagtccgttttaaatattcagactacagggattctttcc

SEQ ID NO: 3913 - DNA, 342 bp, Glycine max
tttcaataaaactattatttgacaaagatatacacagcctatacaaagtttttaagttactcaccaaaatattgagcattgaccaaaacatcaaatcaaatcacatattaaggtggtcatcagttccatccggatagaagattgaagtcccatcgccctcttcaacaaacctacatattgagtcaccaagctatgacacttcttcagccaagagtcaccactcatcccatttagttaagaagtcatcccacatagatgaagcaattgaatccctcgatgagaatgcaagttgttcttgtattgaagatagcatcggcacatcgggaagttcatcaatatctg

SEQ ID NO: 3914 - DNA, 430 bp, Glycine max
taaacgacagtaggagcctggtctggtcggtgtggcactcaaacattgtttgttgtaggaagaggaatcttgagaaatggcaggggacagcaagagcaagattctgttcatcggagggactggttacatcggaaaattcatcgtggaagccagcgccaaagctggccacccaactttccttttggtgagggagtccactctctccaaccccgcaaaatcacccctcatcgacaatttcaaaggcctcggtgtcaatcttgttttagtaagttaaataaaatcctctatcgctttctcatgtctgagactgtcaattaaacggatattgaccttataattatatgcagggagatctatacgatcaccaaagtttggtgagtgctataaagcaggtcgatgtggtaatttctactgtaggacacctgcagca

SEQ ID NO: 3915 - DNA, 645 bp, Glycine max
ggtagaattgcccatcatcattctttcatgacgagaaattgctgttcctaaatttaatcaagagggcataattatctacttgtttttgcaggttcttgagatcaggtgtatatcttgtcctagagaagttagaacttcaagtataccagagattagtaaagaagatgtaagtatccagtatcaccttgcaccctcctattccaaagtaatattagaattgataaatgacttggctatttaatgaatcactagtttcatattattgcttggttgtaacatggcagttacatcattcaaaagcagagggacccaagcagagctcatcaggtgaagttagaagttattgttaaagcattgaaatggcttgaaattgatatggacgtggatgaggtaatttctttaatttttcctccttgttctctactattttcaatttgtttatatctttcaaaaatgaatgcaggagattattgctgttttataatgcattttttatttatatatgatgcttttgcaggtagagtgtatagtggccatactgatatataagaatcttatgaaaggttactttgcccacaaaagcaaagttgttgtattgagcaagcaagaccccttccctaaattaaatggaaaacctgtcaattc

SEQ ID NO: 3916 - DNA, 380 bp, Glycine max
tgtgaactatatagtgttgaagagcagctgcaatgctataggctatagcaattgtacatggttgcatgaatgcaatgtcaaaaatgggattgaatcctctatgcaacacaagtctagtttatttatttaattattattattttttaatttcataaatattcattatataggcgacaattcgtagaaattgtggttaaatgtttcccgtggcaacagtgtagaagttgggcaggatgcaagttttctgctccggtaactaccttctagggtatttgattccatttttttcccttattttttttattttcctgttatttgtcgtcatgctctattgagttgtaacttcccagcaaccaagagtggaacaaatgcactgagac

SEQ ID NO: 3917 - DNA, 372 bp, Glycine max
acaaaagcaactttttatgtacaaaattccaatgccaattgccaccaaggttgtcaatgaccagtgctaaccaatgtcacagacatgtttcagctttctaacgtctcatagttcccttttgcttggttgaagactgtgaccatgatgatggctttaccctaccagctagaaggttggatgctgaagtggcacaaatttttcttcgttttgactctagctcttgttttctcttgtcagatatcgaatagctagagactccagagaagatagattcagaattgatcaatgccctcttgtccttcctatttctctcaaacttagctggaaatttcactgattttgccgtggcagaatcttgttcagtagctggaa

SEQ ID NO: 3918 - DNA, 782 bp, Glycine max
actgctgtccggtgcttgcagggcttgtggacttggatgctgctgtgtgcctctgcacaaccattagggctaagattcttaacatcaatatcatcatccccattgctcttcagcttctcattgactgtggcaagaccccaccagatggattcaagtgtgcagatagttagttaatatataattaattattatggtaatgcaccaaggaccaaagttatatttttcaaccctctctttctttcttttcttctttaatcagttttcacatcaactttacatatatgtcttgcttttttcgtcatgtcattcaccatgttccatttccttccttgttcaaagtatacttacataaagaacatggggggaaaaacttatatatatcagacttctgtactcttctccctgaagaatataacccatacatgaaatcagctgagctaaagaatttttgaaatacatactaataaatacatactaataaacaccctatttcggttagaacaggatccttctttgaaaaagtttttttcttttgggcaagaaaattagggttttatgctttttactaaattttccttgaaagattcaaagctatgtatttatgtatgtatgtaataacagtattctctaacttaatgttcacaggaattgcataactcatgcatgaataaaaacaagttgagaagatcgatgtagtgaaggaatggtctttcgtttctctttcatcaagttgttgtatacccaaaggccaaggacaacataattgtactatgactctatga

SEQ ID NO: 3919 - DNA, 748 bp, Glycine max
tatcatcaattccccagctagttttggccacgcctgcatcttcttctgctttaagctatggcctctaacttcagcttgagaactttgatgatatttgcccttgcattttctctcgtcctgcaaggcactcttggtaagtatacaaaacctgtcaatttcataaaaattcttcccccaaaaaattatcacatggtctcacactatcatactccataatttttacgtgacacatcattaagttaattatattaactctttatataaattaaacgtgtgacgtgaaaattgattgaaagtagtatagtcctaggatcatcttggaccataaaataatttctccaacccattccctttctttacgaatgccttaattgtcatgtgtcttggcatgtcaagtgatctttctagtgcttagaaattacattaagatgcaacctgtaaaaacggcaatgtagtcttcttgtgtttggaattaatattgtaatggaaaaatgcaggagggatagaatgcgagagtctgagccatgacacatgctcattcgccgtgacatctgctggcaaacgatgtgtgcttgagaagcaggtgaagaggactggtgaggaagcatacacatgcaggacatcagagattgaagctgataaactgaaggaccacattgaaactgaacaatgcatcaaggcttgtggtttggacagaaagtcccttggaatctcatcagactctcttcttcaatctagcttcacgcaa

SEQ ID NO: 3920 - DNA, 392 bp, Glycine max
  misc_feature (304)..(306): n is a, c, g, or t
  misc_feature (315)..(317): n is a, c, g, or t
  misc_feature (319)..(319): n is a, c, g, or t
  misc_feature (322)..(323): n is a, c, g, or t
  misc_feature (325)..(326): n is a, c, g, or t
  misc_feature (356)..(358): n is a, c, g, or t
  misc_feature (362)..(362): n is a, c, g, or t
  misc_feature (379)..(379): n is a, c, g, or t
tggtggacaagttcatgagcttggcattgccattgggttctaacaaggaccaccccattgcatgccccatgggaggcggcgctccgccgcttagcgggctgaaactgccgccgattctgctgtgcctggcggagatggacttgatctttgacacagagatggagtacaacgaagccatgaagaaggccaacaaagatgtggagttgtttgttaacaaaggagcgactcatagtttctatctcaacaaaattgcggtggatatggacccaaatactggtgctcaaacggaggctcttattgcaannnatcaaagannntntgnntnngttttttggctatgttactatttggacagnnngtgntttgatgcctgtacatnggagattgaattg

SEQ ID NO: 3921 - DNA, 826 bp, Glycine max
  misc_feature (790)..(796): n is a, c, g, or t
  misc_feature (799)..(802): n is a, c, g, or t
tcttggttgctgccaagggatctaagttcatggacactcatgctaggttcgttccctttttttcttatatgtaatcaactcttcaaattttctcatatcaatagtcaatattgtaggactgaacatcttgaacgtgaaattagcatttgcaagatcagatttctgattgtggtttcatattagggactcaacggtctgataagagatggccttacggatctaacaacaatccttaagataagctttcatgaccattttagaatctgtgtttgtaggattagttatttgcaattgtaccgatacaccaacaacatttattagaatagactttgatatcattttagaatttgatttgactctaataccggtaggaataagctaactcataagatgagagttgttccacttatatacactattttgactatatcacaggatctccaacattattggatgtataattttctgttcttatagcatggtattgttgcaggtttgggatatttccttcgtggggtttgtctcagaagctttcgcagatcataggggccaataaagcccgggaggtatctctctcggccacacctttgactgcagaggtagctgagaggttgggtttggtgaaccatgtcattgaagaggctgaattgttgaagaaaagcagggaaattgcggatgccattgtgaaaaataaccaagacttggttttgaggtacaaggcggtcatcaatgatggcctcaagctggatcttggccgcgcactttctcttgaaaaggtgagagttgtgannnnnnngtnnnnctataattacataacatgaattca

SEQ ID NO: 3922 - DNA, 351 bp, Glycine max
aactcccagtctcctcctccaccttctccaccggcggtgcaatcatcgactctggcaccgtgatcacccgcctccccccaaccgcctacggcgccctccgatccgccttccgtcaaggcatgtcaaaatacccctccgccggggaactctccatcctcgacacgtgttatgatctcagcggttacaaggtgttttccattcccacgatagaattttcgttcgccggcggcgtcacggtgaagctgcctccacagggtatactcttcgtggcgagtaccaagcaggtttgtttggcttttgccgcaaatggtgacgatagtgatgttactatatatgggaacgtacaacaga

SEQ ID NO: 3923 - DNA, 647 bp, Glycine max
acccttaagccgttaagcaccttcaacgccgccgtagtttgttattggtttggtttgatggagatggagggtgagaaacagcacaagtttgatgtggacctcggcaacctcatggctttcgattcctatcacaccttcccttctcaaccatctctttccaggtaccttcttcttcttcttctactacttcttctttttcgttttttgacactgcccttactcacgttaattgaacacagggaggacctcatcaaacagtgtttactgaaaggcactcacttggttcaagctatcgcagatgccctctttatcttaccatcgaccgaagatttggatggaccccttgtcaccttgcctcccccactcactaaattgcctagagaaaaacatgtaacccctcactccaatctcttcttttaaattcaataaattattatttgttagttgttcctttaatcttgaaattctctgcataatctcaatctttatcccctattgtattgcaactttccaagggctaaataaaaccctcttcctctatgtatgtgttggcattgatattagcttttcacttgtcttcattttatctttgttctgtacttctagtattttgctatgtctagtcgttttaaacattgggtcatcga

SEQ ID NO: 3924 - DNA, 250 bp, Glycine max
catcggtatatatccatattacagcaagctaaaacatgaatcgcaatgtgcacatagaccttacaactgtccatatgctggttcagaatgctctattatgggtgatataccctacctggtggcccatctgaaagatgaccataaagtggacatgcacaatggtagcacttttaaccatcgctacgtcaaatcaaatccacaagaagttgaaaatgccacatggatgttgacggtattgttttctaaactt

SEQ ID NO: 3925 - DNA, 395 bp, Glycine max
tctaaacttaatctcagacaagaaaaatgttaataacatattttctaatacactcttttaaatatgtttattagtgacggaatttagtgatgtattgccttttcgtcactaattctaaagttacaaaaactttagtgatgaatttttcaaaagttacatatgaaatatttcgtcactaaaatttattgaaaattaaatctggaaaattcatggttattttttttatgtgattttatagtttttaataaatttaaactaatcataaaaaatgtgttaaaatgagtgtaataaagaatatgttattgacacttgtggtatgtatactctactcgatccgatccagtgtatttttataggtaccaatttcttcttccactgttgttattgtacgtgta

SEQ ID NO: 3926 - DNA, 1103 bp, Glycine max
  misc_feature (1099)..(1100): n is a, c, g, or t
tgctcgtcactctcagacctttctccctctcttcgctccttctctcacaggcccatttctagaaccaccttctctctctatcctctccttttgaagccctccaaatggctccacatagagcccaaatccaggacttgccatgccctcgtcgccgctttgtctgcagaggtccaagtgcccgaaactttcgacgacacggaggaggacgacggtgctgatggctccaccgccaccaacaccgtccccaccaccaagcctaagaaaggcaaggccgcattgcctctcaagagggacagggtaggctatctccaatttcttttcttttcctcatttcttttattaattgactctttttttttatatatttaaaattgcttctaagtagaagtcttttatacttcttttggcttctgtttctacttctcttaagtagctcacgagtaaaattggcgtctctgaatgtcctgtgcttatttggttaaccaattatagcttgcacaagttgctcacacttccatgatctattggaaatgaacttgcctagcgtttcatgaaagtgtggtgacatcccttgaaaagaggtcgaagaagaaaaagatcaatgtcttttatttttatgacataccagtttcagagcagacaagtccgtccataaaagtacatgctcatttacttttgtttgacccaagtttatttaccaactttattttcgtacaatgattttatttaatggtatttatataaaaaatatcttctgaaatttcaagggtatatagttcgagtgtgaggttgcaggtgcttgtgtgtggccagtagtacatccttgaatgttagtagtggtgtttgtcccaccattctgttcaagctttttgcttggtttttcattgtattttagcatttgatttgcctccttcacatttatatgcatcatcggtgtcttccagcagtgatgatatgatttttattagataaccaattgtttacttcttccaaaattgaggtgtttgtttgggttgttgaaattttcatatttgatgttatgcttttaccctttatttcaaggcatgattgttctttcattgcctcactagacgagatnnaag

SEQ ID NO: 3927 - DNA, 650 bp, Glycine max
gctcttgacttgagcagctatattgacatttatggactcgcatcaagtttaaactttctgtatgtcaaagagtttcaaattatggggtggggaactaaatctgtgttttaccaatcaatagctgcaaattattagtgtgacatttaccagcataccatgtaacagttctaaaatatcttcttttattctcattgaaattgagtcatgcaattttcttctcagaactcaaatgtagaagagcttcttgataaggagcttcctcttaagtttgtggaggtggatgaggaacaatctagacttgtcctcagcaaccgcaaggccgtagctggcaaccaggcacagctaggaattggatcagtggtcactggctctgttcaaagcctgaagccatatggtgctttcattgacattggtggaattaatggcctccttcacgttagtcagatcagtcatgaccgtgtaactgatatttcaactgtgcttcaacctggtgacatattaaaggttaacctatattaatgttatgtggatgtttgcctagactcttggacataaaaatctcaagtttcttatttgtttaggtgatgatcttaagccatgaccgagagagaggtcgagtaagtctttccactaagaagttagagcccaca

SEQ ID NO: 3928 - DNA, 394 bp, Glycine max
agcaatcgatcaagattggaaccgcctcttccacatgagtactttggaaacgcagttgatgtggtgagcactgcagggttcacggcaggggaattgcttgagaaggatctaggatgggcagcatggaaggtgcacgtggctgttgcgaaccaaaacgacaaagcggtgagacaaaagctcaaagagtggttgaagcttcctgtggtgtaccaacttggtgtgcactttgatccttgtactgtgaccatgtcgagttccccgaggttcaacatgtatgggaatgaatttgggatggggaaagcgattgcagttctgagtggatatgccaacaaaaatgatgggaacgtgacagcataccaaggatatgaaggagagggaagcatagatttggaaa

SEQ ID NO: 3929 - DNA, 670 bp, Glycine max
cctttttttaaaataataaatcatgacaaaaagtttcaaatatttgttggctttctatttgttctcattgcctcatttcatgagactgtaggagggtgcatcagaatcagatctcagtatacttccaaaatacagatttcaattgttaagcaatgaggaaacacctggtgagggaggaggatcaatgattcctatggagaccagcaacggttattcggtgaatgaacgaacactttcaccagaggatgcagtatgttttacagaacacataattaatttctttcagccttgtgtagttaattacttctgcaagaggttccttgattttctgttttagtcactgcatataaagattcatgcagtagctccgtaagttctttgtgtgtgaatttatggttgtccaaaaagggaaaaaaatctaatttcttcattgggataataaaatttaaaagatttatgaaagtaataaatcaaatttctttttccttttcaggaatgctgtatatgcatctcttcttatgaggatggagctgaacttcatgttcttccttgtaaccatcatttccattctacatgcatagtgaaatggttaaagatgaatgcaacttgtcctctttgcaagtataatattctcaagggaaatgaacaggtgtgacaatactaaaggcga

SEQ ID NO: 3930 - DNA, 914 bp, Glycine max
  misc_feature (851)..(851): n is a, c, g, or t
  misc_feature (854)..(854): n is a, c, g, or t
  misc_feature (905)..(905): n is a, c, g, or t
ttgtcatcattgttgaggatctcaatcctcctcgtcagatgctagtagaggtaataagtgatgcttcataattttttaaaatacatttattcctcaaatggatttgtgttggctctaacctgttgtgtttgctcggttattcttgcagatgctttgtgaggaatgcggtttctttctggaaatagctgacttaatcagaggattaggtttaaccatcttgaagggagtcatggaagctcgcaatgacaagatctgggcacgctttgctgttgaggtaataaaaagggaaataactgatcataactcagaagtataatgaacttcctatagtataattcagtatttgtagcctttaatatttgaacattttcagctatgaatgaactatcaaatttaacgctaacttttataatttgtaggaatttgtatataagcattttaagattactgcttgatatatgctgtgaaaagtaatactggcattgggtgttgattttgatgttatctgcatgactaaaaaatggtcatgatgagacattctatccagttttgggttgggaaaaatgttagcagcactctttaacactcttgttctaacacactcttccattatgtgaaattcatctgagtctctcactgaatatgtaggtctcattctccattttattggtcctatttccagactagtaggatccacgtgaattttaaccattaggagagagtttgtaggaaaaacagtgatagaaatgtgttgtaagaactcctagtttgtatattatggtagtcacttttaaattttgctttgcaggcaaacagggatgtaaccaggatggaaatatttatgtcactgnttngtcttttggatcaaacgatgaagggtggtgcatcttcgtcgaatgcaatgnataacaaca

SEQ ID NO: 3931 - DNA, 429 bp, Glycine max
acaactcagaccgagtcagactcgaggagggactgagtcgaaaattgcataactcggtggcgtgcgaaggaagagatcgcgtggaacggtgcgaagtgtttggaaaatggcgcgcgcgtatgagcatggcggggtttgagttaaaaccactgagtcaaagcatggtcgagtcaattaaagcgcgactcatctctgccaacaaccgagtcaactcgggactcaccgtaaaagaagagaacggagggatttgctttggttggatgggaagaacactcacagtcgcatctgcttggcgttaacttggctcatttatttttctttcttttttctttttattttggttcggaatattattatatataatatcacattgttactatattttaacgtcatctagagataatggaaaggcaaagagaatagatttgg

SEQ ID NO: 3932 - DNA, 959 bp, Glycine max
  misc_feature (388)..(391): n is a, c, g, or t
  misc_feature (506)..(507): n is a, c, g, or t
  misc_feature (509)..(518): n is a, c, g, or t
  misc_feature (520)..(522): n is a, c, g, or t
  misc_feature (524)..(526): n is a, c, g, or t
  misc_feature (529)..(534): n is a, c, g, or t
  misc_feature (536)..(544): n is a, c, g, or t
  misc_feature (554)..(557): n is a, c, g, or t
  misc_feature (559)..(561): n is a, c, g, or t
  misc_feature (563)..(565): n is a, c, g, or t
  misc_feature (568)..(573): n is a, c, g, or t
  misc_feature (577)..(580): n is a, c, g, or t
  misc_feature (583)..(598): n is a, c, g, or t
  misc_feature (601)..(602): n is a, c, g, or t
  misc_feature (605)..(617): n is a, c, g, or t
  misc_feature (623)..(635): n is a, c, g, or t
  misc_feature (640)..(643): n is a, c, g, or t
  misc_feature (647)..(649): n is a, c, g, or t
  misc_feature (651)..(661): n is a, c, g, or t
  misc_feature (664)..(670): n is a, c, g, or t
  misc_feature (674)..(676): n is a, c, g, or t
  misc_feature (679)..(682): n is a, c, g, or t
  misc_feature (691)..(693): n is a, c, g, or t
  misc_feature (695)..(695): n is a, c, g, or t
  misc_feature (701)..(702): n is a, c, g, or t
  misc_feature (704)..(710): n is a, c, g, or t
  misc_feature (715)..(715): n is a, c, g, or t
  misc_feature (726)..(728): n is a, c, g, or t
  misc_feature (731)..(743): n is a, c, g, or t
  misc_feature (747)..(760): n is a, c, g, or t
  misc_feature (766)..(773): n is a, c, g, or t
  misc_feature (776)..(780): n is a, c, g, or t
  misc_feature (786)..(791): n is a, c, g, or t
  misc_feature (801)..(803): n is a, c, g, or t
  misc_feature (807)..(810): n is a, c, g, or t
  misc_feature (812)..(814): n is a, c, g, or t
  misc_feature (817)..(818): n is a, c, g, or t
  misc_feature (824)..(828): n is a, c, g, or t
  misc_feature (831)..(837): n is a, c, g, or t
  misc_feature (839)..(839): n is a, c, g, or t
  misc_feature (841)..(843): n is a, c, g, or t
  misc_feature (846)..(848): n is a, c, g, or t
  misc_feature (856)..(861): n is a, c, g, or t
  misc_feature (864)..(865): n is a, c, g, or t
  misc_feature (867)..(874): n is a, c, g, or t
  misc_feature (881)..(881): n is a, c, g, or t
  misc_feature (885)..(904): n is a, c, g, or t
  misc_feature (906)..(924): n is a, c, g, or t
  misc_feature (928)..(930): n is a, c, g, or t
  misc_feature (934)..(940): n is a, c, g, or t
  misc_feature (942)..(944): n is a, c, g, or t
  misc_feature (950)..(954): n is a, c, g, or t
caaattgtggttacattggatagaagttgtgatcgaactgatgcaccatttcctcagcatctgatttttgcacttcagtcttattcagggctgcttgagtcacttgatgcggttaatgttcacccagatgtccttcagatgattgagaagtattatcttcagccatcaatggagaagcttgtcttgggtcgacatggtttgcaggaaagagcacttccttggaaaaaccttctcttgtcatctgggttttcaccattgacctttagtaactttacagaatcccaggcagagtgtttggtgcagaggactcctagtaaggggttccatgttgagaagaggcagtcttcccttgttctttgctggcaaaggaaggatctcatctcagtannnnaaaaattactaggagtcctctgcaccaaacactctgcctgggattctgtaaagttactaaaggtcaatggtgaaaacccagatgacaagagaaggtttttccaaggaagtgcccnncnnnnnnnnnncnnncnnnaannnnnnannnnnnnnntatcacatannnntnnnannncannnnnntccnnnnttnnnnnnnnnnnnnnnntcnntannnnnnnnnnnnntaatcnnnnnnnnnnnnnccttnnnnctcnnncnnnnnnnnnnnacnnnnnnnaaannnttnnnnaacaccccnnntnaattcnncnnnnnnnttttnctccttctcannntannnnnnnnnnnnntccnnnnnnnnnnnnnntttttnnnnnnnnttnnnnnctctcnnnnnnctattttctnnntttnnnncnnnctnnatcctnnnnnccnnnnnnntntnnntcnnncttcatannnnnntanncnnnnnnnntttaccnttcnnnnnnnnnnnnnnnnnnnntnnnnnnnnnnnnnnnnnnncctnnnttcnnnnnnntnnntccccnnnnnttttt

SEQ ID NO: 3933 - DNA, 385 bp, Glycine max
tgacattagcagtggctgtaacacttgattatgggaaaatttgtcaacaagggagaatgattaggaaatgcttaagatataaatacagaagtagatcaggatggcttatagtattttgttggtacaaatggcatttttgtaaggactccttcattgggttttcctcgaataataatctttactttggtgcctgccttgtgcaatccagatttcacatatcccatggctatgttcttctggaggcaaggactgaatccaccactggtgatttccccaatgttgttgcctccttcatcttgaatctcactgtggcttctgggaggtggaccagaagaaaagaaaccaacacgcctgattttaggaccttcttcgagctgtttcaaga

SEQ ID NO: 3934 - DNA, 154 bp, Glycine max
attttctgtcttctctgcgtcttcttcctctctcatcgttttccatggctcgtaccaagcaaaccgctcgcaaatccaccggtggaaaggctcctaggaagcaactcgccaccaaggtactattttttttattatttagggtttcgtttttttt

SEQ ID NO: 3935 - DNA, 365 bp, Glycine max
gaatctatcataactcttcctttccttttatcgtttcatccagaaaacatggatgccatgacactgtcactcccgctccctccggttccggtctgtacagtgcccgcgtctgcatcaacctcgtcctctgtttctctcactcactcctggtcggccacggccaggcagaggctctcctctcacagaacaagacccattttccggaattattcctctgcggttccaaaacttacagtggtgacatgcggtgcggctgtgacggagatcaacgagacccaattcaaagacacggttctgaaggctaaccgtccggttcttgttgagttcgtcgctacttggtgcggtccttgccgtctcatctccaa

SEQ ID NO: 3936 - DNA, 1316 bp, Glycine max
  misc_feature (58)..(58): n is a, c, g, or t
  misc_feature (60)..(60): n is a, c, g, or t
  misc_feature (1251)..(1259): n is a, c, g, or t
  misc_feature (1281)..(1283): n is a, c, g, or t
  misc_feature (1300)..(1304): n is a, c, g, or t
agtgaagctctgagtctgattctgatagcagctctgatgaggacaaagtaagattttncntttttcacgtaacaccaccatgccatatatcttttctaatatcaaagtaagaagaaaccacctacatgtatatcttttttaattcactgtataatgtcatcttattgtgtactttttttatatcacaataagaaaaaacctgcaactgctaagctgcctgcattgtcagttgctccagctttgaaagtggaaagctcagatgatgaatcaagtgaaagctctgatgaagacaatgtaagtagtgggttatatagggtgtaaaggataatgataattgttgttttttaaaagaattttggaatgagatgtttttattcatatatttggatctatataggatgcaaaacccgccgtaactgatgtgtcaaagccttctgctcttgcaaagaagaaggttgacagctctgattctgatgatagcagctctgatgaagataaggtaaaatttctagctgtttttccctaaaaaattgagtttccttggttaagtttatatttatcttggagccaaaagtcaattgcacttatcttgctaaattgagaatgatgcttcctatcctcaattatatttacatttatttgtagcatataattgttgtacagttatttttttgtttttttcctgaatcttacaagtgccatcaaactacagaagttgtatattgaaatataaattgaatcccactcattgaaattctttttgttttgttcaattgatgatcaacaggggaagatggatattgatgatgatagttctgatgaaagtgaagagccacaaaagaaaaaggtatgaagtcttcagagattggttgaacaagtttgacctgttttgtcatttaatttaattttttcatttgtcatattttcaatgctgtttcattcttatttatttttctaaggctggtgcctcaaatctttgaaaacctatttttaaatacttgagattgatagtcatgattatgatggacttgatattttcctactatgataacactggaaagcaactgctgttcaactaagctgagtaaatttgtaaagtgagaaaatgaggatttatccgctgttgatttgcagtgacttaggtttataagatattttaatccaaattaatggtggatgggtcttcactttctcactgtacaatacaagtcactttttaagtgtagccagatcctaagctggaggaggtcnnnnnnnnncaaagtcactgcttttgagccnnngttttaattttttcctnnnnncctgcagactga

SEQ ID NO: 3937 - DNA, 830 bp, Glycine max
  misc_feature (375)..(375): n is a, c, g, or t
  misc_feature (379)..(380): n is a, c, g, or t
  misc_feature (382)..(383): n is a, c, g, or t
  misc_feature (416)..(418): n is a, c, g, or t
  misc_feature (420)..(425): n is a, c, g, or t
  misc_feature (435)..(438): n is a, c, g, or t
  misc_feature (446)..(448): n is a, c, g, or t
  misc_feature (457)..(457): n is a, c, g, or t
  misc_feature (461)..(461): n is a, c, g, or t
  misc_feature (467)..(471): n is a, c, g, or t
  misc_feature (474)..(484): n is a, c, g, or t
  misc_feature (488)..(500): n is a, c, g, or t
  misc_feature (508)..(523): n is a, c, g, or t
  misc_feature (528)..(530): n is a, c, g, or t
  misc_feature (536)..(536): n is a, c, g, or t
  misc_feature (542)..(543): n is a, c, g, or t
  misc_feature (550)..(563): n is a, c, g, or t
  misc_feature (575)..(576): n is a, c, g, or t
  misc_feature (578)..(589): n is a, c, g, or t
  misc_feature (596)..(664): n is a, c, g, or t
  misc_feature (667)..(668): n is a, c, g, or t
  misc_feature (670)..(677): n is a, c, g, or t
  misc_feature (679)..(720): n is a, c, g, or t
  misc_feature (723)..(726): n is a, c, g, or t
  misc_feature (728)..(728): n is a, c, g, or t
  misc_feature (730)..(760): n is a, c, g, or t
  misc_feature (763)..(804): n is a, c, g, or t
  misc_feature (806)..(826): n is a, c, g, or t
tagttaattatatcaatatcaattttaatttgtctcttctattttctagtttagtatttgggttgtttcaacattccaaaattttgcaatttgtttttattttttttacagccagtgcaaagaaaaacccggattcttcttcaccgagtccctggagagaccttctagataatcccatgcagtggcgtgatttccgtgaaagcaaacgcaatggattggtagtgactgcctcatgacttatctttctctttttgactaatttatctggggatccatccttttacacctctgtttacttagtacaggtaaaaccaaagcaccctgatttcaaacgcaaggatggctattctctctggcttggcaaggatgaaaagngggnntnncctaaattggaagaacttcaatttgatgttccnnntnnnnnntccaaaaaannnntgtctctnnntgtataaanacanaaaggnnnnnctnnnnnnnnnnnagcnnnnnnnnnnnnnaaatgcannnnnnnnnnnnnnnnaactnnncctcantcccgnnttggggnnnnnnnnnnnnnnaaaaaaaaaaanntnnnnnnnnnnnnttttttnnnnnnnnnnnnnnnnnnnnnnnnnnnnnnnnnnnnnnnnnnnnnnnnnnnnnnnnnnnnnnnnnnnnnccnntnnnnnnnncnnnnnnnnnnnnnnnnnnnnnnnnnnnnnnnnnnnnnnnnnnttnnnncntnnnnnnnnnnnnnnnnnnnnnnnnnnnnnnnttnnnnnnnnnnnnnnnnnnnnnnnnnnnnnnnnnnnnnnnnnntnnnnnnnnnnnnnnnnnnnnntttt

SEQ ID NO: 3938 - DNA, 935 bp, Glycine max
  misc_feature (62)..(67): n is a, c, g, or t
  misc_feature (882)..(886): n is a, c, g, or t
  misc_feature (918)..(922): n is a, c, g, or t
  misc_feature (924)..(931): n is a, c, g, or t
tgctattattcccagtatattgctgattgaatgagtatcacagccatctccgcaccataccnnnnnnaaattatagaccaattgttacaatgacttaatatttgaggggaagatcattttaaaagggttaaaaattaactcaaattatgtgacagaaatcaaagtgctactatataaaataaaaaaaacataataatctgtggatttatctatgtgtttatagaaattggttttgcttgaataaacttttcaataaacacttagaggagaatttagtttcctaacttatacacttcaacttttattgcagttttctcgtttaacttcttcaaaagttgattttaacttataataagctaattttaacttaccaaaagaagtttaatttattttcttttcttgtaagtgtctgtttattgaaaagtttattaaaacaggatcctattctgaaattcagtgttttcaagttaaaatgtactagtaaatcacaaaagatcaccatcactatttgtttgcaaaaaaacaaaatgcatccaatatcgaccttaccccaaagtttggcgacgtttttcgtgccactggaggcctaatggcagaacaggccaggaccaccaataccatggcttcaaccatggtgcccctgggaatgtgatcacactatttggtccacagggtatgctccagcgaagtttaagatgtgaagaagttataggactcatattagcatgaactgggttgatcagaattgcattaagcattcaaaagtgcagcttcaaaaactaaggtatatacttacaatagtaagatgcatccatctgataacctaaaggaagcctatatgttccatcaagcttggtggcattaggtggtgggtgaaacatnnnnngatcaagcaactctgggaaatagtatacatannnnnannnnnnnngcac

SEQ ID NO: 3939 - DNA, 700 bp, Glycine max
tttgcacttgatgcactgttggcaattatacttattatattattaccatggtacaatgaatcatgtgtgaatgttcatacggtgataggttttggacattttaatgctccaattttgaatcgatgttttggtagtataaatttttgttatagcagaattttactcatcattgaaattgttgctgtagtccttattattgctaatctgcatgtttaccactgaatgcctttattgtgtaatcaactacacattcttatttgttttttgtttgctatatagttcttatggagaccaaggccaccatctttcttgactccggagaaagaggaagagattgccaagaacttgaagaaatacagcaagaaatacgaggcagaagatcaagatgtttccttgctgctgagtgaacaggagcgagagaagcgcaggatgttgaaggaagagtgggacaagtgggttaatgaatggaagcagatccacgaagaagagagtttacagaggcaaaagctcagggatggagaggctagcgatgaagaggaggaatacgaggcaaaggacatcgaggtggaggaagtgatcgatgtaacaaaagaggtccttcaccttgagtatggtcaagagtgagttttttagctgggaggacttggattcgaacattttattcacttgtcgaggtatagttgttgggcagcttacttcg

SEQ ID NO: 3940 - DNA, 551 bp, Glycine max
  misc_feature (486)..(486): n is a, c, g, or t
aaataatattgatggtcatggaaaaatggataaaaagttaattgatcttaataccaggccactgctgttaaatggatcagcaccaaacaaccaggtaattttttttttctcgttttccatattgatttgagttcttgatttgtgggctgttttgtaatatgcatttcataacccttgaatttaattggttttcttaagcgcacagaaactacaaaagttgtgacacttgatttagttgttgaattaacatataatctattttttgaaggaacaatgcatggatattttaagaggcaataatcataaatctgccagtgtgccaccagtagaatccttcaaacaagagtctgagaagtaacaaaggtacaacatatagggtgtgccagtgtgggcagaggctacaaaaatattatgtttactcaaatttcttttacactgttgaccttgtttatgtgaatcttgttttttttttgcttaaaagtttanttgtttggctgcagaccaaattaatgagggaaaatagttgctttcatatggatgagctgcataaa

SEQ ID NO: 3941 - DNA, 259 bp, Glycine max
ggcggcagtacagctcggccgcagatcggaagtggatccttcggcgaaatctacctcggtgaaccctctctctttctctcttctgctattgatttcactgtaaccgttaattataggcttctctgttctgatcgattgctctctttgctgcagcgacgcatattgataccttcgagatcgtcgccgtcaagatcgtaaggctccgcgtactgctatttgctaggggttttcctagttgtctctgcttctgtgctatttt

SEQ ID NO: 3942 - DNA, 1520 bp, Glycine max
  misc_feature (534)..(535): n is a, c, g, or t
  misc_feature (559)..(562): n is a, c, g, or t
  misc_feature (569)..(574): n is a, c, g, or t
  misc_feature (577)..(582): n is a, c, g, or t
  misc_feature (584)..(587): n is a, c, g, or t
  misc_feature (592)..(593): n is a, c, g, or t
  misc_feature (601)..(601): n is a, c, g, or t
  misc_feature (603)..(604): n is a, c, g, or t
  misc_feature (612)..(616): n is a, c, g, or t
  misc_feature (618)..(623): n is a, c, g, or t
  misc_feature (628)..(629): n is a, c, g, or t
  misc_feature (644)..(648): n is a, c, g, or t
  misc_feature (650)..(650): n is a, c, g, or t
  misc_feature (657)..(657): n is a, c, g, or t
  misc_feature (659)..(664): n is a, c, g, or t
  misc_feature (668)..(676): n is a, c, g, or t
  misc_feature (678)..(682): n is a, c, g, or t
  misc_feature (684)..(685): n is a, c, g, or t
  misc_feature (694)..(696): n is a, c, g, or t
  misc_feature (698)..(700): n is a, c, g, or t
  misc_feature (702)..(702): n is a, c, g, or t
  misc_feature (704)..(704): n is a, c, g, or t
  misc_feature (706)..(730): n is a, c, g, or t
  misc_feature (732)..(732): n is a, c, g, or t
  misc_feature (749)..(753): n is a, c, g, or t
  misc_feature (756)..(758): n is a, c, g, or t
  misc_feature (760)..(766): n is a, c, g, or t
  misc_feature (768)..(774): n is a, c, g, or t
  misc_feature (780)..(781): n is a, c, g, or t
  misc_feature (783)..(783): n is a, c, g, or t
  misc_feature (788)..(790): n is a, c, g, or t
  misc_feature (792)..(796): n is a, c, g, or t
  misc_feature (798)..(815): n is a, c, g, or t
  misc_feature (818)..(820): n is a, c, g, or t
  misc_feature (822)..(826): n is a, c, g, or t
  misc_feature (828)..(834): n is a, c, g, or t
  misc_feature (840)..(858): n is a, c, g, or t
  misc_feature (860)..(873): n is a, c, g, or t
  misc_feature (877)..(886): n is a, c, g, or t
  misc_feature (891)..(897): n is a, c, g, or t
  misc_feature (899)..(901): n is a, c, g, or t
  misc_feature (904)..(911): n is a, c, g, or t
  misc_feature (914)..(925): n is a, c, g, or t
  misc_feature (930)..(934): n is a, c, g, or t
  misc_feature (936)..(936): n is a, c, g, or t
  misc_feature (938)..(938): n is a, c, g, or t
  misc_feature (940)..(942): n is a, c, g, or t
  misc_feature (944)..(946): n is a, c, g, or t
  misc_feature (953)..(965): n is a, c, g, or t
  misc_feature (967)..(974): n is a, c, g, or t
  misc_feature (982)..(988): n is a, c, g, or t
  misc_feature (992)..(995): n is a, c, g, or t
  misc_feature (999)..(1003): n is a, c, g, or t
  misc_feature (1011)..(1015): n is a, c, g, or t
  misc_feature (1017)..(1020): n is a, c, g, or t
  misc_feature (1024)..(1028): n is a, c, g, or t
  misc_feature (1032)..(1055): n is a, c, g, or t
  misc_feature (1060)..(1070): n is a, c, g, or t
  misc_feature (1077)..(1094): n is a, c, g, or t
  misc_feature (1096)..(1115): n is a, c, g, or t
  misc_feature (1124)..(1134): n is a, c, g, or t
  misc_feature (1139)..(1143): n is a, c, g, or t
  misc_feature (1145)..(1152): n is a, c, g, or t
  misc_feature (1160)..(1165): n is a, c, g, or t
  misc_feature (1171)..(1176): n is a, c, g, or t
  misc_feature (1181)..(1187): n is a, c, g, or t
  misc_feature (1191)..(1195): n is a, c, g, or t
  misc_feature (1199)..(1202): n is a, c, g, or t
  misc_feature (1210)..(1214): n is a, c, g, or t
  misc_feature (1216)..(1236): n is a, c, g, or t
  misc_feature (1238)..(1239): n is a, c, g, or t
  misc_feature (1246)..(1276): n is a, c, g, or t
  misc_feature (1278)..(1285): n is a, c, g, or t
  misc_feature (1289)..(1292): n is a, c, g, or t
  misc_feature (1303)..(1307): n is a, c, g, or t
  misc_feature (1322)..(1357): n is a, c, g, or t
  misc_feature (1360)..(1372): n is a, c, g, or t
  misc_feature (1374)..(1389): n is a, c, g, or t
  misc_feature (1392)..(1405): n is a, c, g, or t
  misc_feature (1408)..(1410): n is a, c, g, or t
  misc_feature (1416)..(1421): n is a, c, g, or t
  misc_feature (1423)..(1438): n is a, c, g, or t
  misc_feature (1443)..(1449): n is a, c, g, or t
  misc_feature (1451)..(1461): n is a, c, g, or t
  misc_feature (1464)..(1466): n is a, c, g, or t
  misc_feature (1468)..(1477): n is a, c, g, or t
  misc_feature (1481)..(1488): n is a, c, g, or t
  misc_feature (1490)..(1493): n is a, c, g, or t
  misc_feature (1495)..(1504): n is a, c, g, or t
  misc_feature (1506)..(1510): n is a, c, g, or t
  misc_feature (1513)..(1515): n is a, c, g, or t
tattagcaaagctgcttcatctgagaggctttctcataaccttcatctgagatgagtaactctacagagagaaagccacatgcactgttgacaccatatccacttcaaggccatatcaacccattgttcatattagcaaagctgcttcatctgagaggctttcacataacctttgtccacactgaatacaacattaaacgcttgctcaactcaaggggtcctaaagcccttgatggccttcaagactttcattttgagaccataccagatagtcttccccccacatatggtgatggtgatgtcactgaagacgcagtgtctcttgctaaatcagtgagagagaagatgctcgtaccctttcgcgatcttcttgctcgtcttcaggattacataccagatagtcttccccccacatatggtgatggtgatgtcactgaagacgcagtgtctcttgctaaatcagtgagagagaagatgctcgtaccctttcgcgatcttcttgctcgtcttcaggattaaaagctcggacttctnngatagtgggggggatgtgtagggnnnngaggggnnnnnnggnnnnnngnnnngaccnntgtgaaananntgttagtnnnnngnnnnnntcagnngctgattcatctttnnnnngnaattcgnannnnnntggnnnnnnnnncnnnnncnntccgctgtnnnannntngntnnnnnnnnnnnnnnnnnnnnnnnnngngactggcggttggtttnnnnntgnnngnnnnnnntnnnnnnntactcnncnaaccnnngnnnnncnnnnnnnnnnnnnnnnnntgnnntnnnnntnnnnnnngtcctnnnnnnnnnnnnnnnnnnncnnnnnnnnnnnnnntaannnnnnnnnnttccnnnnnnncnnntgnnnnnnnnggnnnnnnnnnnnncttcnnnnnantncnnntnnnctaattnnnnnnnnnnnnnannnnnnnnttctcccnnnnnnnattnnnnccgnnnnntttattcnnnnncnnnncctnnnnnccgnnnnnnnnnnnnnnnnnnnnnnnnccctnnnnnnnnnnnccctttnnnnnnnnnnnnnnnnnnannnnnnnnnnnnnnnnnnnnatctatttnnnnnnnnnnnttccnnnnncnnnnnnnntgctccannnnnnctcacnnnnnnttgcnnnnnnngtcnnnnntccnnnntccctttnnnnnannnnnnnnnnnnnnnnnnnnntnnctcctcnnnnnnnnnnnnnnnnnnnnnnnnnnnnnnncnnnnnnnncatnnnnctccattttcnnnnngttatgaacgctctnnnnnnnnnnnnnnnnnnnnnnnnnnnnnnnnnnnntcnnnnnnnnnnnnncnnnnnnnnnnnnnnnnctnnnnnnnnnnnnnnctnnngtctgnnnnnnannnnnnnnnnnnnnnnctgtnnnnnnntnnnnnnnnnnnacnnncnnnnnnnnnntccnnnnnnnngnnnntnnnnnnnnnnannnnnctnnntcgtc

SEQ ID NO: 3943 - DNA, 517 bp, Glycine max
  misc_feature (62)..(64): n is a, c, g, or t
  misc_feature (458)..(459): n is a, c, g, or t
ctgttatctgaacttctcaaatcttaaaagcaagaaaagtcatctacatgatctattagcannngaagttttaaagaaatctaatgaaatagaagctgaggttctagatagtatattgcccttacataatatagctgtacgttcagaatccgtggatgatggcaattttattgaggcaaaagatactaaaagaagccgaaaaaagtcaggaaaatcaaagggttcgggaactaaagcttcattgccagttgcatcttctgaggcacctatagtttcaagccccattgaaaagggaaaaaactcctgttcagcacagcaagagaaagaagaattgcctgccatcccagcaggaccctctctgggagattttgtactatggaaaggagagcgagaataagagataataatggagaatgcactcattgggatgaagaaaaccttggttttctacaaaggannagctcctaaaggtgaaaagacaaactgggttatgcatgaatataggttggaagggaaa

SEQ ID NO: 3944 - DNA, 380 bp, Glycine max
agctttgacagaagttcttggtattgaggttgatacccgcccgagaattgttgctgcgatctggcactatgtgaaggctaggaaattgcaaaacccaaatgacccttcttactttcactgtgatcagcctcttctgaaagtatttggagaagaaaatatgaagtttacaatggtttctcagaaaatatcatctcatttgttccccccacagcctatacttttggagcataagatcaagctctcgggaaacaatcctgctggtactgcttgttatgatgtgatggttgatgttccttttcctattcagagggagttgtctgctttattggctaacgtggaaaagaacaaagatattgagacatgtgatgaagcaatatgtg

SEQ ID NO: 3945 - DNA, 124 bp, Glycine max
ctctcgaagtcgagagttcagataccatagacaatgtaaaggccaaaattcaagacaaggaagggatcccaccagatcagcaacggctcatttttgctggcaagcagcttgaggatggacgtac

SEQ ID NO: 3946 - DNA, 603 bp, Glycine max
atcgctatggtgatcgaggtggttctaggatcatcaaatcagtgtctgcagctcttggtacgaggttttacgccaaggttgcaacagggactgacatagtctctgccgcacccaatgtttctctccagaaagctcgtacctgggacgagggcctggcttccaagttctccaccactcctctcaaagacatcttcaaggtccctcttttttctattttgtcgaaccccctttttctctttttcctcaattgctaatgccccttttccccttcatgtttcaggacaagaaagttgtcatctttgggctcccggtaagttaatttgccattttctataaagtttatgtgtttttggttgtcactactttggtgtttgttacccttgttttgtaaaatttggtactacagaatgaatgcttcgtttgttctaggaaatgaaattttttgaaagaaatgtgattttttttttgttatagatttattccatagtaatgtattttatgctttggctttctctcagggtgcatacacgggagtttgttcaaacaaacacgttcctccttacaaggagaatattgataagtttaaggctaaggggatagatt

SEQ ID NO: 3947 - DNA, 653 bp, Glycine max
  misc_feature (50)..(51): n is a, c, g, or t
ctcttgggggttacttttcttggggactctctttatattggaaggtatanntcagtgttttgttagagagttattttcttcttacatacttcacattattttgttaaaatccattttcttctgtcactctatatcacacttttcagcttattttatacttctttcttttctccatttatgtctaccttattagttgtataagaagttgtaaaaaccgtaggtaggaatataatttctcttatgttaacatgttcaatttaaaacatttgtttcgggtctaattacaagggtccaactttatgtacagtgtgatcggagctgccataatagttgttggtttttatgctgttatttgggggaaaagtcaagagaaggtggaggaagattgtacagtctacagctctgagtcatatgataatgaggtccctcttttacagaacaagagaacgggggaataaaatcttcaggaaatgatttatatactttctgcttgtaagcaaagaacgatggcagaaaaatttcaatattcttgtttcctctaaatctgtttccctgggcctgcaagaaatagatattggtcaccgaggacatgaatagaaagattgcataatttgcacaagatattgattttttgggtgccacttattccctac

SEQ ID NO: 3948 - DNA, 313 bp, Glycine max
ttgacttgagttgtgaccattgttttagtacttctattattcataagtctctaacaacagtgtcctagtggcaatagactggtgccattgttgtttcttttctttttggggcatcatttaaaagcacttcactatctcaaatatcacgcggggattaattttgtatttttcatgtgttgtggcctcttgctcaagttatgctagttgttcatttaaacccaatctagtatctcgtgaataatattttgaaatagattctattaaacctagtaactggagtacattatatgctattatctggtgtgttccttgg

SEQ ID NO: 3949 - DNA, 366 bp, Glycine max
ggggtttatggctaatggtcaattagagttgagtcaagttccctacagagaagatttggctgatatcccactaccacaatagggtaccagctggtctataaattaaatgcatcaccaaaaggggtttttctttcaagtcattctaaaagtgaatgtaatattaggaccttgagaattctcctctcgagttgtcacccatgtgtttgttgtgcgtactacatacataactactatataagttttatggttattatgttatagcaaaatttataagaaccatttcagtgtaaaccccatagtttactggtcttgaaaaattttgaataataaaaccccaatagtaagtagttttgtcattttctacgt

SEQ ID NO: 3950 - DNA, 408 bp, Glycine max
ctagaggaggagtctggaatacctttgcactctcctggggtaaatctgtttatgcagcaaatacttgatggaaattgggatgacagcgtagccacattgtataaaattggtctggcagatgaaagtatggtcaggtcagcctcattcttaatattggagcagaaattttttgagcttctaaatggtgaaaaggtcatggaagcgttgaagaccttgaggacagagattgctccactttgcattaatagtagtagaattcgagaactttcttcctgcttagtttcagcatcttctaggctagacattctaagggtgaggtctcgatcaaagcttctggaggaattgcagaaactgcttccccctacagtaatgatacctgaaaagaggttggagcatctagttgaacaa

SEQ ID NO: 3951 - DNA, 959 bp, Glycine max
  misc_feature (471)..(471): n is a, c, g, or t
  misc_feature (512)..(516): n is a, c, g, or t
  misc_feature (901)..(905): n is a, c, g, or t
  misc_feature (947)..(950): n is a, c, g, or t
tcattagatgatccgaaggcgccatttgtaaatgatgttgatgatgttgagaagcattttccagtaagttctatcaccttactagttatcacatgtttctctttctcatgagcaatctatgttgaagctgctttcactaagatgttaattgtgctagatactcaattggtgtcatgatcagcaacttttgtgtgttatataatctttggttgtctccagggaactctaactgcaattagggactggtttagagactacaagatacctgatggaaaacctgctaataaatttggacttggcaacaaggcagcaaataaggtatttttactgcatgaatatcttgaatcaagtatcattcggaattctttactcagtttgtgtacttcatgacagagtttagcagtttacatcttttaaattgttggttgattgttaaggttactgagtatagtgtctttcaggctgcatttnttcttgaataagttggttgccttgattactgtaggtgtcannnnnataggagacttttttaggattataagtgatataacatattcttctttgtgtatgatcactgagttagattcttgaacttggctgaaaatttccataaattaataatgtaaaagataaaagcaattcgttaatcttctgcagtgttatcattattggtgtttggtgttaatgtgttctggtcgtgccctcaatttttttcagttgattctcaactctaaactcttaaaacttgtatttggtgaacaggattatgcgcttaaggtcatcacagagaccaatgagtcctggaataaacttatcaagagatcaattcctgcaggagagttgtcacttgtgtagagatgtattgggggaatgtctattgttcatgccattgcttgcattnnnnncaattctatttatgaagtagcaaatttttctattgagcttcnnnngttataact

SEQ ID NO: 3952 - DNA, 875 bp, Glycine max
  misc_feature (865)..(865): n is a, c, g, or t
tttcatgcaaagcactcctactggtaatccaccatttccattcttttttccacctttaaaattttctattttatgattcttaattcttacatttaatttcatacaagtcaatgacatgatttgaatcgcaaggttcatgctttgtgtctacaatctgtacaaattcttatacaacaatttgatcttgaagtcattggcatttcatgcgattcttatatctttttttgtgccattctcaagtgatcaccttctaaattgagatgttcggaaaatggcctgtcctaagtcttctagttcaagtgattgtagtagtattaattgtatatttatacttctgttagcagttcataactcttgttttcattttggctccactttcgtttggtcttaatctgttaatacaatgcagggaaccccagttatcatggaagacacacagcagtaactgctcctcggactataaattttcaacctattgctgtcccttccatcacagtagatgaattgaagtctttgacagataattttggctcaaaatatttcattggtgagggtgcatatgggaaagtatatcaagccacattgaaaaatgggcatgcagtagtaataaaaaagttagattccagtaatcagccagagcaggaatttctttctcaggtttggttcaattgcagttgtaaacttttagtgataagactgtaaaagggaatatgtttttattcagtacttctgattcccatcttttgtaggtctccatcgtatcaaggctaaagcatgaaaacgttgtcgagcttgttaactattgtgttgatggtcctttccgtgcccttgcctacgagtatgctcctaaaggatcccttcacgntattctaaaa

SEQ ID NO: 3953 - DNA, 908 bp, Glycine max
  misc_feature (414)..(417): n is a, c, g, or t
  misc_feature (419)..(419): n is a, c, g, or t
  misc_feature (532)..(540): n is a, c, g, or t
  misc_feature (543)..(543): n is a, c, g, or t
  misc_feature (549)..(558): n is a, c, g, or t
  misc_feature (570)..(575): n is a, c, g, or t
  misc_feature (579)..(595): n is a, c, g, or t
  misc_feature (597)..(600): n is a, c, g, or t
  misc_feature (602)..(602): n is a, c, g, or t
  misc_feature (604)..(607): n is a, c, g, or t
  misc_feature (611)..(636): n is a, c, g, or t
  misc_feature (639)..(642): n is a, c, g, or t
  misc_feature (644)..(647): n is a, c, g, or t
  misc_feature (650)..(651): n is a, c, g, or t
  misc_feature (653)..(663): n is a, c, g, or t
  misc_feature (679)..(683): n is a, c, g, or t
  misc_feature (685)..(696): n is a, c, g, or t
  misc_feature (698)..(699): n is a, c, g, or t
  misc_feature (701)..(703): n is a, c, g, or t
  misc_feature (706)..(713): n is a, c, g, or t
  misc_feature (717)..(725): n is a, c, g, or t
  misc_feature (727)..(743): n is a, c, g, or t
  misc_feature (745)..(746): n is a, c, g, or t
  misc_feature (750)..(750): n is a, c, g, or t
  misc_feature (752)..(771): n is a, c, g, or t
  misc_feature (777)..(778): n is a, c, g, or t
  misc_feature (780)..(781): n is a, c, g, or t
  misc_feature (784)..(795): n is a, c, g, or t
  misc_feature (797)..(802): n is a, c, g, or t
  misc_feature (804)..(805): n is a, c, g, or t
  misc_feature (809)..(813): n is a, c, g, or t
  misc_feature (815)..(827): n is a, c, g, or t
  misc_feature (829)..(833): n is a, c, g, or t
  misc_feature (835)..(852): n is a, c, g, or t
  misc_feature (855)..(857): n is a, c, g, or t
  misc_feature (859)..(871): n is a, c, g, or t
  misc_feature (876)..(894): n is a, c, g, or t
  misc_feature (897)..(899): n is a, c, g, or t
  misc_feature (902)..(905): n is a, c, g, or t
agagtatgcgttcttatggcttaaccgtaccgggaagcgaccaccgcttctgcgtgcccaccgtatctcaggtgttctttaggcccaacaggcccattaaccgaatcgcgtttcccaaggccaccctcaagaacgacggcttcgtggtggacctgagcttctacgaccttctgggaataccggaatccggttcggtaacggagatcaagaacgcctacaagcaactcgcccgaaagtaccacccggacgtgtcgcctccgggtcgggtcgaggagtacacaaagaggtttattcaggtgcaggaggcctacgaaaccctgtctgatccttccagaagagctatgtacgacaaggacatggccaagggcattaacttcgccttcaacgcccgcagacgctataattaccacgatnnnnanatctttgttctttgaaatcatattcttttcatagatgatacgtcccctattatccttcactatgccagttccataccaatacttggcagtgtcttcttctgaagcatttatgnnnnnnnnncanagaatnnnnnnnnnntatagatttttnnnnnncaannnnnnnnnnnnnnnnncnnnntntnnnncttnnnnnnnnnnnnnnnnnnnnnnnnnntgnnnnannnnctnncnnnnnnnnnnncaacacaaaacctttnnnnntnnnnnnnnnnnngnngnnnatnnnnnnnnaagnnnnnnnnnannnnnnnnnnnnnnnnncnnttcnannnnnnnnnnnnnnnnnnnntatctnncnngtnnnnnnnnnnnncnnnnnncnnttcnnnnngnnnnnnnnnnnnnannnnnannnnnnnnnnnnnnnnnnagnnncnnnnnnnnnnnnncccgnnnnnnnnnnnnnnnnnnntcnnnttnnnnccc

SEQ ID NO: 3954 - DNA, 174 bp, Glycine max
ggtggtggttcctctatgtcgcaaaaattgagacaatcataccgcctacgtattcacatactttcttttctttcccttcccttccctcgttattttcccttatcggaggctgctactttctctacttatataaaaaaaaaaactaacgagaaattcataatccgaaacacaaaa

SEQ ID NO: 3955 - DNA, 299 bp, Glycine max
tttccattcaataattcaaacaccagttaatggctacccttctattccaccacaattcgcctcagatattctcttcctccttcttcttctcacagcattaaacgccgtcgttttcatgactccataattcaccggaagcagaacaacaacaagaagcagcagcagcagcgcgagttcacatgggattgggaacaaccgcgagaagcagaagaagaatcgtcatcgaagaaggttctagaacaagaacacacaacaacaccaacaacgccgatgccgatggagctggagcaggagctagg

SEQ ID NO: 3956 - DNA, 891 bp, Glycine max
tggcacgtaagtcttgcttgccctgtgcacaaagaggcatatgctgtattgttcatgtgtttaactatttaagctaacatatttcttaacatgttgaaattttatttaaagagtaaatgaatgtgaatgtataattatcgatgtgtactagtggcactaatggtcaatatgactcaattgattcatgagactatcaaaatgcctaatttctaatggtggttaactgtgtcataactggatcgtgtggatgctgtgtgagacattttcagcaggtgtttatcattttcattacttttaagttacctcagatgctgaattacatgaaccacattgtactgaagtttgtgaatgctgttttccactacaattgttcataactaaactatgaaagggataatgataataattctgacttctgatgactgcagctgtgacatacatagattctagtgctgttcaggctttgaaagacttgtatcaggagtacaaattacgggacattcaggtagaataagattgtgaagtttcaactaccgttagaattcttgaaataatcgctacaggtttacaatgtccccaccaaccaacttgagcttattcttcttgcagattgcaatatccaatccaagtccagaagttctgcttaccttgtctagatcgggtctggtggagttgataggcaaagaatggtactttgtgagagtacatgatgttgttcaagtttgcttgcaacatgttcaaagcttgaaaggagcatctaacagtccacaagcaccattctcttcagtagagaacaaaccaagtttgtttgcacgattatcaaaagagagagtggagaagctttcaattaccgacttggagtctggtaatggcaggcctccactccccgag

SEQ ID NO: 3957 - DNA, 413 bp, Glycine max
  misc_feature (268)..(268): n is a, c, g, or t
tcttgtgagagacttgacagcaaaaattaggtagttatgtatcatttcttattgagtgtcgacctctgtcaatcagcatgggaaatgcaattagatttctcaaaagtcatatagccaagctacctttgaccttgtctgaatcagaagcaaaagcttctctccagtcagatattgagtgttttataagtgaaaagattatacttgccaacaaggtgatagtgaagcatgctgtcaccaaaataagagatggtgatgttcttctaacttntgggtcttcatctgctgttgaaatgatactattgcatgcacatgagttgggaagacagtttcgtgttgtggtagttgactctcgtccgaagcttagagggcaacttttacttcgccggcttgtggagaacggtcttagctgtaca

SEQ ID NO: 3958 - DNA, 406 bp, Glycine max
agtagggtgtgtccgggccgggccttgggtttggccacgacccatctctggctcgcgcaacttcttcgccacttcatatggcttcccgcgcaacccgtggatctttcggagtgtcttaggctttccatggaaatgaagacacctctgcgatgtctagttgttcgtagataaaaaatataataaagtaagccttttagctgaactatgtttgatgtgcaattatagaatgatcgagcttgtatctgatgtttgatgttaaagatggtactcaaatatttagtgaaatatttagagatgagtttatcgtataattatggaacttatctctaagctttatttcactttatttttaagggtatcaaattattaaaataaatatctagtgccaggactagaggtggatgta

SEQ ID NO: 3959 - DNA, 421 bp, Glycine max
accttcaatcctcaatgttcaaggaacaatttcctatttgataatttacagtttcggaagcagtagcaccttcttcactaagaataagatagtgtttgttgtcagtcttgtacgtacaaatattacattacattgtacagcttaaggtttaccaagcatggactattgattataaccttcctcctatgcacctcctatttatagggcattcttggatagtgacacaatcagttgctttctgttctaaggacagaaatcatcaacaattaaagatatatgcttcctctgttttagacttggatgcatttgtcctgtactcctattgttattactaaaccttccattacgatccaaccaagcagacttcacaatcacttgtcactctatggctgcaagtgatagcaaagaggtcgagacaaaa

SEQ ID NO: 3960 - DNA, 514 bp, Glycine max
gataacatctgcatgccagatctctgactttggtttagccaaacttgatgaagaagagaatactcatatcagcacaagaatagctgggacaatgttagtactatgccacagcatttcctgtttgaatcctagactttgttcatcattaataggcttgcagtgttatccacaatatatctatagcttgcatttataatcatttaaataattaaaaaatacacatttcattgatttgtgaaatcactgacacaagggtattaaatgttttcttatcagtggttacatggctcctgagtatgctatgaggggttacttgactgacaaagcagatgtctatagctttggaattgtagctttagagattgttagtggaaagagcaacacaaattataggccaaaggaggagtttgtatatcttttagattgggtaagttacacttctgtgttttcgatagattgaagtgggagcatctggggtgcataatacacaaattatcctgtcatcgtcacaaaa

SEQ ID NO: 3961 - DNA, 396 bp, Glycine max
ctcttaccgttaccattaccagtacaattaccattccaccccttctttcccgtccccgcgacgtcacccccgcaaccaaaggctccacctttccttctccggcggaaatagaggcggcagcggcggcggcggcggaggaggaggagactccgatggcggcggcggcgacaacgagaagaacgtgggattgggagttgtgggaatggtgttaaacggatggagatcgagagtagcagcggacccacaattcccattcaaggtgttaatggaggaactggtgggagtgagtgcggcggtggctggtgacatggccacgcggcccaagttcggtctgaacgaactggacttggttttctcaactcttgttgtggggtccattctgaatttcatcctcat

SEQ ID NO: 3962 - DNA, 702 bp, Glycine max
taacgggaaatgattttcctgaatggtgggtgggagaaaatcagcaaggaaccatcggccaaatgttcccatgtttctccagaatgataagacagaaacagctaaaggttgctgcccgcatattgtgtatttcaactggtatgtatgtttcttttctgtccaaattatacacaaatgagaaattggaaaaagtaatataagttcatttgactgtattatccttttgctctgttaatgatttaaggtgctctcattctacttaattgagatacaagagtaaaggtggaaacaagaaaagtaattaacgccttcttagttgtatatagtgacatattttgaataattatttttttaaaagtcacaattactttgaaaacggagggacaaataagaaatacacttgtgttttgtcacacttcatcttccattgttgatgtcaaatatgatgtttttgcagatgaaacgtttaattcagattggcgtgacatgaaaccttacaacactgaggttctgattttaaatcttcactctagccaatactcattaccgtgttttacaaagaagatgaaaaaacttaaagttctgatagttacaaattatggttttcatcgttctgagataaagaagtttgagctgcttggttctttatctaacttgaaaagaatcagattggaaaaggtttcagtcccttccctctgcgaa

SEQ ID NO: 3963 - DNA, 345 bp, Glycine max
ctgttgtagggatcagtggttctgatcttcttttgaggcaaagacatgcaactccaattaaggcaaggtcgtttttaccctctttgtcaagagaaaagggtcaaggatctcttgtttcagttcaaaagccactgcacattggtgcttctcttggtgttggaaattttgtgtcagtgaagagtgatgataaaaggggtgatttggtgaagtgtgaggcctatgaggcagacagatcagaggttgagggtgcaagcacaccgtcagaggctgcaaagaaggtgaaaattgggatatattttgcaacctggtgggctctgaatgtggtgttcaatatttataacaaga

SEQ ID NO: 3964 - DNA, 385 bp, Glycine max
taaggtcaagtgagttgtaggagctctcgatgcaggcattggactggggacaccgtgctgtttgtaacaatttattgattactgtaaatccaaggtgtttactgtctgtagtaacgtttatgttgtatattgttagttcatggcaggagaaaaaagggagtaagttttcatatatactctctctctctctctctttttcttctttttttttaaagattatgtatccatacttgagaatgatacgtgtatggtgtggaacttggttccaaaccgtagccagaatgatgatgggcttgaaagtgaaagagccagcgagtcctgaatgtccaaagttttagttggaagcagttattacgcattatgcataaagaattgaccagagtac

SEQ ID NO: 3965 - DNA, 723 bp, Glycine max
  misc_feature (660)..(664): n is a, c, g, or t
gagtaaactgttactccatagcaacatatttctcaccaggatcagttatttcctcagaaagaggagcaattggacctctttgcaagaagaatatgagaactacccaatagaaagctacatcattaagcagtgatgaaactcccagcaatgcaattgaaacccctgtgaagcgtaatgaagcctgagaaatagacttatgtcagtatcttcacataaaaggaaacaaaggaaggcaattgagcaactagtcaaatattattaagatcataattcataagatactgacaaatcaagtttcactagttttcttcttcaaaatacaaaaatattactgttatacctttcttccccatagggcaaaagaaattctccctccatcaagttctcctgcaggaatgctgttgatggcattgatgaggagtcctgcccaagcccaaatcacaagagggttgatagaaattgcagttccttccttgagaacgttaccaagaagcagctttgctaaaaagttaataaaaattgtcactacattttggttttctaaatcaatgaagcagcaaataaaaataataaatgatatactgggcagtcatgggatttagtttgtaatgtaataataacaacaaataaatgctcatttgaaattattttgattaaaannnnnaaaagaatgcagacacaattgtatctaaatttcattacacttactaaagtgtatagcta

SEQ ID NO: 3966 - DNA, 517 bp, Glycine max
gttaagcagttgcagagttccggcggacccatgctgatacatggaatgttcagaaagaattttttactgaagagcaacttgaggtagttacccagaaaatccaaacatattatgtcctgtggtttaatttgattgttatacttctatttttgtttctttatattcttttttgctaatttttccctccatatattcacagattctggcagatacatcctcgtcatcgtcatattttgcttgataaaaaatttcaaagatattgttgggagagagggtactgaaataattggttagggaaagtatgtttttcatttttggtgtattgactgtattcatagttgttaaaatagcttttatttacattttgtaccattgatcatgtaagaaatttattccttaataatctagtctcagaagttgagcttcttgctttcctctgtctgttctgtaatttttcttagaccatggggttaatcaaatcatccgttggtagatcccacacaacacaatctgagtt

SEQ ID NO: 3967 - DNA, 311 bp, Glycine max
aagtctctttgccacagatctcgaaatgaacgaccagaaaactaagctccttggctcccacaacaggggcacttggagccatgttttctataagctgcgctctgagatcagaaggttcatctctacttctgatcacgccactcttcccaaaacctaccacaggtcctcacctcaagtcttctcataattccctccacatttctcaatgcttccttcaaataatttacctctttatttcagatccaccgtggaaatcattacgtaagccaattttatgtacaattcattcttcatgttaattttgttgcccg

SEQ ID NO: 3968 - DNA, 798 bp, Glycine max
  misc_feature (285)..(285): n is a, c, g, or t
  misc_feature (287)..(287): n is a, c, g, or t
  misc_feature (705)..(709): n is a, c, g, or t
  misc_feature (744)..(745): n is a, c, g, or t
  misc_feature (762)..(765): n is a, c, g, or t
  misc_feature (789)..(789): n is a, c, g, or t
  misc_feature (791)..(793): n is a, c, g, or t
gttggatcttgctacatcactacttgcaaaagccaaggaaaagggggtgtctctcttgttaccaagtgatgtggtgattgcagacaaatttgctcctgatgctaatagcaaggtttgttttctaagctcctttagatatgatattggtctgatgacatggtcggttgaatgaaccacttgaaatattagtgatatgtatggaaggcaatccgtttgtaatataagtcttcattcattctgaaacatttacagtaataacttaaattctgcatttaccatttcagngngtgccagcatctgccatccctgatggctggatgggattggatattggtccagattctgttaaatcattcattgaagcattggatactacccaaaccatcatatggaatggaccaatgggagtgtttgagtttgacaagtttgctgttggtacagaggtatgtatgcaagaacacccacccacatatggaattccattcaaattttatgttaaaccacgttgacagtcaatataaaaaaatgtccactctaaagcaatgcatactcaaaaatatgcagtaagagttaaccttcctaatgtgatttgtgcatcttgtaaactatatgcttgttcatttatacacgtgtcagatgagggatgattcaaatttcatccgcagttactacagcatattctattctgtttgactgataaacgtnnnnnctgtacataatttgcattttgtgctcttctttcannctattgcaaagaagctnnnngatctcagtggaaagggggtgacnannnttatc

SEQ ID NO: 3969 - DNA, 396 bp, Glycine max
catcctggtttatatctgttcagagattagaccaagaagaaaagtctggtggaatggttgcaatgcttggtggatatgcacttgcttactttgcagttctttgtggtgcttttgcttggggggttgattcatcatcatcagcttcaaagcgacgtccgaaggttttaggtacccacatggagtttctggcaagtgcacttgatggtaagatatcactaggatgtgattcagctacttggcgtgcctatgtgtcaggttttgtgagcttgatggtaggttgcacacctaactgggtgctggaagttgatgtgcacgtgttgaagagactgagcaatgggttgaggcagttgaacgaagaggagcttgctcttgctttgttgggtgttggtggagtag

SEQ ID NO: 3970 - DNA, 458 bp, Glycine max
tagcaatagcatggctaacattaggcaaaggccacacgcagcccaagtgttgcttcttctaattaataaaaaccctcttacacaataataatatctcaaaaatattatttgtctattcatattgaattgtcagtcacaatcgaccctttagaaaatcaacgcacaatcttttcaatatctctttatctggctcttgcgatgccgccttaacctttgcatccacagcaaacgcttcctgatattccaaaacatctatggtaatgagtaaccattaatttcattcgaaaaaccaaaagaaacaagcttaatgcaagacaagaaaaatgacctggaccaaatttcgctgaataatacggtcaataaagaacaagagaaggtcataggtgaattccgggtggccttggatgccaaacatgtggtctccatagctaaacatctcaactccagtcatttctgac

SEQ ID NO: 3971 - DNA, 732 bp, Glycine max
tttgtgtctagcttcctcctttctacaaagagcctatgaccaggtccaaccttatatcagcttaaagcctatgaccatctggatttctttgagaacagtattttttaccttatataaattattaaataagtaattatgatatttgaaaacagtataatgatttgatataagtaattatggtttttaacatgttacatatcacatataggtggtgcatgatgttgatcaacagagaattccagtgcgttttgttattacaagtgcaggattggtaggctctgatggtccccttcaatgtggagcatttgatataaactttatgtcatgcttaccaaacatgattgtcatggccccatctgatgaggttgaactcatgcacatggtggctactgctactcgcatcaatagtcagcctatctgctttcggtatccaaggggtgccctggctgggagagggtacactataagcgatggaatccccatcaaggtaattaggtggctctctattttttttatacatttgtgtgttactgaaactttgaaatgggtaaactgattaacaaacctaagatagtgtccttcatttctaacatccccaaagatttgtcataatatttttttaagatatcttccttttttaattttggagtggctgtaatctattcctacacagataggaagaggaagagttcttgttgaaggcaaagatgttgctttcctaggatatggatc

SEQ ID NO: 3972 - DNA, 404 bp, Glycine max
ctatgtggtgatcaagcacgcagcattgttcacatccaccatcatgagcaagctcttggccaggccaaacgtgaagctcttcaatgccgtggcggcggaggacttgattgtgaagaacgggagagttggtggggtggtgaccaactgggccttggtttcattgaaccatgacactcaatcctgcatggaccccaatgtgatggaggctaaggtggtggtgagttcttgtggccatgatggaccctttggagccactggggtgaagaggctcaagagcattgggttaattgatagtgtgcctgggatgaaggcacttgacatgaacaaggctgaggatgccattgtgaggctcactagggaggttgtgcctggcatgattgttactgggatggaagttgctaaaa

SEQ ID NO: 3973 - DNA, 404 bp, Glycine max
cttctttcacacaaattcagggttgcaccctatgttgagcatggattctgcttccattgacaatagctcttcttctaactcggttgtttatgatggttatggaggtggtgggggctacaatgtgatgcctatgggaactactactgctgttgttgcaagtgatggtgatcaaaatccaagaagcaatcatggttttggtgataatgagataaaagcacttggttatgaaagtgtgtatggctctgcaactgattcttatcatgcacatgcaaggaacttgtattatcttactcaacagcaatcatcttctgttgatacagtgaaggctagtgcatatgatcaagggtctgcatgcaatacttgggttccaactgctattccaactcatgcacccagatcaacta

SEQ ID NO: 3974 - DNA, 376 bp, Glycine max
  misc_feature (365)..(368): n is a, c, g, or t
cttattctcaccttctgccttgagcagaaaatgtaaacttttcagtatgccttaattatgtagaaaataaagtagctgcattaggtggatattggatcttctaaaataatgagatatgtaaaatgagaaaatcaacagtagatacgttcatgcgatctcagtttgtaatcctcacttaagagacaaagctaaatttgcatctggtttggttgaattacaaagaaaatgattgaaactgtgaaagaaatagatgagaggtatagacctaccaatttcaaggaatattttctatgagtttcatgatcagttgaaattagataacttcaccataacagatgatcatgatatagaaagattaaatgtgnnnngcagtcca

SEQ ID NO: 3975 - DNA, 377 bp, Glycine max
gatcaattccatcaacttttgctggctaggttcgctcgaaattcttgaggccttcttaaacacgggattagttttatatatagcaatactatttatttataacgtctatttactcattgttttgaaagagatttttattcttccactatgtttttgggtgccccagaaaaaaattctgggtgctcctagtaacacccggaactagaatgtttgaacagaattggttgcgcctggtgcccattccaagtttgttcctgtattctgggcgaatgcgaaggctcatgtcacgcggctattagaataaagtcacttcccagttacttgactctctctctattcttttccgccattcctaaccctacaagcttcgtctcaaa

SEQ ID NO: 3976 - DNA, 679 bp, Glycine max
ttggatactcgcaggtttatttcttgcggccgattgtgtaatggcttcagcatatattattgtacaggtgaaattatcattgtagtgatatctcgcaatctgtgatttctacttgcatggtgcaaatactctataattggttaattataattggctatatttcaggcttctattcttaagaaatatccagcagagttgattgttgtattcttttattgtttctttgtggccattcaatctgctgtgacctgtttggttgtggaaagagacatcagtgcttggagcttggaacctaagctaaggttgcttgcagttttatactcggtaataaaaatgcaaatcaaataaattattttaccactaagtaactcttccgcattatctttaccgagaagtctgaaacttcttctgtaaacatttacagggagtctttggctctgcatttcaagttggtattatttgttggtgtttgcaccagacaggaccggtttttgtttccatgttcaagcccttaggaatactcatatcagtggttttaggtgttctcttcctcggggatgcattctatcttggaaggtgggttgtgtagcttttgtctgattgaacaattgagtttatttcatccaacatgaattcattgttatctttcaatgcagtctgataggtgctacccgtgatt

SEQ ID NO: 3977 - DNA, 530 bp, Glycine max
aggggtagacaatggtgtttatgtaagcaagtctctgcagccatttgaggcgacctcccgcaaaaccataccagagggggcaatgtctgctgaagaaaatttcaactgatccaagggcccatcgaagaacttggtgcaaacgatcagaaagattgattggtgctgatcctttgaatgcaggccttaagggcatgcagtaaactgatctccatccccggcattgcatcttgaaccccgttaagatatcctcagtaactgaaccatagatccaaccaatctgaacaaacaggaaaacatgtgattaaaaaaagtagagtgaaaggtagtaaatgtagttggaatgatattttcattggtataagtatagtaacagaaataccatcattggtaaatagcattagcatttgagtctaacctcttttccccatgcagttttctcttcatatccacagctaataacatgaatggcctctttgatcagcattgagggatcagcagattcaggaagccctccattctccattagtgta

SEQ ID NO: 3978 - DNA, 437 bp, Glycine max
  misc_feature (140)..(141): n is a, c, g, or t
  misc_feature (370)..(371): n is a, c, g, or t
  misc_feature (380)..(394): n is a, c, g, or t
  misc_feature (399)..(402): n is a, c, g, or t
  misc_feature (408)..(412): n is a, c, g, or t
  misc_feature (417)..(423): n is a, c, g, or t
  misc_feature (426)..(430): n is a, c, g, or t
tgaggtaggaatctgattgtacaaattagacatcaatttgtaatatggtttggtttggccacaaggattagagaaaattcaaaggcaacaaaggaagaagaaagaaagaaagagttgcttgagtgagattgtattggatnngtggtttattgaaaatcctgctatgaagaaaacagaatcaatcacctaataacctattatgcttgagagacgagagaaaaaatggttagggagaagaaacaagaaagaaaggaaggtacaaaactagaaatgaaaaaaaaacaggagggccacttctgtagtagctcagtagttaaagcaaagccttaaagggtgttttcactctgtacctctctctctgggtgtgagnnggggggggnnnnnnnnnnnnnnnaaggnnnntttatnnnnnacaannnnnnngannnnnggggggg

SEQ ID NO: 3979 - DNA, 456 bp, Glycine max
  misc_feature (350)..(351): n is a, c, g, or t
  misc_feature (387)..(397): n is a, c, g, or t
  misc_feature (399)..(400): n is a, c, g, or t
  misc_feature (415)..(422): n is a, c, g, or t
  misc_feature (424)..(425): n is a, c, g, or t
  misc_feature (428)..(429): n is a, c, g, or t
  misc_feature (435)..(447): n is a, c, g, or t
gaatctccaacctccttttcaggaagatcctcatcaacgaaatagtcatggacgaaacaaggcgtaacacaccccaatacaacaagcttgaccgcatgatctcttctgaattgatcactcttgtgctcttcaaaatcgcatacttcactcttcttctcatattctctctcctttctacctcggcagtagtctacaccatcgcatcaatctacaccgcaaaagaagtgacattcaagagggtcatgagtgttgtccctaaggtgtggaaaaggttaatgttgacctttctatgtgcctttgctgcttttttcatttacaatatcgtgaccatgttggttatgttctaaaannggatcaggaaaaatactattagagagtgtgagaggnnnnnnnnnnncnncgaggggagccactnnnnnnnngnntanncctatnnnnnnnnnnnnnggggggggg

SEQ ID NO: 3980 - DNA, 403 bp, Glycine max
taagaatctccagcagaagcaatgtgtctgagagccttttcaaaccttttcagcctaaggtcaatattatattgcattaatagagttggcatacgctccaattcctgtaagaaaggaagaaactcttttggatctttctgagcattcaatgccacaatagctgcaagatttaaatcataaagacccaaagcagcttcatatacagcatcagagtcagctaaccacaaaagatgcttcaaagcttcttcagcagaagggtaagacattctcccctggtcatcagcatgagacaattccttttcacgaataacttttattctctttaaagcatcttcaagtaatggaggatcactctgagctagagtggtcaaaatgcaaagctcccttgcaggactttctgata

SEQ ID NO: 3981 - DNA, 579 bp, Glycine max
  misc_feature (58)..(59): n is a, c, g, or t
  misc_feature (539)..(540): n is a, c, g, or t
  misc_feature (574)..(574): n is a, c, g, or t
  misc_feature (576)..(576): n is a, c, g, or t
cttgcatgaatgtcaaccatgagaataatcatgaactttgttctacagattgtacagnnacatctattgcagtgtgggatattccgaagtgttcaggttggtgtttctcttagcaccatgatgttacggcatctgtatttgggggtttgtatctagatatttcttgggaaaaccttaaaaacacatgaaattcatgaattgggatcccaaaaaataattatttttaggtacctcatggtgaaaattgtttcaagcttctcaatgttgcatctttctgttcaactatggatggaggagttttgatggggaaaagggaaggataatttttaatttctaaattaatttaaaaaattaaataagggatgattggaaaggctacttcataatctgtcattttatttccttcattttaatataatctcaaataaggaatgtttagttaaaatgaaaaatttctcttccctccaaaatcctacatccaaaatcatctcctaaataaaggacatatttttgttaaaaaaacattttatttgagattnnaatggatgtgctgataaagtttctagcatcaaantnaat

SEQ ID NO: 3982 - DNA, 340 bp, Glycine max
ctacttgcagtagccgcttacttcctgaggcaagaaattgaaaagtgaaggttccaagattttgcttattgaaatatgaaacaattagcatccttgtgaatgctactgcttatttttgatgcattgtcattttttaaggggtttgctgatacttttatatattttggcatctttatgaacagttgttctaggacacgaccctctctctaaaatgccttgtaacatgggttgtatcgttacgttacatgtttcgtacaatgcttccaggtagaattgagctatcattcattacttgctatttgctgtgtattttgatgttatatgatatatagctttcact

SEQ ID NO: 3983 - DNA, 406 bp, Glycine max
ccttgccggcatttaaaccctaaatttcatgtcacttcaattattcaagtacaggaatacccctatatataatttacattgtccactgttcaaaaacatatcatactatattttatcggaaaaaaaaaacatcatactatatatactagagtaatctatttgcttctgctgagttaatttcaatttatcccatgtggtacgtctcttcaattatttcaagtctttcatataaacacgtgaaataaaatgtacatcaataaaactaggggtaaattattatgtccccataccataccacatggataaattgaaattaacacttgttttgttttgggggagagggcaaatgattctggggtagggggggggagggctatgttcaaccaaaaaaaaaaaaaaaaaaaaa

SEQ ID NO: 3984 - DNA, 698 bp, Glycine max
cactttttaagtacatccagggtcagtgtcaatactcatttatgacttttctgccatcataaacacaacttacaagaacttttggtctctgtttacatataaatgccactagtttataaagggttgatcttatttgtcttgagtttattaaaaccaacaaaagtgtaagatgcacgcttatctttacttcatattgaaattcaactttttttttatataaaaaggcaatgagaatcaaatatattttacttaatatttaatttgttaagtgaaggcaactgaatatttttctatttaattaaactgtacctcatatttacgttttgatttttttttttaatctctgcagagtctcctttccctgctaatttgatgttggcattaggccactcaatgcatgtaaagggtgattgtacaaactatgagattgacccttctttcggggtggaagcttctaacctttatcctgaggtgaaatacactactgtcgacaactatttgaatgcgtttgtctgaagtccagagaatgcgttatcatcaataaactgctctacctaagctgatcaataaaatcagagcatcttgtttattgctcaagaatttgtaccttgtcccttattgtcgttcgctacttcgcttagcttggcactgcttgaaagttcttctaatattaaagttctattactatttgtttgtgg

SEQ ID NO: 3985 - DNA, 993 bp, Glycine max
gtggtgtcagggtttgtggtggaagaggctcacatggtagggatgggacagatgcttattaccagaacatgattcaagcaaaccccaataatgctcttttgcttggaaattatgctaagtttttgaaggaggtaattttttggttcgtgcttaagcttgaacttgatcgtgatctttgtcttaaaaaagatgaagaaatgctgaaaatgaaaagaaaaacaaaaagtctaatcagtaagattattcaataaccaaaaaagagaggaaagaagaaaaaatgaaaaagaagccaagctagttagaataatcgttattaaaatatatccttgtctcataaaacttcttgtttttttttcctattaattactaattaatgttttttctgacattcaatttgcaaataggttcgtggagattatcctaaagcagagcagtatcttgaaagagctattttggctgatcctggcgatgctaatgttttgtccctctacgcggatttaatatggcaaacagagaagaatgctgatcgagctgagggctattttgatcaagctattaaaagtgccccggatgattggtaacataaatctacatggatcatgttttttcttgtttgcatcattctcctaatttttttgtagtatcagatacattctttttttaaaaaaaataattggaagttgtttctttcgtcgtagtgttagatgaccttgttgcataaaaaaagtgttacatgacttgggtctagatggatgtcacatgaagttggtttttgtccctatttccaaatatagacacattcaatgatttgttaaatttgaaactcaggacctgttgatagagtagctaaagtatgttataattcaatgatccgtaatccatgataattgtttagacattttgctttattggttgcctttcattccaaaattaaacttagttgtagtcctgaatttttttgtttgttcgtaaaactaatgtataaacctcaat

SEQ ID NO: 3986 - DNA, 364 bp, Glycine max
gacatattattctcgaggttcgcatacaggattgtggggctcttagtcaccagttccacaatgtcggagcctgaggcccctttggagcgtaaaaattcaaactttgggaaaatccttttgtgggggtcgcatgagagaacattgggtgctcttctaataatgctgattatctgggtgttggagaaaccgtggcttctgaataaggcgatgattgaatcgggtttttcgggggttttgaattgggtgaacttggagatcttgagagcggtttctacggagaagccacaagtgcttacgaggtaggaaaccttgaatgggtggtgctgtgaagtggttgaggtgtgtttcggagtgagtgatggtg

SEQ ID NO: 3987 - DNA, 404 bp, Glycine max
  misc_feature (394)..(397): n is a, c, g, or t
tatgtatgatctcttaacaccattaagacaaaaactatggaaaaatgatcacctgtacaatagatgatacgggaggaaaaacattcgatcactaatgatctaattttccctcaaacacatcacacaaaatctataaacagattattgactacaatttacaaaaaagaaaaaaacaaattgctatataatagctgactgcagacatgtaaaaagggggtgaattttcttaaaaggaatttattgggactgtcatgcaacttagcatccgaaggaaaaaatctcaatgatcgccattgttcaccttgatctctataagttcctcaatagactgacggcatatagggcatttattggattgaagtcgatgagcatttgcacactcactgctcttacnnnnatgtcga

SEQ ID NO: 3988 - DNA, 344 bp, Glycine max
gcgacagctgaagcaccacccctggttgccgttgtaaataatgaattatatgctgctgattatgctgacacggaggtaaaaaaatacgacaaggagcgaagagtgtgggttaccattgggagactacctgagcgagcagtgtcaatgaatggttggggtcttgccttcagggcatgtggagatatgcttattgtcatcagtggaccaaggactcatggtgagggttttattgaactcaattcatgggtgcccagtgaaggacctccacagtggaatctactcgccagaaaacggtctggcaactttgtctataattgtgctgtgatgggatgttgaagaattga

SEQ ID NO: 3989 - DNA, 395 bp, Glycine max
gaacaagtgcaactttttattttggtccataccagtggagctgaaaggaactagctccaatcaggcatgaattgggcctattttttaagccccattctatattcttttgttaatttatttgccatgccctttgggatatttgtgcaatttgtgcgtggctgtatggtatgaatacaatacaagcaccttggattataatgcctcgacccttctaccaaagtggaaggatcaaaatgcttattggctccaagtctatgcgaattaggttcctttattcgcttcaaattcacgatgttgtacaatcgatttataggcatagtaatacataatattataaccaatgaagaataaagagaatatattctcatatattggttaattgctcatacctgtcc

SEQ ID NO: 3990 - DNA, 397 bp, Glycine max
ctccgaacccaatcaatttgcattaggactcaccgatggtggagtacatgtacttgaaccactagaggcagaaggaaaatggggtactccacctccgaacgagaatggtgccgggcctagcactgcttcaggtgctgctgtttcagagcaaccccaaagatgatggatggcacattatgtagcacttttctctaaggaactttgagtgtgtgttttgattgcatatgatcccgctccctggtgcctccattcggtttgcaaagggaagctgcggaacgtaggtgtttgtaggttaggacaaatcaaattgaaccaatcacaccttgttattagtggcttcctaaccgtgggattggcacagtatgttattacccacataggattactggcgtaaaaa

SEQ ID NO: 3991 - DNA, 401 bp, Glycine max
ctcgggcaagccagaggacgttctcactgccgcggagaagtacattgaagagcatggaactgaagcatttgagaatctgcttagcaaggtgtctcctaattccatatgtacaatttggttaccaaatatttattctatcttttgttttgtttttttatcaactatgctatttttgtatctcaccttttgtactaatggtgctcatcattctgcaggctggtaaatctaggaaaagtggcaggcatgcaaattgaagctattgaatgcaatatattagcctagcttgtgtcatgtttgggataaaggggtgcatgtacatgtgttggcttaacttttgttaagttgtgtaactatatcagtcttagtcatctatgttttggctcaaggctatacaactatgg

SEQ ID NO: 3992 - DNA, 469 bp, Glycine max
  misc_feature (18)..(20): n is a, c, g, or t
  misc_feature (371)..(378): n is a, c, g, or t
  misc_feature (382)..(382): n is a, c, g, or t
  misc_feature (391)..(393): n is a, c, g, or t
  misc_feature (425)..(426): n is a, c, g, or t
  misc_feature (430)..(435): n is a, c, g, or t
  misc_feature (437)..(437): n is a, c, g, or t
cagtgaccccaaaaaccnnngaagcaagaactgaaattgtagtcgcggaacattttttaaaaccttgatcataatgtttaaaataaaaagaaaagaaaaagaaagatccatgaagaaacccatatcctttagctgggcttgtgcaagcttaacaagccattaaagttggtacattcaaacaatgccttagctgtcatttccctctcaaacctccaaacatagttcagccccacaagcagctcagtgatggcagcttctgtcttctccttgtttgcaaagaacaaagtctgcaacaacaacacattggtctttggcaccaagttctgatgctcatagctcctctcactctgccacttgatcatgttaataannnnnnnngaanccttttcgnnntttctaatagctaattacaaatcattcacacnntttnnnnnnantcggatggtgatcttgaagtttatactttggt

SEQ ID NO: 3993 - DNA, 372 bp, Glycine max
aatgttggttccttcaggattcctcctgcttccctctcgagttttgatgtgataagtgttattgtctgggtccctgtctatgacaggattattgttcccattgcaaggaaatttacaggcaatgaaaggggcttttcagagttgcaaagaatgggaattggcctttttatttcagtcctgtgcatgtcagcagctgctatagtggagattgtgcgtctgcagcttgcgaaagagcatggccttgttgatgaacctgttcctgtaccccttaatatattttggcaaattcctcagtatttcttattgggggcagcagaagtattcacattcatcgggcagctggagttcttctatgaccaatctccagatgca

SEQ ID NO: 3994 - DNA, 408 bp, Glycine max
gatttgaggttgtagagaaggcgtgttgttcgacaggaacatttgagatgagctacttgtgcagtgacaagaatccacttacatgcacagacgccgaaaagtacgtgttttgggatgcatttcatcctacggagaagacaaatcgcattgtctcaagttatttgattccaaagcttctagaaacctttagatgatgattatccattattttccatttgaaaaatcacatagtcttgcctagggcgacatgaaaaaaaaatacatttagcgagatttaatgtcgggttgccatgcttgatatggatactttttttgtgtgttcaattgttataacaaataaatttacacctgaaatcatgtagtcatgtacacccacatttgaccttttgtaccttcccatgctatact

SEQ ID NO: 3995 - DNA, 326 bp, Glycine max
gggttgttgtttcaggttgtggacgacattctggatgtgacgaagtcgtcggaggaattggggaagacggcggggaaggatttggtggctgataaggttacttatcccaagctattggggatagataagtcaaaggaatttgctcaagaattgttaaaggatgccaaggaacaattgtctggcttcgatcctccaaaggcggctcccttgtttgcattaaccaattacattgcttataggcaaaattaaaagtgaaaacattggataccctgttttctcactggggaaccactcaaataaatttctctgcttccatttccagtcaa

SEQ ID NO: 3996 - DNA, 403 bp, Glycine max
ctcccgccgcgccacgtcagattccggtcagtagtatcgttcgccaccgccactttcacggaggagcaacaacataaggcagctccgtatctgagacctcatcacgggatggctttgagcgcgacgctgtacgacattctggggatccgcgccacggcgtccggcgaggaaatcagggcggcgtaccggcgactggcgagggtgtgccaccctgacgtggcgccggtggagcgaaaggaatcctctgcgggcgagttcatgaagatccatgctgcgtactgcacgctctcggatcccgagaagcgcgacagctacgatagaagcttgttccggcgccagcagcgaccggtcaagacgacgtcgtcgggggcttccggctacggtgggcggaactgggaaacgg

SEQ ID NO: 3997 - DNA, 459 bp, Glycine max
  misc_feature (61)..(61): n is a, c, g, or t
ttcgaagatcaacaccacccccacttcctctccgcttgtttcctctgcaaaaaatctctcnggggacaatagagacatcttcatgtataggtcagtcacccacaacaacgcaaaaattcaattttttttttcttttttaacaaaaaacttcctttatgtttttttaagatacccttttggttaagaattatagatctgatttgggtttgaattgtttgttgcagaggggacacaccgttttgtagcgaagagtgcaggcaagagcagattgagatagacgaagccaaagagaagaataggaacctttcttcatcgatgaaagctttaaggaacaaggagcagagaaataataataataaatccacgtcgccaaacaaggcgcaacaagactactcgttccgtacgggggcagttgcggcggcgtagggtacaagtacaacgtaggattcctcgagagag

SEQ ID NO: 3998 - DNA, 714 bp, Glycine max
  misc_feature (49)..(52): n is a, c, g, or t
  misc_feature (700)..(701): n is a, c, g, or t
agagcgttgtaacctattgatgtgttggatgatttgatcattaccaaannnnttaaaaagtcttatcagaatcaagagcactaacaacatactaactaacacaatctttatttaacacaatcttcattgttgataaatagtgaaacctacataattttgtgattccggttaataatagtgtgttttaaagagtatatatactaaagaatgttttacaagtatttctttataagaataggtcaatagtggtagaatattattgactagaactcaacagcagaaagatgctattattctcctatttttaaagtaaattcaaatttaatttactttgttagcaatcaaacaagtcatctaacctgggcaagatccggattatccccatcccatttctcaattgcttgaagcaagaacttggtagcagcagggtaaaatttcctgcgcagcatcactgcaccaagttcaaaaagctcagttgcaccagcatcaccacttcttacttgctcctgagataatggcagaaaatgagtaaggacaaactgacaaaggataaaaaacaactagttccaactggcttgtccagttgtgcttgtgtataagctttattatggtaccaaaaccagagaaaaaacctcatacgtctaacataaaattcagggtataatatattttgaggttagtaccatatatatcttgctcnngatctaaaggacc

SEQ ID NO: 3999 - DNA, 428 bp, Glycine max
gaatcattagctgctggaggttctgaatcatctgcaagataccttcaagccttggggcatagctctagaaatgggcctctggaagattcttcctttccacctctacccataacttccagcaatggccagcaaaggtccaaacatgaactggaaggttcatctagtaacactatggctgcacgtctgcgtcggcatggcaacagaactgtatccgttgtcaattctggtaatgcttggccagcagcaggccgtggactggtacaaacatcaagtaatccttcacaatctaaaccgtcaacaaataatgttcttggactgtctcgtaacactgggcagatgaaaacagtaattaacagtggaccttcatcatcaacttatgcaggttctattcaggctacacaaagaactactcacggacaatttcctgc

SEQ ID NO: 4000 - DNA, 490 bp, Glycine max
gggttctctctctcaccccacatgaaaatggaggctacttcagcagccactgttccgacatccttctacatgtccccttctcaatctcacttgtccaacttcggaatgtgttacggtgtcggagaaaatggtaacttccattctccacttacggttatgcctctcaagtctgatgggtcactttgtatcttggaagctctcaaaagatcacaaacgcaaggttgcctttttttcttttcatccattttcttattttcttcatttttttattatcttcagacaatattttaaaatgatgcagtactattttttatgtcatgttattgttatggctctttattaatcattacattgtgaacttggttgcattattgaagtgatggtgccaacttcgtctccgaaattggaggactttctaggtggtgcaactatgggaactcacgaatatggaagccacgagagaggtttgagcctagacagcatctattat

SEQ ID NO: 4001 - DNA, 407 bp, Glycine max
tcaccaccaaaccctattcagcatttcccccaaatccccgtcacaccatgggctcctccgcgatggtgttggacccgaaaccctcatcggagcctccgccgttcctcccgtcgacgaaatcggactaccttcaaggcagcttcggcggcgacgccaccgcctccgacgaggacgacctctacagccgcctgaaatccctccagcgccagctggagttcatcgacatccaggaggagtacgtgaaggatgagcagaagaatctcaagcgcgagctgctccgagcgcaggaggaggtgaagcggatacagtcggtgccgctcgtcattggccagttcatggagatggttgaccagaacaacggcatcgtcggatccaccaccggatccaactactacgtcaggatcctc

SEQ ID NO: 4002 - DNA, 567 bp, Glycine max
  misc_feature (506)..(517): n is a, c, g, or t
atcatcttgttgatctcagggtcatgaataactgcctcaaggttacagagggggttgatcatgttttcaatcttgccgcagacatgggtgggatgggttttattcagtctaaccactctgtcattatgtacaacaacacaatgattagcttcaacatgattgaggctgccaggattaacggcattaagaggttagtgatggtccatatcatttcaattatatgttttgtgactaaacattttatgatgtggtgtctgttttgattatatgatgatgtgttttatgcattccaaaaaatgtttttccaggtttttttatgcctctagtgcttgtatctaccctgaattcaaacagttggaaactaatgttagcttgaaggagtctgatgcatggccagctgaggtttgttggtgatcttttcaattgttcaatttatgttggttcttgattttcacattgggattgggattaatgtgtttaattttgtgactgtttttagccacaannnnnnnnnnnnctagagaagcttgcaacagaggaattatgcaagcactataacaaggattt

SEQ ID NO: 4003 - DNA, 371 bp, Glycine max
gaacgttgttgattgtggaggatggtttagaagaaaaacaacctcccatgtgtgcttctttcttggtaaataggatgcacaatgaaagggtattgcaactaaggttgtattgtacttatgtgtgactatgttaattaactatatactatagaccactggggtttgattattgatgcgtggttggataagtttctagttttttttatgcataagcagcgttatagaaatgaaatggatggttttggttacctaagcagtgaattttctgactggctccttgagtttatctacttgtggattcaacttcaagtacacaaaagggtggctattaaataaaagtgcttctacttggaaacacaaagctgaagcac

SEQ ID NO: 4004 - DNA, 414 bp, Glycine max
tatataacacaatgatgtagaacgacacgggtatacccgtatttctgggatatatcttttacattaaatgaacgcaaaatgaagcatgcatctagtacatacttgaacttatttaaatttgtggggtacaaaacgacattagaaagaaaacaaattaacaatagcaaaccataactgtgaaaatgaaacactaatcttagtaattatcatcacaaatctggaattattgaacgtacgtacgtaattaactcaattgatttttcaaggcttgttggcttcaacatgcttgaaaccaccaatgacaccaccaataccaccaatagcacctacaccacctccaacccctccaaatccaattcctttgtaaatgcctccctccaattcaaaatcctttgtaaatgcctcctccaattc

SEQ ID NO: 4005 - DNA, 1224 bp, Glycine max
gcggcggcggtggcggcggcatagagtggaagtagtaaggatcaatggcagttccagggaggcgcaacggtatgaacgacgacgaagaggaattagacgacaacgcccttttcgaagaacaaggtgccgtcgaagacgacgccgatacccctcctcacctccgcgacctctccgccgccgctcagctaggcgacgtccacgccctccgtatcgctcttggttctctctctctctctctctctctccaattcactgtaataattgatcaaagacctgcctctgctataccctatctagtatctgtatctgttacttcttcaaatttcaatccaaaccctagcaaactggaaaattatgtttttctatatcttctgttagaaaattgattgatgatatttactagtaaggctgatataaatagccctcaccctctggcaaattgctgtatgagtgtcttggataaaaattcttatgttttcacttctcattaagcttttataaaaagttctacattcatgattttggtcgcaacatcaaggattttagggttaatgcgatcgcaattgccagccgcattgaccgcatttgttccgcaatatcaacaattgagataaactgtgaccgtgactgcaatttaaaaccttgtttttcatggattttgaatctgatatggtcctctgtctgatacattagcagtaaattttttatttttttttctgaagattgatatatagtgtgtttggtttcacgtctctcagatgtggttttttactcttacttagaagctagtagttatagcttctaagttctatggtttttttagtgaatttgacataatttcttttattctcaatggatttccaaacacgtaatttgtagagagtgcttaaaatttattcaagtaactactatgatttgatttgttcggtaaataaaatcattcttgctagcgtactgggactgggtgtcctttttgttgatgcttacccttatgctatatacttcagataacttgactggtacccttatgctatatactgcagataacttgactggtagtattgatgagccagtggaggatggggatactgctcttcatttgacatgtctatatggccatttggcttgtgtccaggtttattatctttgcttattcttatgtttgtatactcttattacagcattgcatgaattgttgatattgtttgataaactgcagctgct

SEQ ID NO: 4006 - DNA, 392 bp, Glycine max
agtgctgcttatatggctatgaaggagtctattgaagctccacaaccatatgcttacaatgataagttgtataactcaggagtcaactctgggaccttccaatcaaacaatcctgcaaaatgtggcctgaacaagactccaaaatctacaactgaagagaaaatgtacaggtcacagagcgtaccaagatctgatcatctgaacagtgaggatacattgccggatcaatatggtggaaatgattataggaggcacagctaccatccaacttctgcgcattcagatattaagtttgatgaatcagattgtgatgaagaaattgaagcagaagaacctcctgtggttactatgccccctaatcggtttccaccaccagtaccttcatctaaaaa

SEQ ID NO: 4007 - DNA, 1231 bp, Glycine max
  misc_feature (180)..(180): n is a, c, g, or t
  misc_feature (182)..(182): n is a, c, g, or t
  misc_feature (185)..(185): n is a, c, g, or t
  misc_feature (205)..(206): n is a, c, g, or t
  misc_feature (526)..(527): n is a, c, g, or t
  misc_feature (547)..(548): n is a, c, g, or t
  misc_feature (555)..(556): n is a, c, g, or t
  misc_feature (566)..(568): n is a, c, g, or t
  misc_feature (574)..(575): n is a, c, g, or t
  misc_feature (577)..(578): n is a, c, g, or t
  misc_feature (589)..(592): n is a, c, g, or t
  misc_feature (594)..(594): n is a, c, g, or t
  misc_feature (596)..(601): n is a, c, g, or t
  misc_feature (618)..(621): n is a, c, g, or t
  misc_feature (623)..(625): n is a, c, g, or t
  misc_feature (631)..(631): n is a, c, g, or t
  misc_feature (636)..(637): n is a, c, g, or t
  misc_feature (648)..(652): n is a, c, g, or t
  misc_feature (656)..(665): n is a, c, g, or t
  misc_feature (670)..(671): n is a, c, g, or t
  misc_feature (678)..(682): n is a, c, g, or t
  misc_feature (684)..(685): n is a, c, g, or t
  misc_feature (687)..(693): n is a, c, g, or t
  misc_feature (695)..(696): n is a, c, g, or t
  misc_feature (710)..(717): n is a, c, g, or t
  misc_feature (720)..(720): n is a, c, g, or t
  misc_feature (730)..(730): n is a, c, g, or t
  misc_feature (733)..(733): n is a, c, g, or t
  misc_feature (747)..(753): n is a, c, g, or t
  misc_feature (758)..(761): n is a, c, g, or t
  misc_feature (773)..(777): n is a, c, g, or t
  misc_feature (790)..(791): n is a, c, g, or t
  misc_feature (795)..(798): n is a, c, g, or t
  misc_feature (805)..(810): n is a, c, g, or t
  misc_feature (815)..(820): n is a, c, g, or t
  misc_feature (822)..(824): n is a, c, g, or t
  misc_feature (826)..(826): n is a, c, g, or t
  misc_feature (834)..(835): n is a, c, g, or t
  misc_feature (837)..(847): n is a, c, g, or t
  misc_feature (856)..(869): n is a, c, g, or t
  misc_feature (876)..(887): n is a, c, g, or t
  misc_feature (908)..(910): n is a, c, g, or t
  misc_feature (916)..(923): n is a, c, g, or t
  misc_feature (925)..(928): n is a, c, g, or t
  misc_feature (931)..(933): n is a, c, g, or t
  misc_feature (936)..(937): n is a, c, g, or t
  misc_feature (939)..(940): n is a, c, g, or t
  misc_feature (944)..(949): n is a, c, g, or t
  misc_feature (968)..(973): n is a, c, g, or t
  misc_feature (977)..(990): n is a, c, g, or t
  misc_feature (995)..(996): n is a, c, g, or t
  misc_feature (1007)..(1009): n is a, c, g, or t
  misc_feature (1012)..(1013): n is a, c, g, or t
  misc_feature (1016)..(1020): n is a, c, g, or t
  misc_feature (1024)..(1030): n is a, c, g, or t
  misc_feature (1033)..(1038): n is a, c, g, or t
  misc_feature (1043)..(1071): n is a, c, g, or t
  misc_feature (1073)..(1076): n is a, c, g, or t
  misc_feature (1078)..(1091): n is a, c, g, or t
  misc_feature (1096)..(1102): n is a, c, g, or t
  misc_feature (1105)..(1105): n is a, c, g, or t
  misc_feature (1113)..(1122): n is a, c, g, or t
  misc_feature (1132)..(1137): n is a, c, g, or t
  misc_feature (1144)..(1159): n is a, c, g, or t
  misc_feature (1163)..(1163): n is a, c, g, or t
  misc_feature (1165)..(1165): n is a, c, g, or t
  misc_feature (1180)..(1208): n is a, c, g, or t
  misc_feature (1210)..(1215): n is a, c, g, or t
  misc_feature (1217)..(1226): n is a, c, g, or t
agccgcctcactttctaaaaccaaatcggtaagagtctgcaacacctcatttctgcaatcaatccatgaaaccacgaaaatcgtccgttttttttttttcggtttttgaaggggtaaaaataaaaattttattccttggtaaaattatacccaatttcataggttgaaaagggttttaangnaangaaaattcaagtcaaattgnngttatttacttgttgagttttgaaattgatacacatacatacaaacagactgacatacacacttcccgtttcgggaaaaaaattatggaagctgccttatgattgacatgtatcttttgaagctgctcaagttatggaaggggctttatgattgaaagggttatccttttccatgacttatcaacaggtttgaatcctcatttcccgcctctcactggaaagcagcaaaatcaccttgaaaaagttgttttgggctatctttctttctgttttccatttcttaaaaaaccaggggctattctttctggggttattaaatnnaaaaatggtttttgttttgnnaaaccannaaacactttnnnatttgnnannttcaattcttnnnncntnnnnnntctatctgttccttttnnnntnnnaggggnaaaannccagggaaagnnnnnctgnnnnnnnnnntttgnnaaaaacnnnnntnntnnnnnnncnnaattaaaaagaagnnnnnnnnaanatctccaaanganacaaaaaaaaccgnnnnnnnaaaannnntgggggccaccnnnnnggaaaaatttaanntccnnnncctttcnnnnnnccccnnnnnntnnnanaaaaatannannnnnnnnnnncccttttannnnnnnnnnnnnnaaaaaannnnnnnnnnnnggggttcaaaattttaaaagnnnttttcnnnnnnnncnnnnttnnnaannannaatnnnnnnaaaaaagaatggtaaaatnnnnnnaagnnnnnnnnnnnnnnggggnngggaaaaaggnnnatnnaannnnnaaannnnnnnatnnnnnnaattnnnnnnnnnnnnnnnnnnnnnnnnnnnnncnnnntnnnnnnnnnnnnnntcaannnnnnnaancctttttnnnnnnnnnntctcccaccnnnnnnctccatnnnnnnnnnnnnnnnnatancntcaataccattaatnnnnnnnnnnnnnnnnnnnnnnnnnnnnntnnnnnntnnnnnnnnnnaactc

SEQ ID NO: 4008 - DNA, 519 bp, Glycine max
  misc_feature (422)..(423): n is a, c, g, or t
  misc_feature (510)..(510): n is a, c, g, or t
atatacggtgaattgagaagagttgaacatgttgatcattctcgcaaatcggctgaacaggctgtgaaggtaagtagcttacctaaatttgtcagctcatgcacaatatacatatttatcattgccccggcatgctctctctagctattcagtagatatctgcttaaacgtttctttttctggtcctccaaatcgaagtttcaagtaaagagccaatgcttgcagtgctgtttctcattctgtgattacttgttttatgtaggccatcaaggcagctgaggaaggaaaaacagttgaggagtatgattaccttccatacttctattcccgttcattcgatctgtcttggcaattctatggcgacaatgtcggcgacacagtgctattcggagacaacaatcctgcgtcttcaaagccaaagnntgggacatactggattaaagacgggaaagttgtcggggtctttctggaaggtggaactcctgaagaaaaccaggctattgctaaagntgctaagtc

SEQ ID NO: 4009 - DNA, 372 bp, Glycine max
  misc_feature (345)..(345): n is a, c, g, or t
tctgagataagagtgcaaatgcaggaagagttggaagatctttatgctgctcaagaagctgggattgccttcattctagggcattctcatgtaagagcaaagcaaggctcatctgtactaaaaaagttggcacttaactttggctacaatttcttgagaaggaattgtagaggccctgatgttgcacttaaggttcccccagtttctcttttggaagttggcatggtttatattgtgtagaatatctaacttgtaattagctttttttgtgtgtgtttttcatatagaggacataggcttgaaagccatagcagtgtgcagtttccaaaaggattttgtgaatgngactgtgggaatgactctaccctaaaa

SEQ ID NO: 4010 - DNA, 528 bp, Glycine max
gtgtatttttagtttacttgttcacataatgataatgtatatatagtttgtgaagtgaaatgtgttgtgattgtcaggcgtggatggcctgagactgccaacacttgggaacctcttgaaaatctacagtccgttcctgatctcgttgatgcttttgaggacaggtacgctactttctactttccgtctatgcaaaaaaaaataaattaaaatgaagaaactaatttcttctcgtttttgaagcctcaagtctggaaaacatcagaagcgcaagcgcaagcatgtggatgtgcttcaactcaccctactcaagaagcgctccgaacgttctaccacttcttacagccttagacatttcccacctctaactcccactaatgcaaatgattatgatccaaagctcagtgaacttaaggcaccaacacacactggggttcagctagataaccttgcaatacatttccaacaaccaattccaagcagaggagcaaaaaggagaaaatctgcttcttctgtcaagaggttcaa

SEQ ID NO: 4011 - DNA, 887 bp, Glycine max
ctcacctcaccctcacccttcgcctggattagtatccccctccacattttgcattccaagctttcatcttttcgcctgagaggcccaatttggtcatttggtcttcccgctgcggcgctcctcatgtcctgctggatcctcatcgccttcaggaagaacaagagaaccctcactcccaatgaagctcgtctcatcaacatcatcaacaacaaagatcgggttcgtatatattgtgttgcttgttttggtatattagttacttaattacacgatgcttaagttaaagcctaaacaaaataactcaagtgatggagacaacagccctgtgttggtttgttgtgtgtcatggaataaatagattcaggctagtagataaatactctcttctcctttaactcaccaaagtagcgtgtcttttagtgaacacaattctagaagctcaccaaagtcaaaacaaacaatactttgaatttaatgccagcagatttaaggtcagagtagttttctatcttaacaaggttggttcagccgttcaggggtcctatctaactgcaagtgcattggattggattggaggaaaattattattgttttgtgaagaaaggcatttccttgtgcttgactacatcattcaaacattggatgtgtatgtaggcatgaatgattgattctctatgcaaatgcaatggtgtttttctctctcatttttattgattcatctcttgaagctatactttttttcaacacttccctgactgccctcgtttgctatggccttcatttctaactgctagctacttttatttacagaaaattgccaaactcttgcaccagattgcacaaatgaatgaaatacttattgatcggcacaaagctttggctgcaaa

SEQ ID NO: 4012 - DNA, 355 bp, Glycine max
tctgataaagaactaaatccagaatttttccaaaacttgaaagaaggggttcagatgatttaccagtggaagtagttgttcctcgtagaggcctcaattcttctaactccaacaatgaggaagaatcagaggcaaatgctaaagattcaaaagaaagaataaattctgttggaaacatccctaatgatgatcatggatcctccagtaataaatatcgtatctttgagagaggcaatgatggaaattccaaacaaaggaattatgatgattttggccatgacagattctctgaaaggagagtgaacacaaaagaactgaggacaaaagcttatgatactgatggcaggactgaaaa

SEQ ID NO: 4013 - DNA, 334 bp, Glycine max
  misc_feature (19)..(20): n is a, c, g, or t
cttctattgtgattgaagnnccatttgcattcaggcttagatcgcttaccacaccaccccatatggctgttactgtggccatgttacctcgttggtcggtgtttcttctttttctgtttgtcttgtgtagctcaggagcaaaggttgtcgccattgatgtacatgcagcaaagcgtctcatccagaccggttccatttatcttgatgttaggtaacgcatccattcactttagaggatacaaagttaataatctaagtgattaatgagcgaaaatcagctttctttcaacaacaaaaatgacaaacatgttataatattaacgggttttttttt

SEQ ID NO: 4014 - DNA, 412 bp, Glycine max
gaggcaggaggcaggaggcgagttaccttttatcgtggagtgcagcagattgagagcacttggttacccttttcacttaaaaacaatgcgaaaccttttgtagccgaaggcaaactcaaataaccatgtccaccaccacaatcccttcatccctcttatctcccagcctatcctccttcaaactctcgttcccttccaccaaactccaacccttgagtccccaattcagacgcaaccgtattggcttttccttttcttcccccaccttctctccgtggaagcgtttcgctgtaaacgacaacaacaaggagagtgacaacggcgatgttttgactgggttggatgaagtggagaaagaggcgcgtggaaatagcaccatgcccgaacgctttaggtacctcgccaaagaagt

SEQ ID NO: 4015 - DNA, 625 bp, Glycine max
gtctcctgccactgaagtcgaacccctaatggcttctcaagttcttcttcaagtttaactcttatctcttcatttaatctcaaaaaccctaacattcttttatttatttatttatttattcccctactgattcggaaattgcattgcagcaggcactgtttgcccccaagctaagtttcccttcttcttctcgtaacgtcgcgttaatttctagggttccttccaccccaatttcatggcgttgcactcctctcattgctaagcctagtttcgctgtgagagctgactccaacgtcgaaggcgctggtgaagccaccgaggatgttccttcgtataatgttgatgaagtttcggaaggcgaaggagaacaagtttcggattctgaagctccaaaatctcccagaaaaccccgagtcaagctcggagacgtcatgggggtaattagtggaagcttaaaataataagcttgagtgttttcagttaccaattaggtttccgcactctgcattcgctctttctatgcgtgtctgtattgtatgtgagaatgtgtaaggaaaaatagaagatggatgaagtgtaaaatgcatgatgttgttgatgcggatactgaatcagagggcaattg

SEQ ID NO: 4016 - DNA, 345 bp, Glycine max
acgaagttgttcaacattttgatttacaaatatcagatgaggttaaattattaaaaaggatctcatggtgaacaatatccttgagaatttggcttttaactgagcctaatagtgttatgtgatccatgtagcctaactcattggtataagactattattgctgttgtactatctggtaaggttgctaatgtagattaattaggagcaagagttatcaagataaggtctcaaacataatgagctgtgtagggcatgtagaaagatgatctgatggtaaaggatttcttctggcattttgttgacaggtgagaacattatagggattaatcggggaagaaaatatca

SEQ ID NO: 4017 - DNA, 324 bp, Glycine max
agctgcagacctgcgatatggagcaattcaagaggtggaaactgcaatacaacaacttgaagggagcactgaagagaatctgatgttgactgaaactgttggaccggagcaaatagctgaggttgtgagccgctggaccggtataccagttacaaggcttggccaaaatgaaaaagaaagattgattggacttggtgacagattgcacagcagagttgtaggacaagaccaagctgttaatgctgttgctgaggctgtgttgagatctagagctgggctaggaagacctcaacaaccaactggttcattcctattccttggtca

SEQ ID NO: 4018 - DNA, 509 bp, Glycine max
gctatgccaccagaattcattcactgccaacagaagttaatagagtctcatccttggaaccaaaagcacttaagcaggaagtcaccttcagaatactttgttcaaatgatagagttggaggagttattggaaagggaggcaatattgttagagctcttcagagtgagacaggggctacaataagtattggtcctgcagtagctgagtgcgaggatcgattaattactattgctgcttcagaggtctgttaaatatgatctttccgtttttacttgtttatcttgcagttgtttgtatatcattattattattactgttttatcaacttattctttggtcgtggcttcatttttctacagaatcctgagtcaagatattcccctgcacaaaaggctgctgtgcttgttttctccaggtccattgaggttggttttgagaaggggctagactctggattaaataaggggtcaattgttactgtacgtcttgtagtcccatcaagccaagtt

SEQ ID NO: 4019 - DNA, 361 bp, Glycine max
cttcaggttataagttcagataagcaattgtttcttaaacttctacaagacccaaattcacatttattgaaatacattcaggagttggaaagtgctcaagggagaggtggtaaagaatgcagttcagttgtcagctccaactgctctgaacaagaacttgttaatctgaaagaaactagggagatttccaaccgcaagcatcgtaactttttcagaaaaagggtgaagtctcaaccaaaagattcaacaaatgaaaatgggaaaactgaattttcaaatagaattgtcattctgaaacctgcactaacaggcatgcaaatttctgaaagtggaaacaaccttgcctcatcactagattctc

SEQ ID NO: 4020 - DNA, 388 bp, Glycine max
acatgaatctgagctgggaagtgtgaaccttccagtgatagtgttgcatgacttccttaaggtagctcggcctatctggtgcaatgccatcagggagatattagagtgttatgctgaggagccttctgattctaacctagcaacaattactaggtttgggagaacctggagttttaagggaggttcaccctttagttgtggacaggacttgattgatcattgtttacctctctggttgtctagccaggagatggaaaatgcagagtttgaagctatcaagttaaagctttccaatgtttcagttagtcagggaggaattcaggttctcatagagactaaataaaagttgtgtaacttgatatgtcaccttaaatcattctcagtattg

SEQ ID NO: 4021 - DNA, 759 bp, Glycine max
  misc_feature (280)..(281): n is a, c, g, or t
  misc_feature (299)..(312): n is a, c, g, or t
  misc_feature (314)..(314): n is a, c, g, or t
tacattggcaaagcccccaaaggcaccaaaaccaattggatcatgcacgagtatcgcctcctcgactcttcccgaaaaaacaccggcaccaaggtatatacacagctacagtacattttttctatcaataaaagttaatttttttatcttttttagtattattagtttttattaacggaagatttaaactttcaatggctcctccatttcttattttccaatcttaaattttcctttacaactataatacataagtgcattcacacatgcatattttcannaatttaatcaacttcaannnnnnnnnnnnnncncgaaggtagaaaagttggcataaaaaaagccctcgttttctacgttggcaaagcccccaagggcaccaaaaccaattggatcatgcacgagtatcgcctcctcgactcttcccgaaagaacactggcaccaaggtatacagctacacatacacacatccacatactctgtttcttaattgttttacaccttcaattaattagaatgtctaattgcagcttgatgattgggttctgtgtcgtatatacaagaagaactcgagtgcacagaagacggcgcaaaacggcgtggttccgagcaacgagcacactcaatacagcaacggttcctcttcttcttcttcgtcccagctggaggacgttctggaatctctgccatcgattgatgaaaggtgtttcgcgatgccacgcgtcaacacgctgcaacaacaacagcaccacgaggag

SEQ ID NO: 4022 - DNA, 473 bp, Glycine max
tcactgatgatgataatatagatgtgaaagaaaatggttaccatgatgcagagaatgaagttgatcaggagacagatgatgatgctgatcgtgttcagagtggaaaattgagtgagagtagtggttatgctggcagtgatctttatgattacaaggttatcttctgcagtcttatttcctctgttagagatttatattaagctcttgctgtgagtagcaatgttattttcttttccctctgtcctcctaaactcttctttgtgatcctgcaggcatttggaggtgatgattctgatgttggatcctccagtagtaaccatgctaagactgaaaatgctaatctgaatgctgttccagataccccagggtctgaggatcaaaacaagcaaagaaaggccagtgaaaacccagttgatgaaaatgatgcttcgaatttgttgccttcatctgaatcttatcgatccatggacatg

SEQ ID NO: 4023 - DNA, 427 bp, Glycine max
  misc_feature (390)..(395): n is a, c, g, or t
  misc_feature (398)..(400): n is a, c, g, or t
atgacatcaagatcttgagagacattgaacaatactacagtactcagattgatgaaatgccaatgaatgttgctgatcttatataatttgtcacgtggtgtgctggatggagtggatttgtcatatcttgtggtagggagtagtgtttgaatgtggtttcttgctatggaatgcattcgtgatgctcttgtacacttttgacttttggtcaaattagaatttttaccttagtgttgactgtaccagaggtagtgtttttctttgctgatgaggttgagaattgagattaatgtgtaaattgtgttgagttgttttatctattgtatcactcttgatattgaatttgtaattttatgcttcaaatggcaggtgatatcttgaggggagggnnnnnnaannnaactcaaaacaatttacacattactct

SEQ ID NO: 4024 - DNA, 647 bp, Glycine max
atcttgtatcatttttttttatgtacttaattagtagtataatgaatttgtttaattggagttagtgcttttaggggctccttttagggattgtgattgcacttactatgcaagtggtgggtttccttgtcatcacgttgcgcaccaattgggagaaagaagtaagtcttcgttcaaatcactggtgttatcaattttcaattttggaggaaatgtaagatttgtcggtggttgagaaagaaaggaatgagggaaaggtcacccattcgatcttcatttgtctgcttataaaaactaataaataaataattaatatttatctataaaaaaaattctaactttggatcataccatcaataacgcaatatctttatatatactgttcaggcaaataaggcagcaaaaagaataagaagcaacggagtgccaactgatgcaaatgcactgccaagtgaccaaaattaaaatcttcgacagttgaacagtaattatgcttagtgattctgattatttagaaaagcagtttttagtgaacattttttttggtacaactattttgtatataaaaggaaagtgccctcgtagattcataattgggctgttaaaatcaaaccaaagactaaattagcagtgggagaatgaatggt

SEQ ID NO: 4025 - DNA, 374 bp, Glycine max
tgaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattcaa

SEQ ID NO: 4026 - DNA, 891 bp, Glycine max
tattttctattcccctcttctttcctttatcgttttttatttcatcttctttcctgtaaatgcccccaatctgtaaaccctgatttttcttctttgtagaaattcggaatttttatgtgacaaagacgttatgattatctagtttttttctttttctttttttccccctgtacaacgatatctggctattttgtcaccttcacctattcttgtttgtttgattctctctgcttaacgtaactttatcatttttctttagagattttgctgcatttgacagttgtttctttcaattccgtccaacatttgggcttcgtcgtttacttgaggccgtgtcatcgaaaacgcgttttgtatgttatgaaacgacgcaatagcctttttggttcacgaataccacatgtaaaatattgattatttttatccctaagtgtgcccctaagtgtgctgtacgaggattgtcatgtgtaagcctgttatatatgttatgaatcactcattaatttgtataggcatttgatggtttgggttttgtagatggcaagtgggtttggggaatcaacagggagatcacccccaagcccttcctacttcaacaacaataataacaatgatgctgccaattttgaatgcaacatttgctttgaattagcgcaagacccgataattactttgtgtggtcatcttttctgctggccctgtctttacaaatggcttcactttcactcacaatcacgagaatgcccggtgtgcaaggccctcgtggaggaggagaagctggttcccttgtatgggagaggaaagtcgtcgactgatccaagatcaaaatctattccgggcgataacatcccgcatcgtccggctggtcagaggcctgaaactgctcctcca

SEQ ID NO: 4027 - DNA, 635 bp, Glycine max
tcaggagcaatcccttgcgggaggagaaactgggtaggtcaaatactcaaagggcaaggagccagcttttcgaaacgcatctagcaaaattgtttaagcagaaagttgaaattttcacaaaagtagaatatacacaggtattgtgtgattattatattggtgatttaaatttaaataattcgttgggagccatgatatcgtttccttacaaatcgcaggagtctgttgttacaactatagttaaattgggccttaaaagtttacaagaatttgtccgactccagacttttaaccgaagtggattccagcaaattcaattggatatccagttcctaagaatccctttaagggaaatagttgaagatgaagctgcaatcgacttcttgctagatgaggttggaaaaattctcctaagtatataattcttcatagagatgccatgcattttttccaatgagaattacctttagttttgctgttatttttttcctgttctaaactcatgcgtgggttatagcttcttaaatcttatgtatctatcgtgcatattttattttttgtatgttttgggcataggtgattgttgctactgcagaacggtgtctagatccgattccattggagcctcccatatt

SEQ ID NO: 4028 - DNA, 954 bp, Glycine max
  misc_feature (940)..(941): n is a, c, g, or t
  misc_feature (946)..(948): n is a, c, g, or t
ttcttcaggtgagttacatgcaatttgtcaaggtttttttctctttccattacttgcaagtgattgttattttaatatttaataatggttactacttctaacttgctatcttatttatttatttttgcaggaaggagattcactgcaccctactttaactgatgtaatagtgtaagttattatacatttttttatgattttcttaagcttattcataccgatatataagtttttgtttgaaaattgattattttaaggaaataatagcttagtttttcaaaatctctgacaaaaagaggcaaaaatattaaataagctattatttttccgaaataagtaatcaaacatgcactaagcttagtttttcaaattaagaaatttattgttttaacaaaatgatagcttagtttttcaaaatctcttattcatacttaagaggacaaagtacaagtctgctaaataccaatcatgtcaatccacagattcacatctactccagacaaagtgaacaacaaatactacctgggacctgctccacttgaagacatggctaggtatattattaattattataggcatttttctccccatttttatatgtgaagttggcgacctatccttcggttgcactaatttttgctaacccgttcaggcaaatagcaactgcatatggcccttgcggaaacaacagggattacattttccttctagaaaaggccatgtatgatattggtaagttatctccttaacttacacatacatatgcagtcaaaaattattctctgaatgtcactagcttcgcatttaaatttgcggggcattctgatgagtcaagaggtttgatgtgcaggccatgaggatgacttagtgatagagcttgccaatgaagtgaggaaagtacttggagtgggaaatgtagtaccaaaggagaagaaacctnnttgannngcccaa

SEQ ID NO: 4029 - DNA, 399 bp, Glycine max
ccttctgggtaactctgcggttaagggagcgtccattaaggtcattagtgacgccaccgcctcctttcccgccaagtggatccctgaaattttattgttggctgcctctaaatgaatgaggtatgacatgaagggtgaacacgtatctcacaagtgttatgtgatatgtatgatgtgtgaatcttgaaataatatcttaagggcaagaagttattagttaaaattattagaggtagttttatgaatgggtcataataataaatgctagctatatgtaccactatggaataagattgggtcataataataaagctagcttgctagctatatgtactatacgtaactatggaataagacccatactagtgctataggggcttgctatatgtatgtgtttca

SEQ ID NO: 4030 - DNA, 212 bp, Glycine max
gtcaggacctcgattggatcaatctttatatgcagtatcaattgttttgttgtgttgtggttttaggattagggtttctcttttaaacctcttttgagtttgagcctgcacatatgttttgttattttggctaatggatgttttgatttgacatatcttatgatatggataaagttgttaacaagatcggtcatgtgctttaatcctttgta

SEQ ID NO: 4031 - DNA, 697 bp, Glycine max
gagatcagtctctatcaatgaagaaagtggtatgtagttggttattgttcgttgtctgctttattcatgtgtttcagagttgcttttgatccattatttgtattttgatgttgctggaaattttcagattacggggtcgtttgtatgcaccatgttggaattttatgtgaaaacctagaaagatcacttgaattttatcaaaacgttctaggtatgccagcttgtcaaactaaaattatctgtgtacatcgtgttacaatgaagtacatgaataactaaattgaatggaatttaggcctcaagattaatgaagcaaggccacatgataagcttccatacaggggtgcttggttgtgggtaggctctgagatgattcatttgatggagcttccaaaccctgaccctttaactggacgagctcaacatggtggtcgagatcgtcacacgtgtattgcgattcgtgatgtttccaagctgaaagcaatctttgataaagcgggtacaacttctttccttctttaaacaacataaatttgcggttcaccatgatttacagccttttaaatgacatgctctaggatctgctttatgatacttttctgtggtcttctacttttcagggatcccttacacacttagtcattctggaagaccagcaatctttgcacgtgatcccgatgcaaatgctctagagttt

SEQ ID NO: 4032 - DNA, 798 bp, Glycine max
ttgccctttcagctttgatggagataccttctcaatacaaggcaaccctagagcttggcatattggggtaataacttaatatttcattacatgaaaacatggtatttataacctgttatgtagggtttttctggtgtaataaccaataactgaatttgaaaatctcatgtcttcattgatatacgtagttcacggagggggcattcaccagatagggttgctctacccccacctctttatagtagaacctcttccagcatcagcacaaaatctacaaggtctaacagttttcagcagaggacacctacacatactagctatgatagcagtgttcacacagagacatcatcaagttctttatatgataataaggtattaagaccatgctttctaatgtaataaatgcctttcttattaaactaagacatagtttcgctttccacccttaatggcatcataatgagtcatgatcatttgattcatttctttatcacttgaatagtggtttacataatacatatatatgacttggttggctgcaggtttgccccatttgtcttaccaatgcaaaggatatggcctttggttgtgggcatcaggtaaccaattattaatcttgattgttatatttaacgttgtctcatgtctacaaagggccaaacatatattaagttatttccttcccatgcattttctctcgtggcagacttgttgcgagtgtggagaggacctccaattctgtcccatttgccggagcacaatccatactagaataaggctttactagttagctttgat

SEQ ID NO: 4033 - DNA, 151 bp, Glycine max
gagaataatctctttagtaaattatgaatatgttcatctgaagctgaatgaatctatatttgcttcaggggtgatgttgttcaagtagacacgtgggtttctgcatcagggaagaatggtatgcgtcgtgattggcttgtgcgtgacgcca

SEQ ID NO: 4034 - DNA, 216 bp, Glycine max
cgtaccggtttaagtgtatgtcaactagttttttttctaattgctgtcattaatttattttctcaaattatttcagatgttgttttctaattagttaacataatgcatcttcattttgcagcctaggtggagtgatctagatatcaatcagcatgtcaacaatgtgaagtacattggctggattctggaggtatttttctgttcttgtattctaat

SEQ ID NO: 4035 - DNA, 194 bp, Glycine max
gacaagaagactgtctaaaattcccgaagaagtcagggcagagataagctcttattttgtggactctgctccagttgtgccagaggataacagaaaactaaccaaacttgatgaatccgctaatttcattcgcactggtttaagtgtatgcaaacttcatgttatcattgatttattttctaaaatatctcaga

SEQ ID NO: 4036 - DNA, 152 bp, Glycine max
gttgaaaatattaagaagccattcactcctcccagagaagtgcatgttcaagtaacccactctatgcctccccagaagattgagattttcaaatctttggaggattgggctgagcagaacatcttgactcatcttaaacctgtgaaaaatgt

SEQ ID NO: 4037 - DNA, 277 bp, Glycine max
gagtgcacctttctctctctgtctccctgtctctctctccctctctctcaatatacctcttttcctgtgtgtgtgtgtgtgtgtgtgtgtgcgtgcgtgcgcgcgcgtgcgtgtgctttgcgaagcaaagctagcaaaccctgatctggaaggtgcaataaggttatgaatgaaaccagtgacaaaagctgtagatgattgttttaagctatgagatctgagggcttcaaattctctttttccttccatatttcatccttgtgcctctactttataa

SEQ ID NO: 4038 - DNA, 423 bp, Glycine max
acgttgtaaattatccaaacaagtgtcaccccaataaagtgaagtgtgatcaacccttggtatttaccagcacgactcaaattgatttgaaatttcttcctaatctggattgatatattggtattgcattagttattggtaatttacaagggggtaccctaaataaaactccccatctactgatgcctcaaaatttacgacgatgggctaccaatagatggaatccaatcatttccttgaatgaaattctgcactgaatacgttaacacgtgttcagcagggatcttgctactccagggcaccctctgagacaaataagagccaggacccttgctctcaaactccccatagtaaagtgtcttgagagcaaagtcaccactccatggcatccaaccctggggtgtcacaaggacctccaagcca

SEQ ID NO: 4039 - DNA, 867 bp, Glycine max
tcataaccttggtgcctaaccctttgagctcatccttaggaatctcaacaacggtgacaagagagtatagctcttccttggcatcttcatcgtcattcctcttgcgagcaattcttaccctaatcctccttggaacactcctgattccctggctccagacaaacttgttcaacttcacatccaccctcacatcattggtccccatggccttttgggcaaatttccttatctccttaatagctttaggagctttcttcttaaatgtgctgttttaagacaacaacaaaccaaacaagaaccactaagactactgttctcgaaccaaaacatgaaagcaatcaaaagacacaaagtataataaataaaaggaatatgaaaccattcatttctatcaaaataaacacaaatttcatatcaatggcccgatatatcacaaaacaggaactcatggaatattttttttgaaagctaaaggctgcaaaagtgacttgagctatgcgttttaatcaatacaatcactaggaaaagaactgcacaacttttgtcctgtttgctagggttcctaatctcaattctatagccacgaaaaaactcagatccatagaaacgtgtatacagctcaacttagctagggttggttactaacaatttataacactttagtactaaacaattaagttgttaatagggtgattattgaagcgttaagaatgggggttagttgaattagacaaatagcagagagaacatggtataaagaagaaggtgaatagattaccagccatggaggcgcttgtggaggttaatggtgtactctctggtaaccacctcctccttcctacccttcgccttctccaccattctcaa

SEQ ID NO: 4040 - DNA, 309 bp, Glycine max
gcatcatgttataatctgcttacacttcgatttttcttcaaatattattattacatcaaatgttcaaacacttattacataaaaatttcaaactctcctcaacactagtaaaaacgacaaattgttgctttggtcagaaacagtgatcaaaacagcttgaagagggaggaccttgaagttttctgatttccaagccagtgttgcatgtggaccccaatggcatccaagtacaagctgctcctcccatggaaacccaccaccttgccttctgtagtggttgaagtgaagaatttacctacttcttcacca

SEQ ID NO: 4041 - DNA, 895 bp, Glycine max
attttcttttctttttttaattttggaattggatgttatatgttcatgttataatatgcaaaatgtgaattaggtagtcaaagattattttgcaagtttttggcatggcactttttcctcattatgatatttgtttttgccttgtaatctggtggctgtggcctatgggttctagttttgcaaatatcctctcattcttatgggtaaggttgtccacatcttacccatcccaaagacaaagatcgaagaggctgatgcaattggctctcctttttatggtctctgtctcttcttccctggtcacagtggttaggctgcatacatttgagcctcctcagatcagaccccacaatggttgggaaccttgtgaattggatgcttatatatgatttggtcttaacttgaaaattgatttatggagagtttaaacatgcaacttgaaaattttagatgtgagaaaatgttacttgatgacttgcaacttgaaacactggtttgggtccttgacatgctccatatacttgtatctttcgtttgatgttggtccattgcagatttagggtggacatgttgcttatgttaaggtcatggttacaagtcaacctccggggcaccaaaatgattaggagctcaaagtaagagctaacatcttggaatatatcagcatgtgctaaatctttatactggcaggcatgctggaggcttctgttctcatttacttccctaaaatcatcgagctgaggtagccaactggcgagccacatttttgtcattaacacgatcccccttgcgtcttcattgcaaaattttatcatcaaataacatgtattagtgcttttttgtacctcatccatgttgtaaattttataggcattggtgtagattgtagtgttta

SEQ ID NO: 4042 - DNA, 328 bp, Glycine max
  misc_feature (221)..(221): n is a, c, g, or t
tcatccactccatcatcgacatggacgctgatgttatcaccattgagaactctcgctccgacgagaagctcctgtcagtcttccgcgaaggtgtgaagtatggtgctggaattggccctggtgtctatgacatccactccccaagaataccaccaactgaagaaattgctgacagaatcaataagatgctggcagtgctcgagaagaacatcttgtgatancccaccatatcactgaggttgcttaaatgcaaaactggctcttatttgttgcatacttgacaaactcgatggaaattccaattgaaatttatcacgccttgttattt

SEQ ID NO: 4043 - DNA, 512 bp, Glycine max
ttgacaggtttatgcagtggtagctgctcccttcttcctaggtgcagcttcggtacctgattcaaaatccccacagaaatataatattaatattaataaaacgatggccagaacacgcagttaatcaattattaaccctaaccaaacaattattagaagagaataatatgatagaaaacgatgaaggtaccttctctgaagccactcttgaatcggcgaggcacgttacgcaagtacctcatcctgccagttccggtggtctttctgcggattgccttgacgctccagttatctgaaatcgttaatcataaatcagagtaagttaacaattccaaacataaaccctaatgagataattgaagaagaagaagttacatttcctagtgcgtgcggcggggaaagcacaagcggcgcaacgactcttctggagatggaagctgcggcggccacacctcacacagagagtgtgagtcttgttccttctcttaccaaaactccctgttcccttcccc

SEQ ID NO: 4044 - DNA, 459 bp, Glycine max
tatctttttttcctcaagtacataactatgttcgatgaaattcccatgtattacacttggttgaaggaaaaattcctgcaaggcaaatgcaaactatgtgataatttacagccttacagaaaaaaataactcattattaaatgtcacttctgcttcttatttcgcaacatagacgagatcaaaggagctgttgctttcctcttggtaaatgcattagctctgctatctaagtcttcattgtcttcatcgtcatctaaagcatctcttgcaattgtggcagactctttagcaatattagctgcttttcttttttcagcattcaacttggcatacaatttcctttcaacagggtcatctgaaggcacaaattttgattggcgtgaaacttttgcacctagaccaagcctacaaagttgtgtgatggcacaacatgagcaataattaccatggcaaacaaac

SEQ ID NO: 4045 - DNA, 333 bp, Glycine max
gacggtttccaatcaaattgaagattactaaagccatttactcctcctagcccactaagtagttggcttgacagatcctgttgatgattcataacttgatctcgcgcaagagatgccattcctccccttccattcatgattgaattatgtcccattacaggtctcattccattggtcataccagatggaccaagacccattgtgccatatccaccaaccccaacacctgaattactactgttcacagccccattacccgccaggccactgccactgttgagccctgtactgttactccctggtagaatcccgtttacattcttcatgtcattt

SEQ ID NO: 4046 - DNA, 510 bp, Glycine max
cttctactcttttttcacaactttctctctctttatttttttctttaatttattggatacgtgtctcctttttttcctatataatgacactctctgcagtgctttggatctgtgactctagtacttctctctctctctctgtcattggtttttctctggttgacatcatcgtcatctactacttcttcctcttatccaattggcccccaacactggtactacattagatccttatgattgatccatcatggttttgtcataaaaaagttacaattgttttccctttaattctatacatgctgtgtttataggcactttgttgttttgccttctctactttgtgtcttccaaccatacagttttcattgtcaatgtctccattgtagatgatgttgttttgattttcctatgttcaagttttgtttttctttttttgtttttttatgtgggttttggttgttttcggatcttttggtgtgaccctttcgatgttggcaggttttggggtaa

SEQ ID NO: 4047 - DNA, 354 bp, Glycine max
atgattctcattacataagtcaaaacaaaatcatgtatcccccccaaagaagagctataagattaactagaccccgctggaaagaaacactaaggtggtgtaatatatgcatgtcaacaagagcaaaaaataattgcagtatcaacttctatatctgccagatatattacagaaaatgaggtaaatcccaacattaaatatgggtgagagacaacgttagtagtcaacaatttacgcctaacctttagttcttgtaattgtgatgctaccttttccaccttcggtgcgaatttttgttttaccaaccacaggcttccctgagaaggctgacttggggtaagcagatggatcatc

SEQ ID NO: 4048 - DNA, 492 bp, Glycine max
aaactttttggattggtaagtatcagcctactaaaattaaaatcctattagtattttttattatttttcttccatgattgtcttgtcacatattatatattttttgaattataggtacgtgattcagctggtcaacttaaagcaagtggaacagtggtgattgatgccgcacttggttctatccatgcccaaaaagcaatcactgatcctcaatttgtggtatgataaataatgaaaagctacaataaatgcacaaatacttaattttacatagtgcagtgctatatgatcatcacttttgcttagtaatgaatttacttattttttttacagaagtaatggatttacttaaaatcttaaattatgtacttctttaaagagttttgtatggaattttaattataaggaaaaatgtaagagctaaaccattgctgatgatttcgaaggtggttaaagaagcactgctgaaaacaataaaggaggcagttgggg

SEQ ID NO: 4049 - DNA, 405 bp, Glycine max
tcaacagcctcgccgtgtgctcttgtttaacgacggcaccgtccatctccaccaacgcagcacccacaatccggtcgtagtcgccgccgccgccggcgacgaaggcgacgagggcggcctggacggggcccaagctgggattaaacgcggcggattccatgtaggagcctttaaaaacattaccatggcagtcgagaagggcgacgccggagggggacccactgtagggtgcatgggatttgttggcggcctcgagagccgcaattttcaacttgtgattgggcacgtgggcgttgagatagtgttggagggttagggtgttgtggtggggttccaagagaaggggagcttcaagggggagaaggtcgtggggaccgaacctgtgagggaggaagtcagagagtg

SEQ ID NO: 4050 - DNA, 267 bp, Glycine max
atatctgtggcaagatgggctctgcagatgacaaagcatgaagaggtaattcattaaaggtaaaacctagtagattctgatatgaaaatgaatttaagtgcttaaacatttcaatgtgcacggtctctcagcacttcaagatccatttctgtggggtcagtagcctggatttcataatggacaccatctagctcacgtctgaacctgtctttagtagtggcatagagcatcttggcacgaatccgagatgttgaaggggaccaggga

SEQ ID NO: 4051 - DNA, 582 bp, Glycine max
  misc_feature (65)..(68): n is a, c, g, or t
  misc_feature (137)..(138): n is a, c, g, or t
gagcagaatacatactttacgtgatggaggtttgctaatgcaggcaagtatttgttctctatgcnnnntatgtgatgttgtattattgcccataacagccctattcatcataatccacattatgccattccatgctnngcgaacattttgcattactatttcattcataattagattctttgttataacttctttgatatagacataaactattgctgctctggcttctaaaattttactatcatgattaaatcatttagcataaactcttttaggatgtattatgcttctctatcagtaggttacagaaaatgttatttgtgaaaaagtacttcctgtttctggagatgttcaaacttttttctgccaaatcttgaaaaggaatgtgtttaatttaatacagatgatttatgcattatttaatgattccatcattttatcacagttcagactctgatcaaactatatctggaaagatatttattaaagcatcatataattctttagtatggatagtctacgattggtcattctagctagaaatgacatgtgtgcctaaagtgcatctttttaattcatgct

SEQ ID NO: 4052 - DNA, 250 bp, Glycine max
cataaagaaggtaaaaaattaaaaaattgacaatgaaatgatatcatgataaatgaaaaagaaaaaagcgcctatttattattatcacttttcatcggtagcttctgtaggctggggtatacatacagctctctgcaaacttcactaaatctttaggttgaggaaggcgagtggccaagcctgacaaaaacacaaactcacttttataagattttcttttaatatttaaaattttaaagaaaaaaaaaaa

SEQ ID NO: 4053 - DNA, 421 bp, Glycine max
acatttgtaactaacatgttcaggttaagaatgtttcttttgtttcttggcctgccattgtttgatatcagcatctatccttgccttcacccttgtattgaatcctggatatggttcatatccaacaaattggaggacctgcaaaacccaataatatcaaatccaccttgtttcaattgtcaaagaggccaagtacaaatatacatgacaaacatttacctctagcaacacgaagaaaggagccatcagaaaagcttgggcaaggttgtccaacagagctggtgcacgtttctaacagagacaaacaatggttaaaacataattggaatatgcatattagtaatggaataaatcccttacctcaaacacgccatgaccaataaactgtccagtccaacaaaacaactgagcagccaaccgc

SEQ ID NO: 4054 - DNA, 566 bp, Glycine max
atcccagccagatggttggacagtatcaattccagagggaggtacagggatttgttgtggtggtggaacagcttccccccaatctcctcctgcagctgcaagagaaacttttattcaacaaaacatgaaaactaagagtcaaacctaaaaaattaacactgcaaaggaagcacatattctctgcatcatttcaccagttaaatacaagagaattgataactagacaaaatcaacattaaagtaacaatcacgttagaagaaaccaatacaaggatcaaagaattgaaagatgacaaaaggcagaaaacaatagctgaaagacagcacacaaaatttcattcagtgttgtctcgcttcacttaataacattaatcacataccagcaggtgcttctgcaggtgccccccagttgacaccaggtactgctggaataggttgaggaactgcatcactccatgattgatcaattgtaccaggccactggccatcagcagcaatagcacctgcattgaaatccgtgatggcataatcaaccgccggagcttcctcctcctcttgttgtttaa

SEQ ID NO: 4055 - DNA, 766 bp, Glycine max
gatgccgacaacgtcatcccaaaggctcttgattccttcaagagtgttgaaaacgttgagggaaatggtggcccaggaaccatcaagaagatcactttccttgagggtacttactgttttcatttgattttctatttcattattattccatgcatctctacccatctatatactatgttgcaatagcatagtaacataattaattgtaatgaaaccaaataatacaatgtatggtaataaagctgatgttaatgaatggatagatggagaaaccaagtttgtgctgcacaaaatagaaagcattgatgaggcgaacttgggatatagctacagcgtggttgggggtgctgcattgccagacacggcggagaagatcacattcgactccaaattggttgctggtcccaatggagggtctgctgggaagctcactgtcaaatacgaaacaaaaggagatgctgagcccaaccaagacgaactcaaaactggaaaagccaaggctgatgctctcttcaaggccattgaggcttaccttttggcccatcccgattacaactaatccgcttcaacttacttgtcatcactttcttgctttttcttgcgtggagacttatccaaatcactctgttctcaacttaagttgccttccaatgtatccagtctttcctttcttctttccttttcccatataatcgtgagacttatgatatatctgtatctcacttcatcaataataaattataataaagatgagcaatcattacaa

SEQ ID NO: 4056 - DNA, 254 bp, Glycine max
tacaattattcgttagatatttttgaagttttcatccaagaaataaaaacttgacacatggatatgattatgaaattaaaagtttgtgtgaaaggccaagcaattaaattaacaataatcatgtacaagtaaatttaatttgatttagtatttttcacatggagaagcaactgcccttgttgctttggactatgatcggggcggagagcggcggcgcagtcttggaggaggaacgaacagcctcgtatctccgc

SEQ ID NO: 4057 - DNA, 246 bp, Glycine max
aaacttgagtttatctttatggaacatcagagtaacaagaagatcaacacgaaaataaaaatctggaaaatgtaaagaaagctctaaagacgaagtcattgcgcttgacacttctttttttttatgtacatagctggtggtgctgggggaatgggccgggtggcgtctacctgggctggtgaatagcccgtgggctcaccttgggcttcacaaacttaggggccttttccacatacctcggcgctt

SEQ ID NO: 4058 - DNA, 516 bp, Glycine max
atacaaatcttagacttatgagaacctactccccacttacagggaaaacttggttccccacctcaagaaagaactaggttaatcaagaattatacaagttctcttcacgtaaacatgcttgcaaatctgcaatttgatgcccaagatcaaaatttcaccataactagaccagatatcagacatgttccctactgacccttcacccaccactgattatgaataatacatgtgatgatgcattctaaacttgatgcaaccaaattccagcaaaagagaacaaccatcagaatgatgagggactcgtctttactcggatcaaattttcatcataatcatccattcttttcttggctgaatgatgccagggctagtcttcactcagatagataaagccagtgttgagtgttctttaaaccttgtgttactcatgtcatggcattttgatcctgtaaatctgagacacttgatcaggaatcacaagaaaacacttgtgaagttgatggccggatagtattc

SEQ ID NO: 4059 - DNA, 175 bp, Glycine max
tcttacaagatgtcataaattactccaaacttcttttattaacactttcgcccccaaactttcccaattccagatctgccttcccgtttaaaaaaatcacggtcgggtcataactccaaaatcagaggggcgtaaaggagaagcagaagattctagattaaggaagagaacgaag

SEQ ID NO: 4060 - DNA, 384 bp, Glycine max
agatagcaaagctattgaggtgaaaaactctaattctgattggaaaacaacacttaaggaataagcttctgtgtaacaagaaaatcaaaggtttcttaaaagtacaacaaaaccacagagcaaatagacagactccaaagaatactaagctatccaataaatactctcaaactattctcaccagcaccttattctttttgcctgctgataacagaagaactttcccatccactatatccgcagcctcaatcctcttaccttcattatccactctgttattattcaagtaaagccctccttgcttcaacaaccgacgtgcagcagatttactctcgaacaaaccagaagagaccaaaagatccaccaacgacagattcaaaaccg

SEQ ID NO: 4061 - DNA, 450 bp, Glycine max
aaattcagtggataaaatttcaagacaaaataaattagaaaccaaaaccattaaataaaaactaccaaacactcaaagtctattcatttcctaaagatttaagcagcagttgcttgttgggcggcaatccttttcctagcttcctcaatgattgatagtttaatacctttacccttgggaagagatatccatggttttgttcccttgccaatggtgaacacattgcccatacgagttgcaaactcgtggccagtggcatcctgaacatggatagtctcaaagcttcccttatgcttctctctgttcttgatcactccaacacgacccctattccttccacctgtcaccatgactacattcccaacatcaaacttgatgaaatcgacaatcttgttctcctccaaatccaacttaatggtgtcattagctctgatgagagggtctgggggc

SEQ ID NO: 4062 - DNA, 379 bp, Glycine max
cacagacagactccaaatgaaaatttcccctccgaaaaagggcaaaagcatataaaccgaacctaaaattatttactaaattgaccaaataagaaattcacagaaagaagcagaaggagaagattgggggatcaagaaagaggagcaccgggaggagacaatcgagtggcctcttcttcgtcgaagaacaaatcatcggttttcctcaacgccgcgtgcgccaccaccaacaccgctccgatgagcagcgccacgaggatgttgccgatggcgccggtgagaagcagcagcacgacggtgagcaccgccatgacgataagcacgacgcggtcgctgattaatcttccgaagattattaacggttcgtcgcggaggaagt

SEQ ID NO: 4063 - DNA, 350 bp, Glycine max
gataaaatgactttgtctcgaacataataatctaacaagggagaaacaaacatgcggtcatttgacgagttccgaaacccatccaatgtcagggtcagaggctccaatcgtgttctccctactaagcttggcatagattctcgctctaatgtctttcccagattccaccctctccatagcaggctcctcctcgcacccattcacacttaaaaacccgccacgtggcgacccaaacacgcaacgggtcaaacccgaatcctcgattttaacattccgcgttgagttaactatttcgcgcacgaagctgtacggcgaagaatcggagaaggacgaatagttgaggaccgaag

SEQ ID NO: 4064 - DNA, 385 bp, Glycine max
aaagcagtcactgatcctcagttcgtggtatgataaataatactagtaaaatgttacaataaatgcaaacttaagttttacgtacatagtgatcatgacttcatgcatggctattattttttcatatttattgaagtcaacttaaaattttgtaaatacagatcgatgctagtaatttgttgagatcatgagaaaacgtaccactactccaatagcattactcattttgaaaattgtataactgtgattctaattataaggaaaaagtgtatataagagctaatccattattaatgttttttatattttgtaggtggttaaagaagcactgctgaaaacaataaaggaagctgttggcggcaattggagtgacgaattgagcagt

SEQ ID NO: 4065 - DNA, 453 bp, Glycine max
agatatgtcatttaacaagacagaataattcctacaggtaaagtgcataacaattgagtataccatctaataatgaaaataacgcaaataacgcaaataacataatgcttaaagcaacgttcatatcagaagggaaaaatagtttgaatcccatccaacaaaaatcatgcgattaaaatccaattaaaaaagcataaagtaaaataagtttttaaaacaggtatctggaggaaagcaactacatttagtccacttcctcaatcttggggccagcaccacttccaccagaaggaggagcagcatactcatcctctgctgcaccagcaccacccacgtctggaccagcaccaccttggtacatcttggcaatgattggattgcagatgctttccaattccttcattttgtcctcaaactcatctgcttctgcaagctggttgctgtctaaccact

SEQ ID NO: 4066 - DNA, 600 bp, Glycine max
gatgctataaaagaaaagagagaaattcacatagcagtctgaagaatagagccaagggtgcccaagacggcgaaggcgagaagagggctgacatcgagggtgtcaaaaacaggggggatgatgttgcggaataggttgagataaggatcgcagaggtctcggatggccgagagaggctgccgctcccaggggatgtttgggaaccaactcagcaaaaccctaaccatcaaaacaccgctgtatatgtcaagccacttccccagccccgccgccacaaccgtcagcggcgtgttcagggctccactagcactcggacggtcacgaagggaagcgaagaacaaagtgcccatcgtggacacgctgtcgctgttgatgctcaacactggagtggccgccttcttcatcagcaacagggcgagtcccatcagcgtggacagcgtgcgagtgcatttcgtagtacaagtaagacttgggctgggtgaagaagggagggcttgaggtttgaagctcaagcaagtggaagaaggacttggggtgtgcctgtgttgtctaacaaagggaagcgaggaaatggagttctgacccagtgacagcgccccc

SEQ ID NO: 4067 - DNA, 455 bp, Glycine max
tatcaaagctctgaaaactttctcggtaacagtttcgatgccacatacacattcctccaaatcccgcatcttcttcagaaccaacctcacctcttcatcacccttcttcttcagattctgaagcctttccattcccaccccatttcgaagctcttcaatgccttcatgctccttattattattctccctcccaccgtttctcgacaacctcaccatctgcgtccacgacaaccttcgtgacgcaaacgacactccaatcccgttgaacagcgcaacggaaacggacacagtcacgctcataacatccgcgatgacgtgtctcagttgagcgtccacaacggaagatggaacctgcagcgtggaatgttgctgatgttgtgtgacgtgaacacatcggaggacagacacgagcttttccatttccttggaaattttcttcttagcctttacgggat

SEQ ID NO: 4068 - DNA, 1210 bp, Glycine max
gtaaataagacttatttcttcttgtctccagcaccaccagccctgcacaaaaatgaaaacagcatcataagtaatagcaactactgccaatcagatttataaattatattgtatgcataatatgaacaaaagaacatagaacaacctcatcttcctgagaacactggacatttcctcacgcttcttctttgcgcgtttgtgtgttccgagctttctctttgcaaccttcagtgccctcttatccttcccaaccttcagcaactcagttatacgcttttcatagggtgcaaaaccggctacctctcttatgaggttcctcacaaagtgcaccctcttgcttgttttctgttttgaatccatataattgtaggaccacatatagaccacataatttaaaacactttcaagaaaaatcaatcaaatacacttccaacaccataatctgcctgatatgtctatagaatgaatgcattaataaaagggagagtgaatgcattcactttcaagccttattaagagcgaatgaattaataaaagggaaaatagatcaccaaagattgagatcagttcggaaaataaattgacgcaaatatgggttcaaaatcttacttctccccacaaagaacacctatagtaagaactaaaagtaacaattttcaaagtttggcttctatgtttgcaatcttttctaatgtctaggaaaagtaattgtcataaaaaataggagttaccctcgtataagaaaactactaaaattgatcagaaacccaacagaaacaatagtaggaacagaaaattgcaaaacacaaacagactctttgttattcagaacttagaaagacgcccacttattctaaaaagacagccactgcattttatgacactttgattccaacaccaccacttacaatctaaaaaaggttcaaatatgagaataaaaaaactgaatcacatttgaaaaagaaacattgaaaaaacttacccccttacgatctgaggggcgtggaggcaattccttcttggtgacgacgtgacccttgttcagtccaacaaacagacccgtactaggcggtttgggagccatttccctgtcccaaaaacaaacacgcttcagaattgtttcgcttatggcttatgcaatcacaagttaatgttgaacagtgattttcaatttcgcattaaaccaagcaaggatcagaagcagccatta

SEQ ID NO: 4069 - DNA, 235 bp, Glycine max
cgttttctgcacttgtacttaattattggccttacttgctattctcatgagctacagcagcaatgtggttgcttgtttgccccagcaaactgcttatggaacgcgctttcaccatgccaagcttcatcctcttcttcgtcgacgtcattattatccctggcttcttctcctccttctccccaaagggctcagcatcatcaacacactcaatttgcttctcgagagaacaaaaaga

SEQ ID NO: 4070 - DNA, 607 bp, Glycine max
  misc_feature (602)..(603): n is a, c, g, or t
cttgctctcaatatgaattgatggtagaaggctgcaattgctgctccaataaatggtccaacccaaaagatccactgaacaaacaaacatagaaaacatatcagacaaatgtgccatgattgtttcatttaaatttgataatagtataaaagtagcaagttgttgaatatagaaaagagctactcacatggtcatcccaggccttctgttggttgtacatgacagcagctcctagactcctagcagggttaatgccagtgcctgttactgggatggttgccaagtgaaccatgaacacagcaaagccaattggaagtggagccaaaaccttcaagtacaaaacaaaagcacaataagaaactcatgccatgtggttaaattaaaacaatgtattttcaaagaaggcaataaaaatgattgagttcataccggcacatgagaatctctagcattcctcttggggtcagttgcagagaacacagtgtagaccaaaacaaaggttccaatgatctcagcacccaatccaacacccgtgctgtacccctcactgagctcattggccccaccaccatacctgttgtagtaagcctttttggaacgcnnccgc

SEQ ID NO: 4071 - DNA, 780 bp, Glycine max
ttgtctattttttacataaaaacaaagctagtaacgattaatttattattattatcattattatgtttctccggtggttggttttggcttcttaacaatcaaaaccgggcacttcacgttctgtgcacagtgattgctgacgcttccaaggaaagccctgccattaattcaacattcaaagaattaattactaactaaatctacaattcacttgtagagaagttaaacacttgatttaattaaaagggtatgttgtaatgttgactcatcactcacctcttgatgagaccataaccatggcttcccatgactaagacatcagcacccaacttttgaaccatctgacaaatcacgtcccttggatcgccattctctaccctcgtctctaccttaattaattaaccacaccaacggttgaaatattcagaaactcaacagaagaagaaaaaaaaaaggaggacatacatcatacatcatatatgtaatgtaattaaattaagattatagtaattaattgataaggtagcaaaaggtacgtacattttcaatattgttacacaatttcttggctttctccaagacgcaatcggccacttgttggctatacctctccatggtagccgttatgtcagaggaaaacaaatatcctgaaaatattaagaaacaccacacaacaacatataatctgattaatcaaaataaacaccaacctaagttacctagctaagcttatgtgttttttttcagtcctatagtgatgcatacctgtgccatcgaagg

SEQ ID NO: 4072 - DNA, 994 bp, Glycine max
gttgtttgcaccaaccaaagtagccacaaatcgaaatcctataaaaatcaaaaggtaaaaaataaaaaggaccaaaccctacttagaaaagcataactgttccttgttccttgttccttgttccttgttccatccaaagggagacaacatgcaagttttgctcatggcttccacagaatggttgtgtctgcaatcatggaagtaaccacatatgggtccatgttagaagctggccttctgtcctcaaaatatcccttccctgctttctctgtgtccctcccaaccctaactgaagctccacggtttgcaactccctgaacaataatcaaataatataaacaccttattataaattgatctaaagtctaaacaatgacaaaactagtgacaatttggtacaggattttttttctttctattttcacgcttaattacaaaaatgacacagacaattaagtgatggtttgtctatactggtagtagaaatccatgttgagaaaaaaaaatcatggggaaatcgacgcagtaacaactatttgttacttcaaaaaattatggtgagttcaaccatgttaccaatcatgcaaatgaaaagaaagtaacatttggtaagttaaaataaaaacaaaaaaatatcttctcaaagggtcccctaaaattttgttttggtacaaagggtccataatgtttggttcaaaggaacatgttatggtcatttgatttttgtttcttacccataagaaggtgttgatgtcagcggtttcgtggcgccctgtcaaacgacgctcgttgccttctccataagcagcaatgtgctccttgtgtctcttccccaacttctcaatggcggttttgatcacttcatagccaccatcatttctcatggacttagtgctgcaacattattaataatactattattactattatgcacttgtcaagcatgaaaagcaaagagatttaattttaatttagtccttctgtgaagaaaaaa

SEQ ID NO: 4073 - DNA, 414 bp, Glycine max
caactaggactgaaaaggaatttaaattggttgcatctatatattttggcccatttgataattagaagaggagagaagtaaacttgaccatatatgaaaaagaagaaaatcttggttaattgttttcatataatataattctctagtttttttttttatatactgtaacttaactggttcggaaaacaattaatgtcttttttcaaaaacagtttttttttttaaaaaaaaattgtttatctttgttgtacattcaaaagcgtttttgtcttttgagtacattactactgttttttaaaatatttgtctgtccagtatttgaacagaactcttgaagaaaatagaaaaatatgtgaaaatatctcctaatttttgtttctagacataaaatgaagtatctaattgtttgagctt

SEQ ID NO: 4074 - DNA, 264 bp, Glycine max
tattatatataggggaaaagaattacaatacaacacgtcaaatgtcttggttgaggagaaaaaagagcgttaacacccactcaatggctcggcagaacaagcaacgaaaagtatacaggaaagaaaggaaggatccagaaggggacagggaacatgtggagtagaattcttctttcctctctccaaataattaaagatctacacagacagcaatgcaaagccaaacgtggatgacaacaatctaatctaatgtttctccatttt

SEQ ID NO: 4075 - DNA, 691 bp, Glycine max
gtcattaaatagtggatgtcatgcaaaatctacaactcgtccttgacatcattatcatcgttaacagcatcagtttcaggctttgaatcttctttcgcgtcactttcagcctctacttcagtgtcatcttcctcctcaactgttgcttcaggactgatgtccaggctagtcttcactgaatcataaatccgggaagcaaaatccttgggatcatcaagcaggaagccgctttcaaagagtgcagtctggtacatcagctgtgctgtatgcttcacaccctcatcctgaaaagtaaagcagattgtgttaacagataaaccccatttgagttgaggaaagagatgcctcagaaaatgttctaataatctagaatgtacctcagggttctttactactctctctcggagctccttgataatagggtgcctaggattgatctcaagaaccctcttgccgcgcatgtatgcttgcttgctagcatctgacaaagtttgagactgcatgattctctccatgttagcactccaaccaaattttgatgtcaccactacacaaggagtgttatctaatcggttggaaatcttcacatcatcaacattgtctttggaaagagcagttttccaccacttggtaagatccttaaaagattccttcagttccttgtcttttgaatctttcccaagtttcacgc

SEQ ID NO: 4076 - DNA, 773 bp, Glycine max
ctcctgttcgtctggaatctgatctcactgatagcgacctgtttttcttactagccaatgattctgatgaattcaaccggtttgtcttcttcaaagttgcaatttattctttttgatttgatagtttaatgtgaatttattcactggcttatttaaatgattcagttgggaggctggacaagttttggcacggaaattgatgcttcacttagtggatgatttgcaacataacaaaccattggttttaaattccaattttgttgaagggttcaaacgtattttatgtgactcaagtctggacaaagtatgcttcagtttttcctcacaactattattcattttgttgatgatgggttttatcatatgatttcatttattgtactttatgcttttttatcatctaggaatttgtggcaaaggcaataactctgcctggtgagggagaaataatggacatgatgggggttgcagatcctgatgctgttcatgctgttcggactttcatcaggaagcagcttgcgagtaaactgagatcagagttcctcagcacagtatggcctgttgtctgaattgtctattattaaatatcttcttcattgtatgaatctcctcaatgttcaccttttttgcaggtggaaaataatagaagctcagaagaatatgtcttcaatcactcaaacttggcaaggcgtgctctgaagaatgttgctcttggtatatacatctttgttgcatactaagatacactatgcatggtggtagcaagctcatct

SEQ ID NO: 4077 - DNA, 1236 bp, Glycine max
ctaggaaaccataacagttaaaatttggatatagatcaagcatctgcaatggtcacctcaacttccacaccaggttcgattgtgatagaggtaatctgcttaaccacatctggggaactgtagaggtcaatcactctcttgtggacacgaagttcaaatctatcccatgtgttggtacctaaaaacaaacagcagtttcatgaacacaaggcagaataactaacattcagaaagtatagacattgaaagcaatacttcaaaaatcaagtcagcaagccaagtaacacaacaatatttctgttccataaaggcatatgaacagcacacaattcaggaacttggtaagattagaaagcaccaaacttttcaagcttctatagccccaacagcacagcacaaccatcaaaatatgttgaagaacattctggtgcccggaggctggctcctcgtagagcgaagatatggggaagggtaattgtgcacagccttatccttgcatatgcaaagaggctgtttcagaattgaacccatgaccaaccagtcaccaagacacaactttaacgctgtgccagggttcaccctcttatgtatcaaatattattcaacaaaaatattgaaaggaaaatatagatataattaagcttaccctgcagatgcactacaagtctacaactaaaagaatgaaaatcgaaacaaaccatattttttatctcacgcttaatagcttttcagaatgagaggaataaataatagattataaacaaaatatcactctcttaatagatacattgccaaactaaaaaaggaaaacaagtctatgatcacttaatgcataagactaaacaaaattatgtttttgttatgaggcacaattgatatcacggctgttgtttaaattttaatccaattgagcacaaagggatacattgaggcacaccaaacttataatgtgcgcaatgaacaataataaacatcaatcaaaagagtaaaaaaacaaaaataccttcaccacagggggacttcctggtagtgatgtgaagaaccttagtgggcatcctaacaggtcccttaaccctgaggcgcttgtcctttgcaccacgaaccaagtccgcacaaactaacagtaacacaaaactagaaacataaggctaaggatagcaacaaccttaaaaacaaaaagtagaataaataggtgcatacccttctcgaggtttttgacgtgcttggaagaaaggg

SEQ ID NO: 4078 - DNA, 357 bp, Glycine max
ggtgaaagacttgtttggttcccatcacgcgcaccctctcggggcaaacccgacccgagaacccgccaaatcgaacacaacccgaaacccttgctgctgaatgttcccaacaatagacaacccactcatcgttccggcaaacgcaaaacaaaaagtcccgtcattatccaccggaatgagataattcgacgccggcagtgacacgtcagcaccccgaaaatgcagtaccacggtcggaaccttaacctccgacagccccgaaagatcatagcacgtgtcaaaaagcgaaaactcagacgcgcgcttcaaatgtgaagccccgacccgaaacgcgtctcttaacgccacataaccagg

SEQ ID NO: 4079 - DNA, 1265 bp, Glycine max
tcattcaaagtttaactcgtccgccgaggattttctccataataaaaggcagtgccaaccatgagcaccttggacgaccacacgagtcctcattaacttctggtctaaaactgattaacacagcaaagttaatcaaaggaaactaaacaacataagttgaatgacaaggacaagacaatcacaaagaagaacctgttccaatccaactgccaaacaaaagaaaaacattaagattagccatctccaatcaccaggcaatgtaaacttgctgcatccctcaatgccaattcatatttcattgcacattacaatttaaatttgaaactatcaaattccttatttcttcctttgcaaatgcaaatagaggcaattttatctgcatattcatgtgcagggagaaagggcgttcattacacttacaccccatgtccttcacatttcatcagtctagaaagaaaaaagagactcctttttcacacactagaagtgaaaactctaacacctaagttaccagattcatttcctaaatccattagcatccagtgatcagaaacaacaacttaataacttgattgatcacactcaaagttggtagattcaacaattagtataaaattcagcaacctaagtaaatttcttgcactcacatatcatccttcagaaagcaagggtaaggtaatataaatcctgatgacatacatataagcagattcagcgcatcaagaagccaattaaaataggtcattcttattttttttcaatttatgcctcacacatatgggtagtgcaacattataaatctataaattttcaactctattcatcagggacatctccaaattattatcttttttattttctcattagacaattccagtaacataccactcatattttctctttaacttcttttgttacagcaatccgaattccacaacattagaccccaccacctactttattaaaccctaactcctaaggtcatattacagcaattcctaactctccaaatccataaagtaactgtctgacaccaaagagtttttttcccttattataaaccctttgaactctttctcaatcccattctcttttcagttttttaaaaataggaaataaacagagacatgaaaaagggtagtctaatacaacgaataaaaaatgcggaaaattgaaattgaaaaggtaaaattgaagagcaaggaaaaggaaaaatagataggcatttttttttaccaatggggactaaagggttccgaactcgc

SEQ ID NO: 4080 - DNA, 300 bp, Glycine max
caaccaacaataataacagttttagttgcattaatttacacaagaaagtaaattaacgtaataggcaacacatgtgtgtcacgttcatgaggatcattttataatgatatgcaacattgaattaaatattctcatgcaatggagcattctggaggaaggccttgagggaaacgtctgatatcagtgcaataattgtaaatcatgtaattcttttgcacccaacggatctttgcctgccccgtggcgtccagtgattggccagtggaggaagaggtttgggaattgaagtttctgtaagag

SEQ ID NO: 4081 - DNA, 825 bp, Glycine max
gcagaaacatgaaatcatcctgttaaaacttcttcagccacatatcatccatagatatgactgactccatcagcgatacaaaccaagaaccttcaagactttggtacagttacgtttagaattttaacatcttgatgtggcttatctgtcctgtctgtcttcactttttctatagcctgccaacatcaaagttatcaattggttagtttatcagataaaaagtcgggctttaatcaataagacctaaaaaaagattttaacacaatacatcatagacgaaaacttaagagaaacattaatcaaatgttccatggataaaaggaaatcgagaaggattgatttcaaaaagatatgtgatcaggtcatatgaaagcccacatcacagacatggaaaatgtttggcgagtgattctgaatgagcacatgcttgtactaaatggttatcaagaatagatgccaatttacctgtacaacatccattcccttggcaactctaccaaatacagtgtgcttgttgtccaaccatggagtagccactgtggttataaagaactgagaaccatttgtattttggcccgcatttgccattgatactgtgaaaggcctatcatgcctcaaactgcaacagaaaaaaaaaaatcatttgctcttagttccatctgaggcaaaaccataccaggaagtttccacatgccatcggcatatcccccaactaatcattagcctggagtgtgaaatcatgatatttcttgcatatagtaacagaacgtttgtagacaaacttcattaccttttatgaaattcatcctcaaattctctccccca

SEQ ID NO: 4082 - DNA, 800 bp, Glycine max
tattaaaatagaaaaatagaaaaccctatgttcttctccttcttacagtgtttggatttgtttgtacatttggaggtacatgaacgcagtcacgttcctcttgcttttgataccctcttccacttgtgctatcaaaatctcaagcttggctgaacctaacatgccaagaaatgcttgtgaagatgcacctgcatgactgcacgaatacacttactgaagtaaactctcttcagggcagctttggtgttgttgtggatttggccacaatcgaatggcttcttggaagctcaaattgtcgtccttcagggatgttttactgtcatagctcctggtttgatgatgtcagagacagagaagggttacatgttacggtgtggatttgctccattgagactgacataaacacataaatacaataataacaaaatccaattaaacattttaagaccaaattcataaattgttttttcttacacagatacttgtttaacaagttggaattattctgtttttataaagaagtttttatagtcacttatttaaaatataaaaaaagtgagtgtgagttatttgtaaattattagcatcaatcctataaaatcagaggaacttatttaaatatgtaatcctaactccaagtttgcattttttttactgcaatttgaacatgcttatttagataagtaaaccaacttgatcaacatttatgttgctaaccttggcattaatcatccaattcatcatcatcatcttcaaactcttcctcttcttcatcatcattttcctcttccttatcatca

SEQ ID NO: 4083 - DNA, 1374 bp, Glycine max
tattgtgatttcttatttgatgaccaaatatagtgagtatgaagtaactatttcaagcgagcatccttggataaaagaaggtcatccactttccgggcattgcatagctcatcagcacaatcaccactctcaaaaacagcagctgcccccattccagtacctgctcacaattgacaataggaatgattttttgcatggtgtataagtgtgcgcaagcatgtgaaacatacaatgagaaagtgagtttacctatgcacatagatataactccaaatcgacagtccctgccacgtttcttcatttcatgcaacagagttgcaacacatcgagcacctaccgaaaaaaattgaaaaacatgcttagaagacaataagaatgccctgccctgtatcattggtatttgagaagtacaggtgataataatcatgttccaggtagaagtcccggtcatgaaagggatcaggtgtatgatgcatagatactcctaaatggttgccatacacaacctgtttttattaggtaccaggtacatacccaatgctcacttgaggggtaggtattcttatgatttaattactttattcattattcttatattctatagcatatatcttgcagtatcaagctttcaatttcacttaggataggaatgaaggtttcatctggtttctaataaactccacaaattagctcattatttggaggtatatgtggcatcccatgcataaccaatgctcttaaattagaaatcgaactagtaaagaaactaattgaaataacacatcaatcactttccatccaagggatccaggcttgagtccttattttcccactttggtgtcaacaaagaatatatcctaatctggtccggttgtttttgtcaactgattcaaggctgtttttgtattggtgggctggtttcctgttcaaccactccaatcagctagtctagtttcttaccaaatcttgtgcttgacattatattttgtaggcctaattaaaagaaggggaacttctgtaggccaaaattattttattttatatatgaacgagaatagctgaatgcttttgtaatcagcggtggtagtgttgcatttgtaatgtaagaatgaaagttgtggtatacacctgttgaacccagaggatgcccaattgccattgcacctccattaacattgatcttttctggatcaagccctagcttgttacggcaatacacgaactgggaggcaaatgccttaacacaagcaaattattgaagtgagtatataatttcagacagagaaaaaggaaaatataagtatataacaaacacattgatcaaatacctcatttatttcaaaaagatcaatatcatcaagctctagacctgca

SEQ ID NO: 4084 - DNA, 805 bp, Glycine max
cattcatatcacagctttgaaggcgactgataccagccccacggttcatcagatatgtacttggtcacttgcttcacacttaaatagttctcgagtcccctgaaataataaacaacaaaaactcagacccagattcagattctcagatgaaaaacaatcaagaatcaagatatagcctaaccaatatttttagagtttacagcataaagttttttacattgtgagtcaattaaaaataatcctaaacatgcctactaaattttttccgctctgtaaaatagtcttaccgtcatccaatcaccaactggtcatgtacaacaattaccttaaaaattacaccaatagtgatgtgtatatgacagtgtgaaactcttgataaaaattcacaagcttgaattttatattaatccacgcttggatgataaagtaaaaaacatttacaccattaatgtgttccaattaaattcacatttttattttccacaaataactattagatgagggattaaaggcattaaaattgacttcctcattcactgatataggaaataagattcataccattctcctagttcacgaccaaaaccactacgtttaacgcctccccatggagcttgaatgaagcttggttgagcacaatttatccatacaattccagcctgaatagcctgcacaaaaagcaatacaagtataaatattaaccattcaatttacataaaacccttttgttttgcagtttttatgataatctaggatcagtctcacctttgatatgcgctcgcatctttctagatcttttgacatt

SEQ ID NO: 4085 - DNA, 495 bp, Glycine max
tttaaaaaactgcaattttctttatctaatgatgttaatagtaagtagaatactcatgcatccccgcctttcaaattatcagtaacataaacaaacaaaacaaaatttggttgaaattggcataaactaataaaacgttcaccctaaaggatgtccaatggcatctccctagaggtggtcgacccacagtcataaaaaacgtacatttgaattggtaccaacttccaagaactaaagccaaatagaagtttagaaaacactaaaattaagcagcaccctttcccttcttcctctggagtttcttcatgtaaaactccagctccttaccttcaagaatgtacctacacaattttggaaaaataagataagcaaacaacaatacgatgttgacacaaacatagtctgacaaatcaggtttaagcatacccatcagccctgccacattgtccgggacgagaagaaatacaggccaacaatcgcccaccaccaaacgca

SEQ ID NO: 4086 - DNA, 261 bp, Glycine max
  misc_feature (253)..(253): n is a, c, g, or t
acctcccttgaggtcattgacaacatcatatgggatgggggtaactgtctcaagggtcgcaccctccaccatgaaaccgggtttgggaccctgaggctgtctcttggtgctgatcttctcacccttgaccttggcttcggcctttagctgatcattcttaatcttcctgaggcggaactcctcagtgcaccttgaaggcataacatgctctacccgcacatgaatcctcttccttataattctgttgccaatntgacctcg

SEQ ID NO: 4087 - DNA, 647 bp, Glycine max
agatacaacagaggcaatagtacaaaagtctggttcacttcagttgacttctggtattgaaggattgtcagtgttgaagacaacccaggtaagcttgctatatagaaacaagtgctttgattttcatgtggtgtttccaatttctgcaactctattacagatgttctcaaaacaatatgtggttgtcggtacgagtggcatgatataattttaagcttgagataaatgctttaaaaatgtgaccatttgctcaaaaaaaattctgcacacatcatttacttatagtaaatgcattatacataaaacatgggattgtaacacaggatgactgattctgcattttatataatttattcataaatacataggaaagtaacacaaataggctgagtacttttaaaatcacaacttgtatttaaacaaactctattgaaaatatataaattgcaactatatcaaggcttataaagtattgtagatttttagttaaaatcagtattacagtaccatatgtatgataatgattctaccaaaattttcacttgtgtagaagatgaggttactcaaaatgattttcagtaaaataagagagagaaaataatttctaaataacagaaagagcaaaagacaaaatcaaacaaataaaa

SEQ ID NO: 4088 - DNA, 1406 bp, Glycine max
  misc_feature (1397)..(1398): n is a, c, g, or t
caacacacaaaaacaaaccaaaagttagcccgactcaagataaaccattattatacaaatgcataagcacacagatagtaattctgctcacatgaaatataaagccaattgtgtcattgtaatcaagaaactccttccactgctttccaatgctcacctgcgagaagaatagtttagatattcctcatgttgatcacccaaacacatctttagagtacaactacagcaagatttatcatgagttgagtacaaaatataacatataatggagttgtcttaatgttattattcagtgtaaccacagaaagacaattttggcaggtttaagagcaaactagatggggtatgcctagtacacattcctcaatatttctcacaacattattgaagaggctagataaatctccctcactccctcccacctgcagcacaatagtaaacaaagggaaaaaaagaaacaaaccaaaactaactgaataaataggaatgttacctgagcagcttcatttgaagcgttcttagtccaaatagcaattttttcctgcctacttctgacattcacaacagctccgcatatttcatctccgtgatcaaactgttctccaatcattgccaacaacttgaagggacaaaaaagagaaaaaaaatagtattattagcttgatagaatgaatttaatcatatgcacttgtgtaaatttttctcacacaaacatcatataggatatgatgataactttcctacacaatccaattcactagtggccacaattgcagtttcagacactaaaaaacggatcaatttttaaaaccttgcattcataagttaaactagacaaagaaatgagtatctatatgcactcacacaaacatcctataggatttatcatcttactaaatcttccaattaactaacagagtccaacttccatgccctattactataattttttatacactatcaacaaattcagacatgactttaaaagtaatcattaaaaatcaacaatatgtgacaacattagtgcattctaattaaattgataaataaaactccacagataattgaattcttttgcatcaaaagcaggtgttaatgtaaaacgataccgtatataaccaactggtatcagattttcccctttggaaggtcatagtccactttcccccattagcgcagataggatcctcccacttgggctcaatcttgtgcttgaagcaatgaaagtccgcccccacacccaacttgctcgggtggtgaatgttattgtaaatgctgaacaaattttaaaacaaaaaaacaagggtcagaacttccaataatcaagaaagaagcaattaggttaagacccagaagagggaaaattgggggaaaaggaagggaaaagatcgaagctnncctccaaa

SEQ ID NO: 4089 - DNA, 221 bp, Glycine max
tatgggaatctgttgggtcaaaaactcctcattctacaaaagctcataacatattccgtaaaagagaaatccactgattgagaaccacacatgtctttcaatggtacgcataatattatggtatccccctcctcttccgcaaggaaatggcaggctgcccggttcttataatggaaaaataatttatgcacccacgtaagtaaatttggttctttgcagat

SEQ ID NO: 4090 - DNA, 496 bp, Glycine max
  misc_feature (30)..(30): n is a, c, g, or t
atataaataaagtaaaggaaagcaaaccgnatctttgattttacaagagaagaccaaatatataaaaatagatacatatagatcctctattacattttcgggtgcaactaacttaaaacactttgtcgtttttgggattaaggttaattaagcccctcctggggattttggatcatgatctttatttgcaccagtcccttcatagtcttgggtttccaaatcgaccctcctctccatgaatccttcattcatgtcaacgagcaccacctcaccatttccaaccacatgatccaactacaaaacatattataaacaaggagttaatcaaaagagaaaaactatatatatatttttatatatacaatgatggcactgaagttatgctagaaacaaactgtattgatcacacacacacaaaaatgtctttcttaattttctgtatatagtttccaaatccttttaatttattgaacgattttatcctttaacttttttt

SEQ ID NO: 4091 - DNA, 473 bp, Glycine max
tgcagcctggtgaagacaatgacaactttcggatcaagcgttatgttgcaaagtataccataaatccagctatagcgaatggtttgtcgcaatatgttggttcagttgaggtataatgtttgaatgtctagggttttaacaatttaaatatgaattgtccaaggcaaaaaacagatacatgagttcatatttcttgtgaaaaaatgccatcagtactcagttacctatgattaaagatgcagagaaaaaagctttaaaagcatacactaggtcatccaaatactagtgaacttcaactttctggaattgagattgagccacctgtataattctgtattgttgtgcatctaaatactacactcctcttttcctccccataatcattaacctcaatttacatatcaaataggcagctgatccttctaatattagtatcatcttgaccccctcatttagaccagtttgcaggcgac

SEQ ID NO: 4092 - DNA, 832 bp, Glycine max
tttatggtatctccaccaggcattaatcttgtgtgtggatataaatattttacactcttctcagacgctagattctgtatttggatgaaattttcttactgaggattctcttaatataatgtaaaatgttactctctagaatttatagaagcaagaaagatgtcactaattcaagtttattagctgtttagtgtggtatttggatgttatgtcctttatcaaggaagcactaaagattaactcctgcattttcatttcagtcacgaagaaaacgtgcaagaactccaaccccagggcactatcttggactgaaaaacacaagggagtatggtaagtttaacttaagggatatcttatcataaatggataatctagtctgtgtttgttttattaaagttctcaataattttttactgaattgtatcttaaattttgttaggctatcgtggtgaccgaggtggtgaccggggaaggtatcgcgatggtcctgaccgtgacaattactcacgtcgtaggtctccgaggcgttcaccatacagaggtggccaagattattctccccagcgctcaccctatggtggaaggtctaggagggaaaggtctaggtcacttccttattctccacatggtagcccagacaggaagtatgctcgcggatctaggtgatgtttatcttagcattctactatttgaacaaggtaagcaaaaatttgttgactatatggtgctgtgactaccagtttgcgcctatatacaatgtatacgtttattggtggaagctgctgttcctgtgtgactatcagtgtgccttttctcgaagtcacacagaaag

SEQ ID NO: 4093 - DNA, 609 bp, Glycine max
ttgacgataaataaattcaaaaaagaaaaaagaaacttttcatattatataataataatataatcctagtaactctttctgtggagtttttctcggataaaccggataatttacaacctgctagtaagtgacgacaacttaggagggtacgggaattgctaggtgtgcaaagccataaataagttctgtttacgcgcatgctctggaataagccgattgatgacatcagggggtacaccagaaagttctgcatgaatgaacaacaaacacgaaattaaagagataaatgcaaattatcatttagatttaagacaagtgagtaaatctggtgtcattcactcctgtatatgctaaaatagccactaccattgttgttttttggttacagaatttgctttataaccctgaccccacatcatagggctaaaactcacaccaacaacaaatcacgtgtgtagtgaaacaaatccattgttggctggctttaaataaagctattccaaataaacttcactaatagattgtgctgatctatgagaaactacttaaactcaccctgaggtttaaaattaaacagtggaggaagtggtcgaccattatgaaggcggt

SEQ ID NO: 4094 - DNA, 324 bp, Glycine max
aattttcgaagcttggaaagaaaatgaaatcacaagaatgccctccttgtggagcctgtttctctaatttcacatgttatttatattttattagttgtaagctttttattgggcgcatgtaagtatgacgtgtcgtgtttctatctcacgcaatgacgtgaaaactaaggttcagagtccacttttgctttgtgccccttaaatgcagtcaattaatactcttaaaaaagaaaatgcattcaattaatacttttaaaaaagaaaatgtagtcaattaatataataaatgcaatcaattaatataatgttaaatgtgccacacgc

SEQ ID NO: 4095 - DNA, 417 bp, Glycine max
tttccaatgcatcggtctcattaggcatcagatctttatgcacaaacaagttaagcacctccattagagatctttaacccagattaacatatttagaagaaaaaatacaaacaattctttaacttgagtgatttgtatcatttttttgtcataaacatgaccaggtaagcatgctctaatatcacttcttccaacagttccgcaaccttgtttctgtatttaggaaataattcatcaattattccttctccaaaccgtgccgtcataaaaggttcagtagtagctctcacatatttggcgatgaatttggctctgacattagtatctaatacgaaatcaccattaccattctccttcaaaccgtcatcccaacgcgacttgaatgtctccaacttctcaagagtgaagaaaccctgc

SEQ ID NO: 4096 - DNA, 372 bp, Glycine max
gacatcagaattccgtcccgagaggttcttagaaactggtgctgaaggggaagcagggcctcttgatcttaggggccagcatttccaactcctcccatttgggtctgggaggagaatgtgccctggtgtcaatttggctacttcaggaatggcaacacttcttgcatctcttatccaatgctttgacctgcaagtgctgggccctcaaggacaaatattgaaaggtgatgatgccaaagttagcatggaagagagagctggcctcacggttccaagggcacatagtctcgtttgtgttccacttgcaaggatcggcgttgcatctaaactcctttcttaattaagataatcatcatatacaatagtagtgtc

SEQ ID NO: 4097 - DNA, 415 bp, Glycine max
  misc_feature (407)..(407): n is a, c, g, or t
gcggtgacggtggcgggggatacccggaacctgaagatgggtcagtccggggcggtgttcgggtcgctgacgtggacggatgggaagcacgtggttcggagccccattgtcgtgagtcaaatagaaccgttatagagcctcgatcatgtccgttttggtcgatgcggcgcgtggcttgtgactttcttctttaagctgccacgactaatataaaaagacaacagtcaacacaaatattttgtattttcttctttccttctttttcatttttaacttaggattgtgtcttgttagagtgaaaaaggttggacttgtaatccgttgttgtacttttttttaataagttttttttttcttgggtttaatttaaattccccttgtatttataaacagacttttaggggtcnacgtccga

SEQ ID NO: 4098 - DNA, 462 bp, Glycine max
ctggtaaacataggtcaatccgcacttgccacagtagtggcggtcgaagtggttggccatgaaggtcccggcgccacattcggcattggggcactccttgcggagcctctggagcttgccggagtcgtcgaccttgtagaactggaggagggcgagcttgaccttcttgtgcttgtgcttgatcttcttgggcttggtgtaggtcttcttcttgcgcttcttggcgccgccgcggaggcggaggacgaggtggagggtggactccttctggatgttgtagtcggcaagggtgcgcccgtcctccagctgctttccggcgaagatcaggcgctgctgatccggcgggatgccctccttgtcctggatcttcgccttcacattgtcgatcgtgtccgaagactctacctctagggttatcgtcttccccgttagggttttcacgaatatctgcattgtggctag

SEQ ID NO: 4099 - DNA, 379 bp, Glycine max
tatgaaatatgacttgtcatcttttttgtattcctcgtctacaacttggattatgaggatgtttagataatttttcttttcagaagtacttctagaaaaaaaatgaaaaaataaaaaataaaaaattctccataatctaaaatttacttaaacgtaagttaaaaataagttttttagaaactatgattttttttttacaaattaatttatatgcaagttaattttagtttttttttctcgttcttataagtgtctctgagaagtatatccaagcatattctaaatcgataacatttttattctaggccaattcaggaatttccgaaacaaattatagagcttaaaggaccaaatacgaggtttacgtaaaaccatttac

SEQ ID NO: 4100 - DNA, 466 bp, Glycine max
cgcctgtgggtaagctaaactaagttctcacaggtgaggtgagttcaccaaccacggccgccagaatttccagatccccatccgttccctgatgctgctttcttgggggcagatccccagccagagcttccttgttcaccatcacttggaccagcaccaccactcgcttgtcccccccagccaccattgtcactgttactagctccacctcctccccctccccaaccactactgcctccaccgcttccaccaccaccaccccaaccaccaggaaaagcttcccttccaggagaattctgaaccttggcccctggaaaattgcttaaaccatcatccgaatcctttgtattattagaaccccatctgcccccataaccagagtcctgcctttcattattggagttgtctcctctattgttataagaacctcgaccacgaccacgtacacgcccttttccaccaccga

SEQ ID NO: 4101 - DNA, 626 bp, Glycine max
attaagagactgaaagaaatgcttgctgtccagctacatctgaagatctgcaggaatgtattatagtgcatatatctgtcgtctctaggattttctctgcatggtaaaaaatctaaaccaagcaggggtagtactaggattacgatactagagtggtcaaagtaaagattgtgttttaagagaacaaagatggtagaaatccacatattacatatatttttcctttttttccactcatatataaaatgaaatattgtgtatatacatccatatgctcctacccctgaacattataacaagattcctttttgatttgattgaaaccataaaagaaagtctaatttgcaatcaaaatatccatacaatcattttaaaactgtggaagtaattcaagtatgaaacaaccatcaaagttttgtggtagatgaaagccgtgtagaagtaaaaactatagaaaaagtttcttcacatccggacagacgaagtaaaatttcacctcacagtgcaacacttaattggagtagcagaaacatgagatgatttaccttagtatcagtctccttcaacttttccaatagagttgaaacagtatcttggcaaaactcacagctatcttctttgaactt

SEQ ID NO: 4102 - DNA, 356 bp, Glycine max
tttaaattctctcagtgttttgattattaatgaaatagtataatcatcttacagtgaaaaaaaaaagttttaagaattgtaaaatttgagattgatggtgctccaagaatggtaaaattttaccttttgatattcatagactacacttgtcttttttgaggattgagattgttttctttagcatagagattgagatattgccttttaaaaaaaatagagatagagatattttatgtgatgggtctaacagcacactgggactgaaagggaatttaaataatgcatgaaacaactctctttataaaaagggttgggggaccagttcgctaacatttggcatctgcaatatatttttt

SEQ ID NO: 4103 - DNA, 1084 bp, Glycine max
tgattttctagagaccaactccatgttctattactacatcctaatggtaaattatcaagagaaagactagccttctcgtatgacaccacaaattcctagccaatacctgcttcacttcattgcaaaatgtaactttgttaaggtgaaaagtaaaacccaaataccatcagctaaatgggtacataacctacctatgcattgtcacctccagcagctctggcagaatccaccttttgttcctcagctgttaaaagaggacgtatttaattaaccagacaaatcatagatactgatgttgggttggcaggaccacagaacaaagaaagaaaaatagctagaaaataaaatgagaagcaatagcctagtcggaaacaacagcaaaataagtatagcaaacagtaaaccacaatcaaaatatgatgaccaatagaagcaataaattagagtgaaaatgaattgaaaaacaaagcgaaagactaggacatcaccttataagtcaccacaaccaagtacataatactctcagcaaactcacctgaccctaaaaatactaaagcagtggtatggccttcaggccactgtagtctgtaacaatgtccaatactggaatgtgtgctgcatggtatgcatgcttttgcaatttttattttggaaacccttttagttttttctgacaccaggcagccaaaatttcaagttttgtgggcttctgacccaataagggcaagcatgaatcttcaccacccaaaaccaacctttgatggtttgagtttttggttggaaacctttcattttaaattatttggtatttactgggttaaattcattggatcaatccaggctaagcctatgaatgctcttaattttttaagttctgcttagctacaaatgttttttagtgtaattcttgtaattaaccctaaaagttttcatgtatttaatttacattgtggacaagtccagctaacagagtgacacaaaacattgatttccattaatgaatacctccttcttcagggatgtcagaagtccacagggtgagatttccctcagaagctgcataattagggtgctgtcttgtaag

SEQ ID NO: 4104 - DNA, 370 bp, Glycine max
ctcatcatttattttatgtttcagcagcaaaattataagcatgagagggacaaattgctgataagagtacagcatacattatttaaactatatgtataccaactatgacattgcactggcaatcatttgtcacttgtcagcaacaagagcttcgattttgttttcaaggtgagcttcatgatcctccaagcgacctttgacggtgttgttctcccaacggatcaacgttggcaccccagtgagcttgaacctaggatccaccctccatggatgctggggattcctccatgttggtctatctccaacataagctctcaatagtgcaatgtcatcaggtgaagcctccagcttcttgtatatcacaggttct

SEQ ID NO: 4105 - DNA, 386 bp, Glycine max
atgattctgagtcccaacaacaacattccctcaggcacttcattgatgactctcccaaaccaccatctcataatcatcatcattcgtcgtccatttggcccgaactcgacaacatacagtcagataggactcagttatcaatctccataccaatatcttcctcagacttcatgtcattcactacttcctcaccctccaacgagaaactcacgttgtcgccacttaggctttcgagggcgttagaccccattcaaatggggttgggagtgggaagcggtgcctccaatgaagcaaatcctaggcaagccaattggattccaatcacttgggagagttcaatgggtggccctcttggagaggttttgaaccttagcaataacagcaat

SEQ ID NO: 4106 - DNA, 576 bp, Glycine max
aataccacatgcttacaccttccagtgacaagtacagtatgttgtggcaccagccgtttcagttgatgcaaacttgcttcgtgccaaaattctaacaacacaactacctaagctatcaaacaagagaagcccttttgtcctttggtcgacctatcaaaggtcatcagatcacactagtcctacccttttaagaaaacctactatcaacagtcatatgtatctcatgaaaagcacataaaaacatgtcactttgcctcttcaccatctccactgttatgagcagccgcggagctgccttggccgtctccaccagctgttccagcctcagaggcatcttgcttgcttccaccacgtgcatcgtttggaccagtagccgaaggtggaccaccgctgtttccacctccaagagcagcctcactgtgcattggatgcatgccattatttatatctccaggtctaagtcccatttgaccttggatggcctgctggtgtagctgctgttgttgttcctgcatttgatgtggattgccaaattgcaatggcattttctgggggaacattccttgctgctgctgg

SEQ ID NO: 4107 - DNA, 701 bp, Glycine max
gggggctgtggtatgtgaaaccattaattgtttttactacgtaattaccactccttctatcttaaaataaacagttgtcttaaattgttttatataaattaaaaataaaataaaataaaataatatttttaccaaactaaccttattagtgaaagagattaccattaatactagatttaaaaactaaaaatatatttattagagttattggtgaaaaaaataattaattttacgttgaaaagttaaatgtgatatttattttgctacaattttttttagtgtgacacttattttggaatgggaaaataattattaacactaactttttttctttgtcttgtggtatgtgaaatcattttgatatataggaagcggttgggcgttttctgccacgggagccatagaagcagcacatgcaatagcaacaggagaccttgttagcctttctgaacaagaactcgtagactgtgtggaagaaagcgaaggttgttacaatggatggcactatcaatcgttcgaatgggttttagaacatggtgggattgccactgatgatgattatccttacagagctaaagagggtagatgcaaagccaataaggtctgtgaatatataactgaataatatgcatgcatgcgattccttttaattaatttaacccttcatctctttgtttaattttgtgcaacttttttttttt

SEQ ID NO: 4108 - DNA, 397 bp, Glycine max
ctcaggtcctttagcaactaccttatttgttgattctgtggccatagattaggattttttttccacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaac

SEQ ID NO: 4109 - DNA, 385 bp, Glycine max
tgcttcaagtttcccacatgaagcagatgttgtcccagtggaactttcctgttgccaagctcatcgaccacactcaaatccttgcaaacatctaccttgaacctaacctgtgcttctgattttcctggcaagtgcactttctcaaaacccaacaagtgtttctgaggagcattatgcacatcaggaggagtaaagaacagtaacactacatggctagtgctcattttccccgtgttcttgaccccgaggtgaatatcaaaggccaagttttggcaatgctcatcagcaacatcaagtgacatgcattctgaggaacggcattcatgatcttctgctagaggaacagacaccaattgtggtgctttaacaattttgtgctcacgca

SEQ ID NO: 4110 - DNA, 1099 bp, Glycine max
  misc_feature (1092)..(1093): n is a, c, g, or t
cttgtgctgaattcttgctattgcagctgaaatagcttctgttctggtaattaataactcctaattaattcccaaccattaaaaagttgcatgattggattcaaaattctatggtattggggttctgatataaatttgtaattaaattgcactaaaaaaaattatcatatacttttaataaaaaaaatttatctaatttaatttattattaaaactatttttaaaattcaatcctaactcttttttaatcggagcatgtaagctggcacccaccgtatatcgttggaagatgctataaaaccatttaattaatggatggaatcagtcaaaacatttaattcaaaatactcttaattgtgattagtaatcatgttcgggcaagttacgttgtgtataattaatttgacttaatcagataaaaaaacaaatggacgcaagccggttggtatagatatcactggcctgtagaatatgtggtttttcacgtttaaataaaagctagctactatattatatttagtctttttttttcttaaacccatttaacgtgatttattgactgtgaaacatgtttccacacacaggcttagaaactcctcgcaactaacatctccaaaatttgactatttatttatgaagataattcatctatgatgttcaactctattatatatatgtatcatcgcagtattaagaattataatagtcaaatatagaagtatatcgggtaaatgtagttgcatgtgcgacctgtttcgtgtaaaatgcttattctatatagctttttttattggaaaataacaatgaactaaaaacgaaagggtatcatatagtttgacttttatgttagagagagacatcttaatttggtcatatgttaaataattaattacaatgcatacacaaatatttatgccatatctaaaaaatgataaaatatcataggtatactcaactatatgatatccccataacagaaattgtacttttcttcaggcaatgaacttaacatttctgtttgctaaaaacaaacatccacttaaagtggttcaacatatttatgtaataatttacagggaggaggtccaggannccagtc

SEQ ID NO: 4111 - DNA, 439 bp, Glycine max
agtcaattagataattgcgaaaattaattatatttctcaaccaaatggggagcttctaccttgtgccacagaactagaattgatcataggactagtcctatctggttgaagtggtgatctttttggagaaggcctttctaccttcatagatgcatcaaatttgttctgatcacttacactttctccatggagtatcattggttttgtgtcataaatctccgatatgggatcactatccattgatggtggtgaaatctgaaccttatgatcacctttgaaagggtcatcttgaggactaatgcatgatgaagctgttcccaaatcttgaagcctgagatcatcactccaaatcagtggactctttccactaccactataggggcaattaggcctcttcttacccacaaacaaagtttcattgttattattagatggcacg

SEQ ID NO: 4112 - DNA, 1441 bp, Glycine max
aagcagagctcagtctgcaagtttgtctttagctcatctttcattctttgaaagtcatgtattggtctctcacctttgttcttttacatagctaattctttttcttctcttcaggacttcaaccatagttagtgagatggtgggcaatatcaacacaagcagtgcccttgcagcttttgataagatggaggaaaagggttagttttttcattttttaatatatctatatttacacccttttgaaggctccatatggaagaaatggcttccattcatgtatcaatagttgatgacttgacgtgtatatatagttcttatacaatttacttcaagcaagccttagaaatttatttgattttatttttacagtattaaccatggaggctcaggcagatgctttgaatcagttgagtactgacaatcttgagggaaaggtagtataacttctcatatataactaagctgtatatctcttttaagatctttttcttctttaaacaaaaagggactgtttcagtttcaagtttttggttatacatatatggggcatccaagtagaaaagttattgatagaaagcaagataaaaagaagaaatcacaaacttcttaagtttgactgtgctattatttcccttatcaagaagtttctttattttcatttcattattagtaatgctgcatttatgttgaagtgtatctttgtatgtgctagaagtggatctgaaattcgtggaactcttcctattggttttgtgtacactataatttgcattttgctacagcagttcactgttttgagccacatcttctaagttttatatctgtgtggttcgttgaattctttcctccctcacactaaacaaaaggcatttcttactcttgtcatttgcagtttgcactactggagaactcttctgtcgatgatgatcttgcagagttaaagaaagaattatctggaagctctaaggtattcctctatctatgactgtttcactttctctatatattagtcatcaacacaagcccgttcatcatgggaacttacatatactaattttgttttgatgtgaaatttcatggatatgatttatattacataagaaattttaatccaaagctaaattttggaagaaaaaatgcaacaaaaatcaattcaactggttaattatgtaagattgattttaatttgaactggtgtggtgtcaattatcctctcttgtatttaatgcttcattgtgattttgttttattttattttttcgtttttctgttagcagcggggagaacttccacctggaagaagtgttccaaccagtaaagaaattcccttccttgacttggagcttgagaaggagcttaatgagctcagaagaagagcaaaggggtactagcttaagtgcatgtttagggtaactttttttggagatactattgctgtatt

SEQ ID NO: 4113 - DNA, 998 bp, Glycine max
taatggcgggttccaatattcctgatatagcttctgatcctgaaaaggggattcttaaggtaagctcccttgtgtttcaataaataggtgaaaaatgttcatttgttcttataccaggacattttcgctgtgcagcttcaggaaaagtttcggttggacttggatgatgaagccagtatacatttcttccaggatcttatcaatgagagtgtgagtgcattattccctcagatggttgagactatccatcgttgggctcaatattggcggtaaccccaatatttattgggtgttattacaccaagtaattaaccaggtaatttcttattctattttgaggaaaaacaggtagaaccacccaatttgtattttgactgagatagtttttaccatacgactataagttttgatttcttttctcttttttttttaatacaattttgggagcacgacttttaagctgtcaaattaaatcataacctaaccactcggtccaaagcacctccccttggctcttaaaaatggaacatcatagtacctgcatttttcattccttttgccgaatctgcagcattttctgtcgaacagaacgattttatctactgaaaacttctgcatgatagacaaattgaaatgaaagttatttttggtttctttctcacattctctctcttgtttccagcatctgatgctgtctttttaggcttcttcgaagcttaaaacgtatgtggttttatcttctcttggaactccacactcagatcccactgcagctgtatgcgcttctaatttctgaactaattatcctgaaggccacttagtgacattgtctatgtaaataaattagttctctttcgctcttctggttacggttgcttcaagactgcagcataacttaaaaaatcgtatcatacacaaactaatggttgtttaagtgaaaccatcctatttcatttttgtaaataactcttgcctggttataatctgtagttgatata

SEQ ID NO: 4114 - DNA, 536 bp, Glycine max
gtcagattcctgtatacgaacaattttcaacgaaacttgatttcgtctggtggcaatgaatcgtattatgggtattttaacaggagatcatacacttcactttatatgggaactggaactgtgggtgggattacaagtgctagaatcagggtgccaaatgtaggatgtgaaggattcatgtgctcaagtcatctgtcaatcactcaaagaaattcaagattgatccattctactagcaagattgttccaaattctgaaattcagaatataactactgagatggtgaagacaccagaggtctcaaggtttgttttcttcactaccatatgtacgataatatttgtgttgtatacaattaattgatgtatatgatttccaaagttttttagccatgtaaaatgctgtaaaaaaagaaaattatacaactatttatcaatcaatcttgtgattggaaagtgagaaaatcataaatttagaatgaaaatgactcatttttttttgttgttgtaacaaaatgcaatagggtagaatgtaaa

SEQ ID NO: 4115 - DNA, 376 bp, Glycine max
tcttgtgtttttatgcgtactttagaactgaattctttcttctattatgtaaaaatctaatcttgtctcgccaatctgcgagctttaagctcctcaatcaacgcctcagcatcagcgtaagatgttccaccttcttccacggctcttttagctttctctgcaatgtctttgactcttgttgtcatttcctctgcctcttcactctccaccatcaacttcctcactgcggattccaccttctctcttcccaccaaatctttccattctgaattccacgacaaccactctctgcttcccacttgaacaccaatcttcaaaacctcagttatcaacttctcattcgaaaattgctcggccgagagaggccacgtaatca

SEQ ID NO: 4116 - DNA, 341 bp, Glycine max
ctattttaagatcccttttgcgaattgtcatctaactaaattctataaaattcaaaaaattcatcaaataaataaactgttgagttgcaaaaggagttgctaccgcaagccacgaaattgcaatcatgccaccatttgctcctggtccaagtacaattgctccaaccatgctggaatcgcatctgttccattgtggcattgcagtagctttcgctgatcttccacactgtattcaccagattcaccggattccggtggagcatccttcacaagtgagttaacccaagacacatctggctcatcatcaacatttgctgacattttggttgaagtctttgtta

SEQ ID NO: 4117 - DNA, 245 bp, Glycine max
tatgcaaggtgatcaaggatgttttgggtgacaaggttgagaaggttgtagtctctgaccgtgttgttgattcaccatgctgtctggtgactggagaatacggttggactgcaaacatggaaaggatcatgaaagctcaagccctaagggacaacagcatggcaggatacatgtcaagcaagaagacaatggagatcaaccctgagaacccaatcatggaggagctcaggaagcgtgcggatgct

SEQ ID NO: 4118 - DNA, 437 bp, Glycine max
tttctaatcttgcttccttgtcttgaatctttttgatttgtcgcttccttgaacttagtaagaacaacacttgaaaaatggccaccaaataaatagaagcaacctcatatgagtcatgaagatcgtagcttagaggtgatacactcagactcttattcaaagaacttgtataacaaattatatgcttaactctgctccaaatggaacggaaatttattccacaatgaatactagaacctgaaataaaataaaagttttcaatacttctcagagtttataaatgcatataaaatagacatttatctattttaagattactaacttacatgacttattattgttgctgcttcttaattccaagcttacttgtagatgggtggtggaggggaagcataaatgtaaactggtggtggtggagacttggttggtggtggagg

SEQ ID NO: 4119 - DNA, 344 bp, Glycine max
atttttttcctcattgatctttcttagtagaagatcatttggtttgggaacttaagatatgctgtgtcagaggacttctgagattttagctggtgtcctaatggacgttttctattcatctattaattttggcagtttcatttaaaaaatgcacaggatcggctcctttatctgtttatgtacatttgttactgttttatttctaagtagattgtataatactgaattattttttttccttgttttctttcctattgattttgtgtgttatatatactatgatgctgtcttgtgtagaaaaagagagtttgaagtaaaccctcaaaagtctgtaaatggctggg

SEQ ID NO: 4120 - DNA, 947 bp, Glycine max
actgctctctacatcctacaaagatgtagagattaaactaaaatttccatgtcaaagaatgaacatctcattctaaacatataaacatttcttcatataatcttaatgtcaaaagtcaatagcaaccttgttaccacttccaatcccttgctagaaatgttctgtttctgtttcgtcagcagtcaccggaaagaaactcaagatgacatctgcccccaggtcaaaaaatcaccaatccaaaaaatgtagattatatctgtaaatatgtacgtctaatcacatcatgaacaaatattttaaatcatccacagtgaggcgagtctgacgatcaccagttccatcctccccaaatgcagatgcaaccatcattctcttcttttgctgcaagaacatgtaagattttcttgcataagcaatcacactacattttacattttttttataacgaagtactctaaatgtgttgcaacgaaattttcagtagaaagagtgtgctagcgaactagcattttaaggctagtaaatcaaaacattttaaccaaaacagttcagatagcacgccacctaactcaaaagatatgcccagatagagcagctccaactaaggttcgttgttatgcaaaagacccgcacacattattcagcccatacaattcattacacagaaataatatattttaagccaaaatttaaaaaatctttgtgttaactgatagtgatacaagcatattcatatagaagtgcagatgtcattgactgttcagaagcattctaatctcattatgtcacttaggtgctaactagaacaatataactcacatctcctagaacacaatgtaatatgattaaaagcaactttatatggcacaaaaaattacctgcagagctagaatacgatcttcaactgtatctctcacagttaaccgcaaaacagtcacaggacgagt

SEQ ID NO: 4121 - DNA, 401 bp, Glycine max
cataactaaatgcatataatattaatcctactcatgttcaatgtcactagctatttgctatcttatgctctgatgaactccgtctggatttgtagatggtctttctcatctctcctagtttactctttcatgctcaaaactagtgcctatgcatcattatcatatatctaatgaagagccacttgaagatttcccttttttgctgtggaaaagttccacaacagtgctatgttatttcacatcacatttggggcctgaaacccctttatatgtatcattggtggttttattgaagctgtggttgaaatagtttagatggagcctttgttttcccaagaattacctctccaatatattaattaatatcattgaagtcctataattgctccttgctttgccga

SEQ ID NO: 4122 - DNA, 1394 bp, Glycine max
  misc_feature (696)..(697): n is a, c, g, or t
gaatagatataccgagtagaaattccagcagaaagaatcaggcgagcacgaggagcatccgcttccaccgcggaaacctccaatccatttatcaaagctgtggcaacaacaagtggtgagtgttttcagaatttagaaaacaagttattggataaaagatgttttcaattacacaagatatgctagtgatgatatggcacatcaagtatgcaaaagctttccagaatcaagatagccaaaaaaaaaacctacaataataataaaaaaacctggaatttaggtctcaaagatgcatagttcttcaaaattaaacgcttatttaacatttgacccagttttcttaggttttacttctctttaaaaggagtttagtcaaatctaactctaaaaaagttgttaaaaataaaaatagtttttctctagggaacaaaagccccaaaagcatagtttctataaaagctaactataggaacttttactttacgtataaggagaaaagtccaaaaaagttaggccaaacactaacaacgtcttatttgtccacaaattttaccgaggactccaatccaaattttttgtcaacatgttgattgaccaaattatgctctgaactctaattactgtatatatgagggtcatatttctgcttagctagcaaattgttcaatatatttgtaaaactggatatactccagnntatttaaagtgtatggtaacatcagtatttgcaggttctgtgctgcatactgtcagttctaaagtcaaagacaggttttaattattcaacaaccttcgtctatgactttaatatggacctatctatgcattgttaatgaagtagaggaaatcttagaccttgtttggatacacttcataaatacttatagaagatggaatataaagcaaaaggaatcttctccttccatatgttaaaatcagcttatgcacattagcttttgtagaagttagatgagagggttgctataaaagtagaagtgcataagttgattttaacctatggggagcttaattcatttcacctttttattcccttctcctaaaagtgtttgtggagaagtttattcaaacaaaaccttaatgccgtcttgcaacatatattggtagcatatcaaattgcttgatacgagatcagacagattgtcactacctctttaaataactgatttcatgcatcaaagcatcttaaaccttgccagttcttaataagacatacgaagagtctgttgtgagggattcaagatgaaatatataagaagaattttgaaaaattgcagttctgtacctgccaatgctgtagcattagaagacgcaacggacagtccagggatcaatgtcttgtcatcaatgtcaagacccaataattcaagatctag

SEQ ID NO: 4123 - DNA, 294 bp, Glycine max
aacaaattctaaaaccgaaatagaagctagagagagacagagttaaaagtctctattggtgtcatctcaactgtggtcatagctaacacattttttgtcactaggtagacagatggatacatggcgtgagcttagccatatataattccctgccaatgcttttgttgtttagagtatgtttgttttgaggttattatcatttttcactctttccaatgaacaaaacaaagaagtaaaaaacttgggtctcttgtgttttttgcctcgaaatgatacaacaaacttcgcagaggg

SEQ ID NO: 4124 - DNA, 366 bp, Glycine max
gctgctaaggctcttggatcattcaggagcaaccccactatttgagtcaatttcctcttcatggggggttagtggaaatggaaaaaaaaagataattggaggcaaaaaaagttgatattgcaacaataataataataatatggaactgtttgtgctttgatcctctgcagattgaaggttctttcaagaaaaggaagcctttggtaaatagtaaagaccctttagtacttcgaagcactttcctttgtatttccttgttagaattgatgagcttttttttgatatattggaagtaaaatctattagatatcttgttttaatattttgtgatatgtaataagtcgacttgttggtgaactagtgtgg

SEQ ID NO: 4125 - DNA, 524 bp, Glycine max
aaattaaaagataatcagtactactaggcagaaccgaatttaagagaattcgagccaaatatcttagctaaatggtacaagagctgaaagacaaggtaatttcttcagccctgaacctccaccacacttactcctcctcttcagcctcctccagccaattaacaaagggttccagcgccttcacaaaggtttgcctgtaccggttccaaataagcagcagtaagtagcataacatgtatagtgacagcaaaaattacagacaccaaaaggaggaaactatcaattggagttttattgtgagtaggacactaggacaagtgtctaaaaagaattcatacctgcccttggagtttgttccttttcggaaccaatgaagaatggtatcttcagccagcacatcctggtcataaagagatctaataatctcagggaacagcttcatcagtttagcatcctcgtagcattgcatctgtactttgtacatcagctccagctcaagtttcccgctggtgcagaatgtattc

SEQ ID NO: 4126 - DNA, 353 bp, Glycine max
ttacacttattaaacacaattaaattgcttgcgtatgtgtagtaggacccttaatattcgagactcaattagtaattagttaatccttctacaattcttcctgatttctccgttggagccagtgagaggactaatgtctcccatcttgatcatggcggcggcgaagtcagaggagaaggagctcgggttggtgctgtagccacgcacaatggagtcggtggacccaccattgaacagttgctgatcagagtggaggagacccttcttctgaacaagattcttgaagtagtagttgtcgaattcggttggagtttgaagatcaagcgttgcaagattattgtcccctgaccccc

SEQ ID NO: 4127 - DNA, 1225 bp, Glycine max
ccattgaccgctcaacttggtgcctgtgtggatcttcttggagggttggttcacattggtttgggtgaccctgttgcgaaccagtgctgccccgtgcttcaagggcttgttgaggttgaagctgcggtgtgtctttgcaccactcttaaactgaagcttctcaacctcaacatttatgtcccacttgcccttcagctccttgtgacttgtggcaagtctcctcctcctggttacacgtgctccctctaaaccagttaagtgccagaaatccatgaacctttttttccttccttttttttattcaataattaacggtgtgagctacacagtatatgaatagcaattttctttctttctgtaaatctcctacccagttttctcctaatgaaaattaatcttgacttagaaattgaagtatatttagtattcaatcatttaacttctcttaatctttgaccttcttctttggaaggagctagtaccatgcatggttgtctactttgtcttctattatttctctttgaatttctgtcttggaaagctaattgtgacccatgcatgctattaagtttgtgaccaagaaagtaatcaaaggttttttttattgaaataatgatcatgataggatatgctttttaattaaagagattagacgttactttgactacgtcataagcaagaaaagttgtccaaacaccaactttcctatccatattcaaatagaaattgttaaattaattaaaacatttcaagtagaaaagcacaatatttatgcataaaattataatattacgtttataatttctgtttaaacaattcaataaaaaaatatacatttcaacacttttctccattttttctaataaaaacaatataaagtttttttgagtaaatgtatcatttttgcaatctgtctttttccttcttttttttgaagctgatgctatatatgattatgaatgttgtccagcacactatatgctatgcgtgatttaatttctatttcgtatcagtaaagtaattatatcgtcctttaatctacccgtgaactttgaaatctttgtctcattgtatgtcatggcctatgctttgcaggtggaaaggattgaggaatatatggtcaaaatcgacatgagaggatgtcgagccacactatctctcttctcttctgattggaactgctgttgtttgttttgctattatttgtaaaaccatttgtttttaa

SEQ ID NO: 4128 - DNA, 687 bp, Glycine max
atatatccaacaaggaagtgcatatcaatggttagcatgatacgattcattcacctgtttctgatacgccaaattatggtacgatgatttcaacctacctgttacgacctatcttgcaataaaggagcattatggctcgatgactccaaattctcaatcttgttctcctctctggaatttccccatagtacagcataaaatcctatcacgattataaccgcaccaatcaaactgcaaagaagtcattagaaattctcatcgtcaatctattagaaaaaaaatattcattctgttagcataaacaaattaacagggcttggcataattttgagttttttcaacaaactaataattgtaaatgtgtcattttctctttgctagaacatgttctctagttttgaagctttaccttccaaggccaaaattctcccccagaaagattgcactcatagaaacggtgaagatgattcccactggcttgaacatagcacaaaacagaggtcctgctctatggacgcaccatgtggttagggtgtaacgtaacattgttgcaactattgcctattcataaccatcaaacaagtaactgtattagggaccaagagcaccaaattttgtagacagctacctaaaccatgtcaaatgtgatcacaaatgcaaccaataataaataatttgatgtttttt

SEQ ID NO: 4129 - DNA, 828 bp, Glycine max
tgtcttcactcaagatcggttttgcagttctctctcaaatttttaagtgtctcaaagcttgtttcctgaaagcaaaatcaaatcattaaaagcattagggggggaaatggaaacaataaactgggatacagatcagagaaattaaccttcatgacatagcatatcaattactaaataaatatatgcctacaatattttctaaaaaatggcttttacagaagctatctttgactaaaattggttgagcccaaaaagaaaatagagaatgagaaaatcaataaattggaattgataaaaaatgagaaagatataagaaactgcgtgatacatgttctatatatagaacttacaagtaactaacaattaacaaattaaccaatcaagctaactagtcaattaaacctcaaacactgctccccatatgcaacaaaaagttaacatttatttatataatcaaaagatccagaggagtatgcactcaacataaaagaaaatggatactgcaaaaaacacagaattcaattcagaaacatggcaatggaatttaacatttcaagtaggattgaaatactaagcccatgtatgtaagtgatagcattgaaaactcacaagttggctactttcttgagtatacatattctgcatttgaagaaagagagacttccactgatgcacaagggacaattctaacttcaatgattcctcacttcggtgctggtcatgcatgactgtattctctaatccagaaaacttctgaatgatcatttttgcttctttctgactcttctttatagctagcaaaaaggaagagagcttaggggaaaaaaa

SEQ ID NO: 4130 - DNA, 814 bp, Glycine max
aactaagaatattacattacatgggtaataaatctaaacccaaacggattgtgataatggaaacaagcaaaagattaagacataacggaaagtaactccattgcgttactggtggcaattagcgtccccttgccaactccacacaatgtctttgagagaaggtctgacttggtcctcacagaatttaatgtattcaagcgtgtctccagcagacttggcgaactcaaccaccgcaacctccggcgccacctcgaatacctcgaccgtcatggccagcttccccttcctcccttccgtcgccccctgcatcctcaccacgaactccttcttccccgtcaccctaaagttcagcttcttcgccaccccctccagcttcgccatcaccgccgaagccgaaaacttggaaatgaacatggacggcgaccgcttcctcgtctcaaacaaattcctcagatcgaacccattcgacaaggacgagattatctcaaaagcgttgtaagacggacgagcaggcttagccccagtcaattccccatcatcgttgttgctgctgctgctattgccatcatcactaccattggaaacatcatccccgctgaaatcaatgttatcttcaaccgcagactccttcatggaaaaagcaatgggcctcatgaacccaatttgaaaccaagggtccttcatgatgtcgggaatggaatacctcttttgcgggtccacaacgagtaaattggagatcaagtttttagccccaggggaaatccattcggggaacgcataatcggctctgaaagacttgctgtaaattctcatc

SEQ ID NO: 4131 - DNA, 380 bp, Glycine max
cgagtttcggtgtttggcccgactaacaacattaaggtttctcatcacatgcatgtagatttgaaaccttcattatatatgacattttatgattagatataatataaagaaaaagtttcattgtgagtgcatatatatatatatatatatatatatatacagacacaggcacatacatgctttcaggatcgtgttcattgttcttaatgcaatattttatgtgatagggtggagaaatttaactcgaccttgtatgatgaatgggttaacaagggcaatgcaccggcactgcccgagactcttaagaattacaacaagctggtgtctcttggcttcaagattatattcttgtcaggaagaacactggacaaacaggccga

SEQ ID NO: 4132 - DNA, 289 bp, Glycine max
gtattccaactgctaaacgtttcatcagatgtaatatttacagagggaggaagaatggtaaaagaacatcaccaactacctaatcaaagtacaattttcctaccttgataccccccctccaccaccagattgccaaacgatttggatattctctcaactcaatttcaactgatgacagaataactcaattcgtcaacaacctaacgtagaatggagtaataatgtaacatgctgataaaatttgttaactacggagaccataacaatgaaaactagatttaaatccaac

SEQ ID NO: 4133 - DNA, 394 bp, Glycine max
gcaaaagttacaggtgactttacaaaagaaaaatgtgcctacagcaaaatacacaaaattcatcatgttctctcagtatctggtacttagcaattattaaaggatcagtctaatttcactgatgctataacaataccaaacaatgccctagcacaggttcctgagtgacaaggagctcagaatcacatggcttgatgaaattaacaccaaaagataacaagaatatctaatatgtggacttcaatttggtaaaatgacattggggtttcttatatgtggatttagtgcagccaactccttccattttcctcgagcaccatcaatacgagatgatatgctccacaagctgtcaccaggttgcccctttgtggtaactggagcattagatttagac

SEQ ID NO: 4134 - DNA, 509 bp, Glycine max
acttatcctattcactttcctgcttttaatgtttctgatgcgtgtccgtttttcatgccaaaaacatgttattgtttcactggaaattgttttgtcggctcatggttgttcagtgtgttaacgtacagtatgatcaattttcttcaaaattaataataataacgctcaattttattccatcattaagcatgtacagttgctgtgtgattgggttgttgttcacaatttgtataggctctagagaagggcagaacaataatgatgtgtatttatttgttcacctgagctgtggagattgtttgtatttcatgattgggtcatagaataaattttttagtagttactgaaagttttttgtaattttgtcatcttgaggaatgcgttggaaattttttattatcttcttgaattgttacatgagcaggagcgatgagttggatggttaagattggagggaagaggatataaggtgagttgcatggttaagatgagagaaaagaggggaaaag

SEQ ID NO: 4135 - DNA, 375 bp, Glycine max
catgaagttctggttacctcccttagtcaagtcatgacaaaaagtaatggaaagagtatccgaatagtcaatgatgttgcagggcatattatgatggaaactttatatggtgatagtcttaggcttcagcaggtcttggctgactttttacttatttccatcaatttcactccaaatggaggtcaggttgttgtagcaggctctctaaccaaagaacagttaggcaaatctgtccatcttgttaagttagagctcaggtaactcttccatgctcgcattcccactgtgtatgtgatttaaatgcctggcggaaacactgtgccataaattgttgcatgatcaacacattgttctcttgtgctaggcaaagaaact

SEQ ID NO: 4136 - DNA, 184 bp, Glycine max
cacacacacacatatatatattaaatattcatgcataatacaatagtattacacggatcataaaaactagttggtggttcaagttgcacaggatacagtgtggcatgcaaccattgtatcagttggcagctgctgcggctgcttcagcaggggcaggattaagagtgatttccacattatcatg

SEQ ID NO: 4137 - DNA, 815 bp, Glycine max
ttgcacatacacataacaatgatgattttagtcagactagtatggtttggtcttcaagcgatacaagagcttcttcttcttagagcttgtgttgtcaatggtgagaacaactttcccaggttcaccaaccttaaaattgttgcaaagcactggttctttttctctataagtaagttttttcccatatttataaatccttgctaaatgttggtggcagttgattgagcatcaaatttctctaatcaatcattttgaggtaaaattggaatatctgacaaatttaatattcaaggttactttatcttttgtacaacctacctaaacctgtttcaaagtggtccacacgttttattggtttgctaaacacacagaagaaatttggctcttagcaataatgagaaatgagaattacatgaaataaaatttaaatattacaacctcccagtggcaacagatagctaaccaaagaaacttgctttgtattggagtattttccctttttttccaattggggtataccctttatgtatttatttaatttattcttaatttactaatatgagtgtgtttgctcctgaatttttcttcaggctagcacaatttgtggcatgaaatatgagaaatatgcaaacaatgaattaattagataatattgagaagaaaggaatcctatcaaagattccccattccaatgctgcattctttggattctcataaaccaatttactccgagaaaaaagcaatggaaaacccacctcagaaactgaaaattccatcttatgttttgttgtcggcttcattgtgatttctgtgac

SEQ ID NO: 4138 - DNA, 319 bp, Glycine max
ttttttgctatttgcaaaacttctggttcagtatctgtcaaattttcttgacagtttaattaatcctgtagtgcttgatttaatgcgtagtttgaacagaaattgaatgtttgacatcaccaatgtggagttcatgttcaccggttgggattcttcgaaccccgaactggtccacaacggataagtgtttgcacacatgaacaccaaccttgactcgttgctttgagccagcaagaacatgggtcttgtggaagcccaccaattgtttaatttgcgaccattttccatggggtggttgtgagaatatgagaagggtggg

SEQ ID NO: 4139 - DNA, 810 bp, Glycine max
  misc_feature (800)..(805): n is a, c, g, or t
tctcaatcgtaagttatctaacacatcaacacgaattcaatttataccagcgggcataacttggaatttggttatacaaatttgattgcatctgcagtctcttttgtttaactaaattccgagaaccattcagcttcatcaaaaggtaatttttgaagcttcgattggtctttttccttgctggtaatactggaaatagatttcaacataatttttcaccggtctgtataacactggccttgactcgttgactagcttatccactggtttaatctctttttctgaatccgggacgcagaacattgctactgtgagcctttccttcgctttatttatcactaccctatgtactgggctccggaagattccattgctcattatctgttaatcacattcaaaggttctgagtcaatcctatatgttgtcatgggcaagctttttgagctgtatcaatcaactctattgacaagtttgctctttgcatgaatgtaatgatgaaattttaatgataaatgacgcagttataaaatggtggttagaaaatatgtgatagaggaggagatggaatgcatgtttgttacttcaattgaatcataaatgaatgagaggcttacatcataaagcctaaacaattgatattcatcaattaagatcaaaatttaatccaataattaaacaatgttaacccacaaaattccaactagaacaagaaacttcagttattacctctatttggtcaccgacattaatcaggagagcatcagggattattggaactttaaaccactgatcatcttgannnnnnggggg

SEQ ID NO: 4140 - DNA, 555 bp, Glycine max
  misc_feature (550)..(550): n is a, c, g, or t
gatgacatggaatctgcaatgaactttcactcatcatcttcatcattatcagcagcagagttgatagccgccacacgagcaatcaacttagccttcctctcctcataagtgagtttcttcagattgtacctgcagaaagatgaagatactctcaggaacattctccaatcagtaaatactataactaagttaccaaaccacggttctaaaagtcaaacaaaatatatagtcacagtagataacgagcacataagtagctaaaaagaaagccatgccagcaacaggtacaaatcaatttgccggaaatcaaatgacaaaaaatatacatacattaccctatttcaagaatctagtattctagttcaagtcaaaaatcaactttacctcttgtgttccttcgggggctgcttctcagatttcttgagagaaggatcagcacggatggcagcatgaaccttcttgtacagtgcctcaataccatcagcttctattccacgcttgatgtattcactgaagtgtgactgatatttctcaggttcatcttcccccnacgcc

SEQ ID NO: 4141 - DNA, 489 bp, Glycine max
gattctcctgactggctttacttactagaaattgtcaaaagcaggccataatgatcactaggcaaaactgggagtaccagttgttttatctcctttcttactttcttttctttgttgtatgaaacaccaggtattgcttccatcccaatcatgtcaacactggttatcttaaaatcagtgaattggcaaataaagcgatctaatcgcttttggagagtacggttgcctgtcaacatctggtttgacttggtgtcataagtccaaccactttcatttggtcttagctgagaccaggcatcaacccatccatcttgtagaggatattgaccatcctgttggtcattccagttcatgtctcccccaaaaacaacacttggctgtttcttgagaaggtttatagcctcattggcctgcactactctttccttgctgtacatctgatcccattttggaggagctggacagggactctcaagatggctagtggca

SEQ ID NO: 4142 - DNA, 415 bp, Glycine max
cagcttgattttgcaatcaatgctcttatgtccttgaacatggtggttacactgttggtggcattcctactggacaacactgtccctggcagtcaagaagaacgaggggtgtaccaatggtcgcgagcagaagacattgccactgatccctcacaacaatccgaatattcgctgccaaagaaagtagcccggtgttgttgtcgtttcaaatgcttgggagtctaatgcttggttcactctcacattttaatcctggtaacattccttcaagaaaaaggccactcccaggatatgtccattattcctttattctcttccgtgggactggaagatgttgcagttcatgaagacaaaggtaaattatacaaggatgtgtaatataactatagtgacattagattggtgataggctggg

SEQ ID NO: 4143 - DNA, 906 bp, Glycine max
ctgatggcactattctccaatatattattactgtgccaatgtacatcacacgcagcccagagacatggacatggtcatggtcatggtcatggtcatggtcttctcaaatagttattgaacactaaactttccgttccccaagccagcactttcttcgcccaaactagtcgctacccattgatggacccattgtctggatctgtgaaaaggtgcatcaaggttatgaacaaaaacatggaacaaaataaggctgagcattttgtgaaaagtgagaaaaagataactaggacatctaaggagcaaaagatgatcctgcttagaataccttattaacgagcaagttcacttgttctctgtacatttccttcaagtctacaatatccgcacgaagttcctccagctaaacacattgataattttagataaaaatttaaaaagtatataacttttctattataaatcttaataaataaaaggaaacatggcagtttcaatatatcaaagtcttgggccttagtataactaagtctacaaattattttcttttctcttttgctgcttttttgtattcagggcctagcttgtctagtgtttttctttcatttgatttctcagatttttctgaagaaagagcaattcagttgtgccatactctcgtctgggctctaaagtatttcaaacacaaaaatttataaggcaaacaaactaagaatgagttcctctacaagtttataggattccagagatttccttacagggaataggcagaccagtaggccaggaatccaaaaaccaaattatgtctaagatattagtcctagaaagaaagcaaacgttggcaaagtgagaattacctcttcatcacgttcgcccatcaattccaaagcagcagagtgcctcctcctt

SEQ ID NO: 4144 - DNA, 675 bp, Glycine max
agttaagtattcttttggaatattatcagtaatcttcttgatcaccatttccctcaagccaatatataatttcttgatgtttgagagccaggtttgcagttcacgcatgtgccaactgccttctcaagctgtgtgatcaatatcagtatgatcttcattataacatccagaatgttaaatagccatccaaaaaattaatccttgtgagaaaattatgcattttcagtctcacgcaaataaaaacatgaagaaaacattacactttcttagactacagcttttgcccagtttggtattgcctttataaacccttaaaaaagataactgtcttcgacaagattttcataaaaaaattttggcaaagcaacattggtatgttgagttttataaaatgcttcttttgcagctttaccagatattaactttcaccaaagacagcaatatcaaatggacctttctccaagaaagattgtacgtaaaaaacaaattgaaatcccaagcgaaatccagaagcccaacttgttaatatattagaattagaatatcttcagaaattaattaaaagcttctgaaagtgaaaagtaggcaagtttccgaacttaactttcccagacaataacaaaagaaaagatcatacccatggataactgcaaagatgataacaccatcgcaccc

SEQ ID NO: 4145 - DNA, 301 bp, Glycine max
cgaaacaagagcagttgctaaacctcaagctacagctaaagaactattgcaggatataaacatcgaaattgacactataagaaaccctaatcgaggacgcagtgctgaaatccccaattgtctaaccgccaaatccgtagagggtcctcccctgcctcttgagggcgtaaacaacgtccatggcagtgacggtcttgcggcgagcgtgttcagtgtaggtgacagcgtcgcgaatgacgttctctagaaagatcttgagaacaccgcgagtttcttcatagataagaccactgatacgctt

SEQ ID NO: 4146 - DNA, 553 bp, Glycine max
cttcaagatcacattcacagctgattaactacaaccaagaagggtaaaagaactaagcaactaaaagaagaactttcgtggggatgctctagatgcaaccgttgatggatagtttgaggacttgagaggaggagacactgccttgctttcttgacccccaagctctctgtcaagcaacttagctgcccttggatctgttagtagtgtcttctggaaggactgtgagaagccagttgcaatgatagtcacatgaatctccccattgtagcgatcatcaacaacggcaccaaatataatattggcagaagggtcggctaaacttgtcaccacctacagcagttatgaagttttgaaaacaggatacaaatgttcacaacaaattcataagatcaaaagaatgctgaaatgttccttctgacaataaaattcttaagtacctgagacactctgttcacttcttgcagagttatgtctctccccccagtaatgttatacactactccagtagctgactgaatagaagagccaattaaaggagccaaagtagcctgtt

SEQ ID NO: 4147 - DNA, 436 bp, Glycine max
tttgggagtttaagaggaagtatatatatatcaatacaagaagcaaatcaaaggatcaaaccctgagcaggagcaggcttggaagatttctgctcacttgcttctgctgcttttggggactcagaaaggacttgtgcatattgatcttccacttttcgtttctgatgttcttctgcaccctctactttctcttttgtcttctgtcctacttccccagccgccttagaaaccttactaaacgcgccagttacccaggatgccccagtaagcacatagcgattcttcattagggcagagccagcattactcactgtctgttctgcagcagcaaatgctgatttggtcttttctgaaacctggaacttttggtccacttctcgaactctatcactcactactgtagctccagcacttattttctcgctaagcccaacgc

SEQ ID NO: 4148 - DNA, 933 bp, Glycine max
ttgttcatgcttttcttttagctttttgcttaaatgcgcaagtgaaaaaatgtaaccagatctcgctttgtttgaacctttttggatctgttttgtttgattcgtttcgtgttacgtagcggtagatcagtgactgagatctttagaagtaattgtttaggatttcgtaaatcgtgctgtgttgtgttcttcatttcagtgaagttctttgcgaactcgttagttctaggatcttacatgtttgtgtaatacgcgtttctctgcatctgacaatttcgtcaacagtgatcagttctagtcgttattccgatttccgagggagcgttttgttggttttgtttttgaaaatgctaattgttgcaaattacttttcgtaaccaacacacgtgcctctgatttctgttaaatcagtttttatagtatttcgtaaccaacacacgtagtaccattgatttctgttaaatcagtttttttttaatatattttaaattttttgaatcaatgtttcgtgaaaatatgtttctaactaactagctgcattctcgtttgttttttgttttttaagttgttgataaagattttcactgttaagccgagtgattagtattagccatggaaataagttttgttccattgtgctgcttaagatttttgctttcattgcatgcttttttcaaaggattggcgttttcgtatttgcgatttgaatatgatatcgagaagttttcctccggctgataattgaatacctatagaaaaaagtataaagtaaagtgtcttcatgttaattttgttaacgtattcatatcattattatcatttgtcaagcacaattatgtgcaaatgcagaaattaactgcgtttcgatgagtttaagtgttgtaaaaatttaactatgtaactaacattgagaaatttctccataggatgtct

SEQ ID NO: 4149 - DNA, 379 bp, Glycine max
aaaaccaaaaacaaaattaatgaacccagaaggaaaatgaaaaataatttgtagctttatttatacacaggaagaccaaagaaaaagctgttcagaaaactccgctagacatggaaggaatgtcatcaaagctccaaaggttcatgaggtttccaccatcctgagttgtgtcaccagatagcaaggattccaacgaagtatcgccccagctcccttcaagataagccatctgaaagaacttcaactcagattcgatatccacacgctcctcagagagtctctttgcagaatcatcttccatagataccacattctgagagttaggctgctggttggcattttgcacaaaatgagattcacaatccaaaggagcagaaac

SEQ ID NO: 4150 - DNA, 1191 bp, Glycine max
aaaatgtatttcggagacgaaacatctgtaccattgtttctccgtgcctcatctgaaaattgtaatatttactctgttctgaactctccaaatttatgcttttcttcatgcagctgcttgaacacattatcaagttcgggaaatgccgatgtcagcagcagctccaagatgtcaaaaaccagctgcttcaagataacggatgactgcaaggaagtcaataggaagtatttacacgaccaaattatggagagacagagagaatgacggaagtgagtcttgcttgagcatagagtctaggcatgcaaatgaaaactcaacataatattataaataacttcaacacagactttgttattacttattactgtaatatatcttgagcttttgatcgattgtgcctgtaagcaatgtgcatgtgcaagaattgctcgacaaatgatctcgaggtgcaaaaggaattataaaccccaaaaggacatctggggacatcaattcacgcctgtcatgacaagattgctacatatcccaataacacctttgcattctaatggttacaaattctaatcatagctgaatagaatcatttcttaactaataaatatttcaatatcttgactatactagaaaggttatcaatatgaaaagcattttcatgaaaatggtgccaacataatatggaagagaatttgacagaaaaactcagttacccatgaacggtgggataatgctttcatatgactgagttgataagcagagcagaaagatcagccctaaaatatatgatcgtgctctaagtgagcaaggcgaattataaaatggaatgcaatgttcagcatcattaacatcatggggttatgttacaacttacagccaccaacaacaaaattaatagatgaacaaaagaagcttctccagaaaacttcaattcatttaatcagaaattacctgaaggaaaaaatatagatcccttgcacattgctcatactccttccgaccaacaagacctacaattgctggcggtgcatgatctacatgaacagagatggtcagctaagcacgataattttttttaatagaattagataaaagacgttgaatagacacaattatggatataaatgagagcagtataacaggtattaccgatcattagctcgtatacaaattttgcacgccgatctgcctcctgtg

SEQ ID NO: 4151 - DNA, 344 bp, Glycine max
attacatgaaagttacagactctcgatgaaactcacatgaaagtttcaatctaaaataccccatcatataaacctaacaagagagaagaacaagactttttgcttgcctttttctttctccttggtgtgtcccttttttttattcttcttcaaaaaggataaaactaagaagaaagaaaattcccaccttctctcaattatacatgacaccttaaattaactcgtgaacaacggtatatacatataatacaataagattgaaattaagattagctcctcagtcccaaaaatctcctctgctcttagaacttttgtgattctttaatccccttttcttttcggca

SEQ ID NO: 4152 - DNA, 765 bp, Glycine max
ctataatctcaaactaatatttatataacacatattaaaaattattaatttatgattacttgattatatattacataaaaattaatatagtgtaagaaccaagataaatcataatcatttaataatttctcttcagaccaacataaccacgaccagtttctttcatgagagagaagataagagaaaaaatgtttttcaattttttttaaaaaagaatttaatattagtctttgaaatttttaagcaccatggaggtgaaaaaaatagatatccatataatggacaggatatctgaattgcaaaaaaatcatgaatctcttgtttaaaaacagttttatttaaaacatttattttttattggaatgttttcaagatgataaatgagacaaatcaatcaatcagacttggtattaaaaacaaataatttcctcgtgacattttttttttcataaacataactcaactaaagaaaaaaaaacagaaaattaaaacccggttatttgctgatcattaggaaaagaaaaaaaaatgggttggtaagtataactataatggggagaatcagcggtctacttagacatgcggtgggtgcacaccacaagcgcagtcagagaaaggaagcatgcactgcatctaccttaatctacctacccacacttttctatatatatatatccacccttccaagccactttgcaacatccatccaagccttttctttcgtagatagctactacttcactttcatccttgctccagaaaata

SEQ ID NO: 4153 - DNA, 329 bp, Glycine max
tctcagaaaattcccgtatctctctgacagaaattgacataacacacctaattccaaattccaattcaatgttgatcaatgcctcaccacagacacagttacaacactgtttcaataagtgactggtctccgaaacaaaggacccatcttcgaaatttgaactctgccttctcaattaagaatttaaacttgtcaaattaagggggggaagtcaagaactcgatggtggttgcggaagcgaatataatataatcaaatgggggtataatttgttctgataggctgagtccccacaacggaaagcaacgaactttcctcgtcaagaaaca

SEQ ID NO: 4154 - DNA, 726 bp, Glycine max
gaagcatagtataaaactcataccaaaccataacaaaaattaaacaaacaaaactctcctcttgacataatctaggaatattgtgcctcaaacaattaagttgtattctatgacgaagcgccacttcgaagagcttgggatttcttgcttgttgttaacttagtctcgggctacaaaccaacaaaagaataagaattagatcatcaatcataggaaaaaaaaaacagggggaaggggggcggggggaagagaatcaacacaactagattaatcaaatacctccttcttcacaggttcttctttttcagataatattaactctatgtggcacggagatgacatataagctgcaaaaacagtatccataaataaaaccgtgtaaaagataacaacccgttaaaacaaaattctcatcatttaaaacatacgattgattcttccatgggctcggtatgttcggcgtctttgcttctgtgcttgattgacttggatatgcgaaatgtacagtgcatcaacatccaaacctttcacctgaaaagaaaaaaatttcagttaaattaatttggaaacagttggcatgaaatagccatatggaaaagcaaaaaaaagtatatatagacatacttcagcattgctctcagcatttttgagcaaatcaagaatgaattttgctgacttgacaggccaccgtccttggccattagagtgtctattcttagcctgggc

SEQ ID NO: 4155 - DNA, 486 bp, Glycine max
ccaccataacatggatacttgatatatctataatatctctttacttctcacaattcttgcaagaaaaccaccattgaaacagaccaaacatgaacgattaaaggaagagtaacagactgatcagccgcttgaaaatggccaaactcaaaagtcaacaagaaaacttagattttgttgaatgcaacaatgtcacagctctggatatactcgttgcatggctcaactgtcaagcgttcctcaacaagagtgtccactgatacaaggtcatcaacaatagtcatcatgatctgcaacttcttgataccatatcccacgggaactagtttggctgtaccaattgaaacaaacattttagataaaatataattttgaaagaagttaaatgcatcaaatatgcaaaagtttatgaaaatttcatacatgctccccacaataaaccaggcatctcaatactacggacagcctcttccagcttcttcatgtcgc

SEQ ID NO: 4156 - DNA, 402 bp, Glycine max
cgcaccatttacataaatcgtatcttctacatggattctacatggattaattacatagtcttaccatgccttaacaagcttaaaagtatgtctagtcacaaccaccacattgcctagaatgtcacaacccacaaaacaagttcactcataagcaaatttttttgaagaagtaaagctgaatttaatcagaatcagatgcagattctaatctttgttcctcagaggctgcattatctccttttaagttcgcctctccctgcttgaatgccttggctatctcttcaatgggaatcaaaggtagatacccgacgaaactataacccttttgagtcatggccttgatcacatggttgtacttctctgaccagtgagcagcagtgggaactgctatctctgccaatg

SEQ ID NO: 4157 - DNA, 319 bp, Glycine max
cttttctttgggggctgcaatgcttcctcctcctcgtcttcctcatcctcttcattctcctcgtcctcagcaccatcttcatcctcttcttcacctccctcatcttcttcgtcatcatcgtcatcgtcgtcatcctcatcatcatcttgatcatcaccatcttcgtcttcatcctcttccccattctcttctgctccacctgcgccaccttcgggtgccttctttgagttgctcttgttgttggaattgttgccatatccacctccatcttcagatgacaactcctcttcaccctccccaaatccaccatctccatcgt

SEQ ID NO: 4158 - DNA, 551 bp, Glycine max
atacattgtgcataatgataggcaactacaatggaatccttattgcaaccttcacattttagtcaacattgaagtggacagctaatatcatgatataaacataggaaatgcatatgtgccttacaatttaaaagggtaactacgctatactatctcactcgactaaaaaagacatctagagcttgaaggtgtatgcaataaaataaagaacttcaaggccataatattaactctcccaaacttcagtagcgtcctataaattaaaatgacagaacgacaaaattcattcgtgtagtctctgccccattttagtcctctagcagcatcccaggttttgaacaaacggctatgttggctttcagaagaaatgaacatgttctcaaggaacattcatcacttgtattgactgcaacatgtcagagacggcaacgacaaggtcacctgatttgatcagatttctggccttgagcaatgaaaaggttctgttgagattgctctccatatcatctgtgaagctcaagcggaaaggtatcaagccccactgaagattc

SEQ ID NO: 4159 - DNA, 236 bp, Glycine max
tgtacactggagcaattgacacatgcagagacaaagggcttcttccgaaacctgcagaaaaagggctttttactaaacctgcagatcagaaactccagtgaatgccatcatgcagaaataaatacgcattcatatctttgtatctgtgtgatggctgtgcaacttgcttttcttattccgtttcttgattaacgtttctgttttatgaaaaattagaaatgtgagtggcttgtaaa

SEQ ID NO: 4160 - DNA, 1012 bp, Glycine max
aacgatttattcagacctctcattttttgctcgagcaagacactaaatcgcagctaaacataaacatacggtaataatgtgaagacaagctactttgaagtaaaacaccccttaaagagacttcttggcaacgaatacaagaagatcaatgacacgtgagctgcagaaccggggacaaagaaggtattagaaccagctgaattaataataataaagcatctaaaattcgggtgattagatttttggccaaattaacaacttattgacgcactaacccactatcacatacaagaaattgttaaaggtgcatttacctgtatccccactcgttgtcgtaccaagaaacaagcttcacaaagttcttattcaatgcaattccagcctttgcatcaaaaatacttgatctggaacaatgatttttttaaacaaaaaatggttaacaggtaaatgaataataatgtcaggttgtcaacataaaaaggcaacaattgtgttaaaataaattttcagcttttaccataatttatacctgctatcgccgataaagtcagtggagaccacatcatcttcagtgtaaccaagaattcccttcaacttgccctctgattcctccctgagaaatacaacatcatataagacaaattgagaaggaccaatacaaaaatggagtaggcatttttgaataaaagtaatgaaattttgcataagatccaataatacacaatatcattagaggagaatcaaataattcagtcattacttgatagcatttttaatttcatcgtaggaagcttctttctccagcctcactgtgaggtcaacaacagagacatccacggtgggaacacggaatgccataccagtcaattttccattcaaagcagggaggactttcccaacagccttgcacaaaaaaagtaggaatcagtaaaaccaaaaaaatgtgttgattataaacaattaaatttggtgttcatgagcaagaaacaacacaacaaatcatataaaatat

SEQ ID NO: 4161 - DNA, 504 bp, Glycine max
ttatataatttgacttgttaagaaaaaactagtaactaattccggtccttaagtttaagggtaatacttactatatatctatatgcttctctctccatttctaagtcatatacattaatttgagagtgaagaattaaatggagcaaaagcaaaagagctcgaaacattattagtgtgtgattgtagtatagtagacacaacaaacttataagctctctcagttggatgggcagaatcccagaaaacgtatgaggaaggatttgggcacaagctgaaaaggctacatattcctgaaactccaaatggcgcagtcccacaacacccttctgagacatctacaaaccctgaaattattatgaagcaaactaacatatatattaacgattaacaagtgttaatataatttacacagttaagttaatattgtatagaaaatgaccttctggctgaggattatttatgagattaaagagaggagtatagacatcgatgaacctaatgtca

SEQ ID NO: 4162 - DNA, 990 bp, Glycine max
attacaattggtgtaagccatgtaatgtaatatgtcacaattatgtaacaaatggatatagacctgaagtgtggtaactttggtagctgccgtgcaaatactaggcaagatgacttgcttgagatcgatggatttcatcagcatatgctgagggaacatagattgcatgcaacagtgagctgtgagtgcggccatagaacaagtatacaagtactcctatcaacatccataccgaaactcgcagccatgtagcaactctgaaacacaatatacgagtgattagaagttggtactcatgtcatgcgtgacacaaaaaaggaggcatggttgtcaagagatttctcacccaagatcgattagtaagtaggtgtttataagaatacatgcagcaggtaagaatggaacaaatgggcaggcaaaacctgaaaatacacggtatcaaaaccattggaaaagattttaaccaaatcttgtatgacattaagagaagaaatgcaatcaactagtattcaaaatacactggatagcaagtttgtaatgatgaaaactcaataaaataatttaatcattattttgttgatacttgcagattaggtaattattagctgtcagagaggaaacttctaaataagaactagctacatcatttgtggttcattctaaaatgagtttaatcaatccatcaaagtgtgatgggcttagatatttaggctttacttggataaacttttccataagcacttacacagagaagaaaataagaaggtaaaatgaattgaatttctcctacaagttaaaatcaacttctgcacttaacttttatagaagttctctcatcttacttctccaaaaagctaaagtgcacaagttaattttaacttatgagggaagctcaattcatttgtcttcttattttcttctcttatgagtgtttatggagaagtttattcaaacaagaccatagacttatctactgcacatacctcctga

SEQ ID NO: 4163 - DNA, 918 bp, Glycine max
aaccaagattactaccagtaaatgcataaaagaaaggtgaaacggcaaaagatgaaagaaacgtcatatcttttggtttctttatgaaagaaagaaaagtaacagtggctagatgctcacaacatgtaatacattctgttaccatgcaaataaaattatacaagagacatgaagaaaagaaatacctttcatttctcccttgggattgacaataacaccagcattatctgcagaaagcataccaagatgaagaaaacataagcacagattatccaggttaaacgggatcaaaaagaaaactagagctaaaattgtccaataaatcctaaaaagctaaggagtgtcattgaatgagcaaaaattgtccaattaatcctaaaacactaagaagtgtcattgaatgggtaatccctataagtctaaagggcacaaattacacaataaatctatattagagatttagcaatgcaggaatcaaaccaatgacaattttgggggtttaagttgatcgaataataagggatttaccagcagacaggtaacacaatgcaaagagatgataaacatcatgctgtttaaaactggcaatttcacaactatatgcttcccagagtgaatgccccaatcacaaaacggggcactcacaataatagaactatagaagcaacacataacagaatagtgatatagttaaatctaaacaaaacgagatcaagttaaatcaattagcgaaaggggtagggtttgtatgtatgtaccttcgaagtacatgtagacgccgtcctttcggcgccatggcttgcgctggcgaacgatgacagctggcaagaccttcttcctcagatcgggttttcccttattcacggtggccatcaccatgtcgccaacgcaggccgagggaagacggtcaaacggcct

SEQ ID NO: 4164 - DNA, 369 bp, Glycine max
gctgcgtcatgttttggtctactcaaacttagacctgccctttgtcatataaagctttttgtttctgtttaagatctcaagtacaatatgtcccttctgcatgcactacttcttcaaaataaaggctttatgcctatgtataatactctactttaattctcctttcaccatcgatattgtaatgtcaactactagtgtgggtttatctatggctataataagtttttctttgtgtttacttatgagtctttgtttttaattgcatgctaaaaattggcaaaaacatatataattctgttcgtacatgttttattttatgaacttcataagtaccggtaaagcaatgataatgtgtaaagttgcttggtc

SEQ ID NO: 4165 - DNA, 317 bp, Glycine max
aatataagaacaataatatatctccaattctatttataataaacaagtttttgtgtaaaatacactgcaattacttgtttcttataaaaattaatcggaagtggtataatataatatacgtgttttttttaataatgtgggatgatagggacacgtggaaggtatgggatagatagtagctagcattagcaagcgtagaagtcgacgagttcgttgagtgactcgggttgtgggtcggcgttatcgagcatccagagcaagtgttcgaaaaggacaacctcgcatgcgacgacattgatcgtagtagtgtcttcgtt

SEQ ID NO: 4166 - DNA, 1027 bp, Glycine max
tctggtagctttctgctttctagcaagtcaattgcaattatttcttacgcaaacttaaaagtctgcctcttcctgtttgatgcaggatctgtggaccctgcttgcattcttgaacaaattgaacttcagatttcccaagtcaaagaggaagcttttggcagaaaagagatacttgaaaaggttgagaaatggttggcagcatgcgatgaagagtcttggcttgaggagtacaacagggttagtaatttgtaacctacttcaacattgccattttgactcactttttaatcttggctacattttaacaatttaactgtgttttgttttgtttatcctccaggatgataatcgatacaatgctgggagaggtgctcatcttactcttaagcgagctgagaaagctcgtgccttggttaacaaaattccaggtatataatagttagccatatttgtcattaatttgttattaaacctttaccattagggctaaatgttataataacatcaaactgaatcacgaaccagcattatagtgggttactgattacattttatgcggagcttcttcaaaggtgccaatttggatgtgtgaagtcgtgatagttctttatagttctgattttgcttgtgagttccaaaagcaattatggagtaattagaatgctagtttagttattttcttggttgatattgtttttttcaagtcttgttcctacactacattcatcttttaacttcattcctctgccgagccatctggttctgcttgtcggatgaaacttcttttcctgccacagtgttcgtgtataattttaaaacggtctctctttttatgtatatagcaatggtagatggtctgacttcaaaaactattgcatgggagaaggaaaaaggcattgagttcacgtatgatggtgtaagtactttcttcaagaagctagtttcataatgaattttttggggtggggagtggattgaatgttagttagttagtgtcttttatttggttgttctagcaaatatgctt

SEQ ID NO: 4167 - DNA, 491 bp, Glycine max
cccaaagcaatccaaaatcccgaaaaagatattcaggtcaagggatgatgaaaaaaaacacaacgttaaacagagtatcacaacaaaacacacaaacaagaacaccctgcaaaacactactacacttgttttaagcctcatcttcctgaggttcttcctcatcttcatactcatagccctcgtcatcagcagttgcatcttggtattgctggtactcagacacaaggtcattcatgttgctctcagcttcagtgaactccatttcatccataccttctccagtataccaatgcaagaaggcctttctgcggaacatagccgtgaattgctcgctcaccctcctgaacatttcttgaatagaggtagaattgccaatgaaggttgatgccattttcaacccagttggagggatgtcacagacagtggatttcacattgttggggatccattccacgaagtacgatgagttcttgttctgaacattgatcatc

SEQ ID NO: 4168 - DNA, 877 bp, Glycine max
tctcgatcctcgatcttgagccagatacttgttgagctccatcacatggccgcgaagaggcttaatgtaatccatcaatggtgcatcgggtggtgcagccacagatccagcccatagggtgttatcgtatccgatcagtcctccaatcttcacaagctctagtaccctcttgtggtagttcaagtaattgtccttatcagcatccacgaaaacgaaatccaacgacccctttttattttcctgcaaaattgacatagtttagggtgagtttatttaaatttaaaatttaaagtaattttaaaataaatacttttatataagtttttttttttcaagaaacacataaaatttacttcttaaaataaacaaaaattatttaaaaaaaaaaactaaaacagttttaataaacacactaaaacaataaaaaaattatttgattaaaataaacatttttaacaaataaatttaaaaaaatcagtctaaattgacaaagccaatataatcaaaatatgtttttcctatttgtaaatcatcagcacaattcgttggttcgcattgaattaaatttaatctctttaaatcatattttaaattcaaatgaaattgatttaatcttcttaaataacatcttaaattgagtttgtaaatctagaaaaaagatctcattaaaacttaaaagtggtcatttaaatttttccgtaaaaattaattatcaaccaaatcgaaaaatatttcccaatgttaacaaaaaatcatggataaaacttgagatggtgagaaactgtgcacccacatctttaagcatctcgtcaagaaacggaagagcaggtccttctctgaaatcaatcttgtgagccactccagcttttgaattatg

SEQ ID NO: 4169 - DNA, 491 bp, Glycine max
ggtctatatagatggaattagattgtaaaattcagctgatccatccctctgaaaactgttagcaccaagctgtaattttgggcttgtaatatgccaaaattacataattagccagtgcagttactggtttcaaccagctgctacagcattagctctaggatttgtatccagtagttgatgcagctttgcaccagaatttggtttgttctcgcagatatcattctcattctctgcagttctatcattagctccggaattgttaactcttgataacaagttttctgtacttacaggtgcagccctcttgctgtcaatgctgctcaaagttatctcttcccttggtcccagttgagtatttatcagtttttcctgaataaaaagcaatcaagtattcaatatcacagaatacctatgaaatgtcacagtataaaggaatattatgggaacagtaccctcaatgcagaattttccatcctcatctgctcagaacc

SEQ ID NO: 4170 - DNA, 1182 bp, Glycine max
gggtgtggcgtggtatacattttactctaataatgccaaactgcagccgattagtaatagtaatgatccctcaacgaactcaactcaaatatgttgcaaaaacaagtgttactctatgcaagaaagcaaaagtaacaagttacatgtgacatgaaagtgctagcagtgatcaaactaaaatgtgttgtctccaaatccaatcatctagttggttgccaagtaaggaagcacatttgtcatgaatctgacatggtttttgatttgaaaaactttgcaacttcctgatacagattctcttcctcaaatggctttgagacatatccatccatgccacatttcatgcacttgtcgtatgtagcatggatcacatcagctgtcatggccagtataggcacatgccactcattcccattattcatctcctcatttgccttgctctccatcatccgaattcggctggttgcttcaaatctgcaaaatgtgtagcctctatttagatggtttccccaagtccatgcaagcatatcccaattttcctcacatgaactagcaccctttcttctccttagcattgaggattattaacaagtgtgcaaaccaacaacgaaaaacattaatataatatgtagcaaacttttatgaatacatatggattaaaagtataaaattccatgtattcaaactttcacatcttgccagcttggttcatcttttatggttggaacttcaggagaagaaccatatagaatgctctaagatcagtatcttattttgcaaacccactttttccttctactccatccttttttcattgtaaattaattgaggcatctaatctaaattcttaacaaccaagattaattaagaagacaaaactgtgtagtacaaaaggacaatttatatttgagcttatgttaacataatagtcaataatagcctcaatcctaagttatatatgatgcttcttgacaaataatagtgtagataagacttggtggaggctatgtcccaggctaatattaactgagtgcaacttcctagacactacaattaactggtggacactaattgcatttatcatgtgatacatgaatctacaatttcctaagtacattaagtataaatatttcaaacaaataaagcaggaaaagaacaaatagtaatcaatataaatatgcatac

SEQ ID NO: 4171 - DNA, 355 bp, Glycine max
aaaaaaggaatctgaaaaacaaaaacaccaaccgcagccaccaatcatcttcatctttccaaccaccaactcaagcacgctcaccacgaatccttcttgccagctgaatatccttgggcataatggttacacgcttggcgtgaatggcacacaggttagtgtcctcaaagagcccaacaaggtatgcctcagcagcttcttgcaatgcaagcacggcgtggctctggaaacgcagatcagtctgcaacaaaagcacagcaaaattcccttgttaacaagttcaacaacaaaacacacaaacattaaacaataatacacattacaataccttgaagtcctgagcaatttcacgaac

SEQ ID NO: 4172 - DNA, 584 bp, Glycine max
atatagccctcctaaattagctgattgtcccatcaaatgctagttaaacaaacatcaacaccacaaaattacacaagcacaaaacaaaacacccatacatataaaatatactatgtcatcatctttaatataccacacaaggctaatcaggagtcattagcagtttggctaaatcattgtatcgaatctatgttcttactcagctcctccagcttcttcatcctcaatctttcactttcactcaccaactgaagaaaataataacaatatcccacatattagaataaggaaagtaaatgtatttaaattcaaatcattcacaaccatgattgagcatgagactaactaacctccattaacttggtgattagctgtactttttccctgttcttttcattaaaagcttcaagggcgtctttgtattctttctcctgaaatgcatcaaaatcccaatttcaattgtgtccccaataacatgtcatggtccgtataattcggcactttataacatgttattcaaccgagtattgatggttttctgtgaaattcaataaacttcaccttcttctggcaagtatgaccca

SEQ ID NO: 4173 - DNA, 473 bp, Glycine max
aaactaccaaaaatatttgatgaagcactatataaggatgcattctgatattgtgacacataacacaaacacaaattacatagcctcagtaatctgagagagaaacaaaaacaatgaaggtttccattgccaagttccactcccttcccctatgttttttccttctcttggccttcaacacaaaacccctcctagcagcagaaccagagccagtggttgataagcaagggaaccctttggagccaggagtagggtactacgtgtggccactttgggctgatgaaggaggcctcacactaggccaaacaaggaacaagacatgccctctttatgttatccgtgacccttcattcattggcaccccagtttcattcttagcaccaggccttgaccatgttccaacactcactgatctaaccattgatttccctgtggtgacagtgtgtaaccagccaacagtgtggaggctccgc

SEQ ID NO: 4174 - DNA, 590 bp, Glycine max
tgttatccacctagttggggcataccaggtattatatcatatatatgatccttcaatgctacttatatatctgttgtaaagtctacatattgacgcaagaattatgatgggctcaagaacttctgagcaggcagcagtagacaagaaatgaaaaataaagagagaattgatcgaatataaacttataatgatcttgccttaattgggttgtgctttgcatctcatagaaaatctaattatatacagatttcctagacacactatcagaagattgtgactaaaatttaattaaaccataacaattacatggtgccatattaggacttgatgattagtatagtacattgtttcaaggaataatgactagtatcttatttcaaagacttgatacaacttgtgaaaactttttaccattatcatgttacagtttgtgtcagtatcatttggtttgcgttgctttaattttgaatacatttatttatgaaatgtatatattattccaggttttttcccagcccttatttgcatttgtggaaaaatggagtgcacgtaaatggccaaagagcaattttgtcaccgcagaatatgat

SEQ ID NO: 4175 - DNA, 405 bp, Glycine max
gaaccattaggcaacagcaaatcattgacttggcttaacttagtgaacttcagaaaaatctttcaaaacaaacgcaggctaataatggtttttgttccattataaaccaaactagcttgcttgatagtgaactcagaaatcaagtaaaatagcaaggggaaaaatcctgaaacggggccgttttggaagaaaaatagataacctcgacaggatttttctcctactattgaatttcagccccaagagagagagcttcttcaactctcttgaagctctgtagtaaaataatgaatgacaattattatttaaaaaaagaagaaaaaatagaatatccttcaggtaacttcgcagccaaccaatcctccattccttttactacacttctttccttgttgtcttcccgca

SEQ ID NO: 4176 - DNA, 588 bp, Glycine max
cttccctttaaaaagttgtcaagcttgtccacgtctaggcaacattttgtccccgttcatatccagtgaccaccacatcgatcaaaactcaaaagcttgcctgcaccatatgttgtaaggcttgtgtatgttaatcaccgcatcaaatatcgcattcttcataccaaagctcgcagtgcctaacaaataccacattgcaattcaacgatattcccattgtcttggatatgatatttgtttcttccctcttcaactgatcgatgcatatggcttcaggaattaggattaggaagatttgaataacttagtatatatagtctttgtgtaccaatttatatctaggttcattgtctgcatttcaactaaataaatcatgagattaattaatgattttttaataaaaagtataaaatttaactaattaaaggaaacgactaacatcattttaatcataattataaaatataataaatatttaattttgatttcgggtcagtttgataacttttgaatggttcagtttttcttttttttttctttttataaaagatttaggcttctagagataacaaatactcagcaaacgag

SEQ ID NO: 4177 - DNA, 276 bp, Glycine max
tacaagcctttgaaaggttggagaagaacgatgtgagatacaggtttgtagtggatgtcaaaggcagcaaacttgttgattagtaaaagaaagtataccagcacgacacccgcaacatccatccatcatcatcaagagtctggaaaagtttttcattgaactaaagctgtgtttgtttattaaaaagagtgctctgttttctctgttttggttacacgccgttcattaaaatatttgatatcaaattctcgtggaaagcaaaagataccaaactta

SEQ ID NO: 4178 - DNA, 335 bp, Glycine max
gagccaagatttgaagctatgaaggccacggagtcatccaacattaatttagggcccatagcaacggtctaagcctcagattgaagcattatattaattataatataatatatgtttactaagattactgctatctttatttgctatggatgctccgttatgcagcatctgtagcataatatatagttcaaaaataaagcattagcttgatatgatagtttatttgtgtaatgtatgtgatggttaagttggtggcatgtattgatgcacttcttttattagaaagtaacccgatcttagctattttataaagaactctctcccatgattcttct

SEQ ID NO: 4179 - DNA, 464 bp, Glycine max
gcatcgatccgcatatggggtagttaattaattagtttctaatactgttagtgttaggagcgttccttcgttatgataaaggaattcatgctttaattacccaatacttttgagcgaggtaggtttatttcttgaagaaaaaaaaatgtactaattaagctaactcatgttatacttatattaccattatatccattataaaaacttgaccgagtagaagaacaaatgatttgagttggtaagaaaaaagtgatctgagagctgacgtcaaccaaataaattgtacaaaaaattactagctctaatttggtagatctaaattctgcctcccacgctaattaagactatggttatattcttacacagcaatcgttagtcaaaacgattcaattatttaatacggcaattgaaattaattatcccgaaattccaacgcatatagtacgtcggtgcattgaacgcaa

SEQ ID NO: 4180 - DNA, 364 bp, Glycine max
ggggttggttgctatgacccaaaaccaaagccacttcactgtgatattataaaacatatttcaattataaaattgatgcatgccacaaggaacaagcttaaatgaggaaaaatagatggcactgccattctgatatattggccaggaatagagaaaattataaaaaattgcgtgctaccacactcatgaaagaagccagtaaatgccaaaataacaaggcgatttagcccatgcagtttggaaggtactttcagccgaagtgcatatacctttccagtacgagagtaggggaaactatatgaaatctcaaggcaatttggattattgttatcaatttaaaatttgtcaaacttctctttcacgc

SEQ ID NO: 4181 - DNA, 372 bp, Glycine max
tcagaagccgcccatagtcgctggttgtattcttcgagcttctgatgtggcaccaacgtacttctgcacagcggacacgtcttctgatcgtgatcgatccaacggtccacgcacgcgcagtggaaaatgtgcttgcagttcgccatgcaccggatttcctcttcttcggaaaactcgctcaggcacacggcgcatcccgacggaggaggatctactccggaggcgctggcgaggtcgcggaaggcggccacggggagaaactctcggatgagaagtgcggatagcgtcggctcgcgcggcggagccggcggagggaggtcggagggggaaggttcagtgtcgaggaggtcggagatgcggaggaggcggaag

SEQ ID NO: 4182 - DNA, 905 bp, Glycine max
tctacgagcaagccttagtcccttcaccctggatgataaaataggttgcaatcaggtatcaagattctatcatgttgaaagagaattttgacagcagctgtgggacccctgatataatttgcccatatgtctgtaaaatgcacaggtaaaggggtcaacccaatcatcaactgaacactccagcatttctcataggaaatattggataagacagaccataaccaaccaatgtccttacagttttcaggaaaacaaactagtactccgagataaagtcaaccacaatcaccataatgaggatcaaaaaggaattgttatccttgaataatgtcagtttgaccatgttatcctaaagtatgttttaatttataaacataaatgaaataaaatatataaacaccagactggccacatgtactaatttcaatactgtgaagtgtgaaggcttaatgatatcacttatcagagcaacatagagctagatactttccatgtgaatggattttcttagtctgtaccttgtgattttcatgaacttggcacaacggaactgcaagcaccctcatgtttgtaggcacaatgaactttctactctctggcagcttcacaaggaagactttggtacactcctacaccacaaaccaagactgtgaaactaggacatctatcagaatttgtataaacaagccattggaattatgtacctttggcttttttacattaggtggaatgaagggatacattaatgtttcaaaatcaggcctccaccacattccaaggcattcacccacctaaaccaagtaaattatagttcaaatgctcacgtgatgtgaggttgtaatgacaagtacaaaaggacaagtttaatacctcccattctgacccgtccccatcttcattcacag

SEQ ID NO: 4183 - DNA, 318 bp, Glycine max
tgcgatttctcaggagtctttcccttgatcatgtctgctactgtctggcaagtaaggtccaaaaggctcttgatgttcaagtagtttgcagcctgtataggaaattttgaaagagtgttaattgacataataaagagtaaacctaagattaaaaatatgcaaacacaggcagacaaaagtctacaatggttaacacattggaaaaaagactataagacacaatcataagcagaggagtttggatcccctgaaatcttaaaaaatcaagagacagatctaaataataatcaacactacattaaaaacaaggaaaaaaaa

SEQ ID NO: 4184 - DNA, 387 bp, Glycine max
ttcctcccattgcaactcttcacatcgaacgcataagccacgtggacttcaccatagccgcttgatccaatcaacaccagcgtcccatcaaacgccccaacgtacgacacgtttcgtatctcccccgggagggacgccatcttctgccacgtgtccccacgaagggcaatcaagtcctcgccgctgcacaagaacaccccctcgtcatcgccaccgtccacgaaggttctcggacacgtggcgcaatccaagaagtccttcacttcactccagctcctcgtggccggatcgaacgcctccgcactcttcacgaaccttccctgcgtctccgtcgggtaaccgccgacggcgacaaacctcccgccgctgaaaacgcccttgcactcg

SEQ ID NO: 4185 - DNA, 540 bp, Glycine max
ttttatcgaagtccagcacctggcgaacctccatttgtcaaggtatgtatcagtataagtattactgtatatgcacatgtaatttaaatagtgaacttcttttgaggtgttgatttacaaatcattctacagggtacatactgctaatcattaccatgtttgccaaataaattaatggataatgctaggtcatgtatttgattgtgttttttttagaattattttattaaatattttttgaaaatgagataataaattaatggtaagagtaaggtaagaagatgagataatgtaaggaagagagtgagtaagaaaattgaaagtagaaaaccaaaacaacttaaaattgttctggttattttattttaaaaactgaaagagatattacttttgaaatcaattttgaaacagaaaatagttttctagaatatgagacaaataaagtcttattcttctgtcactgtttctgtgtttcaggtgggagataaagtgcagaaggggcaggtcatttgcattattgaggctatgaaactaatgacg

SEQ ID NO: 4186 - DNA, 739 bp, Glycine max
tgttgatggagggtatgcatatatttctgtcacaatttttctttcccagataagcttaatttattttttaatagtatttatttttccttgaaggatgatacttgaaacaaatggacctcttattgctgaaaaagtgacatctcatagcttggatgctgatgcccccttgtcagagcaggtaatgcaactctgttttgacttggtgtgtgtttgggaagcaattgaacccaacgcaacatactttatgaaagctacagcatagttgatttgaaatttttgcgttggaacatgcaatttctctgttcagcgtggtttcaacgctaatccaaacacaccctagtttctgtttgtaacgtgtgctttctattggattttacaatgcaaaccgcacaaaacctgatatgtaggctattcctcaagcttatgttaccaaacccttaatggcaattttctaaaacacatttttgcgagcccaattttgaaccaattatgacttttgatggattacattttaaaataacaatggctagctattcattctgacagtgagttttgatattgcagacattaactcaagcctgggctacagccagagaacatttgacaagaacccttttaaaatgatgtttgcatacactgaaaatgagctacttatagtcgaatatccaattttttgtctgttaatgggagttgtttcatcccccattgcgagttattgtaatgagcaccataccatttt

SEQ ID NO: 4187 - DNA, 359 bp, Glycine max
atttttcgctttttttttaaaaaaaaattgattaaatcttttgccatgggaacccagattttgcgacctcaggactgcttggtagaacgaatcagggctcctccggctgacttttcccggcggaggagttccggtaattactgtaattattattactacaacaacaacaacaaccatgtcgccacttccaggtcgtgccggaagcctgttagccgacccgaccaaaggaaacgggctgctcccggttctgcccagccggtggtggcggaggccgcggcggcggtgttgaagagaccgagccgtgatgattcaagggtggccaggagccaaagtttggagatgactacgattctacgtaa

SEQ ID NO: 4188 - DNA, 396 bp, Glycine max
aacgaagttctaggtttgcatatgtgtggagacgatgctcctgaaattgtgcaggtttttagagttgctacagctgctctgtattgctttgataatgatacatgagttttcaattcacttgttatacatctgcttgatacccaggggtttgcagttgctcttaaagctcgcttgaccaaggctgactttgatgccactgtaggcattcacccaagtgccgctgaggaatttgttaccatgaggacacctactaggaagattcgaaagattgaatcgtctgaggtaagtcaatgattctcagcttgtgtctttaattgataacttgtctataaaatcctgcatttgatgatttaagtggtaatgactaataaaatacatcaactatccttacttggg

SEQ ID NO: 4189 - DNA, 417 bp, Glycine max
aaaatcaatgctcatgactcgcaaattaatatattttaatgaaacagacaaaagcaactcgatcgaatcatataattaattaattaacgagctaatgttagtgcatcaattgcttgctctcgtgtaaatcaaaaagcctccaaaactgctcccaaagcaaatatatcataatcttcagcactgcaccatgcatgttgatcatgcccttgtttgcatccacactcgtcccacctattgttcaatctctttctcctattattattctctttctccacttgtattttaatctccacttgtacttgtggtgccttgaacataacatcttcacaatcaattccactcaccaaatccatcttcacccattccttgaactccatgtttggtgattcaaaaattgccttccaaggaatctcaccc

SEQ ID NO: 4190 - DNA, 440 bp, Glycine max
gcttctctgggtatgtgcagccaggcctttggatgataacattggctgcataacacccagctctcacacattcttcaatgggcttctgcttaaccaattgcgaaagaaatcctcccacaaaagcatctcctgcaaaaacaaaagaatataagtatataacattaattttttaagtttccacacacatttaaaagagacaaaattggaatcgagcttgtcactatcatcaaaatgtaataaattggccataaacttaactgtacatatttaaatattaaaaacaataggtttatacctgctccatttgtatcaattaatttctctttaggtaatagtatcacaggatacaattttacttttccatcctcagcgacacaaacaggatctgcaccttgggtgataacagtaatccttttatgtttttctgatgctttgccaca

SEQ ID NO: 4191 - DNA, 637 bp, Glycine max
agtcgcatatttcacgaattctttgtacaagaaattcatctaacaaagctctaccagcaagctttgcatcatttagcttcagcaatcgatcattttgtgctgcactttgtctgattttcccacagttcacaatccacatacaccattcatgacgacagtccaatatcaagtgtgcttggcaaggaagtcaagaataagctgattcaccttctcgggaaactgttcttgaacaaaatgggttccctccgggataaatgtaacctccaagtttggaacaaaccattttgctttttcaccctttgttaaatcttcaatccctggaaacttcagaacataatccttgccacccattatcagaaatgccggaactttaaccacaggatctggcaagctaagcacttcacctaatgacctacaaatacaaacaaaaccaacaaacaattaacaagaactcacccagagataagaaaatttgagagttcgagagaccatgttttcattgctttgtagtaagaaacaacattttttactaaaagggcaatgacgaacaaaagctagcacctatatggaatctgcaatgcagtttggaatccagatttctcatacaaggctccgtatgttgcaagatcttcctctg

SEQ ID NO: 4192 - DNA, 385 bp, Glycine max
ctggcatttattaaaccacgtaacaattgctaactaaaaataaattcaaaagtctggagctacagaaacacacatcagagaaaacaataaggggagcgcatattcgcttatatcagtctggtgataggattctcaccacctacagcttaaactaactatcatctgagtcagcatacacagactaagtccttaaaaaagcgaatgctttcccttttctactggtacggtaaaccatcatcatctatttgaccaaggagacaaataatgcttattaacaaatcctcaaagcagcttcagcaatctctaccttcctcaatatggtaggtcttcatgataaaacgaataaaaaagaggacataaattttaataatggtgatacaacatt

SEQ ID NO: 4193 - DNA, 1378 bp, Glycine max
aataaagctacagacaattaacttattgcagcttacatcacgacatacctcagttcagtacacattagcaataaagtaggccacaataataagagaagttatcatggtagcaactgtaattacagggctcaatattgaatgcatacaatcatgataaagagcccttatttctttccacttttcttgagcccagaacctccaaagcttcccttctgttgcgccttggctttcaactcctttagcgcctgttcagtgcaagtaacaggattaagtataaataaggtcattattattagaaaagatcatagtatgtactaagttacaatacaatatctaaccttctcctcttcctttttcttctgaatgttagccacatcaatctacaaataaattgcaaggtcataaccagactcagaagttttgtttgtgtaaaaccaacaagaattaaccatatgttgatcatggtcaaaaccaaaatttcacaacaaagtgaataaacaaatacttaagaaaccattctaaaacaaaaacaggaaagataaaacaggttcggggagggtcttgcagtctccctacccaaaatgactgcctacatctcccctctgctctcaattctcaatcacttcttttccatttatataaaccaaacacccccttggctctcaaagtaaaatatttatatcccaccccttcattttagttgttacacagaccacacatgttactatcagttggacagttgttaaaagaacatcgattcctctatactcctcttaccctttctaacatagacccatatgactgtaagcttactatcatcaacataattacaatgccaaaacaattgaatcctgtcacttgaaacaaaaagaaaatgcacgaaaacaaacataacattatatctctccctttcttcctaatcctacaaaataggtacttcctagagtgaccccagttggttagttatgtttgcttctgcagaatgcaacatggaaacaatagagcaaatggacaaatagataacgagttagaaactgaaagcccgggtgaaaacctaacctgcagtgcaaacaaggggtgaaaagagagagaaagaacactgttaccaaaacctaacttgacaatttattttagataaatgcaaaattaaaattttccgattcttcaatagacattgcagcagccagaatagtagcaatataaattaaatgattttgtagtaaacctttgcaaagcttcatattgaaaacacccaataattcaaccaagcctaaagatctcaatcctgtgttatctcttccttaaacttattgccaattctaaaaccgaagtccatcaagcatggaaattctaatctttgaccacgataaataaaata

SEQ ID NO: 4194 - DNA, 349 bp, Glycine max
accttcaaggattttcatgttcccacttcttctgtttctgctgaaaattctgcattcgtgagcactcgtgtggattggaaggagaccccagaggcacacgtgttcaaggctgatattccagggctgaagaaagaggaagtgaaggttcagattgaagatgatagggttcttcagattagcggagagaggaacgttgagaaggaagacaagaacgacacgtggcatcgcgtggagcgtagcagtggtaagttcgtgagaaggttcagattgccggagaatgcaaaagtgaatgaagtgaaggcttctatggaaaatggggttctcactgtcactgttcctaaggaagagg

SEQ ID NO: 4195 - DNA, 624 bp, Glycine max
ttgaattacatacatatacaattttgctttatgcagaataaattaaggaaaacaagtgaatgtgaaccactcatcagcttgagttcattatgttgcctcattctgaaccgggatttaaacaagagcatgtgaaatgctgaggaactaactgtcttttgaactgggtagacaacacgtaatgctaaactagtaacttagctttccactgccaccacaggttgaacaggatcgaccagaagagcactttgtgcaatagctccacttctttggaagcctggtacaagtaattgagttgaatggctaaactaaaaaattaaagagaaaataggttgtgcaccgacagtgtaaaacaattttacatcatcattcaatcacaactcatcatatatggtaagtttgttgacttttatgataattaccctaagagtcatttctacggtgatttgtgattgaatgacaatgcaaagcagtgcatgatcattaaactcaaaattaaatactaaaggaaaagagaggtaagaaaatagtaccctgccgtgaatcgggtggccatattcttagcttgcactcttgccttctcagcactttcatcagaacgtttcctaagaacgaatccttcacctt

SEQ ID NO: 4196 - DNA, 398 bp, Glycine max
tgctgctgctactcttggggttacatgcagaggaggcaaatatgacaaaatcaaaatatacatattaggcaaaaaagccttttatgtttgtggttaaaccactgagagctcaaataattttttcatgcctaaagcagtctaaccttgcagaagtaatacaaaacttaaagaatcacaacttctcaagcctctctctttctagccttagcaccaatatggattgtcacgtgtccctccaaagagcttggctcatcacggattgctctcaccatggctcttgccaatggaattcagctcataagatggatttgccctcaatgtagggaatgtatcagcctgtaacttctttgatattaccaagaatttaattagctggtacatttatacaaagaataaca

SEQ ID NO: 4197 - DNA, 474 bp, Glycine max
aaaaattacatttaggatgtagaagctataactattagcttcttaaaatcacatccaaaatgtaccaccaaacatgctagtagtgaaatgagatggaagcaccatcaaagaaaacagttgctgtaagcaacatatggaaaaaaagataggaatgctgatgttagccgcgttagcttgttctgtggtaagccaacatgtgacgttcaatcctcccatatatgaggttacttaataaataaaacctcactcgactgtgcagtgtgcatcaatttgatgtgccagtataagatagtagtaactgcctcatgctgccagcaaataaacccagactacacctactggattattgaaagaccagatcattctctttctgttgtaactcctttagctgcctcttagaataggctgtgaaaaagattattgtggctacagttacgcagaaaccaactacattgaggacaatttgtggagtgg

SEQ ID NO: 4198 - DNA, 456 bp, Glycine max
ttacttatccctagaaggcttattaagttttgggctaatctaattcctagcccactttaaaaagcccagtagctgaaatcttaacaaaaggagcgtcttccctcaactccgagcgagagaagttattagggtttttgagtgcggcggtccaaacactcttctctgcagcttttgcctacaactcccttcaccatggctgaacaagtgcgcttattctccacattttctcttccttttctccatttcgtttgatcaatactcattaggcctcgtttggatcttccgttgttttttttgttttcaattgtgttttgcagaccgagaaagcttttctgaagcaaccaaaagtgtttctcaggtacgcttagtgttcgagaaaatgcttcacttttgttgtttttgttttttccattgtgatgttttgatgctgaatcgtttgttgtttttggtcccttt

SEQ ID NO: 4199 - DNA, 279 bp, Glycine max
  misc_feature (31)..(33): n is a, c, g, or t
tatcaagaagagtggtgcagaaggtattgannnccaacgtgtctgccctggtggagcttaacatgctcaaaaaccttgctggttctgctgtcgctggtgctcttggtggatttaatgctcatgctagtaacattgtttctgccatctttatagccactggccaagatccagctcaaaatgttgagagttcccattgcataaccatgatggaagccgtcaatgatgggagggaccttcacatctcagtgaccatgccctccattgaggtgacttggccca

SEQ ID NO: 4200 - DNA, 512 bp, Glycine max
ggtacacactggtctaactgcaaatatacatatatttttccaagatatttgagtttgcatgtaatggtagtaatgtagagcgaattagagagctagtagcaaggtttgaggggcttcccgcagagacaatcgttgtagacaaaggaggaggcttcgagatgatcaaaaggagagccaaggggaatcttgccacagagatggttatgactcaaatccaagtgcccaatataggaagcagaggatatggacttaggtatggccccttttaggttattatacgacaaatccagagcagtgaaataagacctcacgccgaacgcgtccggtatgtttccctccaaggcgttccggctcaggtttaagtcactgattccggaactaaacagactcaccggaatgggcccagagagtttattcatatccaagtttagtgtcgataaaaccgccattttacccagcgactccggaatgggcccagaaatctggttacgagacagatccagatccgccag

SEQ ID NO: 4201 - DNA, 554 bp, Glycine max
gtaccttaatttcttcttatctcacatggctaagtaccatttaagtgggaaaagttcttccatcactgctatagcctttctgtttatccttcttctaatcactaatacaggcaaagcaggtctctttctctctcttccatgcctctctatgcatcaatatgttttcaactttggcttcattaagggctcttacatttatgttaccatttactcgtattaataatatgtaatgaataggatgttaaatctagatatataatttttttgatttagactctttatcacatgtatcttttaaggataatgattttattcgagtgagataaaattaataaattatgtatgacaaaattttatgtttgaatatttaatgtgtaattacattctcaagattaaatataaaatctttagttaaattaaaataattttatatgagttgattcacgttttgaattgaatataatattaatacctaacttgttccatatatattttcccttacacgtcatataactatataattgctatattttattgatgtggctgaggcaaaa

SEQ ID NO: 4202 - DNA, 715 bp, Glycine max
gcccttcgctgctgcgccatcaccgtgcccttctcaaagcgattttaacctaaccgcgttctttttttcttcagaaatcgagcataaggatttgaggattgaagtattgaacaccaaatcctttatacttgtgagtttttgttgcgtcaaattcttcaattgaaaactttgttattaggaattagaatcacactgcgttcctcactgattgtgtgaccgtagtgttctacataaatttttagggccatatatcacgttgtctctcacttcggctaaatttcaccatttcacacactaaccacacttttcttttgcatctccaactccactccacccgttgccctagctgagtttcgcgttggtatacgcagtgttattgatcctattcttggggtaacaatgcaagctctatattggtcctgttgctggcatttagtgtaacaatctctgtaactctgtttggaactgtattgaggaatattgaacataaactccattgggttctccatttgtcggttctcgtgtaattatatgcgacaatttttctcattttattctctttatcttttcttcttttgtgttttgtggcccggagtgactgtccaggttgggcaagaagggagggaaaaaggagaaacacaaaaatgtttttccacatagtgctggagcgaaatatgcagctgcatccacgctactttggtcgcaaccttcgtga

SEQ ID NO: 4203 - DNA, 286 bp, Glycine max
attttttagaacaatggaggcatcaaagatgaagtttttcttggttttggtgattgccatgttggcgatggtagcaactggggtttcagctgctgaggcacctgccccaggtccttcatccgatgccaccgccttctttgtacccactgctcttgcttctctctttgttcttgcatttggccttctcttctaattaattcttcaacaacctttggttatttgttacattacatatatggaattcactttgttcagaggtggttgtgttttgtgtttcgttcttctc

SEQ ID NO: 4204 - DNA, 1220 bp, Glycine max
accagagccgtacttcttgccgaacacaagaacctgcaacttgtcataaccagcaagcacaccagcaccggcaacggcacggaggatgttggcaccggcacccttgaacaaggacttggcaccctcattcttgaggatctgtgtgaatgcatccaaggagctcttgtacttgacagcttcaccagaggtcatcatcattcttcttctaacagtgtctattgggtatgatgcaagacctgcaccattggtgatgagccatccaagggcaaagctggcaaaaaagctatcctgcaatcatcaagggaaattcattgcgttatatttcagtaaataagacaacactacataaaaacctgaagaaccttttggttgcattaacataattaagtaaaatatacatacatttagccatcacaaaatggttttatttgatgtaggtccctcaaatttaattttgaatggttgttttttgtatattttaaaattattcaagggtgaatactcaaattgatccataaaaaaaatgagatagattgatccctaatacaataaagtagcaatttaatccctcaagattataaatatgggacattttagtcaagtcaatacattcaacgaatagaaggacaaaaatatctcacttttacaaggattatttggtaactttattttcttcaggaattttaaaaacaaaattgtgtatttactcatttcttaaagtaatccatgccaccacttaacaatgacataacatacatccagttatgtcacgtcacatgcacctcaatatggttaatgacacaacagaacatgattaaatgtgacatcaatatcaccactaagtaactactacccagtgataaaaaaaaccatttcaaaatgtttaagatatgtgaaatacttccaaaacaaacaattttaaaagtctaaaatcatatataaaaaaaagaactaaagacataattaaacatcattaaaaatacactagcaacactcaacaagtataagaatttgattgaacagaatatcacatatcaattataaaggggccaaaaccaacctgcaatgaccctgtgaggacaactggtttaacagaatcatacaatccaaagtacagaccacgatacacgatgattccaacacatgagatgttgaaaccacggtagagcccggcaacaccatcagatgccaatgtcttcctgtagacatcaacgagacca

SEQ ID NO: 4205 - DNA, 319 bp, Glycine max
cacaagaatccacaaacagattgcaccctgtgcccgtgacacaaacgatataatagaggcatatccaagtaacatggaattagattttacaacagcaaaagacagtggagacaaaaagtaactgagaccagatcatgatttttcaactaaaattgtaaactagatatttcaaatctaccatggagttcctaattaacctaaaccagagttagtccttcacaccggcctcgacactgaatgattgggagtaggctgcaaattaccggggccattgaacatcggatctgaagaagctgaatgttgttgttgaatcatagaa

SEQ ID NO: 4206 - DNA, 463 bp, Glycine max
ccccaaaacttacgtataattgctctagaaaccaaacctataatgttcctcatcttcctgtactttggttgaaaggaacatttgcttattttgctgcaccattctttttctctcaaactatttcacagatcacatgtcttattttttttctactttctcaaccttttttttttcacttctattggatttttcctatatagacaaacgctattaacaaggaacagagaagggaacacaattccagcaccggccttttacagcaaaaagctcgagtgtgttgtgacgggtgaaactgcacggagaaagttgcgttttgaggtaaaatttatcagggggcattatagcaaataacctaaagttactactaacttaatttctagtattctatgactagcccacccattggggcacggtgtggaattccctttcttctcttggccgttctgtaattaacagaagttga

SEQ ID NO: 4207 - DNA, 495 bp, Glycine max
ttgcaaactgctggaagactgattgaattcgaacacatcacataaagaatgactggaccttgtttatcgtctagatgtaatttgctagttgaagggaagccaacagaccacatgtgaacaacatcagcagggaattaaatgcaaatgtggctgtgttggggcttcctgttggttctgaaccaaagacagttgatccgccaccaggatttagcatgtctggtggagttggggtcatcactggagttggtggacttggtgggctgacaaatgttggtgttggtggtggctgattagtgctgcattgataagataatatattaggatgtataggattgcatcttcattaatatagggtgaaaaagagatattggtgctgcaaattctcaccttgttgacttgggtgatgcgtatttgcaactcccactacctgccatggagttagatgttattttctatttttaaggtagagaagcatacggtaacagacatagagca

SEQ ID NO: 4208 - DNA, 576 bp, Glycine max
gattacaacttaactttcatctggacattaaattaataacaacgaaatacttaaatctaatctgaaattggcgccccaagaaaggattttcctttaaacaaaaattgacactatagtatatcctcagctattaaaaaaatgcaagagaactccagcagctgacatggggaactacatatgctaacgctcaaaaggagccacgccttggcctgtcctcagcaacactcaccttaattgcccttccgtccaaactctgaaacaaaaacaaaaaaacaaaaaatcagaatgataaaaaaaaataaacagtaaaagtagtcaatttgatatattgtttcaccctgccctcaaagcacacactagaggcaatttcaaaagctgtgatttccaatctcaaaccacttacctagagcatagcccatgacattccagttcccttccagctttcagcatatttaattattaatgcaggtaacattgaaaattttacaaagaacttaagtaatacctcgccatcaagagcagcaacggcatcattcatttctgtctcatcagacattgtgacaaagccaaagccac

SEQ ID NO: 4209 - DNA, 256 bp, Glycine max
  misc_feature (231)..(236): n is a, c, g, or t
  misc_feature (246)..(248): n is a, c, g, or t
tcgtcgaagctatcgtcacctgattcgccagcttcgcgaattgccccttcccactccctcccatgtacttcactttccccaaatgagaaaacaacggttccagacgcttcaccgtcgcttcttcccctccggcgaagatagctagggttccgttcttcgcgccgcggtctccgccggatactggggcgtcgattgagtggcagcctttggcaatgaagtacttaccggttnnnnnntgcgtcttcnnntttttttt

SEQ ID NO: 4210 - DNA, 450 bp, Glycine max
gcatatcccatgcatgaggccccatcacccccatcccgctccaaataaaaaagagacacttacaaaatatatatatatagaaggaccgatattaactttgatgatcaatagcgaaagttgtaaggtatactatgtttgaaagaacacatgcaactccagcagcagcatcagacactggcaagtgatttggatattgcagtggaaaaatctgttgatgatcttggaggagaagacaggaaaggttttggtggcatttccaaggaatccacactaccttccaacatgtcaatgactctacttatggtaggtctatgtgaaggaattgtctgaatgcaccacaaacccaccatagtcattctctttgctatctcattttcctcaccggacaatatcccatcaagtcccaaatcattgccctgctcaagcttcttataaataaccaactgcggg

SEQ ID NO: 4211 - DNA, 384 bp, Glycine max
cgaatagaaaacgcagcaacgcaaggtagagagggaaggaaagctcatacggcgagagagatatcacccaactcaagctgagcagcaatatcctcaagctgctttctcacactcatgtcaatcaatttggagccggaatacctgacagtgaaacccgcgaccaaactagggtcaagtagcgtcttaatcctcacgttcttcgtcccagtgagcttctgaacctgcttcgcgatctgcgccaggtgctgcgactccagcttcaccaccgacgtcaccaccgccagctccgtgtcggtcaaggaattgtaaaccaattcgaactcttttgcgatctcgttgatgaggtcgatcctctgcgcgtccacgaggatgtagaggaagttt

SEQ ID NO: 4212 - DNA, 276 bp, Glycine max
tgccttccaagtcaagatctttcaatgctgccatcaacctggctgcagggtggttcttcttgctgcattggattcttaccattgcatcccaaccaatgatcttcacctctaactccaaatcagcgagcttgcttgttgtcttctttggttctacgctattagatggaggcggtcctggtggtggtggcggcggtggcggtggaggagggtttttagttgcgagctcgagttccttcttggttgaatccaattgcttctccaattccgttttctctg

SEQ ID NO: 4213 - DNA, 327 bp, Glycine max
tttaatttttcatcaacaaacccgaaattttcatttgaccccgttcatacatgagctcaagtagtgtcattctcaaaaggatctgttggtaaagtggaaaaaattgaaagaaaattaaataagataatatatatatatatatatatgaacaccacgttattttactgtttattcctctattttttaccttctttttctaaagagagcggatttctgcacacacacagaaaggaaagcctacactttccacaggtcgaattaatgttgtcaacttcttctgccaccgccatcacattcgatcactggactcccataaatgttagctcc

SEQ ID NO: 4214 - DNA, 852 bp, Glycine max
ataaaatacccatatgtcaacaaacacaattacaaaaaatccaaaacattccaacattctaattttaattcccctttaggtttgaacaaggaaaaaacttttcataatcacaatcataatggtaataatagataaatagcaaacatggtctttcacaatgagcaatgagattatattaaaatatgttgatcagttgtagaaaatgcacattttgaaatattaagatagcaaaacctctcacaaggcaaacacttaccctaatggtatcatagtagctccatccaacttcagatgacaacctgcccagcacacaatacttgtgtcccttctgaagcctcaacaccctgattccaatttttatcaattagtccacattcacaagataaacaacacgtatttatccaatgtaggagtttaataggcttgccctataacataaaactttttttacacttacatcccatcacaaaccaaagcatatgataaatttatcaacatcatttctgatttgtcgctaatacgtgcttattaaactcttgacacatattgaaaactaaacgattcagaaagacagaaaaactcttacttgagtgcatcaggaacaaccattctcttggtcttgtcatatggaggagggattccttcataaaccttcaaacgagcaagagcagcttccccacgctttgtcttgtgtggtatcattctacaaaaacacaaacgagtgattatatttagacacccacaaattctaaactccctctcaacacctcttatttctctttatctatctctccctctccctgccacactacaccatcaatcaatcaaatcaaacacttatctatcctctct

SEQ ID NO: 4215 - DNA, 257 bp, Glycine max
gcggtctgcttatcttgctgagtcactcctctcaaaaaaagatggtaagatgtaaatctacacagttccgcaaatttgtacatctgatagctcatcaacaacccaccattttcattgctccgtatggcttgacgtgccgaggtaatcaagcccctcagttcgacaagccattatcttccggaagacctccctcacttggcgctccaatggatccaatccatttctgaaagcttcacaaacactcattacctccacgc

SEQ ID NO: 4216 - DNA, 689 bp, Glycine max
agaatttcctgatatccttctttttaacatggcatttctgtaacaaacaaataaataaacaattaattaaaccctaaaccaataccaaaattgagaaaaaattgtatggaaacatgtgcatgtagaaagattaaacctggttaatgagagcacaggacctagaaacaagttcaatgtcgttcccatccaaaatcaattcatctttaactttttcagatcgaacaacggaaacaccgttaagaaggtccacttttctcacctaatgatacacgtaataagcaaatcaatcactaaacctaatatcacaatttatttcctagtagcaaaagattaagaaaataaataaattaattaaaagaaatagagatgaagagagtaaagtaccttcttttcgccaaggaaatttctgatctcaatagacttgttgtcgttgccgatgcttgcgttgatgggaaaatgggcataaacgaacctcattttgtagcggtagcccttggtgacgccggtgatcagattctccacgtggctcagggcggtgcgaatggcggcggatgttttccgagaaccgaaccaggcctccaccttcagcttccttttaccgttttcgtcagtgatgagctgaaaatcgagattcaagtgcttgaagtctcgcaccaattttccgcgggggccctcaacttcgatgacct

SEQ ID NO: 4217 - DNA, 409 bp, Glycine max
aagacattaaaatataatggtagatcaatctttagcttcttgtttctgcatatagttgagctgaggtccctctgttgaaacctttatgccttcagaagttgctcgatttggttcgagtaacatgaatgaatttttcaaattcatagtatatagtttgaataacttgtagctccttcccttttgggaaacataagaagaaaagccataaccaaattgaaaacaacaatattctaccttatgttacttaaggtagttcttcaaaattcttcaataccatgtaaccacaattgccctcctcctcagggaattcaatcctcaaaaaatgtttgtcttcctgatcacccctcaatcccaccttgcagcttttgtaaaacatgcagctcacaattgtgtcaatggtgatgaaacg

SEQ ID NO: 4218 - DNA, 426 bp, Glycine max
tgaactcatcaagtatctagcagcgtaggagtataaaatataaacacaaatttattacaaacaaaacgggagatggcgcattaactttctccttgttgggatgaacagcttccaatgtaaggaaaggaatcaaaagcaacatctacccgagatccattttatcatcgttttcttggtattgaaaattgtgaactatagcactttggttccccttcaatcctgatgagaaaaacaacatgagcaaactcaagccagtaaagggaggggtaactgaaagtccccaaagtttaacaataaaaagagtggtttttggtatttgatcattccaactgtttaacatgaaccggggcgtctaatttcagaacaagatcacaactcaattcacaggataaaccagtttcagctatataccatttcctcttcata

SEQ ID NO: 4219 - DNA, 758 bp, Glycine max
gattatccaacgagggatggctctgcggttcgtaaaattcaaccatattctacaatgtatttgttcctttttttacatcatatacacctacaggcgacaggacaggacattaggggaaaatgtgacactggacaaagtaaataacagcatagcatatacatagtttttaccactgtagaaatgctaatcctcccttctttttccttattcacaataagatccgggactatatccatgtgatggacttggcagatggccatattgctgccctgcgaaagctcttcacaacggagaacataggtgaattgttctttttcttcccttgcatatctatatggacaaatttgtgtctttgtctgagtgttttgatatttatatgttgattgtttttctctgcatgctaaagtaaaatgtgatgtattgttgttcaggttgtactgcttacaacctgggaactggtcgtggaacatctgtgcttgaaatggttacagcatttgaaaaggcttctggcaaggtaaatatgtcttcctgatatactcgcgaaatgaaattttttgaatgatgtaaaaatgttaagttttatagcaatataaaccaatccctttatatatctaaacacacaaatgaatgaaatagtgtcatctgaaggcttatctttttccactggatatcaaatcttcagaaaattccagtaaaattatgtccaagaagaccgggagatgcgactgaggtttatgcatctacagagagagctgaga

SEQ ID NO: 4220 - DNA, 280 bp, Glycine max
cagcgctgtcactacgacggcggaaacaaccacagtaacagcaacgccaacggcaacaacagcagcggcgtcactacctccgacggcggcgctgcctcctcctcctcccacgcgttccgtgggtttgacctgaaccttccggctccgctgacggagttctggtcgccggcggggtttgatttcggaaagaagaaggttggcgttgaacaagaggtggaaagcccgttgccggtaaccgccaagaggccgcgtttgttttcgggggaagataatgaagagg

SEQ ID NO: 4221 - DNA, 345 bp, Glycine max
taaatgaacaaccatgcattaaatctctctctctctctctctcacacacacacacacatatatatatctatatgtaccaagtgaaaaggaatggctcatcaagattattgaagacattgataactagattgttgttgctggtggaattgatattgggtcctggaaattggccattgatgaaaatgccttgttggggtatacccaatggagagatggtgccgtaagtaacattccatgtaaagtagagataagggtcttcaccccggaccaccgtcaataatgattcgatccataggcatgacaataccagtaacattacccttttcatctcgcttgatctcgacc

SEQ ID NO: 4222 - DNA, 939 bp, Glycine max
ggttttcctcagaaccactacaaactaagaagtagctttcccaataacagtcttcacttaagaggaataaacctggatgagtgagtagcaccaataccaggtctcccgtgcttaacgggtttgtatgaaatagaaaactcagcaagataatgcccaatcatctcaggtttgatttcaacctgattaaaggttttgccattgtacactccaataatgctaccaatcatctcaggcacaataatcatgttgcggaggtgggtgcgtactggttctggcttctcacctggtggagcttcccttttctgtgaccaaacaaaaaggatatgattgttaaacagagaagctaattcctacaattaaacttcacagaaaacaaatatctataatccatctcaaacaacagaatacaacttgtcatcgagtaagtgaaaaatgaacgaattaacagatattcacggtaataagtattaacaaaaacaccggaagaaattaagagagcgcttggtttcatggtgggactcatgaaaattgactttgaccgaaatcaaatttgatattataaaaatataggtgtttgattattgctaggtaaattcgattttatctcaaaaccttggttcaactagaaatcatataaaaaaaaacgtaactattttattgtgttaagaaatttacaataagttttatagccctaaatttcagggtaaaagcatccaaaacaaatcagttcactagacaatcaattttacaaagccaaactttaccgtcatctggggccaacacactaaattaaacatagaacataatacctaaggaattgacgcttgacaaagcataattggaagcagaaaatacgaaggataaaagaggatagaaaagagtaccgctttacggagcttcttgatcaaggccatgggctttctagtgaggcctctctgg

SEQ ID NO: 4223 - DNA, 335 bp, Glycine max
  misc_feature (330)..(332): n is a, c, g, or t
agaaggaaaatacagagagagattcaaacaaggaaaaaaaaccaattatccaaattctatataaccgtctccacccccaccaaaaaaaaaactataagcctctcagaattaattaacttccctatatacaaaaatcaaatcaatttccaagcctcaactcaaaatatatagcactagtcttgagcttgatatctttcaagatgctgaggattggtgctgatggagttgttgttggctactgtgaacaaatgggtggaacctgggtttgccaaaggggaatccaatgggtttggagggtgagtcattgttgttattgttattacctgtttnnncac

SEQ ID NO: 4224 - DNA, 739 bp, Glycine max
aacataacaaatgagttaaaatcaacattctttggttgcaatttcttcctgctgttttatggcggaaattagggaaaatttgtttctgcaaagaactaaccaggacaagaaaaatttccagagcattcaagcagatgcggccaaaggcacagatctgtagcatgctctctttgcagcacgaacaatatcttcaacctgtacatccgcatttaccaggaagcaatcagatttaaatgaaggatagacatgtaccaaaaccttgaacaaattagcatctagctctttatcaagatacaaaactcatctcttacaaaaccatcatgtcagggcatttcacccattcaaaatagaaatacatttctggatcaaaataatgaaaaaatatcttccaaatcatgctgacaaagtcacagaaaacaattaatatttaagaatcattacctgtgggacagccattctttccagatttgctgcatatggcatgggaacatcagccccggcaattctctcaaccggtgcatcaagataaccaaaactctcctcaatgacagatgtgctgtgcaagagaagtacacactcatgattgccaagagttaaccagtaagatacattcatacaaaaacaaatcaatgtaaagagataaaccagatttcagcgccaacgccatgctgaggaaacccttcttcaactgtcaccagcctgttggttttcctgacagaagtattgattgtgggatcgg

SEQ ID NO: 4225 - DNA, 485 bp, Glycine max
cctttttttattacacaaattataacactgaagaccattttctttcatttgagtaaactatattacatattttccaacataattccttaatcaccaccgccttgaccgtaaccctcaccatggccatagccctcaccatgaccatagcctgagccaccgccaccgccaccaccaccgcctccgccaccgccaccgccacctccccttccttgacttcttccagatcctgatccggcacgagagccagcatatgaaccggcttcggagccagctccggagccgccagagccagaactggaagatgaggaagctgaacttgaggcagaactggaactagaaccagaaccagaaccagaaccagaccctgctccggcaccagctccagagccactgccacctcctatccccaggcccaaacccagtccaagtccaacccccaacccaccaaggtccaggcccaagtccttccttgccactctactctc

SEQ ID NO: 4226 - DNA, 1045 bp, Glycine max
tttgtggctctctcaaaatgaagccaaaaatatgcgccgccggtagatgcttttctccatcagaagcactcacgaatatacaaacactataatagtgaatgaaagaaaaatgatctaatgatatctacagcccaacctgccagaaaaagaaataaacaaaatggaattagcatctctcaagggcaaaccaacacaacgagaaatatgaacataacatgtaagcaatctgacatttacactcgaagtgttcaacattgcaacacgaactgacattatttccaagcaaccatctacaatactaccccaattgtccccggtaaatgaaaaatatctgacagtatttacaacaaagtacaagctttttacagcaaattgttttatttcgccaaaaaaaaaaaccatagacgtagccaattgaaaaaccatatataacaaaatgttcttcctctagaggaaaattttgactttaataagtactccaaggtgctatgcgttagaatgcatgacagatataatatagttggaaacttggacataagacaagaaataaaaagctatcattaatatataggataaaaaatggcatctttggtaataattaaagacgaagttggtaagcaatgaaaagctatttaagaattacttaagctgaaaaaggatcaattccaagcagcagaacaccaccttacggattgaagagactggatcccccaacattgagagcaattagtagtgatatgctagtaatcacagcaagccaaagtaaagctgaccctgcaattggaagttttaattgtcatcatgaaacacaaaatgctttttaaatcttataaaccttcagataatacataacaaatattatagaatattcaattaaagatcacaatataatgatacctccagagccttcggaattatcagaactagagggaattggttcaacattgggaacttgagaatttgacactctagatccaacatttgagccattatccaaaactttgctaaaccctgtttcagatgctactatcccctgaaatctcgc

SEQ ID NO: 4227 - DNA, 217 bp, Glycine max
ctcgttctcgggattcgtagggatgcctccttctctgatattcgcactgcctaccgcaaactcgctatggtaaactataactaaacaaccatacatcaccgtttcattcttttcctattcttgattagttcctgaaattttttaaaattatgtttgttttgcgcccggctgagaagaggtggcacccggacaagtgggctcagaatcctgaatccgg

SEQ ID NO: 4228 - DNA, 275 bp, Glycine max
tatgttgatgaccaccctccacttaaacagcaaaactcctttccttaaagacacatctacagtaatggcagagagcagtaactacaaacaggcagataaatgaaattataaaaaataatctggagtcttgcgtgtggtgtcaggctcaatttgcctgggcgctggatcaaactgaaggaaattctgatccatattctctcctatttctagtatagcagccatattcccacatcggtaacagtaatttggtgcactaaatacagtcaccacatttt

SEQ ID NO: 4229 - DNA, 487 bp, Glycine max
aagttcataaaactacaaaatcaagtcttatacagatataaataaccagcacaaaaataaaacctacaatatccataaagtaaacttaaaggtaaagaaccacaaaatttaaccaaatcatattgagaatgtccctctaatcgaacaagccaaatcccatatcatcatcactctcttcttcaggttcctcctatagaatagaaacacacagattcatattagatacacattaactagcataaagcaggattgaaaaacaattggaggaacaacaaattcactagcgggaaaccttctttttctcctcagcagctggggcggcagcagcagcaccaccaccacctgaggcagcaacaggggcagctgctgcaacagcaactggtgcaccaccgcctgctgcattggctatcaaatcgccaagatttttcttctcagcaagtttagcaaataaggttggccaataggtatctacttgaacctttgcggc

SEQ ID NO: 4230 - DNA, 300 bp, Glycine max
cttcctttttttgcagcaggatactgtaataaagaaaccaacactaaaacaatgcaatgccctttatgaatttaatgaatgtattgcaagagttttgttagcttctcaattgtatagaattttgacacttttgggttttgaaagcttacagatgaacaagatgtgaaccaaacaccaacttatttttgtccatatttgtacctcttcatcaggaatggccaacagtgagcacaaggcccagaatgaatttactgtcgaatggttgaccatcaattaccttccttcttcatgctggcaaaa

SEQ ID NO: 4231 - DNA, 374 bp, Glycine max
ggtgctgatgttacaaaggggctaggatcttgtcgtcagctctgatgagaaacacgtcaatttgttacttatggaatagaacttattcttcctggaagcatttcaaaccctgctgtttggaggcattgggagaaccccatcaaagaaatcaccaaaatagccacgaggctcgtgtactagccttgagatgatatctctgagtgtgattagtccttccagattcccgtcattgtcagcaacgtagaccctatgaatcttctcatggtcaagcagttgaatcaattctttgattgtgcaatccttattgcatgtaatcaggtcacctgacattggaaaggccccttcatgcttctctaagtagcttctaatggctg

SEQ ID NO: 4232 - DNA, 795 bp, Glycine max
gacggaacatatagcaaggatgatccttattgttgttatcttcatggtagcagattataggatataatatgatttgaagagctagcatgaataacatcagctacaatttttatttgacaagaacaggcttttccatggtaccggcaaacttctgcttctcagaaagagcttctgctgatgacaacaccgacactgggctcacttctacttctgagtcgtcttccttagggagtgatcttccactccaacgtacgagatctttgatggtggtttggaggtcattatctttgatcagtgattccaaagtcacatgcacacctgacaacagtccaaagcacacttagatcataattttccaaaaggtggttcaataatcaatagtaatagattatctagcgtagttaactgagacaaagcttaagactcacggtatctccaatagtgcttcggattcgtagggtcgttgattgtctcctctgttgcagggcgtgttgtatattcttctttcaatgctaacaagtcctgtatttatggtcaaccacattaggagcatgagtttcatgtgcagagaaacagctaaaatgaatttggtccagatagccataaactgaagtttttttcaccgttaaaataacatgtctgtgagaatacctgaagagggaagattgcccacattgatggggcttcaaaatgctgtcttagaacaaaatgtacaacttctggaacacattgatcgggcggcaactcatcggactccatcacattcttgaaaaacctgagtcttctttcttcatc

SEQ ID NO: 4233 - DNA, 823 bp, Glycine max
tgctatcacaacgacaaacatatgattaagcattaactcaacactatctagctacccttgacattatttgatttgattcaaactacggacttgataattccatcaaccttagaagcttctatgaaaacaatgtcgaaggcctcatgctcagtgagattcaaacgtcttcctccctcaccatttttggcatcaaaccttccaatatctaaacatgtgcctgagccagtgatacagaacacaagtttgtatccaaatttatatttctgaatgctaaatgtgccactaaatgtttgttgaccaggatgaccttcaggaccaccaatacccacacatgccttttggatttcattgtccacaaacgccacccatttggaggattcagcacaatatggtttctctgcgaactcgatttcaagtggagtacctacatggatatatagatattttccaaaaacaaagacattcaattaattaaagggctcaacatactactagaaaatattaacattaaaattagtcacaaacaattttcttttaaaaaattgtcaatacaacttgacgacctcaaaattagcaaggaaaaactatattctatcactaaatttagttttttttaataaaaaaaaatcactaaatttagttaccacttggttggtagttgagaaggaggatttaaggaaagaagatatggtgagttcgaatatttccactaatattttaacaaaaactagtaattaacattaattaattaataaaaaaaattagctacccgttcattattttttagtagtggtgaaaaaaatgataaaaaaaattaattagt

SEQ ID NO: 4234 - DNA, 870 bp, Glycine max
acccaatccgatcattcactcttgcatcaccaggaatcccacattccagtccaccattgattatgttagtcaccaaaccataacccgctgttcggtttgctgctatgtcatcttctgtcggcacatatatcccaaccatcacattgtggcatgaaggttttggcttttgctctgtcatccaaaaccacatagcagttttgaaggctatcacagaattgttcgccacaatctctgggttcctcagcccatcaaatcccaaagccttccctgctggaccatagttgtagttcctgcacaaaatcttaccctagttattaaacaactcaactgcttctcttatacattaagtaacattcacaattataattgcatgtgcatgtttttctttatataatatatgatgtgagggggtgagtttttttttattgcaagtgataaagtaattaatatatattcatatttaagactcaaattcaagattaattgttaaatcagaacaagaataaataggtaaattagccttgaaaaatgtaatgtgatgataaattgattcttaaaaaataaaaaaaaaatataaatttaatttttaaatgtgtaaaaaatatgataaattaatcatgtagttaaatttataaaattattttgtcatcaaattgtaatacttaagaatcaatttaatattaaattatatttttttagaaaaaaaatatattaagttatataatttaggaatcaattagtcattaattatatgcaaaattaaattatttaaatttaaatttcacacttttaaggatcaatttaattatttaagttataataataaataagaattaagaataaaccaaagaagcaatgatcatacatacc

SEQ ID NO: 4235 - DNA, 379 bp, Glycine max
acacatatagcatttgatttgaagtattcattcactaattgattagccttagaaattcaaatgatataatctgaccactcagagataaaggaagtatggtccatggactccccaggaacatcctcgtgcttagagggcttctccttcccaccaaccaacctggctgggttcccaacagctgttgtctgtggtggcacatcgattaaaaccaccgagccagcaccaacctttgcaccttccccgatcttaatattccccagaatggtagcaccggcaccaataagcaccccatccccaatcttgggatgccggtccccaccaaccttgccagtcccacccagcgtaacgtggtgcaggatcgacacattgttcccgatca

SEQ ID NO: 4236 - DNA, 274 bp, Glycine max
ccagtttacaagcctcctatagagaagccaccagtgtacaagccaccagtgtacaaaccaccagtgtacaaaccaccggtgtacaagccccctgttaagaaacctcctatttacaaaccaccttacccaaagtaccctccaggctccaactgaagacacccacctgattttgaattaagttaagggatgtattaagtatatgctaaataagaggtgtatctacaaccattgactttgtcatgctcaaaaatttagtttaatttacaaattatgg

SEQ ID NO: 4237 - DNA, 415 bp, Glycine max
atcttcatcagtctcatattatcagattcatgaaccctcaaaaaggtggtaactgaacattctgcatattgagtggtaagttgaagaagggaagtcctgaagaagggtcagggaaagggttattgttgttgtttccttgagatgacgtcgttgcgggtgactgaatctgaagctgttgttgttgttgttgttgttgttcatcttcttctaaggggagcctctcgtaagccacgttggtgaacgatgctgcgatgacgattactggccctgccgcggttaattctcccacgacgtttcctccgacgacctggccctgcccgccggcgaggtagattgtgagactggtggctcccggcggagccggcggcgggaggaacgagccggagagagagagaatctcgaaccttccgtgcag

SEQ ID NO: 4238 - DNA, 391 bp, Glycine max
acacacgcacacatattcatattgcatgttcatgatgcttaattaattctaactatttctaatgtataatttgtgcatgatgcagttacgttcagaagggtcatcttgggatgagatagattttgagttcctgggaaatctgagtggtgatccttacatagttcatactaatgtgtacacacaaggcaagggtaatagggagcaacaattttatctttggtttgacccaactgcagattttcacacctattcctttctctggaatcctacacatgttgtgtgagtttatcaaatctaatctatataccatataatgatataaatataacattgaactgaaaattagaatattcaatattcaatactcaatgcatggaatcttttatttcgc

SEQ ID NO: 4239 - DNA, 431 bp, Glycine max
ataaagagtaagaaaagaaaaaaataaaggggattgccacaatcatatgatcatgtggtgaagtctaaaatgaccttggctttgccacaatggtggaatgcttgagtatgtgcaagctaaactgccctcctttctcactagtgtcaatctgggactggccagggggaggcaagagctcaaagttttggaccaaacgtcccaaagtgatggcaagaataggcaatgcaagaatgattccggggcaactccttctgccaaccccaaagggaaggtacctaaagtcattgccattggcttccacatgcaattcctcctccaagaacctctctggccggaactcctctggcttcttccagtgtgcagggttgttggccagccaccatgcattcaccaatatcttgctctctgctgggatgtcatagccaccaagc

SEQ ID NO: 4240 - DNA, 550 bp, Glycine max
caaaagattacagaagaaaaggaacattctcttctcaactatatcctatttgttgctgttgctgaggtggttggtaaccaggataccccggataactgccatacatgttgggatcctgtccagcagcaggagcatacccataattttcataaccttgtgcagcatacccatagtatccaccaccagaaccagcaccaccattccactggtttggatctgcctgagcctgagaaacagagcattcaaaattcaaactcattaaaaagaatcagaaacatattgaaatcaagtgcagagatgcaacactataactacctgtttgtttgaaggactgcggccccatgaaagacgaacattttgaccacccaacagggtcccattcaacacccgaagtgcctcttcggcacagctcctgttgcatgaaaaatcaagacacagtaagagagctgcctagactagtgttatcacacaaggtgaatgttcaataaaggagaggttacattacctgtctgcgaattggacaaacccacatcgcttgcctgctggaacg

SEQ ID NO: 4241 - DNA, 380 bp, Glycine max
  misc_feature (374)..(374): n is a, c, g, or t
tgcattgcggaccacacgatatttttgacacaaacagataacactaatagtaataatacacataacagagaaaagttaccacactaattaaactaaaatccccaaacgagaaagagcaaaagaaattatcaacgcagaaacatgtttgcggtggccataatcggttgtatgggatgaggaatctgccagggcttgaggagaggatctggaatctcgggaatctcaacggataatccctcgacctcttcagcgatctcaaggatggagttcaagaagcgcaatcgatcggccagttccattgtctgagccctcagaatgctgttcgcggcttcggtctccacgcatgcttcttcctttgcctttatgttctcgcncagccg

SEQ ID NO: 4242 - DNA, 485 bp, Glycine max
ctcaatctaggtacatatatatatgacttaaagagagaaggaggtaattaaccaagtaaggggaagctactgcttaattactacacatacttatatatagacagtgtgaaaatacactgcaagctccaccatatgctaatagaaatgggttaagtgcatgtttcattctgtttatcttgaaaaaataactattttttttaaatcctagaaatgtatactactaaaaattaataaatcagtgatcaaatttagtgatagaaaattacttttccttcaccagttaatttcgggatcactaaattttagtaacggaatttttttttaaacatatatagatcattccgttactaattttaatttttctagtagtaacataaaatataaaaccattatttttcctagataaaataaatcaaaacatgcactaggtttttagtaagttcatggcacttgtttgccagggaatgatggtagtaggtcttgca

SEQ ID NO: 4243 - DNA, 275 bp, Glycine max
cggttgggaagagagagcaatgtaataaagaccatcatagcatcgtctctctgagcaaagtaagcacagcagcaccgcttagcagttacagtgtccgttcccttcgtcgttggcaaaatggctgccggcacaactctatcaaaattgcaagtcacctatgcttccgctccctcgttcctctcgaatgcctcccttcctcctcccactccgccggctgcggcgggggcgacggctcgtacctcgacggcctccgtttgaagtgccgctcgtcgcca

SEQ ID NO: 4244 - DNA, 436 bp, Glycine max
ccaaaacttcccctggcaatttgcaacttgagacataaacaaacttacaatgccacaatgtcaaataatcaatttacatttcagtgcctcttctgttcttcacagccacgctttgatctattcatttattgtatctatgtgacttaaaataccaattcctttttttttctcaacaggcactatttgatggatcacaggttgctgcctcttgtctttttggactcttttctagcatttgacttacttgattggccagttttactcttccccatgtttcctacgggtggaaactcacaatacaaatcctcattgcaaacaagattctcagaagagtttgtcaaactgccaggttctcctccagttgagttgttttggagtgattcaggggaacggtctaaggcagttttctctaaaacaaagttttcttgagcctccc

SEQ ID NO: 4245 - DNA, 360 bp, Glycine max
atatgaaccctaacgaatactaatttataaaaagaaacaaacaaatccccagaacaattaacaagagcgaaatagaacaagagaatggtgaactagaacaatggcggcggtgcataaccgatgaagggtcttcctccgccggcggcggcgccgccgcaagaatcgcagaaactgacagtgtctttgatcttgtggaatccatgcttgaacactccgaacccgaataacaacccgatggcgatcaccaccagaaccaaacacgtgcaaagcatgcaaactctccccccgcagcacatcgttcaccggcgatcgatgaagacgccaaagttttaatctttcctactgggtgtctgggatctg

SEQ ID NO: 4246 - DNA, 690 bp, Glycine max
aaaaaaacttgaatcatcattatcttcaccattcatcaattcaaacaacatcatcatcatcatcaccatctccaaaacatttcttcttcatgcttcttaaaagggcttccttcttcccccttcttgtggatccgctcaattgatttttttttctttctttccatcatatcattcattcagaatcactttccatgcttcccatagccttcaaccctcttggtctctgcatccaaaaaaaaagaaaatatataagccgtgtggtatatatacatgcaaacacacaagctatatagaaatttagatctaagtcacaaaaggtaaagtaaaaagcccacaacacaaaaccaccaaccacgtaccttcttgttacttttcttctccctaacttcatatctctcttggcacatatcagtcaaccacgccccgggactcaccaactgtaaccaaaaacaaacaaagacaagataaggtggtgagaataaagatcaacccaaccccaacccaaatcacccaccaaaattaaccccctttttttactataaataaaaacataaaatacccttttttaattaagagagagagagaaacaaaaaacaacttacaagtaagcttctttgaatgattttggccctctttttgggtcgctgaggaagcttgcaacccttcatggccagaaaatcttcctctttc

SEQ ID NO: 4247 - DNA, 464 bp, Glycine max
cttgcatttatggcgtcatcgcttgcttgaagacacaaaatttcagtaccatagtccaaccaagtctattctactatccatcattgtctgccacatcttcccttagtactagaaatgaggctacaacaactcaacttgttctttctgttgctttgtgttgccaaagcaaacgggtctctgctcccattcatggatcctcctccaatcactctcttggctgatctctggtccgatcgcttcccagacccgtttcgcgtgctggaacatattccgtttggggttgacaaagatgaagcatccatggccatgtcacctgctagagtggactggaaggagaccccagaggggcatgttataatgctggacgtgccggggctgaagagagaagagataaaggtagaggtggaagagaatagggtgctgagagtgagtggtgaaaggaagaaggaggaggagaagaaggg

SEQ ID NO: 4248 - DNA, 395 bp, Glycine max
gctcatgaaaccctaactactactagacaatgcaacatgcattgggattatcatcgctgaacatggatgtgatgtttacattgtcgttctggtaatctccactgtagtgttctatacaattgtaatgtgtttgtctggatggtgatctgacgtattcatattcagtgacgattgacgaaggcacgtgtgtgttatagctgtgtgtcacatacatgggtcgggatgactcttgtagaaatacagggccattatggtatctgtgccagtgttcaacatggttgcggccagaactgaatctgttaacgttgttaggcagatgatagtattgcttcacatgaacctgttctaattcttcaattcctgtgttgttctgccactgccggcttgtcttgtgc

SEQ ID NO: 4249 - DNA, 702 bp, Glycine max
aaaatgtcgtcataacaatataattggctacttcaaaagtattgtctcaaaacaattaacattaatcaaaaccagaactataaatatcaaaccagtccctgttccaaatccaacaacacgaaggatgagaccaacaatatcacacagaattcacttgatcttcttcttaggcctcaactgcaagaaggaaacaacgttcaaacccaatcaaatttttaaccattaagcaaaataataaaaatgataaaatttaacatcaaatgtaaacccacctggttactatgaccgcactttttcttgcggcagttcacagccctaggatgcagacgggcgtagcacctaacaaaccaaaaccaacacacctcaataaaaagcaagcagcggcttaacacaaacaaatagcaataaaaaaatatccaatacaaaacacaaaaaataaattaagcttaagtaaaccctaaaccctaatcaataataattaggaacaaaactagaatgtaccaaccatagaaaatcaactgcgagtaaacaatcacagtagacaaagtagagatggacatgaatatagggagcaagaataacccctttttccactcgagaagcaaaaggggctaagttattgtcccataaaagatgatataaaaaacaaaagacgatagagtgcatacttgcggcaaatcatcttgtcctggttgtatttgc

SEQ ID NO: 4250 - DNA, 385 bp, Glycine max
tactaacaagagtaattaagaagtatcttgagcaacaaacacaaacagaagaaaattgataactgaactcacagagtcagagttcaaagagccacggcaactcctaggtcaccaccgccatgaaggttccagaaaacgttgcctgcgtcatcggacttgccggtgtcaatagcaacagcgccaaagattgctcggaaggcgccgcaaacgacggcgggggcggaggaatttgtcttgggcgagacgcgaaccaccttgtgcaaccctaatcgcgttccgtcgacggcgcaggaggaatcgacgttggtgatttgggacaatcgacggttcagctctttggaagaaagatcaacgtctctggagagcagatggaaagagacggaac

SEQ ID NO: 4251 - DNA, 506 bp, Glycine max
tattttccttttctgccattgtatcaacacaagccttttgttcccatttacatgtcttgtgtatcttgattatcatcaccccctctgttggatcctccttgatcagttccaaacgtcctcttgctcatgttagttcgctgcactaatcgaaccagcgcttgaaccacttctgacataggtggtcggaattccggctccggctgccccaaaagtaaaattagaataaatgataatgcatgtaaatgctgttcatccccaagggtgccacaaggcttgaacttagcacttgggaattattgtgtagaaattcaaatagacgcccaaaacaagtaagtgatttactgcctattcactgaaacaataaaatttaagatgaaacacgactgacattacctgaacgcatagagcaataacatccgcaaatcgagaaagggacttcacagggtatagtccttccaatgcaggatcaaccattttagccaaagcatcgatatcatggagttgag

SEQ ID NO: 4252 - DNA, 469 bp, Glycine max
attaaaccacgatggtgattttctaacgtcataaaaggatcattaaagagcaataggtttgttagtgtaattgtatatgtagtaattcgggtagtaataaaactgcaactctttaaatccacaattaccattgtgaaattacagaaagaatgaccagttgcaacatgacacttaaaatgacttaaccaaagtcaacaggccacagatcgtacataatacacttaaataattgaaatgaaaggagcaacaaaatataacaattgcagataagaatattgttttctaagattataatttaatgtgtactaaaatcagatatatagttacctgatattctggttcctcagtgattcagtagcaggttgaatgccatcatatctcctcatggcgtcttggaccatgtttttagacactttatacgtatgatgccctttcaaatcgctttgaacttctgccgatggattcacaa

SEQ ID NO: 4253 - DNA, 421 bp, Glycine max
atctaaagatgtgcgactatagtataatacattaatactagacctattattacaagactcagagctggctttatttttcatcacaacacatattcacttatatagataccatataatattatagtctcttggatccacttccaagatgaatttagttaggacacataataatgtcaaaggtggtgttggtgtggcagttgttctgccaccaagatgtagaaaagccccattactccactgtgcatttcgctgttgctgtagataatctctagagttagggtttcaccatcttttattttgatagtacctggtcgagggtaacatgtggacattcctacaacataccctttctcatttcctgcttcacttccagtaccatattttggtattgaagaacaaataactcccccatcctcgcaca

SEQ ID NO: 4254 - DNA, 954 bp, Glycine max
tgataaggcccttcagctgccctttcaaccggcgttttgcaggtttcacattatgattcaggcttaggttcaataaccaattaaagatgagggtttgagtttctcaggatagtctcagctatgaaatacacccttcaagcttccctcagctcaattttattcgttttacttagcttgtttatttgaccaaaggatacctttttgaaatttgcagctggtaggaactgatcattgtgcctttaattccacccaaaaagctcgtggaatcgatgacttccggaaaatgcctaatggtgtcaatggtaatcacatgaaagtcttggatatttgtggcctaaatgcattcttgctgattttgaaatgtttccttactgatatacaatgcaacctgtaggtattgaagaaagaatgcatttggtatgggatatcatggtggtaagatgtcaacttccagcttagccctccctttctgtttaggtcggggtaaaatggtgaagagggtaaccttttagctagaacttatggtttatatatctcacaggaatctggccaaatatctgtcactgactatgtcaggataacaagcactgaatggtatatattcagttaatcaaagtgcaaattagcttctagttcttatggaaataaaaaagctttttggtaaagatgccaaaagtattactgatgttttttatttctacaatcatttcagtgctaaaatcttcaatatatatccaaggaaaggagctgttctcccaggatctgatgcagatattatcatcctgaatccaaattcgagctttgagatgagtgcaaagtctcaccactccagactggacacaaatgtctacgagggaagaagaggaaaggtaccggtttaactataatctgttcattatatgattgtttgtgtattgttcaacaattgaaggcttgtcattcaatatcaagatc

SEQ ID NO: 4255 - DNA, 796 bp, Glycine max
ctttgttttgcaaatgcaaatcttgtagaggaaaggtatctgctatctaccattacccttgggttttaattaatttactatttgcttgttttatgcatgggtattgaaaaatttgatgaaaacttgagtacacattatattgaaaaggattgagagatgggtgaacaatgcaaaagctaaggatggcaaaggaggagaaaacaccttcatacacgtcattattgatgcctcaagtgagtctcccattaaagcattaattaacctaagttatcaacatatgatcttgcatcaaatttttatttccctcataatgcctaaaatattagtttattatttctattaaaaatgtcaagttagaaaaattcgaactttcaactttttcttcctcaatttttcctttattatttttaaccactagatcaatcttatatttcttttttaataacattataggtcttacaaatattgacactgtgggaattgcttctctggtggagctcaacaaaaatttgatttccagtggagtaaaggtgatcatttttatttattttgtgttaatttcttttaatcttgcttgcaattgacaaatcaattttacaccttctatttttacccaaaaagattgacatcaattcctcctttccctttctttcagttagctatcgctaaccctaggtggcatgtaattcacaagctaagattagctaacttcgtgagcaaaattggaggaagggttttcctttctgtaggagaagcagtagatgcatgtgttggcactaaaatggttgctgtataa

SEQ ID NO: 4256 - DNA, 1180 bp, Glycine max
tctgtgttttctacagcaatggctatgagatcgtgggtgagtcgaggaggatccatgactcgtttgatggactcaacaaatcgaggggctttgagtcggttcttgagcgacaagggtcgcattctcagcgaggaggaacaggccaaagagaatgtctacatccagaaatgggagagggagaggttggagaaacagaagcaactgtctgagaaggccaaggctctcacggacaaagatgcttctgctgctgctcataaggtacactatctgccaccattgactcttttcattttcaggaattccatcttgtaaagtaatgctcgggatgatgttcaaacatattatgattcgttttcgtaatttcacatcattggtgcatgttagatttctgagattcttgtccaggtttaagattttctttttacaaaaacactcaatttacttgccgttcatgtgaatcatcacatgacttgaagcttgttcttccttttctgttttgtggggaggagggactacccagagtgtatacctcgttgtttcgcaattaggctcattttccatataatgaacaattgatttgagatcatttgcataatctctttgatactctattaggctcatcattatatcttacacggaatgagttcaggccttacattcgtctctctttatttttgctatcaattcaatgcgatgttcaaacaaattgcattgtaattctttctttctgaatctgaaatgctgattgctgatacgattctgttctttaatattttgtttttgcatttgtgcatttttttggctatcaaactcaatttactgtgatccaaaggggatctcttaccgatgagtgctaccatatgccacacatgtgcatagcagtggtggtggggtggttatctaccatgatttgcatttacttaataacactagcccctggggctggggcaattggaatactccatcaagttgatgccttgtccatactttatatgaattatatgatctggctttgaaatgaggggcctagatttacttatattgcatctgttttctagcaacttggtggcattgatattttattgcggatcttatgttactctccttttccttctaccacaatttaacacttttttctttcttttgtttgtagaaacctgaaggtgctcaaaaggactga

SEQ ID NO: 4257 - DNA, 378 bp, Glycine max
gcagccattgatctctgttctctctttcgtaactctatcttctgcacagtgtttcattttctaccttcaagcagcctctgttggcaagtggcaacctttttttacaacttttacctcaatgagcagtgttcaacacaaccgtgcaacatattaaacaaaaatttctgaaagcggtttccaattttcccatgtttcttctatctcagctccactgttctggacagtaccattgcagggtcggtgcttgttcatcggagaagaaattgcaggcctcatcggcgctcaagaaattgtgctcctccgtcttcacgtactgcgcgtgatgatacggtttctggaactgaaaacagttcatcgaagacggcaagtacatggtgt

SEQ ID NO: 4258 - DNA, 523 bp, Glycine max
gagatacaaggggagcatcatggtgaacacagtactgaatacaaaggagagcatcatgttggtgagcacaagccggagcaccatggaggagaagagcacaaagaggggttcctagacaagatcaaggacaagatccacggcgaggagggtggcgccaccgctgagggcgagaagaagaagaagaagaaggagaagaagaagcatgaacatggccatgacagcagcagcagcagtgacagtgattagattatctcccactgctgcatcacctatatatcttataaggtatacttttgttttgcattgttatgttatgctctatccaaattctccaaatttttctattacaacatgggtgatgaatcacgaaatttatgatcttattttcttctatcacacttgagctaacaaatcaaattatgcattttggcacaatggcacccctgctcgttgagatctcatttttagcctaatataaccgactgaagattttatattcatggaatattcgtcaaactttctt

SEQ ID NO: 4259 - DNA, 251 bp, Glycine max
tgatataatacaattagtccaaacattgaagcgtaaagctatatatccaaagcagacatcttacgaagaagaaaaaaatacccgcttaaacatatccattattaactttaattttttttttccaaatttgtatatagccatcctaaaagctaaaaaatttcatacaatgtaataagaatctatagctgctaccacaatgtatactctacactcaataacccgcaaagatggcaattcttcgcatatgcaaa

SEQ ID NO: 4260 - DNA, 429 bp, Glycine max
  misc_feature (419)..(420): n is a, c, g, or t
ttgaactacagaactcagctgacacctaaagctgatacctaggtcagcaactatattattgcacgatatttctagcagcacttttgacctgaacagttgattgcatgtttcatccagtggaaaagaattaaaagactagataactgagctcaagctatctctgattctgttctttggtttccatctccttcacactgtccactatgtgttgtattttctttgaaagactatcattgtgctcttcaatttgctcaaatatcaattcaagatgccttttataggttgcagatcgctttctctctatagccaactgctgggatagttctcgaattttatcatgttcattctggaaattgcataaaacaaagatgtaagcatgggaaaaactgaaaattcaacaagatgatcttcacattttnntcaagcccg

SEQ ID NO: 4261 - DNA, 272 bp, Glycine max
tatacccatctcaattcttctttttatagatactagctagggttttgttttttagggttcccgaattttgatttgtttttcggcaataatcaatggtttgtaacgattatgcttcttttaattcttcgagttagacaataatagcgtaaaattttcgttttttattgtttcaggtgtgttttatgcatgatatattactatgatctgggaatgggatgaggcgccaaatgtaattttgacttgcgaaagtccctatgatttgaataatgtac

SEQ ID NO: 4262 - DNA, 528 bp, Glycine max
tagcatactcatatttacagtttacgcgttataaatacgaggtaaacagaaaattcaaatagtattcacagcaactgccactgaagatctatacatgatgcatccatactagactagaatgtctcctctgcctttaggaaattgtaatattcaagttgggtcatctctccaccagctgcagaatcaaactgacatcgatagaagctgcattaacaatttcaaggaagattcgcatcaaatttctaaaaagagcaagtcaaagacaaggaagtagtgattattttggtatacaataatatattgataggattaaagtttatcgttggacaatgcaaatgccctcatttaaaccattttatttatttttaagatataaattttcccaaaactggcatcatttatcagttatatcataaattataagcatacgaaaaagttgtaaataaaaacaaaaaatgatgcatctagtcgtctggtgccaatattgaagaagcatcttaatcttggacctttaaaaaagaaaaaaaa

SEQ ID NO: 4263 - DNA, 409 bp, Glycine max
agcaaatcatctctggaaattgtccgacaagccacgagttgatttttttaaaataaataaaaaggcttagcaaatacttgtttttgtttgatattatgaagccaatagtgcttctaactttgcaatctggtcatcctcattcttaggaataggatccttgttaacctcttgatacaaatcatgtttccacttctccattcgtgtcttaataggacgataaccttgctttccattaaatttatctcttcccctgtaattgttattgcctccactgcccccataccttgctcttgatgaaaaaccatcccttctagcttcaatcttattgggtgctctgccctctgcattttgcttctcaggtctatccagatgatgaggattgctgcttctttcatccttcctttcccca

SEQ ID NO: 4264 - DNA, 547 bp, Glycine max
tttagatatattaagagaaaaatattaaaaatatacttactaacacactcttctcaaaaaaatgttgataagtattttaaggatactaattaaagaatcaaaagtggaaatacttttgttggagtgcactcttttataatttcaaatacggcttcaatagaataatcataaaagttttctattaatttcttattcgatttgataaaggtttagcaaaacaaaaaatcaatttaataagaatattgattaacaagatctagatttcataagggatgttaaaaaataatattatcactacttattattcaataaaatttattgacaattacaatattttattaagcacactatctattaagatcggtatcatattaatagtccaatattatcaacatatgttatttttctttaatactctcttttctatcacatcacattacttgtgatatgtatatttttcttctttgtctctgagtgttaattaacattagtctactaataatctttttccttctggtaattcaggatcagggccattaggtgatgt

SEQ ID NO: 4265 - DNA, 405 bp, Glycine max
caaatatcagtgacatccatttggcaactgtgcctataatcctagcttccacggtaagtgctgaatgagaatggtgaaagcaggagaggaacatggaaatgttcccttttttgtgactccttgatttcaaacactagagacacataaggaaagaaaccatttgggatgtacttcccagtgttgaaacttatcctgtatatccctggattcacatcatcaactatgctcaacagttgaccactacgaccatctaaatcggtcgttgaagacccttggaacacccaactgccaccgcctgaggccccaaatgtcggtcgagactgagtgcccctccacacctccagaagtacctcgataccagcagctggagagccctgagaaacatccaacacatgagtcgtaatg

SEQ ID NO: 4266 - DNA, 363 bp, Glycine max
acccttttattctaaacaaacttgatacttaaaaaggctttttttttatcacaacaggttatgtatccaagtattgttactaaaacacaagtataactaaatttgattctttagtgttgctgcccagcagtggaaattatgaaacagttgttgctgttatataatttacaacacagaaaagaaaatccatatcagagtaatcaccaaatgcggttaagtttagacttctgacggaattgctttttcgttgtacaccacgggccaggaaaggtgctcaactgtacataagagaacaatcagtcttgagtggcacaaactatcttgtaacagacaatcaagttgagacaagattattaaaaaaaa

SEQ ID NO: 4267 - DNA, 743 bp, Glycine max
atgtatgtcattttttttctcctttaagctataatttgacatctaaacaaggtcggccataaaatttcgtgaacttcttctgcaaaaactggtcttcggctttaaaaccctcttcacctaagataggtcgatgaaacccataatagaacatatgttatcagtgatgagatcacttcaaatgcccttggtcccttaagtatggtaataggaggaattactgacaccatcaagaaggttcccaacagccacgaaataccaaatgctccaaccctgcaacaaagcatcatgtcatataagtaaaagcctaaagaaaaaaaccactaatgcaacaaattctaaagaaagggcacaatgataatatgatattaacatccgaatgtaacaccatgggaatgtgatgcttttaaatgaaaaataacaaatcacgatctaacactatatattctaaacatatttgaaagaataagacgcattgtatgtacccatatagcgaagctcgtatgttgctcttcagccgttcatggataaaatatattgtggcgatcagagatattgctacctgaagagttggcccttcttcagttggaaagaggacagtcaaaactccaagtaccaagaatgctattgaagtttttataatgaattttgtagatggagtttgaaatctgcctctgacagcctgcacaaatttggattgattgacttccctcatttttttcttaatgtcaatttttgggtttttt

SEQ ID NO: 4268 - DNA, 409 bp, Glycine max
gaatgaacctgccattgctaccagtgtggatgtttcagtcaattcaatagagcctaaaattatccccgcacaacctttagttgcttcaggttcagaggagagtgatgaggcaaagcccaaggatggtccaaatcgatgcagcaactgcaataagcgggttggtttgacaggatttaattgtcgatgtggtaaccttttctgttctgtacatcgctactcagacaagcataattgcccatttgattaccacactgctgcaagggatgccatagctaaagcgaatccggctgtcaaggttgagaaacttgataagatctagatttgttgtctttaagtttcatgccctgagatgctgttatgctcattgtcgtcgtcatgatgagatgatcctcctgcatattttaatggt

SEQ ID NO: 4269 - DNA, 549 bp, Glycine max
tttctttctctttctaattaactttgcacgaaatttaatttgtttctgtgaaatggggtcggaagattgtagtaccagatgcgaattattgtttttaaaccgtgtgtgtgtaactgcagaaaccaggggaaatggaggctcagatggctgaagttggcactgagtatgttctcgaaaacatccttacaactcgcaatcctggtcctccaattcttcccaagggaaggtttcaattcaatccagaaatgcccaacaccttgccctcttggctcacagaagaagatctcgcctattatgtctccaaatttgagaaaaccggattcactggacccttgaactactacagaaatttcaacttgtaatttcttgattctccgtatttgcccgggataattgttttccactgctctaagttaatgtttctttcttgggaaaatatttgttcaacatgacgggatcccaataaaaaaagaccattaattaattaattattgtatgtatttgcagaaattgggagttgacggcaccatggacaggagggcaaatcgg

SEQ ID NO: 4270 - DNA, 374 bp, Glycine max
atatttacacataattagaggagattaaatttcccctaaatcaaatcatatcaaatcaatttataataaatgagctttccaaaaaaaatatataataaatgacatatttattcctgatcctcgacacacccctcaagctaaagcttcctaagttgagagagcttgttccaaataaggtaaccctagagaaacgaaagacggttctcgccatgtggttgtgccggatcaatgatggcttgacagcagccaacaaaggcccacaatgataatggagaccagtgtgactcttgtcagagatgcgtcacgctttgtgtgcgtgaactatacacgctgaaaaagggccctgcatggggtcacatgcagcggtgttttga

SEQ ID NO: 4271 - DNA, 823 bp, Glycine max
tatctattttctttttgtttgttatttgatgaaacaatctgcaaacacaagctctataacagtcattaataacaacttgctgacttagtaatacttttttttcatttttgtgcagcatgcttactaccttgattttcaggtgatatgttgttgcaagcattatatacttaatagaagagctgctaacacactctaacattctctttccaataactctagtatctgttaaaatttatgtggacctcactaattcagaaatgagatccacatatttagtgagacccatatgaattttatccaacaaaagaatgtgccccaaaaagggtgccaaagagtgtgttactagcacttttcataccgttattagcacttttcataccgttattagcgagagttgtgtccaatagataaatttaattatgaattgagacttttttgttatctttccagaaccggcgtcctgattatatatcagtgttcatggataagcttgtttcctgggatgcagtgagctctagacttgaacaagctaaggctttaattaccagtgcatgatgctgaattaaatgcagaataagtgatttatcctgatagtgatgatgaattggatggcgtcatgcggaatagtgaattatttttatctagaaagtgtaagcaggcacatcttttgtactttaaataggtgttgtggtatcagggctaaatctcttcatcctgcagattattatgttctatggttagaaatcttagttatggttctctttgtgtgacaatgtgaacaataagattgcttatgcatgaataatcaacaaaataatactat

SEQ ID NO: 4272 - DNA, 346 bp, Glycine max
accgaatacggcgctgattttcaccttccccacaaatcctttttcagtttttccctatatccccctggtaaccccgctaccctttttctgaatttgatttgctttataggcaaaaaacatgatgaggcctaccaggtattccattaaaaactttaggtacattgacaagtaaaacatactatgactatggtttaaacaaattaagtacatagtattagcaaattaaccgcattatacaggaagcgtctctggcaaggattcgggggctccgctgctaccattgagcacaatcacattaccatcagaatcaacatccactataacagagtcgccctccttgacgcac

SEQ ID NO: 4273 - DNA, 580 bp, Glycine max
atttcttgggaacctctacattcagtgaatacactgttgtccatgctggatgtgttgcaaagatcaaccctgctgctccacttgacaaagtttgtgttctcagttgtggaatttgcacaggtatggaagatttacaaccttgacaattgtgatagttgtatattgtttgcatgtagcaaactagctagctgattatattttctgatgtattatattttattccatcttgtaggttttggtgctactgtaaatgtagcaaaaccaaaacctggttcctctgttgccatatttggacttggagctgttggccttgcggtatgttattggttgctcgtttttagtgatttgtttagcaactgataaatgctaatatagaggaaagctaagtcccactcttatttttcattcaatattttaggctgctgaaggtgcaagagtttcaggtgcttcaagaatcattggagttgatttagtttctgcccgatttgaagaaggtataatgcattcttcttcgatcagttgtttaaagattcaatgcagcctaattaaattgcatttggtttgttgatggtggcttatg

SEQ ID NO: 4274 - DNA, 384 bp, Glycine max
atcaagtgggtcgagggagaactgctccaacttaatggcaaggtaaattagtagtcagatgtgttgcattctttttctctcaatgtactagcatgattattggtctcaatcaatagacatttttttggtagaatttctgttgacattttttctgttctgctgttgtcatatttaagggcatgggaccatacatgaaaggtgcagatcttggtttcctttatgtcgtgcctgagcaaagttttctcgtcttgttccaccggttgaaactacccgagtgagccatggttgatggtaccctaatcctgtctaatttacttatcatctgatgcgaggaagaacatgaaggattctgatactagcgtgttgagattactgttacctttt

SEQ ID NO: 4275 - DNA, 1373 bp, Glycine max
ctgcaggcaaaaagccttaggctactactagaaattaaagaaaaataaatggaaattcccagagttaactttcaatcagtgataactttaattagtctgtaaatgcattcagcctccttcccattaattatacagtttccttccagaaccgaactgacctatcagttccacaggaaataaaagcagactctattggtgagtgttcaagccagcggggtgcaccaacatgattagaaggccactttgctactttttctgttgtcatcgcatcccagataacgatctgcaatgtacaccagattcctcaaataaaatcaatctatttgataaagcaaacatcgccacagtaaacatggagaacaagaaagtggatgaacaaacctcattgctcagttcatctatggatagaataaattcttctgtctcattaaaaatagcctgcaaaagagagttcacacatagaggtgattagagatttggataaaggtgcttctgtgataaactgctttccaatgtacccaacaaaatatgtatgagtatcaattaatatcttttttttatttttatttctgatgatatttacaaacaacaaatcaataattacttttgtactgtgattgtgaacaataaattaaggagtaaattacactaactacccctgctgaggttttatgaaattatacaaacaccccttgtttttttctactcctacattgaccacccctttatttttgaaaaatatacaggcacccttttatacattacacattgttggaaaagtattgcatcagactccctaaagggaggttattgcagatgttaaaaaagcaagggtgtctgtgtaattttacaaaaattcaggggaggttagtgcaatttaatctaaattaagagaagcaatgttaatcctgcctaggttagctttgctattcttagccggtcccaagcccggataaaaggagagggttgtgttaggctttcgacagccaacgttaaactttgtcgaatctctatgacatggatcaattacgtaataatgtgaatgataggtcgttgcccggaagcaacgcgctgtatggctcgagtacagtgtcaaaagaacttaatgatttggatagaagtatggtacttgatagaacattatggcggaagttgatccatgtagccgaccccacctagtgggataaggcgttgttgttgttgttgttgtaagagaagcaatgttaattaactaataaaaagatgagcacaaacatctgagtgcaagttaaaaatacaagcatctgcatcactaataccagaaggtttgcttatcagcatatgaattgaccaagattaatttactcaatagactgtattacatatcaatcatc

SEQ ID NO: 4276 - DNA, 456 bp, Glycine max
tgttctgccttttccacggctcttggcgctgtgaattagaaataaacaattttatgtaagataagataataattttctttgaacataggataagtgagtatggtgactaaccaagaccgattgcctcggagcctttcattatgcgaagacgcttgcatgattcaacgaacatcctgtgaaattgtcaaaaaaaggtagtattaaataggttgataattaaagaaagaaaaggaaatgaatgaatgaaggggcactgactcccagggcacatcaccgacgagcatccagtctccgtccttgtcttcatatgtgggtacatagtcagagccattggtctcattcataaagtccttcatcccttgggacccacacttttcaatcgtgaaggaactgaacatcttagccagcgcatctgacagctcctggtagctcttgtacaactttatgtccaccttt

SEQ ID NO: 4277 - DNA, 911 bp, Glycine max
ctgtcttcctttagagcatctatagaccatgattttcagagacattacaagaccagtaaaaaaattgtagcaagataaaagcagggcaaatcgaaaagaaagaagtccaatgaaaattagggacagagttactcaagctgaaggaacaggaacatccttgacagattcacgccatgcgtactctcttgcaccatccttgtccacaattttaataacaaagttcggtggtgcaacaacgagcctggatctgatctccataatgcacttatcaacgagatcaactgcttcttcaactgacattccactatggtagtgtctgtccatcattgacagtgaaaaataggagccataaccaaaagcccccttttcaagcttgtgaagcgttgcaatgtagtcaatatagtatagttcagggcccgtctctttgtcataaccagcaagaaggatgttcacagagtatgggttctgtagaaaaaagcaaatgaatatttgaggcaccaaatgaatcattaaccaactaatggatggtctagggactgtttggagaatatgaattgctctaatagagctaaattggagcaaatgcataaattgattttagcttctcaatttgttttcctaaaagtgagaaaggagatgatatatgggagatagggtttagaagataccttgcggagagcagtggcgagttcgccacgcgtgaaattggcggcggcggcggtggtaagagggatgccgttacggaactgatacaaggcgacgttcttctgaatgtactctgtgaactgaaccctaaaacagaacggaaaggaacgggatcagaggattggaagagagtaggagagaagaaaccctaaccctagatagtagatacctgtctccgggctcgccgctagcggcaatgagtttgt

SEQ ID NO: 4278 - DNA, 394 bp, Glycine max
agaaaattactattttgtaatttgtatgtgataaagtgcccatcttgatgtatgtacttcttcacttctttgtatgtgtccctagtttgagtgtaatctaaaacattttgaagtgattaaggtgccaagatgtgactatgattgtgttgggtgaaggaacatggtttcatggttgtgttgttgcctttgtgatccgtgagatgaaatgagatgagatgtcagaaaacatgtatcctaggttgttgttttttgaccatacccattcgaagatggcatgggttaagcatcaaatccagcaaaaagatggttacttgagctactcaccaccccttttgtcttcttcttcttcttcttcttcttcttcttcttcttcttcacccccttaccctcttgg

SEQ ID NO: 4279 - DNA, 412 bp, Glycine max
aatttcatcccaattagattaatcgaccgtttatgataagcccctattgcacgagtggttgattgccacgtgtccctaacactgtgttgaagctcgttgcaaacagacacgcggcaattacgtgtaagacgattagtccaataatcctcagaaacttgccacgcgtactgcactgacacgtgtgcaaaagatagcgccgcacctaaatctatttatttggtagcatgcggtgtgctgttgaaagaagaaagaacctaagtgagaaacaaagaaaggaaataattgatctttgaaaatgcagggaggaaagaaagctggagagtccatcaaggaaacagctgcaaacattggtgcttctgccaaggctggcatggagaaaaccaaggccactgtccaggagaaggtattacat

SEQ ID NO: 4280 - DNA, 464 bp, Glycine max
  misc_feature (9)..(9): n is a, c, g, or t
cccattttnttcctaacagtgcactatcaaaacatggtacaaccaaaaatttgacaaacagtgcacccaatagggtgtttagaatccaaattaatccctaattcaatccgacccaattatattaacttgaatcttttaaatgtttggatcaaactttcaatttaattataccatagtatccaactgtaaatcggtgttatttatccaaataatgtgttcataagaatatttatgtacaaattatttgcactaatcatttatttcatttcagtactaatcatttacttcctaacagaatagatcaaaacatggcacaatcaagaatttgatgggataatttataaatttgtaacgttaaaatagcacaaaaatactgcatccaataggatgttcagaatccaaattaatccctaattcaatccgacccaattatattaacttgaatcttctaaatgtttgggggc

SEQ ID NO: 4281 - DNA, 527 bp, Glycine max
taaacactctcttcccttcacttctacattatgtctttcgtatctatgtttgttcttaaatgtgaatttggtgaagagggcaacttagagggaaaattgtggatttataatcattgattggaaaattaacaattgagactttgatacatttggactctgtttggataaacttcttcatacgtacttatagagaagaaaatgaacttagcttatcctgtaagctaaaatcaactctgcaatctaatttctccaaaacctgagatgcataagttgattttagtttaatccattttacctttttaatttcttcctcaagtgtttttgaagaagttcatccaaacatcactagaatgtgtaaacttgttaaaatcttctcctgtgacacacatattggtctcatctttttggcttcaacaaggttgcccttgatagttcctccaatgctacttctcctcctatgaaagccaaatcaaaggaggaaccacccgcaaagcctttagcagaaccatcttcttcagtgttggcaa

SEQ ID NO: 4282 - DNA, 256 bp, Glycine max
tgaaactattttgaaagaaattatccaacacattccacctgcaaggttacatccttgattccagcattacgtaacagatgcaaaacctgcgacttggcggatgtcttgtctgtatctgttgacacgtgaagatgcatcgtaccaactacatctgtgtttgtgaagttccaggaatgaaacttttgaatgccataaacaccccttatcttcgaaacattaattaaggcatccttcagctcatgctcatgcgcccttg

SEQ ID NO: 4283 - DNA, 299 bp, Glycine max
aactttctgtggttggtcatgtatgctttaaatagagaattatgttttggaagataaactccacaagataggttctcattcttgcatgttctttatcttcccccatgggtttcctgagtcatcaacaccatgttgtcagcaagggagtagctttgaatggaaatagaaattccaactattgctaacccccatcagttttccttttcacatgcaatgtctgtttctggaaactcaactatatttagtgtttctactcaagagtaactacaaagatgactccttcaagattcttaactgtg

SEQ ID NO: 4284 - DNA, 791 bp, Glycine max
tttatgaaccttaacacagttaatataaactttaaaaagttctcaaaccaaagtgatttttctttttctttctgttatccattttacatatggacttgtagagagaaacaaaagcaagggagagaccaaacaaggccatagtgtacaccatgtcactggtctcaccacttaactaagccaagaatgaattgccttctatacagcatcacaagttggatgagataaagcccttcatcttcacctgcaataaatgaacctcatatgagacttgagagaaattcaactaaaccttagtatagaacaacaacaacaacaacaaaaccttagtatacaacaacagcagcaaaaccttatcctactaggttaggtcagttaaatggatcacatgacaccattcaattcaattaaatatcgaagtttcaactaaaccaaattatgtataaacaatttttttctagtacctaactcttgctgtatggctgagggaagtgttatttgaaatccccattagggtccctctctttaccaaagcagtttccctcctttttcccatttgcttgtgaacggtatagtgctgtaagaccatttccattatggtaacctatagtgaaactctgctctgtgtgcatgtgctgaactgtggcttgtgaaacatttgatgagcctagattcaaattgttggtgaacaaaagttgagtgttaggcaagtttgttgaggcgtttgcacgagtattgttgcctttgtctgaagtggaattagaattgttattttcaagcttctttgtgttgag

SEQ ID NO: 4285 - DNA, 333 bp, Glycine max
ataacaaaattattggttcttaaaatagcctttaaattgtcaagccaagggcaaataatttttcacagggagttgggacatttaccttatactgtagtacttacttttcattcattattcatttattggtcacattgcaataatgaaatgaggggaaagaaataagctttgaatatttcatgactttttcagattgtggtgggttgtgcaagacgaggtgcagtgcacattcgaggcccaacttgtgcactagggcgtgtggcacgtgctgtgtgaggtgcaagtgtgtcccacctggtacatctggaaataggaactatgtggaacctgcta

SEQ ID NO: 4286 - DNA, 799 bp, Glycine max
catgcttcacttgtactcgagaatcatgttattctctggggccaatccaacacaagccctcattatgttttccagcattgcacgctgctttgacaatgcattcaccactggtgtacccggtggaacctgtgagagtactgttgtgagtaaccttgccaacttttgataaaaaaaaatcataaggacaaaaaagggaaattcactgaacaacaatgatttaacttcacaattggaacaattttatctcgatactaaaattcagaggatatgtttctttcaacttaattcctatatagaaataaggatatgtactcatcaatcatcattgaataagattagattaaactcaccagaggagccttggtgaggtagctgaggatggtagcaactgggtggaatgagtggaattttccctgcagcaatcaccacaacatagtgacctcagaaggctgaaaaaaatacaatgactaatacaatcaagcaatgaaattatttagcaatgcatacagacctcattttcagctttaaactcgattctagtgctgagctcagcaagaaggaccaagtccaagataataggagcagctaagagggaatcctcgcatgtgttgtgcaaaacaatggtgctctttccacccatgaatatctctgaagtgtactcatccatggctctcttgctgtcccctacgtaaggcacatactgcaaaggcaacaaagcagatagaataatcaaagccctgacaagagaaagaaacagaaaaatgggtgaaacaaaatttaccttaataacaacaacatg

SEQ ID NO: 4287 - DNA, 1331 bp, Glycine max
gccctgcgtgatggacgatttttgtggtagagatgtcctctgccacgtaaacccctattgcttttcccagcagaagtgaggccacgcagttccctgtgtttatggactggattgcagagccagttgattcttggatcatttcttacagcagtgtgggcaacatccaccagaatgacctcaaaatatttgtaagtggagtcctgcaacaacacataacaatagaatcagaccaacaaagtcagcaactcataaccaggttttcaacaatgtgatgttaacatacctcattcacccagtatgaattgagaaccctgaggccacccaacttccttccggctctctcctcggcaacagacctcttgctgcgttgaaatttcagttgagtaacaccttggttggtgggcttaccataaacaataccctttggaactggtctcttacggccaccccttcgtacgcgaacacggtaaatcacgtaaccctggaatgttataagaatataatcataatcaagattcaagtgaagcaaggtgcaactcaattattcattactgacaaggtttgtttcatcataattctgatatagccatgcagctgtcacattttcacaaaaatttaaatagtacaggagctactgatagacagctcgttctactgtggctgttctgaggaagcatccgatcaatttatacataagcaatttccaaaagagaacatacatatgctactggagaccacttaaccacataattcaactacacattactgacaagggtttacaaattaaacaggatgggaactacatactatgattactgctttggtgaaaaactgtaccagtctgttacaataacaaatttggtaaaaagtaaattttcttgggctaatgatggacagcttgttctactgtagcaggtcttgggtagcttccaattctttgtaattatgcaatttccaaaagaaaaaagacatgattctggacaccacttagccagcaccctattttcttccactctcatgccaacttacccaactcaattaatgcattattgacaatcaattgtgtcacaatttcacaaagaattagaaagaaataaaaaggagttacacacaactcccactgcttcagatgttggggattggggcaaaatcatagagctaagaatgacatttatttattggtaaacacttccaacaaattttcaccacttttttttacagaaaaccgttagaaaatacaacactcgtaaaaccaaatggagatagaattatcaggtgaataaacctcaaaaatcatgtcaaacaaataaaatttcctcacctgcttagcc

SEQ ID NO: 4288 - DNA, 577 bp, Glycine max
gctgaatgtgtttcttgagtgaatttctagagttcaagataacccttagattaccaccatggtgcttttttgtcctgcatgcggtggtagtataagacctaaagtgacttgcgaaaaggatgggtgtaagaattacttgaagaattagagttgaacctgtgttcttatcaggcattagatgattcaataagatattagcttcattaaacttcatttatagtaggatttacgataagaacatcccttgtatccatatatttgcaatcagtcccattctgtagaatcatggaaagagtttaatcctaaacttaagctttgaagacaaactttggaataaaatggttttcacttgagtaggagcagaaaggaatatatatgcattgcaatttttgcaagaaacaaaaggaaaatgatttagaagtgataattgtagaaaatatcttaccacacatttctaagtttaagcatataggatcaatattacaaaatgatgaggaagttaatgaacaagtcacacgcaagatataagctgggtggttaagatagagaaaggcttctgttgtagaccgccttgccg

SEQ ID NO: 4289 - DNA, 740 bp, Glycine max
atacccccaaccattttgtcaggggacttataaatacaaattcaacaagactttgtttcccaccggttatacctgaagatcaagaacagcttcccctgcaatgagaaatgacacagtcatcaaccctaatataatcaatgtcccacaagatagcaacaacttttgcagctacttaaagtttcagtgtttttctctccaagagaagtacacctcttaaaactgacattaatactcgtttcgtgttcaattatttataaaatgattccaatcagataaaaagactagtgctaggtggatcaaagaacactatcagtgggatcgaataatggaatccaaagttcaatatgatattagtacagttgctgaaccatgcctctgaaagaaatttgggtcttcagggttttgttgattacccatttaccctactgagtgtgggactgtggagtaagaaggttccagatgacacgtgagcattcattcaatcaaggccagataaagggatgattttctttccttaatagatattttcataaatcaattagaggctaaagatacatttaaaattttcttcatcaacttaccatgcattcttttgacaaatctttcaaactctatgaagttttgtcgttccatgagaagtgaactaagcctcaggtaagtaaaagatgaaaagtgccttccatctggatcattcatgggcttggcattatccaaaaccttgttatagccaactctgttta

SEQ ID NO: 4290 - DNA, 249 bp, Glycine max
ccatcaaggattcagctaattagttaagtagggtgtgcgagtctttgttgtaaatcatgatacttgtttttgatttctacggataaaaacccaagaatcccacacttttcaccttgtgaggataggaaaccaacgttcttggaaagaagactggtaagagaccatgaagagaagaagaacaagaaccaacccaacaccccaaggagttccacctgctctgtgcagtgactctctctctggcaaaggaat

SEQ ID NO: 4291 - DNA, 312 bp, Glycine max
acatgattaattacccgtgacttctaaaacaacagagatgactcccttctcaatcaatcaacagcattgttttacctctccccattccaaatccaattatcatgaactaatcactccactccatcttcaaaactcccaaataaagcctgacctgagaggagataagtgtaattaaccccatgaaaatatgggtcgaagttatgaccatatcaaacaattctcaactcaaggtttggatatccagctcgagctttgtgtcgttcaaatagatcttgaagtgcttcaacaaactggctatgtattttggcaacc

SEQ ID NO: 4292 - DNA, 334 bp, Glycine max
cttcaatgactccgataagatcattcacatagactaaaagatccaacaatagcaaaacagctacaggtgcaatagtccggcgtctccagaatttttcatgaagaacatagcttattcctgcaagagagcataattaaaaaaagtcacagtatgtacaagataccatgttgactaaaaagttggtcattttgttactacattctttaagacaaacattacttacatccccatttgaatttcgaggggaagggcttcgagaagcatcagggcgaccgcgtggtgagacactgcgaggggtaggagaacgcccatcgcggctacgatttgcaggact

SEQ ID NO: 4293 - DNA, 970 bp, Glycine max
cctaaatcaaaagatggaggatttatgcatcgggaattgtatgtccttgtttatgtttatgtttggcctttaaacgaacagagacctggtaaccatagagacaaatacgcagatgaccctgaagcatcggttgatagaaataattcttgaaaaggtcccagaattcatctctgccagtcagtagtaacgttaataaatttatgcaaaatcatagaagagagacgacgagattgaattgcttgcgaagaagagcaaacctgacttgtggaagggtcaacaaggaatagccctttacatcaggatgcagatcaagcacaagtacttgcaaccttgaaaggtctaacgcctcagcatcaattagcttctttatcctgaaatgaaagtttgatatacgacaatatttaaaaaaaagtatatggttagtaagtaaaaggatatgggatgaccaaccaaccaacctgcttggtgtgccgctagcaatgttaacacggttttttaacaaagaaatctgcattaatcataaaggacaacgtttcatgaagaacaacatatttatttatttaaattctttcagggttcaaggataaagggaattgaaactttaaaaatcacagctcctatgtacgtatggaaattaaacttgctttattggatgataataatattttgaaatttttaatcttaaaagttaaaatgtgtgagctctcagccttgtgcctacaaatttttctcttgtttcacaaccggacgggaccataggaatttgcataaggaggaattaacaagaggaatgtattagaactagaattgaaaataagacacattaacttgtttctcgtgtacaaagatgtttgacctaaatcacaatcaacacatttacttgaatttcaaattgctaagaaatgaagggaattgatccgtaggtaattaattaatgtacctgctcctcaagcttcatatgcttgagaat

SEQ ID NO: 4294 - DNA, 720 bp, Glycine max
catttggtctgttagtttttgcttcagagggtttgcaagagtatacatcagttttcttcagaatattcagacaccaacacaaatatttggtgctcttgtgcagtgatcaaagcaggttcgttttgtttgtgttctctagttatttccatcaactcaacttctctccaaactcttctgatatacaaacgcatgacaggtcttccttaaacaaagacaatgatttgaccagttatggaacttttgtggacgtcgaccctcttcatgagaagctatcattgagaaccttggtaagttccaacatttatgcacaaaaatattatttgtaaacaaataactttaatgcttccatctttcctacaagattttttttcattgattcatgtgttttaagaaaaataattaacttaattcatactattcttttaagattatccttcattttttttcatttaattgtttctcacccaattaattaattaatgttgtttcttctgttgtccaatcctaataagagaaagtatataattaattaaaaatattatagaaaacaaatgattaatacactaaataattaaaagagtattttataaaaataaaataaaatagaaaggttgttatgtacaaacggaggtagtagtattgatggagataaaaacaaaaagcattatgagtgaatattagaagtcagagctataagatttctcatccttagtttttttt

SEQ ID NO: 4295 - DNA, 487 bp, Glycine max
tctctacctataaccacattctctctaccaggcgcaaaataagagaagggactcgcaacaaattcggactgccaagatatagggaggaaaatcaatttaagaaacattaaaaaacaacatgaaacccactttcacattaggacattctcgaacaccaacaaaactcaactacataaatgacattctgcataaatacttctactgctgcttgcactctggaggtcgctcaccctgctggccatcaccaagttgtgctcttccactcttctgaagatttacacaataaacatgaaaatcaggcattgtaaatttcagggccagtgagggggaggggggaaaaaatgacaatcataaaaatcttgtgtttcagtagtagcatacaacacttagatcatgaaatcaaaacttcataccttaggtgctgatgactgcagcaacattacagataaattgaaaccaacagaggggatcccaaaaaaaaaacaaa

SEQ ID NO: 4296 - DNA, 340 bp, Glycine max
cgtgaacaatgagttgaataggccatccaatttatatggcttactttcttcctcaactcacttccctacactcatgcttctctcctccccacagtacaccactctctgacacccacaacaaacttacataaatcctccatcactttgatttctgccacaaacagcaattcatgacaaacacaacatggtcccccaaactctattttctactcataaaaatctcaacaactcacaaaaacataagaccccccaaatcaattacttgcaaattgcccttgtaaaaaaaataaaaaattgatggggcatgatgaaattgagaaaagtcatgaaatttggtgga

SEQ ID NO: 4297 - DNA, 894 bp, Glycine max
agcctgaaagcaaaagattcagatactttgtttgtcaaggaactcaatgatgagctggttcaccttctctggcatctgttcatgcacaaaatggcttccatctggaatatacacgatttccaagtccggcacaaaatttttcactgccccactacgaatatagtcctccatgcctggaaacttgaacacataatctttctcacccatgatcagaagtgatggaatagtaacttttacatcacttaagccagcatccgcattgatactcctgcatgcatcataaacagtccaaatgcaatgttgaagaaatctgtaccctgaagactatttataacattttattttattatattttaaggtgtctggaaactgccaggtttcacataaataaatctctatccttcaaatttgcctttgacatttgaaaaggcaaatttaatctttgacaactataagttaattcagttcaaagcaactagtacttgatcaaactatcagtctattatcaatcaatttgtttcaaaactttaatgtgtagaagataatttggtacctaacattgtggactaaattgattgatttgataatatgatggaccaaaccaaccgatgatgttaactttaggcattaaattaattgaaatttattaagatcagacactacacttaccattttgtaatattaggatttaggaatcaaactaactgggtggctaaattgatattatagtctagaaataacctaagttgagggaagataaaagcatttggagtagcatttcaatttaaatgggggtaagtgagaatctgttctgtttacctgtaaggaacctgcaatgcatatctgaatccagatttttcatataaagatgcataggttgcaaggtcttcctcg

SEQ ID NO: 4298 - DNA, 323 bp, Glycine max
  misc_feature (8)..(8): n is a, c, g, or t
attttttnaggggtcaattttgcaaagtagtgtgcactaatttgttctagccatgccgagcgcccatgaagtaattgaagtcatgatgttggacccttagttgcttcaaccatgaatctgccacgctcaatagtgagactagtctttcttggtccctaccacaattccctgagacccacacactcccttgcatcttatacgtggccaaaccaaatgctggcagcgaaattccttcaccttcctttctcttctcgtgggctccctcggtatcatcatcaaggtccatatctataaaacacaagtacacacataaggaaaaaaaa

SEQ ID NO: 4299 - DNA, 405 bp, Glycine max
atttttaaaattttctataagataaaatcaaacatgtaagaatatatttaaaatagatccaaaatcaattttttaacatcaaagcaaacagacacttatccaaatacttattactcagattatcaatacaaagttccaattttgatcgaaaaaaaaataccaaaagtacctatgtatgaaacaacttataagttttatttattttcaattagttttataagaaattaattagtgaataaaaatatttattacattaaaaagtaaacaaattactgtatttttagtcgtaaaaaagctcaataaaacttataaaaataatgttgtatcttcctataaatcctcttcttgcttttaaaaaaagtactattaaataaaaaaaaatattaatgtcttgagtatatgaat

SEQ ID NO: 4300 - DNA, 374 bp, Glycine max
gcaaaggtctccagataagattttcatttttttcttcagaagaaataaataaaacacacagatacacaaagctataatatagtcaccccttcactaccagagtttcatcttgcccccaaatattccagtctatgtttttatgacttttttgcatttgcatttgcatttgcatttgctttcacaggatcagtcagcagtcattggttgagtcatgcaacacctgaaccgggccttccgaactgttgtcatgatctcattctctgcattctcaagcattcctacaatttcagcaaatggtggcctaacatcagggttgggatcccagcatcttgtcatgatgtcacggagaacaggtaggcaatcgttgggtatga

SEQ ID NO: 4301 - DNA, 458 bp, Glycine max
aatattaaaaactcaaaacattgtttttgcctcaagaaaataaaacactaattaattggataaattgaacctaggcagagcatacacctcagaatccaagcttggtgcgacgccagtgacggcgcttcgcgttgtacctgaaaggaaaacggaaccgtgagcgagaaaagcaaaacgtaacagaatcgttaaaaatgctcgaggtaggttaggtacctgatggtgttatcggtcctcatgcggatccagtagggaatgggcctgttctgcctcatcttcttcgccaacttcttcttgattctgaatgtcttgtgcgacggctgcgaaaaacacaaatcagtcacaaatcaaatgctgaaaacgtagcagaatcgttatcggtgcaattacaaatcgaaggttagggattgtgattttgatagatgagtaccattttcgattcgtcttctggaggctcg

SEQ ID NO: 4302 - DNA, 363 bp, Glycine max
tatattattagtgataattacaaccaatgtataaaactagatatatttatgaaattaattacccacatgaaacttttggagagcaacgaagaaaaggcatgcatggaagcccaatcctgaactagttaattgcgtccaaggcagcagcagctttaagaagcaagccaaagagaaggaatggggtggagaagaaggggctatggtcgctgtcgagttcatatgaagtggatggtggccacctctttatcatggcttcctgttgctctggcttcaccaccttgtcatgccttgtccttatgtacacgcggcaaaccttctccacttcaccatcaccatcaccatcttctctgaattgagcactaa

SEQ ID NO: 4303 - DNA, 1009 bp, Glycine max
taaataagaaaacgtagattccaactcatactcccttttttcagttaagaaaagtgtaaaaatggtgaggaaatattgatctgaaaataacaccatcctttccctttctccctacgtaaactaagcctcttcattgcaatctgtttagatgataataatgcgatttctatctttcttcagcatccaaaatcatatggaacaagtcctttcagctcgggaccactaaacctgttgtttttaaaactgaaacaagagtaggagaaatatatcgtaaatataacaatagcaaaatgttgaaatctaaattactcctgcttcaaatttaacatgtgaagattttgtgctgtcatatattgattatcaatcaactttcttactggctattctaacaagtaacaagtaagaggcagtttgcaaatatattagtgtattttatttcatacaaatcaattatatctcatgcttgcatgtcaaatgttgtcatctatccagtagaggaataagctagacactacctaattaatgctagttgtttgttaggatgcataattaggtactggttcatgaaagttatacaaatgaagtgcgagaaagaacttgatgttttctggtttttcatgtttgaatctaagtatccaacagaagaatgaccacgactatgagtcttggaattggcatttttacatgtttggtgcaagaaaatgtgttgagttctaaatgactaagccttgcatatttgtcaaaacatgattgaactgttaagccactattagctgtcaagaatttgggataacaataaaaaagagttgatatacctttccattgggaaagattcaaagtttccctcaactggtattgttccacagagatcattattagaaacatcactgcaaaattggggttttaaaattagctaataagccaatcacaaaagtaaataaaaagaacaaaagaacatgagatgaaaagaaaactcacaagatttgagatcagtgagacgagtgagtct

SEQ ID NO: 4304 - DNA, 840 bp, Glycine max
atatataaccctatgtacagagccaatgtctgactgaaatttgatacagaacattatctattttgtatcataataaaatggtaaagatctttatgttacgtgcagcattatgtgaagaagggggaagtgcatccagctggtgctttagtccttcgtcttcccttttacttcatcattggctccttctgcacgttcacatttccttaaactgcttaagcactgctgaccttgttcttacgtccgaaggtccaatggggtttcgctggagtacgccttaatgccttcactccaaaggggttgttcttgctctgccatacacagaaaattcagataagtaaaagagaaagcaatttttacaatcaagagtaaattatacctaacaccccttaaggttttaccaattttctccttgtcatccctccattttcttatccctatattaactctccttgtttgtttgaaatatattatattgacactccttatacattacattgataccttctaatatccaagaatcatattacacagagtgttcttgtacgagagttgtttcaaacattagataatacgttcaataaacctcaagaggtgtgtaaatgcaataagctctataatcatttagaaagaactatgcaaatgaacttatcatccaccaatatctaaaataatagacaatggttagttccctatgaaaattcagtttaaaatgaaagcagctagaaaatattagatggtcttagtcataccctgagacaagttccagcgtaagtgttgcagatgggatagtctgcagggcagcaactgtagtggtcatcacagcaggaagcaccctcaaga

SEQ ID NO: 4305 - DNA, 532 bp, Glycine max
ctcagtgctgagtttggatctctccgcaaggtacgtacatcattcatcaaagatcaacatacatttatacattaaactaatatttgttgccaaatatttattaattttattgataattaatttttttagaaaatttgtttgatcacttttaatggagtctttcatcttaattacattatttatacttagactaatgatttattgattaataataatcttagatacactataaaatgtgtgacggagttatcttaacacttgcatggattctatcttttctgtctttatatatagaaatagagagaaaaaaaaagaaaagattgatgaaaaaagcaaaacaaaaaatagtattattataaaaatattggatgaatttgttgtgactcttgcatgcattgatgtacgatgcagaatgcaatgttcgtgccacactacaacctgaacgcgaacagcataatatacgcattgaatggacgggcattgatacaagtggtgaattgcaacggtgagagagtgtttgatggagagctgc

SEQ ID NO: 4306 - DNA, 931 bp, Glycine max
ggttcttagccagcagtttcttctcctttatagctggatcctcaaacagaagaaccttgtccttgtctctaaccccaaccatatgtagatattcatcatcctctctctctttacccttgaagagaagcctttgctctcggggctcaaaacttgttgccagtgacagaatcattttcaattctcctgcaaataattagttgttcacaacttttgtcttgcatataccccacatgaggtttatctctattaattgaaaaaataaaaaatttgggtgataaataagcattgagcagcttagaaagaaaataaacattttatttttattttatttcaattttcacctaacttaaaccctaaagttaacacttaaggtgagaactaccccagttatatactacttttgtcttaaatataaaaaaaattattttatctttatcttaaatataagaaagttttaattatttttgttttgtttaatgtgattatttttaaaatattcttcattcaatagaaaatttatgcttgatatcaaattccaatgcaaggtagtttagaaaaaaaagatttaattgagattcacacaatttaataaacttaactaatttttctaatgagtgtaaatttttttttcttataaatgatacaggagaacatatcatatttattagtcagatttctaacacacctcatgttgatgaccgaaatttgcaagtgatctaataacactttcgtaaacctaacaataattactaaaatatgttatgatattatgttagaatttaagtttatgtgatcacatacatactattttggcgaaattagagagtgattatgagagaaattaaaggggtgtgatagacttaccaaaagttgatgtggcctcgatagaaatttcatgcgattgtgaaacagttgacactataatgtgatc

SEQ ID NO: 4307 - DNA, 379 bp, Glycine max
ccaagagttcaacataaactatgaaagaaacaaaatttgagaacaaataacaccctaaaaatcttctcaagtagtcttatccgctttagcagcagtggcagcagcttgccccctaagacgaccagtcctcctagcagcaatgagaccaaccttctggccaggaggagcatcacgcctcacggtactcgcatgcccaatatgctgatgattacctcctccgtgaggatgctcaactgggttcatcgccacacctcgcaccttaggccatgaattcctcttcactctgaacttatggtaagcattaccagccttcagaagaggcttctcagtcctccctccacctgcaacctgcccaatcatcgccctgcacccacttggc

SEQ ID NO: 4308 - DNA, 273 bp, Glycine max
gctagctagcaatattctctcaatatgatgcatcgtcagattgagatggagaattctgagctcttccaattcctcacaaacaccaacgatgctttcttcaacactgcatcatatggcctccctgcggcacctgcagcatcaaccatgcagcacagcttctctggctccttttcttattaccctttggaagcatctcatgatcatcatgccccttctcatgaagacaaagcccttgctgctttgaggaaccacaaagaggctgagaagagaaga

SEQ ID NO: 4309 - DNA, 396 bp, Glycine max
ctctaccttttacataattccaacccagaagccacgtctcaaacaaacccattctttcagattccgaaacaacacagtttttcgtgtaaactgtgtttgactcaagaggaagaagacatgatgagtggttctccttctccaaattcaaaacagagaacatgcgactattgtggggacttcacggctcttctgtattgcagtgccgattctgcgaagctatgtttcttctgtgaccgcaaagttcactccccaaaccagcttttctccaagcacacgcgagcgcagctctgtgattcgtgtggagattcccctgcttcggtgctctgttctgcagagaactctgttctttgccataactgtgactgcgaaaagcacaaacatttggcgtctgaagtg

SEQ ID NO: 4310 - DNA, 394 bp, Glycine max
cacttcgaattctcctcccccaactggtcccacaacctcctcctcgaatccgcacgcgccgtcgccgacaacaactccacgcgcctccaccacctcctctggatgctcaacgagctcagctccccctacggcgacaccgaacaaaaacttgctgcgtatttcctccgagccttgttcagccgcgtcaccgaagctggcgaccgaacctaccgaagcttagcttcggcgtctgagaaaacatgctcatttgaatccacaagaaaaacggtcctgaaattccaagaagttagcccttggactaccttcggacacgtggcatccaatggcgccatcttggaagccttggagggaaactccaaattgcatatacttgacatcagcaacacttattgca

SEQ ID NO: 4311 - DNA, 468 bp, Glycine max
ccactgaagaagagcttctggatttctatctcaaaaacatggttgttggcaagaaacttcgttacgatgttattggtttcctcaacatctatcagcatgatccatgggatttgcctggtaatcaatcaatttaattagttaaagcaaatcatgtttttgttttagtctatgatttgtgcatgccacttaattggtatggcatgtaatataatatatatattcatggacattaatttgacaatgttacatatatattttaggtttggcaaaggttggggaaagagagtggtacttcttcgtgccaagggacaaaaaacatggaagcggtggaaggccaaaccgcaccactgaaaaagggttctggaaagccaccggttcagaccggaaaatagttaccttatctgatccaaagcgcataattgggttaaggaagaccctggttttctatcagggaagagctcctagggg

SEQ ID NO: 4312 - DNA, 379 bp, Glycine max
cttctgcttctgcttccgccttttccttcgcgcttcggtgctgcccacctacactcattccgtccaacccctttttgtctgaaaaatcaaaccttaatttctgcgtttttttctattggatccaacttcactcgccggctagagtttcccgaggcactaccctattgggtctaatcattcgagttcttcgattaacgtgaatttgggtcagagacctcatcatcagagctggcaggtggcgggtaaaagaaaatttgcaggttgaccggtagatatagcaaaggagagtagaaaccctagaagaagaagaagaaaaagaagcaatccccatataagaaaaaggatctaaaaccaaaactttctccgtgaggttaaatgc

SEQ ID NO: 4313 - DNA, 901 bp, Glycine max
tcttggtatgcaaaagcacagtgcaaacttcctcctcctaccttggggtgtttagtatccaaagtggtaggtgttcatgtgaatttgccatatgttattaactataactagggtttgtattaaatttggatattcaagtctaatgacatgtttcgcatgtgaacttaattgaatattgtatattattgctaaatagttgcattattgttcctgcaagtttagttacatcctttcctgactatggtgcagctttttgctgcagttttccttatgtatatatatgatagatacctatgcttctaaatctaaatgatttttgagttttttttaatatataactgcattagattttgattcttttcagtacttcatatattaatattcttaaatcccctgatcaaaatcacaactgaactatatgatattttttaataataatatccataatagttgctgcaggtcagcgatctgtctcatgaagtcatgttatctgttcttcatacatccacttccagagggaaacaatatgaattttaaatattaattgaatttattcacctttaaatttgattaaatttcatgaagaaacagcttcatcctatttcctattattcttatttaatgtgtttctatgcagattcttaggatcgagagacaaccagtaaatccaaacaatgaacttaaaatttagcagtttccttgttgatggtaccgtggaacagaattttgacaatcacaaagtggaaggacaaaactcagcacctagcaaccaacaatgagagacataagatcatgattaagagccccaaagaagcagattttccattaaaacaggagggtcattctcaatcaattactgatcctgaaaaggcaaaggcttcagcgagctcagtagcacaat

SEQ ID NO: 4314 - DNA, 379 bp, Glycine max
tcaccctttcgttttccttatcccatacccctcaaaagaaaaagctggcgattctccaattctcctcttgtttcgtgtcctttactactccgaatcctcacaacactctctgtagtacacactactaacccaaaagtcactcacctctagaaaacctcaaatctcaaaacccatcaagattttagcacaaagactcaaacttttcacaaaattaaagagacccagttgatttttttctctttagactgaagtattttgaagcatcgaacatgctacaacggcggcttctggagacggagctgagcatgccaccgtcgtacggcggcagcggcggaaacaacacgcgcgacacgttcatcagcgacgcgaacttcgacac

SEQ ID NO: 4315 - DNA, 379 bp, Glycine max
taacagcccttccgttcgtgcgtggattgacgcgccatcgttcgtcgctgctgccgccgatcatcggcatcatcactatctgtctcccgcggcagcggcagcggcgttggtgtatcagtctgctccttccacggcggcatttacggcggcgcccggtggcttctcgggattccgcgtgccggcacgaattcagggtgaggaggagcacgacggcggcatgtccgataagccgtcctctgcttcctccgattctcgccgttgaaccgtcgagatcgtcagccgatttctgtctccttggaatcaattgggtatgtgtgtgatctgttttttgcagggatggaggagacgaagttggacttggaatggttcggttcggttc

SEQ ID NO: 4316 - DNA, 391 bp, Glycine max
catttatcgttcattccgaatagaatttgaaactccgaagaaaactgcaccgaacactgaatctcagttaccgaggagcttcttctacgaaaccgtgcttaattccacacagaaacaccgagtcaaactggttcgtgctgtgttcgtggttcagattctcaatcgaaatttgaaattcagaagaaaaccgcaccgaacacagaatttcagaatctgaacaagtttcttccgttaacagcacttcaacttcacgtggaacaagaatcaaaccgtttcgtggttcggattctcaattcctcgtccattcgcaatcgattttcaaattccgaagaaaaccgctccgaacactgaatttcagactctgaacagcgaacagtacttcaagttcacg

SEQ ID NO: 4317 - DNA, 615 bp, Glycine max
aactaattaatatacgtatctttccgttgtaaatgtgtctaaatgaaataaatgcatgcttataatacttttaattatatagtagtgtagttatgtatgtaacatgtccgaggttttttcattggtgcgtggcattaagtttcgaatttaatgcttcctaagtttatgtagtactaattttgaatgatatggatgagatgaagtaattaatggggtttcattggattttcaacacttgaacaggaaagacagcttcattactcatagagcattctgcgatgcattggctgaagagagtgctaggctcacatcagttacaacaacaaatctaaatttcaagagtgaagagggtggtaataatgtgatgaactcgcagcagcatggtttgggaggacatggactaattggagcacaaagtcttcaaaatgtttctggcattccacaatttggttcacatggttttcgtttggatttcaatggaatggaacaacaaattaggccaagtttgtcactatggttgaaccaggggaatcaccagatgaatagtaataataataacattaatagcaacaacaatagtgcttccgatgcgggacccaattacatgtcatcatc

SEQ ID NO: 4318 - DNA, 385 bp, Glycine max
caagttcctccaatcacatgagtcacataaattatggggtttctttgcttgatgtgtcatcagaaggattgaggccaatcaaggggattccggtgtatcacaaccgttcattccctttcttgccctcggaacattcaagagacaacaaggatcatcatgccaaaatgtgtttatatcatcacatgccaacatatccctctttgtcctcttcttgttcccctctgtgttcttcttcgtcttcttcttcttctccagctgcaccctacttcgccgctgctgccgcggcgtatagggctgccacggccacaaggtttaatggaatttccggggaggctttcaaatctcatcatccattgcaccaccatcactcatcatcaccacacta

SEQ ID NO: 4319 - DNA, 368 bp, Glycine max
aaacattccaataatggagtctttgtctttttctttgcactcaaacctccattcccttactttgctgcaacattccaatcaaaacaagaagcgccgcaaaatcacacaccaaaactccttagctctcactccctggacttcccatacccaacaccgcctctactcttccaacctcctcctcgcgctccgccgcaacagcaaccctaccgcctccctccaagtccgcgccgccgcagaccgcgtcctcgccgccactgccaaaggccgaactcgctggagccgcgccattctcgcaaatccgttcggccggtggaggaagcagaggcagaggcaccacaagaaggtcaagaactgctccgccaacaaat

SEQ ID NO: 4320 - DNA, 1046 bp, Glycine max
  misc_feature (42)..(45): n is a, c, g, or t
  misc_feature (991)..(997): n is a, c, g, or t
  misc_feature (1040)..(1040): n is a, c, g, or t
  misc_feature (1042)..(1042): n is a, c, g, or t
acaagtttgtagcagaagttgcactaaggtgcttgacatgtnnnngtgttgcttatttagataataaagttagttttatagtcttgtatgaaaaattactgaagtaagccttttgtttcaaaacatgtcaaaaaggttcaaatgcagggggttgcagtgggtcgtgccgtggatttgaccacattggatggatatgatcaacttgtagatgaattggagaagatgtttgacataaagggacaacttcaacttaggaataagtgggaaattgtcttcactgatgatgaaggggatatgatgcttgttggtgatgatccatggctgtgagtatctctttatacacagtaatgtatagtgctgttaagaaaacgagtagtgcagaaagtggaatgaaataagaaaattatattatatataaaaattgcaggtgtagaagttattaagaatcatggacttatactcttcaagctttagaacttaatcggaacataaatacaaacttgttagtaaaatggaagaagaatataagagagaagttttagagattttgttggtttatttggcacgaatgttactattaagaaagaatatgagagaaaaaaggaaagcacgaaagagattgaaaaaaagaatcagagatatgggtgaagcttaatgggaatagtgaagagggaaagtgtaatatgattaggtaacaacatttttaatatttttgttgatcactggatatgttttatttgtttgattgtaatgcatgctaaagttaaattacaataagtctggtaattttgggatgaaaaaatggagaatgcctacttttctttgttaatagaatagataatattgtaaactaaccatcattaaacttccttgtttatatgaaccaattattaacaacttctttctcactattaatataaataccatatatattgattggtattattatgttctttcagtgaattctgtaaaatggtgagaagaatcttcnnnnnnncaagccaggatgtgcacaaatgagctcagggagcaaactcctntntctc

SEQ ID NO: 4321 - DNA, 368 bp, Glycine max
ctgcaacctcctccatcaatttccaaacctaccctcctaatataatctcaagaaccaacaactccactgaggatcttggcctttcccttcactccttccaagaccctggtttgattcatcatggccagtcccaagcaggtgcaaatcaaacaccttccaatgaccaaaccctcttctctggctcaactcaagtggggtttgaggccaattaccccaggattgtgacttggaacagtgatgcaagcacagatatgaacagaaccgggttcatggttaattcaccatcagcacttctaggccaaggtggttctgctgcgtattcccaaagggggacccttcagtccagtttctcaccatcctttcgtctt

SEQ ID NO: 4322 - DNA, 386 bp, Glycine max
ctgatttggagttagaggtgaagatcattggttgggatgcaatggtaagaatccaatgcagcaagaagaaccaccctgcagccaggttgatggcagcattgaaagatcttgacttggaagtgcatcacgccagcgtgtctgtggtgaatgatttgatgatccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctga

SEQ ID NO: 4323 - DNA, 386 bp, Glycine max
tttaggtcgaagatggtgaagcttgtttctaagaaatttcgtgggtctaagaaaaagaataaacacaatgagggtgagtcaggtagtgaaatttcaagtgctgtgggagaagaaaagttaccaattttagaaattgaagaggaagaggaggaagagaatggggataataagtcaagtaacactaaacctgattgcggaatcacttgttcctatgagaagaaagtgaatagagttgagaattcaggttcttccatggttttagttatgattattgcccttgttgggcttcttttgggtcgttttccagcattggtacttttgatgacatggtgttgcttgatgaagatacttgggattctatggagaacacagaaatggagaacaca

SEQ ID NO: 4324 - DNA, 790 bp, Glycine max
caacttaccattaccatgcatgatatttcaacccatcaaccttaaaatttattacatggtcagagaccatcacatgatcccaactaatttacatacgacacctaattgaatgttattaattatttctcaaattaaaaaatttaattatgtatctcatagaaattgatcaaaactatagacacatgatagtttagaattatataataatttctccatctcaattaaatgctattaattctttctcttaaattaaaattttaattaggtgtctacatgaaaattagtcaaaactatatacacatgatagtccagactatataataatttctacatctcagacccactaatgcaaacaattgacataacataaagctttcagctttttgacatagcgtaaattctaacaaacccgtctgaccccatccaggtgcaaagacttctgcagctacgtatagaggctcaaggaaaataccttcaggctgtgttggagaaagctcaagaaacacttggaagacagaatttgggagcagtaggacttgaagctaccaaacttcaactctcagagctagtgtcaaaagtgtcctctcagtgtctgaattcagcattttcagatcggctgaaggagatacaaggatttagcccccaccaacaaacacaaaccaaccagccaaatacaaatgactgttccatggacagttgcctcacatcttgtgagggatcacaaaaggagcaagagatacaaaatggagggatgagcttaagacccttcaatgttcacacattcatggaa

SEQ ID NO: 4325 - DNA, 1065 bp, Glycine max
  misc_feature (1049)..(1051): n is a, c, g, or t
ccagtaatctggtccactgctttctctgtaaactagaggagaacatgaagtaggaactaaacacagacctctgcttcgaaggtctagctttgtgtcctccttatgatcttttctatccaagcttccccatggatccttcaatcccatgaaaaccaatgccaattaattaatagggttaattgattattgctgagagagaaaacttgagagacttttaaaatgaacgaacaactttcttaccttgtgtgaattagctttcaagaaagggttgctcagtagctgcaaagtatgtatgaatgttttttttgtcagaaaatatgcatgaatgcaattgtaaattaagcaaaaaaaaaatattacgttaaaggaattgaacaaaaagaaatttaacccttattgtttaataattagttttatttgtgaaggataaaataataattaattaaatattttgttgtttaaaactgcatcttagctctatgttatatgttggggatagccaatggttaagcatttacgtgatctttaatttatgtttgaagtctcatatatgatgctcatgagatcgagaaaagtgtgcaatcgttcaatgcaacattctttattcattttaataagggattttaatttattcaagaagtctagtttcgttggcattaaaaatgataagaagaagaagaaacttttccataatgatgcccacctggacttgttcttgaagaaactttatgtaccctattgcttcaaacagcacagatgctgtatctgtctgaaattcaacaaaaaaaaattgatcataatgaagtaggtagtgagaaaagtagagcactgttaataacatatatttataaagaagaggaaacgaaaaaagcgagggtgttagtgcaatatgtgtagtaacctttccaaatggagacacaatttgctgaagggctgtgattttgtcccctagcttgactttgggtgcctgcaccttttaaacaatgaatagaagtttcttaagcagtgcacacaaaaggaggttccccactttatgcttttctttacannnaataacttacatgt

SEQ ID NO: 4326 - DNA, 505 bp, Glycine max
gatcttgcggaatttctgttctggattcactggaattggatactcctgattttgatctttctgtaagcataattttactcttgctgactccacttttttattgagttctccaacttactaacatagtctgattttcaatttgcatgcagagtttgtatttttgttctcaagacagtatccttgattggatggacaggttatgaggtgctctatgtatgatgatgccctttttggtaccaaatccagaagttgttccattcaattgccggggtagtgcatcctttttctccctttcatgcttcaattgctgtggtttttcttcttctggatgcagcaaatatagtgcatgaagttttggtcgtcatcatctgatgtttcatgctagtaagcggaaataatactactttctttggttcctcaactcttgcaacttttgtcatattatgaagttaagctcttatctagctagagctggagttttgccttcttcattggaggttatttg

SEQ ID NO: 4327 - DNA, 364 bp, Glycine max
ctcgcggaacgttgaacactcctcccatggttcaccagaatgtacctcctcacatcttcgggcaacctcaacgtgtacctctccacacccttcccttgctcctccacaatgcaatgccccgtcgagttcgacctcgaaaggttcctctcggacacaacaacaaccccatcgccaccattattgttaatagtagtagtagtagaatttgtgtttgggtctaactcaacttcaaaagtcggctcggaagacgagtgttgctgttgctgctcttcacttatatacattattttagccgcatcactggtcggtgtaggatctccaagacaaacttgaccaacgtcattgcttgtactttgctcaattt

SEQ ID NO: 4328 - DNA, 394 bp, Glycine max
gcagaccgtggagtggttattgaaccaagcaaaagtagaaatcaaccgtttagtgaaagagaagaagaagaatgatcatcatcatcaaagttgtagcagtgctagttcggaatgtgaagaaggtgtgtctagtcttgatgaggttgtagtaagtcgagatcaagaacaacaacaacaacaacaacaagagaaggtggaaaaagttgtaaagagaagggtcaaaaactctagaaagatcagtgcatttgaccctcttgcaaaagagtgtagggaaagggcaagggaaagagcaagagagaggacaagagaaaagatgagaagccgtggagttctagctgaagaatcaaagcaatgtggagaggaaacaaatcagtgtggagaggaaacaaatcag

SEQ ID NO: 4329 - DNA, 370 bp, Glycine max
ttttgtgaagagatccaaggagatgaagaaggtggtgatggtgttggagtagatgatgagatgagtaatgtgttcttggagtggcttaagtctaacaaggatagtgtctcagctaatgacttgaggaatgtgaagctcaagaaggcgacactcgaaagcgcggcgaggcggctagggggaggaaaagaagccatgaagcagttgctgaagctgattcttgagtgggttcaaaccagccatcttcagaataagcgccgaaaggagaataatggtagtagtattagcagtgtacttcaggcacagtttcaggatcctagtggccagaacaacaaccagaatacacaaagtggttcatttgcacctgaatcaa

SEQ ID NO: 4330 - DNA, 954 bp, Glycine max
cagtttctcgaagctcttcactgtgagttcatattcataaccataatgctgtttcacttcacaaaatattcattatgtttcattctagattgagtttcatttgtttatgttgattgttttcaacttttggatagaaaaggtgcacaacttaacaaattcgttggtcatcttgctggttcagttctttttagtcctagatatgaagcctctttgcttttgaatgttcgagagaagtatcaaacacgttctgctattgaattactgactttatgtttttgctattcagatttgacagagattggaagaaaattgaagattttgttggttcaaaatcagttattcaggttaggaaaaagctcttcagctatgtgttctaatttctatcttctgttatgccattatgttgtatctctcacagtctcaccatgagttttcttcagattagaagtcatgcccagaagtacttcttgaaagttcaaaagaacgggacagtagcacatgtgcctcctcctcggcctaagcgcaaagcttctcatccttatccacaaaaggcatccaaaaatggtttgattctatttaacacaatgatgttctgttccttaaaatcacagaatgcatattgttgacatgctgttttatggtttggcagttttgttgccaatgccagcttccatggtttatgtttcttccactagtacccttccaccagggtatgtcacatgggatgaaaattccttgctcatgaattctggatccaacaaatcagtgccttgtaaggatgagctcgccaatcttcttggaaatgaaggcacgcacacttcttttagttcttatatttgttggttcaattgcttgtttgatatgaagagtctgtgatggctgtactaaatggaacttttccaccacttaattatgttatatgacgttactgattcagctgatattggatcaaag

SEQ ID NO: 4331 - DNA, 420 bp, Glycine max
tctatcaaatactctgatatgctgctagcactcgttgaaccagttccttcaacagcaaccttgttgttgttgttgttggtggtggtggtggtggtggaagatggaagtggagtagtttgatgtgaaacgttaagaagagaaggggttgagtttgaatcagaggtagtttgtgatgaacgaagcatggcagaagctgcgagtttaacaccagtgagaaggaacctatcgtgcttaagggtgtgttcgttggcagagtgaattgacacgtcacactctttgcagagaatcgctctgtcttgctgacagaacgtgaaggctcttctctccttcaacacaatccatgttcaacaaataaaaacataaaaaagtaaataaatagttgtgactgttttttaggttttgtttttgtttgaagaggaa

SEQ ID NO: 4332 - DNA, 542 bp, Glycine max
actaaagaagaagatgacagactcatatcttatattcgagctcacggagaaggctgctggcgttcactccccaaagccgccggccttctccggtgcggcaagagctgccgtctccggtggatcaactacctccgccccgacctcaaaagaggtaactttaccgaagaagaagatgaactcatcatcaaactccacagtctcctcggtaacaagtaagcatagcaaaactcatttcaccaccacatcaatgaatattaataattcaaaacaaatcttatctgaattaaaataaaaaacaaaaaaaaacaacaacgttgttgttgttgttgttgttgtttcaggtggtctttgatagctggaagattgccggggagaacagacaatgaaataaagaattattggaacacgcacataagaaggaagcttttgaacagaggaatcgaccctgctactcataggccactcaacgaagctgcttctgctgcaactgttacaactgccaccactaatatatcttttgggaaacaacaagaacaagagac

SEQ ID NO: 4333 - DNA, 410 bp, Glycine max
taaccctgtaaataagagctctcaaaatctgaattttcactttccttttggtagtctgcagctacatccacactttccttcatagtctttttccaccttgattttctgagccagtggtcaaccagcatcacactgagaccaatgaagattgtgcccagagagcccccacctactgctagtagcacaacggatagccattgcatctctggactatgtggcaagatcacccatgtgcctgcaacatagccagttgccataaatgccacagccacccacatgaccttgtgagtgattgtcaatagtcttatctgtggctttcttctgaatggaatgatactaacaagcacaatgactatggatagagaggtgaatagtgctatgttgttgcttattgcaaagaccttgaaggc

SEQ ID NO: 4334 - DNA, 411 bp, Glycine max
ttcctgtaggagtgtaggctgtgtcttagttccagtgtggctgatcatcgtcttggtctcttggatcaagattgtcgccttggaaagctattgtctcgccaactagttattgtctcgccaactagttaatcagacgcgaactcctcgggcggattcctccaaactatcattaaagattagtaaaactatattttatttttacagaaatcaaattgatataaatttttttaaagataaaattaatatttttcaaattttatatgtattttaaacatatcttaccttaaaatttttattagggtttcattgttgttcataacttgtattgagattgattgatcagaaatttataataaattatggatgaatgaattagtattttttttaataaatatttgacgggtttggtgg

SEQ ID NO: 4335 - DNA, 354 bp, Glycine max
cggtctccgccgatgacgtggacgaagaggtcaccgacaccgtgtggttctttctgctgtccatgactcagtcttttgctaacggcaccaccctcccgggccaggcttttttcaactcgaccccggtctgggtcgccgggtccgaccggttatctgaattggcctgcgaacgggcccggcaggggcggatgtatgggcttcggactctggtttgcataccttccgcaaacggcgtcgttgaactcgcttccaccgaggtgattttccagaaccctgatctcatgaacaaagtgctcgatttgttcaacttcaacgcagtggacggccatcccactctaccaccacgacaacggt

SEQ ID NO: 4336 - DNA, 389 bp, Glycine max
tagtataattctttctctcgatctttccgttcgatgagagaaaaatgtaatttgaaatttaattgatggagatcaagctagggttcttcctttccttaatttttaatttcagcttattctagcgttgcaaagtaaggatgattaaagtgcatgattaggttaacatgtactacgattgtacattaattgcgaattaatgatcggtgattagtttgtctgtaaagagatcgagaccgaataaaggcaaggtaacgaagttaagtaaatgatagtctttttgcattgtataatcatatgtgataatgtgatggatgcttaagattagcacataagagattaagccatttttaggtttgataagttaaattattcaacgtgtaagacatgca

SEQ ID NO: 4337 - DNA, 293 bp, Glycine max
caaataaagagcaacattgttaaccttaaccccctccaatattgcaatggacacaatcacagatatccccaaatactaaacgaagagaaggatagaaaactcttttaaatcaaaacaaaattaatttcgagttcaatggatcagctgaaagtaacttcttggattgtgcgtaatagttgattcactgcagccgcaatttcatccaccgtgttcagcagacacccgtcctctacctgctccaatccatccatacaaaaaaaaaataaaaaaatctcttcaattaaaaaaaaaaa

SEQ ID NO: 4338 - DNA, 388 bp, Glycine max
tctcggtgaggggcattggcatcttgacgtcgtcgttgtggtagtcggggtcgtggtcatgggcatggtcatggtcatggtcagcgtcgtccacggcgtcggccttggcgaggaagtcctcgagagtcatcatctcgttgtcgtcgtcgtcgtcgtcgtcgagggcctcctccttgcactcgcggcggtcgccggtcacgatctcctgccacacgtcatcgacggttttaggggctgcggcggcggggatggggatgaagttggtggtggtgaattgcggggcgggagaaggggaagtttctgattttcgtgaattggaagacgccatcatcttccctagggttttgggatttggaagactttagactttagagagtggaagctgcag

(The sequence listing continues in the following parts.)

What is claimed is:

1. A method of genotyping a soybean plant to select a parent plant, a progeny plant or a tester plant with increased yield for breeding, said method comprising the steps of:
   a. obtaining a DNA or RNA sample from a tissue of at least one soybean plant;
   b. determining the allelic state of the soybean genomic DNA polymorphism of SEQ ID NO: 3122 associated with increased yield, for said sample from step (a); and
   c. using said determination of the allelic state of the soybean genomic DNA polymorphism of SEQ ID NO: 3122 of step (b) to select a parent plant, a progeny plant or a tester plant with increased yield for breeding.

2. The method according to claim 1, wherein the soybean genomic DNA polymorphism of SEQ ID NO: 3122 is a first polymorphism used to identify plants for breeding with increased yield and wherein the allelic state of one or more additional soybean genomic polymorphisms selected from the group consisting of SEQ ID NO: 2914, 3984, 3608, 1448, 69, 1261, 3436, 1142, 80, 88, 980, 538, 1925, 3669, 2270, 1397, 3747, 888, 365, 2132, 1972, 459, 762, and SEQ ID NO: 1094, associated with increased yield, is also determined to select a parent plant, a progeny plant, or a tester plant with increased yield for breeding.

3. The method according to claim 2, wherein the allelic state of at least seven or more soybean genomic polymorphisms selected from the group consisting of SEQ ID NO: 2914, 3984, 3608, 1448, 69, 1261, 3436, 1142, 80, 88, 980, 538, 1925, 3669, 2270, 1397, 3747, 888, 365, 2132, 1972, 459, 762, and SEQ ID NO: 1094, associated with increased yield, is also determined to select a parent plant, a progeny plant, or a tester plant with increased yield for breeding.

4. A method of genotyping a soybean plant to select a parent plant, a progeny plant or a tester plant with increased yield for breeding, said method comprising the steps of:
   a. obtaining a DNA or RNA sample from a tissue of at least one soybean plant;
   b. determining the allelic state of a set of soybean genomic DNA polymorphisms comprising the soybean genomic DNA polymorphism of SEQ ID NO: 3122 associated with increased yield, and one or more additional polymorphisms selected from the group consisting of SEQ ID NO: 2914, 3984, 3608, 1448, 69, 1261, 3436, 1142, 80, 88, 980, 538, 1925, 3669, 2270, 1397, 3747, 888, 365, 2132, 1972, 459, 762, and 1094, associated with increased yield, for said sample from step (a), wherein said allelic state is determined with a set of nucleic acid molecules that provide for typing of said soybean genomic DNA polymorphisms; and
   c. using said determination of the allelic state of the set of soybean genomic DNA polymorphisms comprising the soybean genomic DNA polymorphism of SEQ ID NO: 3122 associated with increased yield, and one or more additional polymorphisms selected from the group consisting of SEQ ID NO: 2914, 3984, 3608, 1448, 69, 1261, 3436, 1142, 80, 88, 980, 538, 1925, 3669, 2270, 1397, 3747, 888, 365, 2132, 1972, 459, 762, and 1094, associated with increased yield, to select a parent plant, a progeny plant or a tester plant with increased yield for breeding.

5. The method of genotyping a soybean plant of claim 4, wherein said set of soybean genomic DNA polymorphisms comprises the soybean genomic DNA polymorphism of SEQ ID NO: 3122 associated with increased yield, and at least four or more additional polymorphisms selected from the group consisting of SEQ ID NO: 2914, 3984, 3608, 1448, 69, 1261, 3436, 1142, 80, 88, 980, 538, 1925, 3669, 2270, 1397, 3747, 888, 365, 2132, 1972, 459, 762, and 1094, associated with increased yield.

6. The method of genotyping a soybean plant of claim 4, wherein said set of soybean genomic DNA polymorphisms comprises the soybean genomic DNA polymorphism of SEQ ID NO: 3122 associated with increased yield, and at least one or more additional polymorphisms selected from the group consisting of SEQ ID NO: 2914, 3984, 3608, 1448, 69, 1261, 3436, 1142, and 80, associated with increased yield.

* * * * *